United States Patent 7,892,730 (COMPOSITIONS AND METHODS FOR CANCER) - sequence listing, part 3

SEQ ID NO: 223 - DNA, 254087 bp, Mus musculus
  misc_feature (1)...(254087): n = A,T,C or G
atcgatgtttcactctaatgtgtcttgcttatctgtttcattttaagctgggtttatgccgtatgtcatttctagttcagtaaagcaagccttggtgtctcttaatttggctttggttgtgtgtgactcttgtccctttgacagcaggaacttctttggataagaagacgcctctgttttggtgttttgtagacagcagagagaactcagctctcaccgtctttgttgttggatttttcaaaaattgttatttgttattgtttccgaatttgctaacttgaacttcatagcacttggctgagttagaaaacacagggtagctagggtggagggagaggtgcctctgaccttcagtgccaaaatggtgtcttttatctcagagaaactaatctgtttcagagcaacttccgggagcgagatagatctgtgtgtctattagagtttttgaaggataaaattaaataattgttcctttcacacagcagagagacgtgcaagccacagggtcttgatgccctccattcactgtgttgccttgttgctgttagcatattgttctctgtggtcacctgagcggttagggactacagacaaggaggcacacacatgaagtgtgtcgttgaacctgccactcagtggatgttgtaaacctggccgtgtgtacattaaattatgtgaaaaatggaaatgggggaaatacccttctctgaactggtggtggcttcttctactgggcctttcctgagagagctgagctattttcaagtcctaatgattaaagttcactggcaggctctgttagtgctcaaacttcaaacctatattcttgggtggaaatgtgttttaactgtgctctcctgagcgagcacctgcccccttcatgcctgaccttcagcagcttccttgaggcaaagcaaacagcctaccctgcgttggcaaagctccccttctcagttaatgacgtgagcaagggcggatcaatgtgccagggagtgggcccattctctccacttatttctagtgttttgttccaactggggcctttcttgccaacattctgcttaccatggctgtgataataatatcttactcacttcctgcccactagcagacaagagggcagatcaactggagtccagcatctctgactctaagctagaagtaggcacttttcagttttcagaggcctatgttgggggtgggctggtgatggggggttgttgcctgaactcactggtggcttaccaagaatacattgtcctgaaagcttgagtatggtggctctcacctgcactgctgaaatcctttctccttagacatgtgaagtctcctgttttcacacggaaagcctgctggagaagagaaaccttggcttttgttaggacgttattttattgtcaatctattctgccaacttgattttacgtcatgggttacagaggaagttaaacatcctgttctctaccattccagtctatctgaattgtctttatgcgtagtaaatgctcacagccatgggatagactcaaccccccttccccagctgatcatcttgactttccagtgaatgagacggtcctaactgactatttggggtgtggtgacaaatgcctctcattccagcatttgtgagaataggcaggaaaatggtgaattcaaggctcgctggactgcttaataagaccttgactcaggaatctaaaagttgaggatatgtattaaagacaatactttttagcttgtaccaagccatatatttgattcctagtcacaactaaaaaaggaagggaagaaaataagacagtgacttaatgataaactgattttttaatagccagttaccccttctgaagagttacaaaaaatatggcattttaaaaagtaggtgtgtatagttggtggctagagttgatgtcacttctatcagatcaagaagttagacttgggttttacctatatattacatataatgtagaaattatctatcaaatttctattatgtcaaagaagtacttgagaacaaagaagttgataaaaagttgtggttttttttttttaaataaatggaggagggaaggggaaaggggatgtgtgtgtttgtatgtgtgtatctgtgtgtgtgtgtttgtgcgtgcgcgtctgtgcataccagttcaagaggccagaagacaacttagatggacaacattgtccatctaattttaagacagaggctccttgggtcctaatgaaggagctagagaaagtaaccaaggagctaaaggggtctgcaaccctataggaggaacaacaatatgaactaaccactaacccccagagctgtgtctctagttgcatatctagtagaagatggcctagtcagccatcaatgggaggagaggcccttggtcttgtgaagattatatgccccagtacaggggaatgccagggccaggatttgggagtgggtgggttggggagcagagcatgtggagagtatagggggctttggggatagcatttgaaatgtaaatgaagaaaatatcttaaaaaaaaaaaagacagaggctcccagttcctagaggtctcactcaattggctggccaagccccagggatctgtctgcctccatctccctgcctgcctccatctccccactgcctccatctccccagcactggaattacaagtatgtgcttcattgtggattctggagactgaagtcagatcctgcttacaaggcagtcagtttattacctgagccatctttctactcccaaatagaaacatcttagttagagccatctctccctccacttaattaataaatatacattaattcagctgataaccacaagctagtttctgtgaaaccataggaaggtagggcaatcaccaaatcatacagaccagtctgagaaccacagctcggattcttagtctcaagatcttgagtgtcccacatttggccccggagactcatccactgtgtgcctatacctgcttccatcgtggacccaactctccttgcccttggagagctggtgcctcacttgtacaatacccacgtctgttcaggggcacatatgaagatcccaggtttgcctgttccaccctcaacaagaggtcacgttttgtttttgttttgggcatgcatttgacagttgcattccacctgagcttttaccaaaatcccaagattatcacaagatagatggagacctctacaatgcatgataaagttgataatacataaatcatttttaacaacaggtaatatgcataatttacggtgttaccgtgctatcttttgatatttatgatggataatgctcagtttttgccctcatattactgctttaaattataccacaagaaaattaatgagaaagtagatttatgggtttcatttgtttgtcaattcggaaattaattgggtgttaattttagccgtccctcatcagacccggagtttagtacgtgtgcattactttgcattcattgtagcctacctcccatttactgtgggtcactagctttgcatacattaaaatagccctgcggctcattcccttgattactttttgaactgccatgcattagaaaatgtacgcctttctgttagaattatgaaaatttggtattggaagggagtatcttcagcacgtcgacttcacttcctggacgcgtgcttgggtggtctgtctcgccatgatgtcggaccagtgggggctgtggacaaagatttgttatctgaaggatttatccatggcttgtcagagttacctcagaagagcagtgatcagctgctgtcattcactcttgtgttttgcttgttcacctcaagcacttcttactgtagtttactttttctgcttctagagagggacttcgtattgtgtgagtggttgctgctgtgcctctcctgtcatgtttcctagccccctactgctgcccacttcctgtcctcactgctgccttgctccagtctcaccaagtccagtgccatgtctcatgtggcatccctgtcccacaaggccttcactaaggggccctgactttcatctgggctgttctattgcctctcttttgcaagggagcaactcacgagtggttacagggtggggcttatttgatgtcctaagccaccccaccatgtaactgcaccttgctccttgaaactcctttgtttgtcttctgttaccatgtaaactttgtgcgcattgtacaggaaccagttcatttgctcagtgagaccctgaaaaagcacacactttaaaaaaaaaaatcttactttagatagtgtgttgatttttttttttccctctgaacgatagattcaagattaggacgaattttgtaatttaaaagttcagaaccaaagctaatgcatcatcctcttgctttgctaatgtctaaaatgtcaggttaagagatgggaaagcagccgggcgtggtggcacacgcctttaatcccagcacttgggaggcagaggcaggtggatttctgagttcgaggacagcctggtctacaaagtgagttccaggacagccagtgctatagagaaaccctgtctcgaaaaaccaaaaaaaaaaaaaaaagagagagatgggaaagcagctgtgcgtggtggcgcacacctttattctcagcacttgggaggcagaggcaggcggatttctgagttcaaggccagcctggtctacagagtgagttccaggacagccagggctacacagagaaaccctgtctcgaaaaagagagagagagagagagagagagagagagagggagagcaagagacacatgtttactgcttctggaatcctaacactcttggtccgtccgtccgtcagtccctccgtccctccccacctccctcctcctaccctgctggcttttgttttctcttcaacattgtagtctacatcccttcattctctacataggatgtgagtgaggaaggggtggtccttgcacagggctagggatggcaatgcgtagtttgtctgctcactgtcctggaagttgcattgcccttaacctcacttctcccacagcagtagagacatagtctacaaaactctgtttggtttaatttacacatccctttgtgaacggaccaagttctttaagggcatttattctgcttcatataaataattgatcagccaagttaatttacttctgcctgacttggtcaaccttaattaactgccctggaatcaagaccgaactttttgttagcttaaaatcttttacaagcatgataacaagggcttttttttttttttctaaattttcagcaacaacactgtaaccaaggaaataatcataataataaagctgtgttttaatttactataaatacataggcctggacattatgaattttccagaaggtttccacagaggagtgctgttggcagcaacaattaataagcatgtgagacccagctctccttatttttcaaagtctcctaaaaactaacaaacaaacaaacagacaaacaaacagaacaaagtgagcccttaaattagtatctctgtcatatttccaagcaaggtgggcagagtatggtctgggcttccttctgtctctgacagccatggcccagagtgtcaggcctggaggattgcagtgtatgagttgtcaggtgcctgagcacgtcatggtcctgtgcggaaggcatgaggggaaactgaggaaaggcttgggtaagaggtggctgaagcctccagagacaagctcctcaaatccaagtaccacagactcctcaacagaacatgttgtgctttcggttcatagtggtggaaggtgattctttcggtgcagccccagagaggaggagcagaggttgaacaaacaaaggccttgggacaaaccccctctaagaaaagggaaggcgttgctccatcccagccccgtgcttgcttcccactgccacggcgggaagtcaataggaaaagacaggcttgcttcctgaaacattgagggcctttgcctctgtgtattttaggaccttctcttttcccacctgcccccttcttgcctttgctgaaattcagtttctcctggtcagtgtactcattcgtcacttagccagagcctctctgaagaaggaagtctcggtcaggtcttggtcaggtccaaaatggagagaatctatggctttgtctgtctcctaatctgagcagtagttttcttgtctttcaaaagggaataacatttatctcccttctggacacttgggagtttgagatttaaatgtatcaaagggttttatatggagatataaacgcttgttaaatggcctgggatgtttgatagaagcactcatggtccagacagtgtcagagatacttagacacctaatctttcattttctacatggacgtttcacaaagcctccaattgatgttgtaccttttagaaaattaaaagtcctccagcccatgtactctagttagcacttggctgaggacatccttagaccaaaataattctgtatacagttttagtcccataccctgtactctcacaaacctaattcatgagccaagttccttggctgcaggcctgcctaacttgtcctggagaacttagcagcctgttttggagctgcacagagcaaaggagttgcttctcttccaactgcatcagaggtggttcttactccgcctaccatgatggtgtcaaccgaggaaactaaaacagaggcaggcttttagacacctgttctctggtcccagatctctgagagcacgtggtttgaaggcagcacatgcacaaccatgttccccagagacagaatatatgactgtgtgctcctgtctgagggcaggtgaggcatgctcagaaaggccgtttgcagagagatggctcagcagttaggggcactggctactcttccagaggcccaggattcaattcccagtatgcatagtgaccaatcatccaaccttcagttctagcaggctctacagccctcttctgacatccttgggcaccaggcacatacatggcacacacacaaatgtaagcaaaacattctttaaatctttaaaacatgaaaatatttaaaaaaaaaatcttaaagaaaaagaaggaatttttctgtcctgtgagttgaccctttgttatgggcagacttgccagaaggtgggaaacacctgttttatttagatatatttcttttgtaactaataataaaatggatttcattgccaactaccttgagctatctgtctattcccttgtcactgtgcggtattggggatggcttaggacttactgcctacaaggcgcctgctgtaccactgtgctccatccagccagaaacctatctcttatgcacccaaatatacaaatgtgcagtgtgtggtatagaatgtaaagcaataagagagactcctgggcttgaacacatttgagatagagtaatagtttcatgttcctggcctcttgttgcacattttgtatcttttggggctgttggtttgttttcttggggtttgttttgttttgttttgttctgttttgatagattctttccatggtggggcgtgagcagctgcaggcctttctaaacgacagtaattactagaagatccggttcaaagacacaaggagaccctctgttgcttctcatattgtctcatacctgttaacaccaaaggctattcttgataaactccagaatccaattgactaggaaatctgtccttggtttcttatagtccaccatgtagctgcacttaactatggactggaggcggatgaaatgggagtctttaaatggacattcttctctttggttttcgggcaagttgcagagaacggacttctgttagcctttaacagaagcaccgcctcctcctagggtgtcccgagtgcttcagtttccatgtggtagtgtatctagtgcagtgggaaagaaataggtggtcctccgtaagggtgatttgaatgaaatggtttttgttttgtctggcatcaggaactcacattgaagtcttcattatttaagcatttctcagctttgatgtttgagctgactgcttcctttggtgactagtagtttccctttccacatcctagtctgtgaacttggcttgtcaccctgtacctcagccttcagaaaacacgcagtgggtgagggatatggaagcagaacacctcccgtcctgtgctggccgtagctagccatggcacagtggctatgctatcctcaccccacccccttctctttaaagtttacctgcgttggaggctgggcatgcgtggaggaacatgcatatcactgtaactctttggaaatcagaagacaaccttcagatgccatccctagcctttttgccttgtctagggcagggtttctatgctgctgcagaagccagactacctggcacatacgcccctgagtatttcctaacctccaaatcccatttactgacagatggatgcttatatttctgaatccagctcttctttggctcccaggacctgaactcaggaaccaggtttatgtagccagtgcttttacccattgagccttctccccatcccaagcttcagttttcctgtctatgaagtagaactgatgattactgttggcagccacggaacgtgtaggaatcacctacgtgatggagaatccagctcagggctgctgatcagtcgatgtgttttatcctggatgggaacctaaactgcctccccaagctaatgatttttgtgctcaagagaataacaagaattaagtagtatagttagtgttaggtattggtttttgcctataagaccagcacttgggaggctgaggcagaaggatttcaagttcaaggctaacctgggctttaccatagagccctatctccaaaaggctgaaatgagacaccacaaaacaaaacaaaactctgaaacataaaaggagataacagacttttctctattttccaatacacacacacacacacacacacacacacacacatatatatgtatatatattttttcctaatagacattttagtactttcatttttcttttaattaatttactttctggcaatactaaggagtgaacccaatatcccatattcgttaggcaaacgttctatcactgagctgtagcccaagcctcacatttagcgcttggaaatcctgactttttctgtggtctgccagccagcacttctctccaaaattaagagtctgaaggatcgccctgaaacatcagcccttactcctaccctggggaccgtcatctaccagaccagggggaaaattagcgcagaatgtgctttctcaccaacagtagttatagactgaattcattcagtgtctgcaaaatgggacggtctttttgcccctgtctttttagcagtggcctgtcttataggaatgaccgatttctaattgtccagatggtatcaggggtttaaaatccttaaaatgtgtttggtgtttggctgtagcatttcagcaccaattcccttactgggtcttgtagtgatgggtcatgtcacttgagagactgaggttggagaatattctcagaggatgttgtttgccgcagagcttctggacctgataatattaaatttatacttgtatgatgacctcaagtgttttctttttagcaaaatatctgaatcccaccagaaattggctcctaacttcttggatcacctgaacctttctatttttcctaagagggaagaaattatatatttgaaatcatacttgaattgaatgacagccccctagtcctaaagtaagggaccagtctactcatgtgggaaaagggtaaaggaaaataagaactgcttacacgtttggcaacttctttcattctgaacagcaagtgttttaacagctgtctctctctctctctcccccctcccctcctctctctctctctctctctctcttttggctctctctctctctctctctctctctctctctctctctctctnnnnnnnnnnnnnnnnnnnncaggtttttgagtcatgatgcaagaatctgggtctgagacaaaaagtaacggatcagccatccagaacgggtccagcggtggcaaccacttactagagtgcggggcacttcgtgacactcggtccaacggagaggcaccagcggtggacctgggggcagccgaccttgcccacgtccagcagcagcaacagcaggtacttgcctgggagctggggtgctgagtggtaactgagccactgtctgtgctgcaggctcagccatatgcctggaagcagcgtattcttaggcgtctagccttcctcctggacgagacgaattttgaaaccctcaggaggtgatgtgtccttccgaagagagtgactgttagacttggagttgaatgaaccttgagccactctcttccagaccccagagtgtcacctaaatttttattcttcaattaaaatgactctctggggagggatgaaaaggttgatgctttagttaagaagtaaagcagtaattaaacagaagcttaagccttatgaagaaagaaaatcagggctaagggatgaaggaaatgggggccacaatgggtggggcagagggagtagtcaaatagagacacatagaaacataaatggttaaatagcaggaccatgtctacaaaacagacctcaatttgggacatgacttcctcttacttctagaaactaaggtgtatgcatttgcatatatttgctggagtctgacatcaagtgttgttggctaaaatcacagtgttgcttttaactgatctcctatctgaacctcttccacccgtccttgccctgggacattctctttccctctttgccctccccgggtggaagccagtccttgggagtgactgttgaaacatttcccagtggtacaggtgacctaagacagggcattgtgttggtaaaaattcaaatgtaaatagcatttccttgaacactggatttgctttcccaccctgtgggatcaggaaatattttgagtttttgctcctgataacaaggcaggtttgcccttgattcatttatcttatgtgtagttgtggtaccatttattatcaggtatttgagaggggaaaaaaaaaaaggaatgaaatatcttgaggaaatttggtaacttttccatagagaaattgttgggaaatgccatacaagaaacggacaaaccttcaaactactttcttaaaatttgaatcaaattcttaggagtgaggcttttggtaagggctgtctgatgttctctctgagacagcttctcatgtagctaggctgctggcatggaaattactatgtacccaaagccagccaagaattctggatcctcttgtctccacctcccaaatagttgaattccagacaatcattaaaatgcatcagtatctcaaatgcagtattaaaatatcaccatagactgtgaacccattagttatcagttggtgccgcattggaccatagacccagttggggaaaagatctgggaaaggaaaagaaagggaggttggcagacaaaccaagtcggttcacaggggttttgcggcatgacttgatctcttttcttgtcaccccagccatttctgcctccacccagtcagcctgaatttatgtcactttgtgctgtattaatttagtgtattaatttagtgctcgatggctgagttctaaaccattcatgctagcaaacctagcactaaatggcaggagtgtatttgtactaatgttcatcagtgtgatagccttgcatatttatgggtaaacgagtagttttagaatatcgtctgctctgcccttagaagatggaggtcaagatcagccatttccttatgacgtagttgaggtgaggcccgtgcagtgtgcaccccaaatcatttgcatctagagaacatcagttaaataagtgggagattaaccttttttttaattttacctggtagatggacaattaattattcagaatattgagatatttaaccgaggagccagcaggtaaactcactggccaccatgcctgaggactcaggtttgattccctgccatcctcctccctcttatacccaaatgtaaaggtaaaaaagtttaaacaaataacaagaaagcatttaaccaaccacaaaagtttacatattcagtactcctactgctcacacaaaatcccacccaaaacaatagcatcagtaacacgtgagtgaaacaggagaacgctctggaagcacatttcagtgcatctttccccccagataaggagtcaccatgaagttacctgggcctgagacctagagaacatgtcgttaaataaatggtcttccatgcatgttcaagtacttgatttttgattccactttgaagcttgaaaataaatatttcacggcaattttctgtctatttgtcactgatacgtttgagggagaaaggcttccgtcgggtctaggattgtgactaaagccccacttattatggttggcgagccctcttaggccttataaaacgtcaccagctgctttgactccctgcataagagaagcctcagcacaggttggttggggaaaatgggattgtgtgggaaggtgacagaagaaaaagtacaggctccctaatattccaggggccccaagctccccagcttttctgaggcccggaaaacagcagcaattaaacacgtggagaaactgcgagtttcgctcgctcgtagacctgcgtggtttccgtcattttcctcccgcagccagagagtgctgagcaagtcgcagccatgctgaattcattactgtggtagtcacacaaaaccacggataaaatttcaatatctgcaggccacagttgagtaaacagttgcactgaaatttaattcctgttgacttttcccccattcctcgccaggggcacattctgattccgtagtacaaagacaacaggggttacagctttgattaatgtaggacagtggaagagagaactgtaaaatatgtcagaagtccatggaacacaaagatctggcttcaagctgcctggtgtaaaatcgagttaattacgccgtgagttacaaggaatggttctcaatatccttcttgcacggaagccttttggtgttaggtgatggtgggggcgggtgccctgccgagtgagctctgtgttgggctccttcttgccaactatgactacaaattatagcaagtgccctttttggaaactgtagcactcacaaagagccactaccatagtgatcccgttggttgcccaagttgcagtcccacacagaatttgttttaaagaattatctagttaacagcctggagaaatgggaggccgttgcttttccttccactcccaagaaaaagcagagagcagcgtctggcagccttgggtgacgatctcacaagggcagcaactgttgggagatgaatcgcctctgaagacaggagccctgcagccttgctgttcactgtggctccaccgggcagaattctacccctgccctctaggcaaatcagctagtcaggcggggctagaagatacatcatcatccagaaagctaccagccaaagagaaatgtggccattagctggagaagcccgccccatacaagtgccctgtcttccctcctcaaaacaaagcatcttctctcagtgtttcaactctatttatatccaggccctggaactattacaatggttttttaataatgtaattcgatagcatttctgaacattctcttggagccctttagtcgtccttttaccctataccataactgcttttcacttcctattatgcctgcccccatttctgtctctgagctctgtgttggggaatgcctactccattatggaacttagcaacagatactattattgattgttaaggttttgttccctccctccttaagggaaggattttaaaatgtccagagcaatttcataaactctgtggattaatgcatttgaaaagtcttgaattcttgaaagcacgattttatttccatattgctgcaaatgagagctttttcagataagcatattacatagaacataatgtttagaagtttctccatatacagcatatgctggcaggtcaattaacagaatgcataccagaaaatgtttattcaataaaaatgaatagctgttaaataaaccagctatttcttaacaacatcccccttttaaatgatgggtgctttctttgggggggggagtaaattttttggtaccacttgcctttttattatgtgcaaatcagcagaaggagagttttggtgactgagattttggggtggctgtggtcttgggtgtggttatcattttatatgagaagaacaggtgagaaagtcattttaaaaaagatattccacgcttgcaacttaagagcttgttacttaacatggaataagtaagcgaagaccttcttttttgtagcttatctgacatttggtttaaaatgttggagtttttggtcaaagaaagactatgattccagtcaacagtgtaaacaaggagaaagaatgttcagtgactggcaaggaggtaagacggggagaaagcgtagggaaggcttgcggaagtctcatgtgagggaggggatataagagtcccactgtgatcgtgggaagaaaagggtggtaaaggacaaatagatacacaggggcctgagctctcaaagcaaatggatcaacgtacattcaacaggggtttagaaaatggataatcagaggaacctggcagaatcatagatacttacatagtggcattgacagtcagcttcttgtaggcacggttctgttaacagattcaactgtctagctaagggttgggaggaaaactacattttgagctgaacacatctgtatttgcaactacttctatgctgttggccttgtgttgggctaccatgagtaatgtagggataactttaaagtccatgagaagagggtgggatttgctccatgcaaatccatcactgtgtcatacgggaggcttgggcatcatggacctgggtaaccgtagtcattacttttctcactgccacagcagaacacctagaacagctgtctaaagagggaaggatttattctggctcacagtagtccatcatggtgggaaagttactgtgaaggtgtgaagacacaggtggtcacatggcacctgcagtcaggaagcagagagacatgaatgctggtgttcagcctctttttcctgtccagaattgtagcccatgtgggggtgtctcccacattctagttgattatatattttatcaagttaacaattaatataaactgtaacggtgtccatatgggctccaagagtctcacataaacgccagaggctggctagaaaaggacaaatgtgtccgtgccataaggtaatgtaaagttagcggatcttggtttgcagcataagaacaagtacttgaaaggttacctcttcactttcaaaatggtggcatgtagctcttcagtggtctttgttactcaatttactggagaacactgagtgggagagaggttgacacaaagcacatgccttggtttctcattcataccacctttgtattagtcagggttctctagaatcacaaaacttatggatagtctctagatagtaaaggaatttattgatgacttacagtctgcagcccaattcccaacaatggttcagtagcagctgtgaatggaagtccaaggatctagcagttaactcagtctcacacagcaagcaggtgaaggagcaagagccagactcccttcttccaatgtccttatattgtctccagcagaaggtgtagcccagattaaaggtgtgttccaccacaccttaaatcctggatgaccttgaactcagagatctccctgtcttaatcttctggaatccatagccactatgcctcaagatctccataccaagatccagatcagaaacttctatctccaagtctccagataagggtcactggtacgccttccaattctggattgtggttcattccaaatatagtcaagttgacaaccaggaacagctactacaaccttctgtaagggaactgtgtggaaattacgcgacttgtcattagttcttgctttgcacagagtgacctagcacagtgaacccaggagtctgggcatgagactgaggtaccagtctaggttagcgctggcattctgctacttttccactgaagtagcctgtacctttgctgctgcctgagatggctcttttgatgctgttgagaggaaagaaatgatgaagtctcagcattctagaagggaactttctagaaaggtggtgtagagaaaagtgttactaatatagagtgccctactgggacccagtacaagttggaagctaacatgttctttagcagctaggtaaaaaattaaattctaattttgaaggaattgctctgttgaaatatactgtaatcagagacattgcccaagtcaaattaaaaaaaaaaatgttgctgcaggaaaatgtatggtaggaatcagcgatgcccatgttagtgaaaccatgcaaacaaattgaaagacagcagaaatgggagtttagataattctggtaagtaaagagaagccagccacaacaaaaacagcccccaccccctttttcttaattcctctggtgtctatttctggaaaaaaaagcatattttaccctgaatactaaatttagctctctagtctctgttggtttagccctgcctccatcaaaatattgttttcaaagatttatgtaacttgcaggcctcatatgaaattctttcaagttgtgattgctgaacagttgtgtgtcattaatctctccattggaaattaaaatgccgtgggagaccaagaggggagaggggcctcctatatgttaagagatcatgggaacagagcttcagatgacatcatcttatcgggagtgacgtgtctgctctcagtgtcaagagaaggctttgctgctctgagacggtcactttaagccctattatgttaactaataaaaaataaaataacctcattctagcttgtctaatcagaagaatctctttgtgaacgccgaggagataggatttcagtgataacctgttgacagtctatcttcaggggtcgctaagtgtttgctctgcagcgctatggggcctctgcctgtcctctggggcctgcagacctactccactgtgttgtccctgcctgcttctggatagcagagccaaggaggctgaattggaaagtttggatgtgtacttttaggtggtgcatagattactgataaaaagggtctccaggcgattggctgcttttatgacaagaaagaatggctgaataaatgggagtggtcctcagagtcaggaggagaaagttgatggagagatctgaactccctgttccaaagtttctttcatcacagtaactttgatctctaatcttttgtaattttgaagtgtcacaacattccagagacccttgttaaactctgtgttttattcacttcacagaaggagaccctgtgttgttgtttttcaccccctgtgagtgtgctgtcctgtgttatgagaacacgtgtcactgtgatcagacacctgagagaaaccatagtgagatgagatggatgaaaagtttattttatctcacagtttcaaagatttccatccagaatcattggctccattgtgtctgtgacatggtgggacagatgtcatggtgatgggtccatctggcagagccactcacctcatgctggtcaggaaatagaggtgcttaaaacaagactcagtgtgaagacgtggccccagagacctacatcagctacctaagccctattcttaaagtttccaggattttccataatagtgtcactaaataaggaccatactttcagtacaggatcctttgtgggggagggaacacttctttctaaaccttaataaggtggggcatcaggaaagtacaaaatccccatatttctgaaatccaaaactaaggcctgattcgattctaaagaaaagtttcagtttggggaccatttgggcttgttgttgttgttgtttgtgtgtgtttgttttaattaaataggaatgtttaaccaataaatctagatggatatttcaaagtaaaaccttccaaaaatctggaccattttctgagctcaaacatttcagatgagaatcgttctccctgtattgatcatctctccactttgtcctacagaacttaatttgttcatttatgtatatgacttctagtcagcttttcattgcccactcctgtggaggaagtgatatagggaacagattgatatggcctggcacagaaagcttacagcctgagagtgttgggcaggagtcaggagagaagctagggccacaggagaagccgcagggaaggcatgtgacagtatgtgacagggaaggcatgtgacagtgtacctgtatgaagcctcagtctctactcctgtggaaactctgagaatgggtccagctagcagggaaggagtccctgggaggttggcagccattagtccagcatttaataatgggccaccgacattggatctatttgactaggaatctatcatggctcccctcccctttttctctgcaaccccttacacaaattctttaatatcttgtaagtcgcaccaggaaaggacaattcttctctttctttgatactttccagcacacagcccagggatggcatactggggtgcggagacagcccctatggagactgccttctcaggtggttcacagtggtgttgagatgacaaaagtaaccgttccttctcagctggggagagtgcacgtgcctgtcatttgggtcaggagttgagagtcattctcagctagatagctagtgaatctcagttctaggccagcctgagctacttgagactttgtccaagagagagaaagaagggaagaaaggaagggagggcgtgagggagggagaacagaaggaaggaagaaggagagaaaagtaagaaggccctctaatatggctaaaagtcactacagctgtatatgtttattctgattaatattatcaagtactttgcctttatttagccttggcctgttactagaatctcttgcaagagtcacatggggaatgctgataaaacgcctgtgttcctattgatcacagagtggggcttatctatcttagagaacagaactaactaagctggatctctgatagagtattccatattgacaaaagcttcttagaatgaatttgtttttaaagtggcacgggggttgggggaggagcacatagtgtgtatcttttgctggaaaaatacagtgtgtaattattaaacagctggcgctattggtaaactcattcgaaaggtggagatcaaactgcccagggatggacgtctcctcactgcatttaagttgaaaaagtaaggggcagtagatgcacgctggcttctctctagtccttctagatggcccttgtagcctctgcagaaactgtgtatgtactattaactcttaagttttctttctttattttggggggtggggaggtggggtttcgagacagggtttctctgtgtagtcctggctgtcctggaactcactctgtagaccaggctggcctcgaactcagaaatccgcctgcctctgcctcccaagtgccgggattaaaggcatgtgccaccaccgcctgacttaagttttctgttaagtgtgtctgtgtgtgtgcaagaagtgcacatatgcttgcatgcacataggattgcaggctgagatcagagaataacttcttgtgctattcccaattttgtcatcctagtttgttctttgacttttttttttttttttaattttttaagatatagcctctcactggcctgaagctcacatcaggtaggctagaattactgacctataagtcctggaggtatacattgcctgagcctcctcagtactaagataactgacaagctaccactccaggctttaatatgtttttaaatatgggggctgagattgaactcgggtcctactgcttagcaagcaaacaagcaagcagttcactgatagggctatgtccccagaccctagcttgtcccttttgtgatggtactcaaaataagattaacttcttctcacacattcatcctcagcaaggtttctaaaagcacagggcatacactgccatttttcatgctcccagccatgagtgtcctgttgcagtctctccttgagcccttgagcaaggcagagagtctgccgacccactgctaacccttcccatgctgctttgtcttgccctgaacttctgtctctccacagaggagggaaggtgacatgatgtctttttagtcattcaaatccaataacttttaatctgaaggttaagtagtgagatataaactaagagatgataatatcaattttatgttcactgaagggcacaatatacctctttctagtcgagggaaaattgtgcgtaaaatgtcttttgcttttccgtagcagagccatgccttctcacagccacaggaagaaagatttggggaaaatttttaataaaataagatgtagcatcataaagcagggcaagagtggcgtttcgtgattctaattattatatattaatttttcaaggctgcgtggcgcagagcagcgctcctctaaggaaggcttcccccactgatgctcattatcctccataagaactcagccaccttttacaaggtcaaagacggcgagggaatgacacgatgctcattcttttctgactatttttggtcctaatgtgtgtgataaataacaccttgatcatattgcttccctcccctcattttgctccttcctcctggtgagctctccattttggtgcagtaagcattgaacgtgcagaagcactggctggaaatgcctctacccgattccctttcattctgctgttcgggtcatgagacttatatttgtcttataaatacaaagttttatgctgcgtattatgtgtctatgtcatgtgtccttgtgtgcggacttaccgtagcgttcacctgtcggtcagatggggatgacatcatgcacagggtgggcatgctttagttatcatcaccgttgtcaaggttatagtctgtaatggggtgattcatgacagtgattgtgagggtggcattctgaaaggaatcttcaacctgcctcagctgtttgttgggcacgtgtggcgtacaagcaccaaagagctatggcgctcaggccaagtccagcctagcattccatactgcagagtcctatgtaaacgaagtgatactctttgtttaacactgtctacagctgtctgcatgcctgcacagctgtagtagtaattgtctcacagatgtgacaacatggctgtcaaaaacaatttaaggatgcagaaatgaattttgccctgaagtttgtgagggtccagcccatcaatgggagaggttacagttgcagaaccaagaggcatctgggcacattgcttccatagtcaggaaatggaagcagacgctctgcttgctttctccttttcatccagtctggtaggtccgtccattggatgtctacccatatttatggaggttttcctttttaaacaacacagcctccatagatacacctctacaggtgtgtttctttggtgattctaaaccccatcaagttgacagtaaagatttaactgttacaagagccagccaaggtaacctattacagcagaagttatatgtcccagaaaccctgaaatgtgcacggtcttgcacttcacagaaatagtagccctcccctgggttgttgagtagaatgtgaaatgtgtggcagattttctgctcttactttgtagtcatagggtagatgatgctttgtgtatatatgtgtgtgtgggggggggtctatgagtatacatgtgtgtgagtgtgtattgtgtgaatgtatgtatgagtgttttgagtatgttatatatgcatgtatgtgcttaagtgtgtgtgagtatgtgtgagtgtgtgtgtgtatggggggtctacatatatatacacataatttacaactttggcttttggtttctagtctgatgtagtgacaggtgggtgtattcacacttccgttgttcttgttttcggaaatttaactgatagtgtcttacaaattaagaaattggatattagtaatagttaaaaacccttgaggcagcctgctgaggaaatggggattggacattcttggcgagtcacggagagtagctgtcctcagtctcggctcccttgcttccagtgtaggctttctcccgctcatgttctcaccagcagacaccacagagaaattcggcctttccctctccctttgcgttctaggaattcacagtctaattggggtgcaataagatatagaagtacatacaggaaccatcaatagaaatcttaatgcatacaaagataaactgaaggagacaagcataagctaatcaatcgatagaagaatgatttgggtcataaatcctcagtggcctggagagaaaaattagtatgtgcatagtgggttttttttttaaaggctttagtgaaactagaaaacagaaacttgagtgtgtgagcatctgctgatttattttaaacctttcagtgggaaatatcagagcagagatagattgctgagctgtatagccttgacttgtggcttggataattaaggatctgaaaagtttgtcttggactcctttaattctgagatagatgagattaggagcaactggtgagatagatttgagctatggagcatctggtggcagatagtgagttgaggtgtcttcatgaccgacctgagttcactgggctgcaggacatagctgctggagtctctgttaacatagcctgtggtgtgaatgtgagatttgcagggatgagatggggcctgttaagtctggcttgtttccttggtaaggtctatatttcctatgctttaatatcaaattctagctacttacctcatcctataattagaataattgaaaccttagtacctgatttgataatagttgtcaaatctgaagattgttgttcaatgcacttattaactgtattttccagaagatggagtcagctttggtattttttatccttttggggccttttgtcttttctttcttacatagttgcttctgggtttttttttttttaatttttaaaattttttagagcttatccaatatttcacaagtgatgaaaatgtgttcatttctgtcacatacctattgtcaaacaacattggctatggagtgtgtgtgtgtgtgtgtgtgtacatacaggcatatgtgggtacatatcttgaggaggcacgcataggggcatgtatgtgtgcatatgcatgtagttgtgtgcatgcatatgtgtaagtacaaaattttacagttctgtagatgacccttctcattccctctgcagaatttttggtatgctaacttgttcaatgtttgaacaaatatttctatccttttccaggattactttaagttaagccttttagtcgtctatctctgacttggagtagggctcttcttttggctgtaaacactctacagcatgttccttgcattatttctcaggtaccacaataccccagccgattctgaagaaaactctgtaaggcatggagtcaggttaagcctggagccctgagagccatttcacattcattcaggtggctggacccacctttacactcttcatctcatctctcctcactgcagaacccatgtgtgaggcaggtccatgatctatgaaccaggttcatagatctaccagccaggttcatagatgtggtccacaaagcatggacagcccctttggctcagagatccacactgtctgctttgtttgcaaggaattgcatctttctcagaggttcttgtgggattgtgttgaggacttcttagaactgattgccagactctccttcagaattctcaaaatcctggatgggtccaacaatttgcttctttggtttctctcacccatcttccactgcttgactgaagagccacactggtggaatggctggcaggcaaggttagattgtgggactgaagctctggcccaagtcacagtccttcctagatgagttattctggacatctgaaaactctgcacctcagttttcatatccatcaaatggggacagcatcaccattcactatcccgaggacaacaaaggaccaagaaattgcagcacattgtaatggtctgcagatgtcagctggtgctgttattattaacaccactgccaccaccaataagaatttaacctacaagaatagtatgtggaatacaaagaatctaatccatgactgtgttttttttagtgtagtgtttaaaaaataaaaggttgaatagttcctaaatctgatgggagaagaagagttcagtgggtggttttcacataaaattttatagccattaagaatatcatacctgggctgctaaggaggctgcacctggtctctgtggcatatgtctctgtggcatgtaccatgagtatgcacacagctgctcacacacgtgtaacatgcataaaaataataacacttgtttaatatttaattacctgaggactgaccgtgctttgttgggtggggaggtgccctgacccctgctctttggtttcgttgtaggattcttgtgtgtttaccattactttttttgcttttctgtatatctcaaggtttccatagcaacattgggtctctactaaaaaaaaaaaaaacaaaaaaccagaaggtgcttttaagataagaccctgcaggatgcaaatgaaatacatatgaaatacatataatgatcttgatcctgtgcagtgccttggtcacagttttttcttagacaataaaataattttaagaattcctttcacatttatttcttcagtcaccacttgtctggatgcgctctccagatccaccagttttctggatgttcccaccatgacctgtgaccaaggcaaatcatccttactgaaccttactcttctgtgacaaaagtcaaaactctgccagtgcccagagaagtgggaaagaaagcaggcctcactcttctgttttgcttttctccattctcctccatccctcgagcctcccaggccctgtggacacccccttcccatagccacaggcacacataggtacacgcttctcggtcacttcttctgtcctttctgaggctacttccctttgggagttgtagaggtagggggaccatttgactggaattccctgccaggagggtggaaccccacctttcacagttcgtgcatgagaaaagctgtcccagccaggcagtggtggcacacacctttaatcccagcacttgggaggcagaggcaggcagatttctgagtttgaggccagcctggtctacagagtgagttccaggacagccagggctacaaagagaaaccttttcttggaaaaccaaaacagcaacaaaaaacaaaaaaagaaagaaagaaagaaagaaagaaagaaagaaagaaagaaaagaaaagaaaagaaaagaaaagaaaagaaaagaaaagaaaagaaaagagaaaagttgtcccgtgtgaccagcattctgtgtctccattttcttacctgtaaaatggagcagcacaaattcacctttctgaaagaggtggtgtagtgaatgtgtaagtagcacattgcccttggccaaacagtcactgctttaaaccgtgctcagtactggatcaccctccttgtcccccatcctttaaggatggaccaaagccatggtcaagatagtatggatcccaacatactggtctggtatggactgggttgtttctctagagtgttccattctttagcctgccccactcatcttatatccacatgtaatcagtaaactattgaattctccttgttggagtcttccaagacctgcctcccatggatccaggaatccttgtgctttatatcactgggtactagactgtaattcatggccggtcccatctatctactcatctcttcgtttatcctgacctcagtgtgaagactgtagaaccagtccttgtaagcaattagtaccccaatttatcattttagaaaagaaaacacacatcctaatcaatacagaatctctcctctgtacccacaagcgagcaccaccaaaggggccccttgcacaaatgttttaaatttggaggcagagttaaggacacagttggcctccagaatctgaattgaatcagggttttatttcagataaaaatctttgggtctcataacttaaaaaacacaacttttactggcattacgcaatttgccacgggtcatttaccaaaatgtttgtatatgtaagtccaggttcttctctttaaaaagaaggaagggtggagggcaggggttggattttgctaaaatccaggtggcgttcgagtttatatttaattttaattggaaatgaaatacaggcaaaggaggggggaaagacccaccatgttttctttgctaagagtatccattggggagaggaggggcaccggcagccagattttaagacgcacattttttattggcatgtctatttttttttctggctgaatttttatgcctgcattttaaaaaaaattgagttttcacacatggcaggcatttttatgtctcagtgccacttgccgcctccctctgtattttccatgcagttattacctagaaccaggagggcgttctttatacgccacacagaaccaagagctttccccaagtcctctgctgagccccttttgaagctccaaatgaggtaatatttaattcttgcggtttattttgatttctgaaagagtgaggaattttggaagaaagaagagtaagtgaaaaccttcattttaagccagaatttgaaggtcctacaaagtacaggtacagtttgtgaaactgccaggagacaccagcagagaaactggacacagttaaatggcgggttcgtggacaggcagaggcaatgggccagccctgaactcccaacagtgcccaagagagcaaaaccttctgtgttggctcctgtttagatgtgggtgtaatctgggcgttccgaattggaaactaaatattaaataattataaattttaggatatacagaatagtttgcagaaaaattaaaggatgcaggtaaggacacagaaaaacgagatgtggtcttcagtcctgttctcctgcagtgatgactcttagagttctttctccttccatttcgaagataattctcctgacttccatatatctggtcccattccctccgtgcagcttcagggatgggaaaatggctgacaccaaggctgtctgccagcccacaccccagcagctggttttcttacgcattagctcatctttttaatctcaattttaatttttaaaaagattctgtagaattttacttttagaaaaagaaatttcatggttctgatttccagcctcattatttataaacaatgtcattctcttaataacatcccttcttcacatttgctcagccttgctagattagttgttgttgttattggttattttcaagacagtgtttctctccataacaaacagtcttggctatcctggaactagctttgtagaccaggctggtctcaaactcacagagatccacttgcctctgtctccacgtgttggaattaaacacgtgcgccatcgcacgcctggctgctggataattctttatcaggagcaattctttaaatattaactcatttcttcagtcattgactgactgactgacttttatagatctttgagacacagtcttattgtgtagcccagtgaggtcataaacctggcgacccttctgccctgaccttttgagttctgggatgacagacatgcacaccacacctggccctcccattgagggaaaggaaaactttaacaaggcaccatgacgattagattgtattttcaacagtgattacatttttgggggtggtggggggaggcatcccaaacatctctgctatcatagaccagtgtgagttggaaatccctgacaggaggtagtagctacaatattagacatagggtggtctccaggtttatgcggagtctctgcatgcgatggtgcagggtgtgtatataagacccccccactctcccctgtgtgtgtgtgtgtgtgtgtgtgtgtgtgtgtgtgtgtagttggaagtacaagtcactgtgagctgcctgccatgagttttggggtctgaactgtggtgctgtgcaaaaccaacaagcactcataagcagccaaggcagaactgagtactcttaaaatccccattctctataagtggaagcacaactctcacccacatcccttcacacaaaatataactggatgcagctgaattcgaaccttcacctgcaggctctagggcctcagctgcttctcagaccaccaggctgacctgagctatttattgtgtaagtgatagttcgttcaagtgctctctcccatgacgctccccttgtccccgcactgcagaggcccagtctgtcacatcttccatcccatcccatttcatgttgtgtctggaaaggaagtaacccagtattactgaagacagtagtttttccattgccaacctgcccttgctttacatggagcgctggctttttaacaaatgtgcccacagatctttaaagcaactgtgatttgtggcttgttggtttcttttccagagggaggaagtcttgctcctcacctgttgctctgtctcctccttctgaggactcaaacctggtttactgaggaagacctcagcagttccttctgaccctaaaccgtccagacatggcaaacgctaggtgaaattgtcaatgtgctgtgggcagggaatggagcagtgtgattctgggagattttggccatgtctccaaagcccttccagattcctgtctcccttgtactatcaaaagataaaaaggatgcttttaagaaatgggaagtctgggtttattaataaaactccatgtcagccatgaatagcagtggttgcagcatattttctagaaaacttaaaagcagccattctaagtttgacaagtttccgtttattatggctcttgtgttttgtccatggaaccaggaggtttatactgcagactttgtccaggtgccccaaacagctgtcatggacagacaagactcgggacatactttctgtgttttctttgtattgcgtaacaggcctgaacgccttgcctaaccaacaaaaatgtatttggttaaaatactcaagtactttgtgtttcttggggatgggggtaggggtggggctcatgattagcccagtctctttggtgaatgagttaaacccttggaggagtcacagatctcctcattgttttaatatcgtggcttgttttgctttaagaatggttcgagttgttgacacaatgtcctttgctctctgagaggtatttagtgttcctctctccgtggcttacctcctctgctcacattgaggcgttcgccacttagcagagaacaactggttagccaataaataaaagattgtactcatgaaggattgtgctagggcgcacggtggggattttaaagattcataacctacaagtcaaactatgtgcgtttccctggcagcaaaatatctgtttgtttctggtttaggaaacagactttaatgttcatgcctgattttacggagttggcactttatgccaagttcttgccttgtggttaagtcaactaacctgttagccagtgtctgttgtgggttaggccaaagcctgcatgccatgccagagaggacacttttaagtctgtctttatctcattctcacctataaaaacaagctggtgtgtctgcttttggcaagcacagcagagcaggctgagaaacaatctttgaagaaaagttgtcatttggaaatttcccactctaaagctgggatttgagaggcagagagcctcctttcccggaggtgtccctgtgggcacaattgtattgtcacagcagcaaagagacaggtttagtgggccaaggagaaaacaagctattgcagttccctggaggagtccaaatggatgtcactgggaggggctcaggtgcttgctctgtggctcctccatgtgctggggaattcacgccaggctttgcactcaggttgaatgtgtgctgcagcccccaccatccatcgatgctctgaaacagagggctcatgtgcctcctcaattcaggatgctcctgcctctgcctctgcctcctaagggtctggcttccaggcctacgctctgagcagcccctcaagccactctgaagtgcacctctacaggctccaggctccatggaagaatcacatcagataaccacacaaggcttttctcaccatgatttttctgaaaggcttctttggatcttgatcaatacttcctcatgtgtttttttttgttttgttttttttttttttttggttttttgttttggttttttaaagtcttctttctgattcaccccctgcaagaatgacaaagtgacctcagttagcgctcacttagacagtcctcattgatcgcacactcctttccctctataccttatccttaagaacatgtctgtgaaattgtgtttcatttctctcctggctctttctccatagtcagaatttttaaaaattctttggatgatccacccccatattttatggatgataaaactaagctcagacaaaatcaaggcttggccctttgattagtgcttgcatgcatgtgcctgatgtgtttagaaactgcctcgtagggcttgctgatgatgtttccatatgccagggtgaatgaagtcagaaactggtcttgtgggtacccataaagtgagcaccctcacccaggccccatgtgtgcccgtgtggctgggtattcataagcacagctgcttagtcatctctactgtcagcagttggaaagtcagctttgtcacctttaaatcaggggtcagcatactgcaagtttacattgtgtctgtccgtctatccatccattcttctttgcagtgtgtatagggaatcaaacccacggctttgtgtgctcagcaattgctctaccagtgccttatagccacagcccccagccccaatactttattgagatagtatttttaaaaagatttctttatttattatatgtaagtacacagtagctatctttagatactccagaagagggcattgatcccattatagatggttgtaagccaccatgtggttgctgggatttgaactcaggacctttggaagagcagtcggtgctcttacccgctgagtcatctctccagcctgagatatttttaagttattgttttgcagggttttttaaacttgtgttttattgggggagggacctgagtgtactacacatcaggggttggggggggcgaggactgcctgtgggagttggctctgtgtccaccatggtggttttgggaattgaaatcagattatcaggcttagtggcaggctcttttatctgctgagccttcacactggctccagatttgcaaacacttctaggtctgtcaatctaacacgttttcaaccagtcctggctagggcctggaaacgggcctcactgtttctcaggtagacctcactacaagtgtcagaggcctggccttggccagtggtttgccatctctctcctggaccacatggggacagtatctcaaggaaacaactgtctgtggagcaaggtggtccagtgcctgtgctaatcatgtgattcctgcagaacctttcttcttggaaaaagaaaacgaaagctccccagttttgcctttgcagccatggttaaaggtttctcaatcatcattcctcaaagcctggttccctgcggttatcccacaggattctgactgatgctgggaaagaagcacaggcttcccagaatgcaccaccagtccctggtgagatgacctcaaccctcctctctaggtcacaggtctccttgttttcagctagaaggaacctctgctgcacagtcctgtgtagccatagtctccacccaccctccatcaccctccaccatctccacaccctctctgtcattttagaatttttccattcatgcaggtacttccaggtatacagaggcaaggcaggagatcactaagccgaagttctaggctagcctgggcaatatggcaatactcttgaattgtcaatgaaatagaaaacattgttttttttttttgtttgtttgtcgacccatgcgcactgagaagcttcagggcaggcattctctttgtgctgtgtgtaatatagagatttgctaactacaccaagcaatggttggtggatccataacagtgctccatctgagggccattgcgctatttttttgtgcaaggcaaaaaattaaagttcaaaaagacaagttaatctttttcccattgtggagtcaaagtggttgagtggtgaagacaagaaaggatagactctggggttgagggagagaagctgagtgtctcactgcctgcgcatccctctcacagcacagcagctcttgagaagtcttcaggccactgcctgacattcttgggcaataataggaagctctctccgtggtagaaggtgatccccggacagacaaggagaaaatgatttctcaagtgttccaaatgcaaacgatctgccacaagcgtggcccaggaaactcatgtctaccagccaaaatcctgtggctgtgtctcagctgaagcaagccactcgccctgcgagcctctagtttctggttcattgcaatgggtccctttgtccctgtgctttgaaatgactccaaacacatagtttctgcctgctgttttggtttggcttttgtgttttgtgtgtgtgtgtgtgtgtgtgtgtgtgtgtgtttgattttgtggaggagtagacattatgtgtgagagcgtgggaatggtctgcccagcttctcagaccactccccaacccctcctgctgtgtgagttactgaccttaactcatggacttcgtacataagaactcaagagataaaaccacacttggaagcctgaggctccaaaagtgctactgctgtgtcagccatttcttcttgaactgaaaagcctgtaacagggtgatgtcccattggtcttgcatctttgatccctcattgaccagtgctggcattgcccttggatgtaaagggacctcctcatgtgtggtgagtatctctttcatggaacaggaaagtctctccctatgtaagagtggactttaccagcagtgccttgtctctgcagctggtataactcatctctagtgtctgctgcctatgaggcgtatttgccttatttgctccatcctttggcaccgtgagcctaagggaaagctctcattatgtgcgtctgagcctcagggcactgggcttgagccacctccttgttgccactctcttgagcacccagaaattagatgctgtttcttttctctccagttccaaactaagccagaaggcagcctctgttgtaggcactctgtgttttgggcctttgtgacctatgaaataactaatgaattttctaaacaaccaaagcaaacagaaatgccaggaagagggaaggtggagagagaaaataattgcattatacatagggtctgtcacaaaatgcgatgcagaattcagggggagaaaacattgagtgtggaatatggcctacttcccatgggttgtctgggcctcagtttcgccatctgtaaaatgatgctctgagcatcttgtgcccctctgagaagtggaacctaacatctgattggtgatgaagcacagtggatgcaggactctgaatggtgagcccattgtgctgttccctgaatcactcacctctcccagactgagtagttttcctcaaggcctctgtgtcccatggtaccggggggtcttgatttcttgggacatcctttctcagaactagggacccaatgaacaggagtttgaaagctcccaagctctagtgtctccaagtattggcttctgtgctcatctttctttgctgtagtagttacaagaaagcctgagtttgcttctgtgggcacggtgagtcatgatgggacaagtgctgaccatggaagctcgggcccactctcaagcacaggaggctctaagatgcttgacaggaagggaaactgctaggactgtaacttatcaaaggcatgtttgctgttggccttagtataataatgttaatgagattattaggtgggggagatttttgataaataattgataaggattagaaagtgccttttctgcaaataaacttcagaataattaatattcatggactctgtttgtcaacagaaaaatgtaaatgaagagctggtccttttaccagactcaagacctgaaggacatccatgagacaagggttaaggagagaaaaagctaactttacaacccacaccaagagcctggccttatgtagatgcatactccttttcatgctctgtacacacacgtcccagtccacctctccccctggaagaacctaggaaaggaggtttgtaataggcacaggttgcagggtatggagggcagtaggcggtaaggggcaaggcgaagtgatgacgcaaaggcagtgtactgggagccacttttatttcttatttataatctcagtgcgagcttgggtaacggatgacaccagccctctcacttcaaagcagggagaaggcacagatgacagagcagagagtgagaatacagaggtactaacaacaggaggaaaaatgcctgtttacgggatcacatttgttagcaggcgctcctctgatattgctcccccaggaggagcaggaaagatgtgtagcggacggtgatttaacatctgaaaatggtacttaaagagtttctgcctggtaggaatgtgacgaaggcttctgaatgggacctggggacttcgtttcttctatttatctctctgtctctctggttttagtcaaccgtaattgcatatttaacctctctcacttagatttaacccctgatgtgccaactttctgcctgatataaaatgtacatttatcagaaacctttaccaaaaaaattatttagataactttaaagcatcaataacatggtgtatggttttggttggacagagggatgcatggagggatgcagaaggaatacaggtagacgggaaagctgtcctttctttctttggcaaagaaaggggagaaaaagcagttaagatacagacatgaagaagaacaaagatggaaaaaataataaaacagcaaacactacaaccctgttctcacttcaaattcatcatggcccgagctgagaaaattcactgtaggtgccctgcatgggagctggaggggggggggggtcaaggaggaatctgggatgctcactgccatccagtcctctcgctcagtggcctttcggagaggccccttaacagcttatgtgaaacaaatattaacacaaattgtataattacatcaaaatccccaattcctcaatgatgcaaaaacagctttcagctaagaatccaccagcaataaaacatcttatagtcgaagcagcgtactcccaggaagccccaagatgggatctgagcgactttcacagtttattttcatggtatttaaattatgataccagtgggtatttttaattagtgtgcacttgtctccataagccatgttggcaaatttgactcattcatacagtagttgcggaaaagaggccagcacagcctgcaggaattaaaataaaaagttcctgcaagctgttatcgacgtgaccatatctcattaactttcaaaatggagattatttgcctgaaagcttgatttgactagcagtaatcaaatattaggcccgacggagtgtggggtgggctggcgagggggcctcgttgtgatgtatatcaccgagtgttctgcagttcactttaaatagcagtataagatctttgttttgacaaaagcaataggaaagagaaacacagacatatggccccgaaagtattattaggagagttttattttagatgaggactcattatttactaagtttcctagaagacaaatacaagtatgctggctactgattccttatctcattaaggatccagaagaagccatggagtagcgtcccccacctcacatcaaagtgtaagctttggaaacagggcctatcttgtgactggttacctttttcttatttcattggattaattgacataagccttgaatttatccatcggacgcctgccattgtttttactaactatgatgaaggtggttgtaaaattacacacaaaaggagaagaagataaagagtctcttaccccctctgtctttaaaggaagggagcatcttacttgaaatgggtatctggccagtcattaaggagtctgattgtgaaaacctgaagttcccggagcaggttagacacagtctcttttcagatcttgtatattcccacatgcacaaaggaacatttgtactgggtaagggtaaactgtaagatgaagatgtgtggaggttggggggtgggggtgacaggcaaagagaaaggttcagttaaacaaaagacaggagataaagtctttgcctttttatgtctttgaactgagaacacggtctgcattttactacaggagaacaaggctacagtgtaagtaactggtttttgcattaggctctccctggaggtagcagaaaaatatcatgtccctgcatgaaatgtgaatgtgaaatctaccagaaagaaatatttatgaccatttcatgcttgattaggcttggatgacatctgttagcagacaggagctggacaaagagagagacgctcgggggcaaatgttaacggagttgtttagatgacgcgagggtagaggcctccatttactgccaggcaaaacacaggaactgtgttagccacagcacggctgacaagcatcactggaatggggaccccggaagctaagtcgatgaacagtcccacagctgtccatcctcaccgtgctgcctcagtttatatcagaatcccttaacatctagggagctggcatcttagtaaagttaaaagatgtgacacaggatatacagaaattctctccaccttctccctgtaagtttcagaccttgcccctagttttctcagtggaagagttcattaagccacagggctaccctggttccattctgccacaagagttcttatcgtagtttcctttattagtaggattcttattttaacgtggttctaacttaagcatgcatggctttaaaccatgtaaaggtttgcccaaaatgagaagaaaaattcgttttttagaacttattaccagtcattaaacgcactgaggctggtactgctgtctcagccgtggctccccagagtggagggatgaagactagtttctttctggttcctttcccagcctcttttcctgtaacttctctgtctggaatgctgatgggaaatgttattttgtttttgtttgcagcaggtctgttgttttgattttgtctgagtggtatggaaaacagtacgtcacttagagtgggtgtttgtgtaccggccatttggccgttgcacatatatttctcatgcttattacatgatgacaagggaaccaaagagacacaagtttccagccgatttttttttctttccagtttaataatagtgagaaaaaaaagaaaagaaaagaaaaacaaagtcaatagatttagcagtttgatggcgcacagtgctgcagctggcttggtttccttaacgttttcattccttgtggcgaggaaggtatggaggtgaaggtcaagtgaatgcgcacatcagtttctgtaacaagctgcatgtggatagcatttcacattttgcatagagttgtgaaatgctgtaatttaagaagggaaatgcataaaaggataataaacacacttaacatcattccagtgattagtttgaggtacttcccctccaccctggtttttgggccacatgtagaaaagactttaccaatacatgtatcttaattacaacgattcgagatgaaattcggatggaaagccagaacacaaatctccgagaataacctctagccattccctggttctttgtggccatgcaagccttctcagtaggtaggtgcatctcacaagagtgtagaagttagcgctctaagtaagtaattcttggtgtaatacaaaaatataaaatggaaacgatgattaatttttcaatttctctatgcagatatctaatcattgtatccatggaccgccaaaggcacccattaaagatttaaaaatgcaagaggaaggtagaattcaaaagatgagatttgggattaaataatgtaaaattactgcagggcgatagtgacgctcgtccctcagtgagagattttctcagaccccttgaagagccacttaaagtattgatatgacttacacactttgtcctagcactgctgttaaccaaattatgtattagtgataaaattatgctcaattttttttttttgtctttcgtgtcatgtgtgctttctaatgctttaaatagtggcctcctggtaagaagggtgtcttgtcacacccatatatgctgcatcttcctggaggctttccattttagctgggaaaacgcagtgttcaagggttgcctgtgtgtgtacactgtgattttcttcaaatcaggggaacttttataatcctagaagaaggagacctctccgcctcggtatataaaagctgtcaggaaggtccagccgggcttctccgagctccgccgtgctctttatcactttgctcagccccacataataacatcttcatctgagattgccgtggcacaggggagccgcatttgttgatcaaatttggctggctaacactgtgatctcctatcctgaagtgcagagatgtgcctggaatatgtaagtgcaaagccagcctcctgattgattgattctgcctgtcacagaacaagataaccggatcagtaaataccctgtgcactcaccatcgtccccacaatcaaaagtgagggcatcacggggctggaaaacactggggcatgatgggatgcacacatttccaaaggataggcaggaacacatccacagacacacacgtccacacaagcacaaagaaagggagcgctttgtgtgtggcttcttgcaagggagccatgtttaaaaaaaaagaagaagaagaagaagaaaaagaaaaaaagaaaagaaggaaaaaaggaaggaaggaaggaaggaaggaaggaaggaaggaaggaaaggattttctatgtgattagaatgcttcctggttgtaaacctggagtttattttgcaactgtcatcttggaggtgttggacatttgtcataaaaaaaagttgttatttgagtgctgtttacagaggagattgagagaaagattagagggctagagcctgtaagaggtcagcaatggtctccagcacaaagggagccttttcccaagacttgctacctgttaaaataaactttctgttgaaacagatgggccaaacacatgtaaacaaattgtttaaacttttactaaattcccaaggagttcttttcaaaagtagcacaaggtggccagatctggtgtttaattaaacagagttcaaaaagagttgaaagaactgaaccggtgtgaaagctggggagatggatgctgctgacaggtcgcctggggtcacacagtcatggcgccaggatggtctccctaatggctcttgtcaccatcttgcttaagtcgacacttttctgtttgcctctttcctcccataagatttttaagttcctaggagacagggtatcatgtgttcttgtccctgtgtccccattttcccggaagatgacacggtatgtggtacccaagatatagcgactgagtgagggtgggcccgggtgttgggctttcttcagttcatctggagttcttcatcccctgagttgtaactgggctctggaatttgaattgcatccttagctcctttggagaaatgtagtcattttcctcgtgtcaggcggctgcttgagccccttccagtcttcttgtctcatgccgtgggagatggaggtcagattctaagacgtgctgcttgttggactaccagccacacagtgagatgaagtgctgccgcctcttctgccacattggcctctgacaagcagagcctcgttccttgactgtggtttttgcacagatttgtaagtgggccctcgcatgcccacggacctgtttccgtgaatgcctctgggctgggtgatgtctagactatttcagcagaggcatttcttacttttctccttctgttttatttggctcaaatcagtgcctccccatttcagattctatagtttggcccacatgggctatccccatggcacatttaaggaaggtaaggtttaggagtaaccaagaagtccaaaaaaaaagtgtctgtgtagcgagtctctcctgtggaaggtgtgtatgacccaaggactacaaccgagagtctcacacgttgaaaccagcactcgtacttcagaaagaattattaccatgtgtgagatgtctggttagttctttgcgacttagttattttttatttgaaatggttaaaaatgccttttggcagaattggcctcctttcttaattttctgaacataaagcttaaatgagtttaatgttcttgatttaaaaaaaaaaaaaaaaaaggaagtgaggtactgatggtctcagagaagctggtctgagaaacaggttttgatttttttcatttttttccccccaaaagccaagagtgcagcattccctgttcatttggcacaaactcctcctagtaacgttttataaaatcattttcttctcagggtgtgttttatttccttcccttccctttcaggaaagagaacgtgttttattggatatttttgttccagtcctcgtttccattatttttgccaaaattcatgggtgttcactctctatttgcatgcctgtaatagtccttgaaggatttgcatttggggacagctagggcaaggctatgcaaatcgatttagtggtcttagtaactgctatccttttatttactaagaattttagagacaaacaattaaatgagggagggcccctttgagtctaaagttcagaggaaattcctttgctcctgcttgtatgatgttgtcccttagtttccaagggaagggacaaagtttcagccttaattcattaggagaaggaaatggtgaatagatttgttttgggaagacaaaaacaagtccctaagatggtgcacccctctgcatgtgaagcagccttggctgtgagttggctctgtatagacttttttcttgtgagttcacattgggtgttttatcttctgacactgtcgtctgatccaagtcaggtgtattttctgctgtggagtgaatgatgccttcatccctttaaatcgaggcatctaggttcctaagcagcatcttggtgtatgtatggtccttccatggaaaatcagccatcgaaccaagccagtctaactgtgcctggtttctaaatcagacctaaaggatttctatatttgggtttgagctgatgatgcaggtttatctggggggaattcttatagacagatccaggccaggcctggccgtcactgggctcttgatcttcccatggccactggggagaagacacagcccctccttgggactgtgggctgctgctggactcttgtgttctctcgggtgagaatttgaaaaggtgcttctgagtaagagtcccttctgagtaagagtcccttctgagtaagagtcccttctgagtaagagtcccttctgaataagagtccctggggccccttcggcctctgctgcttcagacctgagcattggtttttgttgctgctgctgctgctgctgctgctgttcttgttttctttgttgtctggtctctgttgccagactgacatattttgcgtgttacttggaattttacatatctgaatgatgagctaaacagaaagcaaaggtttgctgccatttcccagcgctgtatgaaatctgagaaagcaaaataagtttcggcgtgggcaccctctggttggccacctcccattcataaatggcctgactccctgatgatgctgggaagcgggccccgaaccgttgaccaaccagagagttaatcacaaattttcattgctggaggaaggctcttacagaccatagcctgtttgtcctgtgtttcagccacctgagtcatagaccatgatcagggatagtctgctccagatgtctgaaacatatgccgaggggtaagtggctaggagtcacagccatgaagccccacttcctaggctctcaaaaaggaactgaactcttaagaagttttccgtggatttcttcatcatttcttcaagcgtttgacctctatttggcctactcattgttgcctcctcctcagtgtttcattgaaggagctgtttaagacatcacctgggcatgcctagggaacatctgtttagtaccttcatcttcctctaagttaaaaaatacttcttttggatttcagtttgtgtgaagggttacaaacttggttttaccaacttccctctcttctgttgatatgtgccctagcacatggacacaagggggatgctccaaagaacaaggccacgtggaacaggagtgacctctgtcactaggaagtgtttatgaaatgttaaaaaaaaaataaaatgggagggattttgcctgaagtggaagtagcttgtgtgtgaaacatcagttgacaatgtctcatctctgactccatccgggactctaattaaataatagcagaatgtggattaaagggcattacattccagtggaggctttgggggcactttaccctctactgaagagtctaatgggtaagtctgaagcggcttgtttcctaagctctctaatagactggaattctcccctctctcatcccttattccttatagcttgatggccttaaggaaaaaaaaaaactaagagttgacagagactcaaaaagaaaataaatttacatgaagcaagtatgattgcggtgcatgatgtgaaatttccaaataattaataaaaatattatgttgggaaaatatagatgcatggatggatcagtgatcaatgacctgctgtccgaagcatgttgctctctctttcactctggctgagtatgccctcatggttctagctgtggcacctttcttggctcacatgcagaccgcaccaccccagccagcatgccagcatgctgcttctcctggatagcgtcaccttatgtggattcgcttgtaatgtcactggcagtgaattccagcaaaggcagaccttgtttctcccctgacctgttgtgtctctccctaagtgccttctacagagcaggaactcagtatttacctgacacaggcagacatttcctaatcttacactgttctaacaccagccaccttaatgtgcctggctccctctcacctgaaccagaccttctgaaaggaccctattgatagctccattccagaagggacatgagagacaaaggctgtgagaagccacggttaatcggaattccagactagtatttagttgcatttgtcctggtgttttggccccgtttcagatagctaagcatctctcataccctgtaatttagtatattgtttcagctttccaaataatggcttgctaatggtaaatgttgtttaactttctgattccgagtagctacctgttcagcagaattttaaaattgcgagtgatgattgaagacaggttaaaaagcacttagggagcttttggctgtatgtttggcgtcggcttgaatcggccatgaccgtcattattctttttgaatctgaacgtacaccatggaagaggctttacttgattggtccaaaaattgaaactcatctttaccaaggcagttctttctttttaaataaacagggtatcttagtcagggtttctattcctgcacaaacatcatgaccaagaagcaagttggggaggatagggtttattcggcttacacttccacactgctgttcatcaccaaaggaagtcaggactggaactcaaacaggtcagggagcaggagctgatgcagaggccatggagggatgttctttactggcttgcttcccctggcttgctcagcctgctctcttatagaacccaagactaccagcccagagatggtcccacccacaaggggcctttcccccttgatcactaattgagaaaatgccttacagttggatctcatggaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcctcttcaggcttccatatggccatagattcaatggcctctcccccccctccccatctccccaaccccactacctccatagagtagaattaaagcaataatgacccgagttgagtcaggctataatcagtctccattgcctgtgtgtagggaaagtttggtcactgatggacgaccactgatggcaacagacacctaagatcactacgccaggatacacgcaagtgtacttgaagcttgtgagtctgtctgagtgccctgcatggcatctgcacagcccactacctagcacatttctcagactgtatctctgtgaccaaggcatgcctgacctcagttgaatggcaatgttctaccatgtagatcagtctccatagctgtgaagttttcaggccgattcctcgagtctctttctagtatccgtatgagagctgtccagtggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctccctccctcccttccttccttctctcttttgctatatagcccaggctggccttgaattcatcattcacctgcctcagcttttcaagtatttggggtgtatattacccttgtgcctcattctcacgagctcactgagacatctgggcactgcagagcaagatcagagtggggcatttgccttggccttgtgaggtccttgtgagtttgagccccagaatttatccaaaagccaaccagcaaacaaaatcaaaaacaagatatggcaatgttgccttgtggtcgcagcataaagggggcagggatggatggatccctggcactcaggagagtcagtatagttcagtgccaaatcccaggacaatgagagaccctgtctcaaagggggaaaaatgaggaaaaccacctgtattagttgctttttatcgctgtgataaagcatccatgcgaaggccacttaatctaaggaagggtttatttgggacaagtggctccagtgtgtaagtccatcacggcagggaattttgacagcaggtggcagacatgacggctgttccagctgagtgctccgagtgctcgaatctcaaaccacaaacaggaaacagaggggacacactcagaatgtgtacctcaaagccagtgcctaatgacatacttcctccagcaaggccagacccctcatcctccacaaacatccaccaacccaagtattctgatgcctgagaatatgggggcatctcattcagaccatccagatgtcccagattgtgctggggcgcgtgtgcctatatgcccctgtcacgtatgcacccacatacatacatgcacacaaatgtactcttcagaacacagattcaaatgaacctgttgctgcaggcttcccatattctaactgtccctgttgtattttcaatcatacttagcattttgtatttttccttacacctggagccagagagatagccactttcctccgggagtgcaaatcctccgctgtgtttgatcataggcagagatcgtcagccagctttggagttgctttttctgagaaaagctccaataggcccagcttgaggaaaataacacagacacacacacacacacacacacacacacacacacacacacacacacgcacacacacgccagtgtcaattgaaaaccagccgggtggcaagcactgctccgcgtagtgggaatagtgccgccttcggccctttgggtgattggggacagtgtagagatattgtgaaattaccttttttattggttcttgagccttccgcagtaaatgcctcttcttgaaggaagcgaagagaatccgtgtgtgccgcgtgaacttgggacgcgtgtgtgacagttctcttcagcctgtaatttagcagagttggagcttgagtgtttcttgcattgggctaatttcccttgtgagcatcattatgttaatcaggctgccttccctctcgtgtgtttactgtgatttttactgtatcagtggaagagtcttatctgttttattgcattttgaaatcaacatctttgggaaagccgccctgtgggtcttgctagatcgttgatttttgttttctgccccctgccaggtcagaaatggcatattggtaagccttactgtagtttaagaacccacagttgaaataccataaaaaaagtgctagctgctgaaggccagcttgtctcttccctacctcaccttctccagtcagggttgtttgtcatcaaagaaaatgggtcctttgtgcaaaatcctctgtgggaaaagtcactgtggaccttctccatgaaggcctgcaggtcactgtggaccttctccatgaaggcctgcaggtcactgtggaccttctccatgaaggcctgcaggtcactgtggaccttctccatgaaggcctgcaggtccagaaccacttcctctgtccctggactcacttggtacttgctagcttctactgccatttatgacagtttcctctggccttgcctggttagagaaaatcactgttggcatcccttgtatgagccatcatacacttagcgacagctgttaagtggcttctgtcttctctgtcagactagtccaccataaccctttaacctttccttaaaggtgccattttccacccccttcattatttttgcttgcttttctttggatttccccaaacctttctgaaaacacagtaagagaagggtgttccctcatccactcccgaagttctgcaggtcagaggcccccagttgtatcttcctgcccagtatccttttttccggctcaccttcccagccctgaaacgtgtggggttgtacacatcactcacactgggtttagcctgtggtctgtgggctaaaggagagatttaaaagtgaacagcaccatttctttctatctgtgtctgctggtggtttagtttggggtgttttttgctgtgctgttttaatggagaatctctgtccatttcctgtctcttacgtgaaatgtttgggctgagggagcatgagagggcagcggcaagcatacacactcgtgattcctgcccaacctgtcctccgtgtctctgtcactcagagttggttcagaaggctatgtcctgatcatgtcctttctggacggctcaccctcatcttcaagttatcagcctaatgatcatctcaggctctccacttaccattctcatgttttaaatgtttactttattttattttcatgtatctctgtgtgtatgtggttctgtgtatatatctgtgtgtctgtgtttgtgtgtgtgtgcatacatgcactctgagcacatatctgtatgtagcacccgctcagaggagactatggaggccggaagaggtgttgaatcccctgagcgtggaattaccaagagttactgtgagtgctggaactaaactggaaaggtagtgagtaccttaaccactgagccatctctccagcccctctatccacagggattcttagcctctcactccagaacaggggcttcctgaggcctcccaacatcaccagttcattacccagattgtgctgggatgaagaaagacttcatgctgcaggtggggatgaaggatagctgggccttggaaggttggtgttcttgacttaggtgtgcctccgattcactgaatgacctggggcagaaccctcggggtcactggcataaagtctattgagcaaaggagttcagcaccaacttctgaatgtctcacagtgaaaaagtggatcagtggagagtggtccctggagtctgaccagggcagagagagggaccacagaaaggaagcaggctagggctcccacagcacagagtgaagttactatctattgcactgtgactaagagtatgaggtgtcccaatgcccatgacacagtgtgtatgtctcacactgagccccataaataaatataaatgtcctgtctccattaaaacatgtaatggtttataaactgaaattcttccctttctcaactcttgtcagattgagcaacttggctggattctgctgtccctggggtgcaggtgtgtagggagtatttattcctgtttgcatcttccgagttacctgtttaaggggtaaactcatgcctacctctcttcccagggtttgatagtattcttgtcccagatacacagtaccacttccgtgaggctgttcaggaggcaatgacttaggattttggagtcctttgtttctggattctgtcctccccattcctgacccctcttcagtggtaccagcagtgttgcgactctccaaaaatgtgtgtcctattcctttgcttgattgttctgtcacctttctgctgagggtccagagacagagctacacggcaacctgaagccacatggtagacttgacttaaagaaggctggaggtataaagcttactctagacttttcctccaccatctggagccagtcagtctttcttgacaccagattaaaaactggtctgtctcatcatcccaccacagggctataccctctacccatttctgcctcccatgtgacgcttgctgtgacatccagagagggtgcatgtgcaagtgtgcctagagcatccagagcaaaggctcagagtgctatactccgagaaagcaaagcgaatctttgtagctgagcaggggatgctagattgcagcagagtagaagaggcagtggcttgttgccctctctaaatcaaaggtctattgggtggacgttcagagtacaggcagcacaagcgattcctcttgatgctgttcagcctgagtgactactgcagtgctgtattcacagtatactgtccagcatgtaaacctagaccctgtgtggacagtgagcctggcctgagatgcactacaaaggaaaaatgctgggctttttctgtcttctcgcctcaatgctggggatggacctctgggcctcagtgttctgagcatgtacttcaccactgagctgaacccccaggcccaatgcactgggttttaaacacctagtaaagttagttgtattttaagaaaccattttattagcactcagatgctggctggctatgcatcagagtgatagcactttagacataccatcttctgtaggtatgggttagatgaaataccttcagccttcattttaactatttcgttttactattttgaacatactttttaagaaattttcacccttgtacctagctcatgctgaatttttcaacagcggtgaatactcaaggctgtgaggtttgcctcacttgaacctgaggacggcttggctctgtggagtttctacccttcctttgttttgcagctagatttgctgttagaccatgataaccacacagaccttacaccaaggcacctctgagttttgggactagctttttacttgtggtcttcgctgtaagtctagacccacctgattgtgagttttctcacctgtggacaccacgtctgtcttccaaacctcactgtgggcaggggtagggacaaccttctagttttctatctacattttaaaacatttttgttgtgatgattgaagaattgtgcttttaccccaattagcaaaggaaatatttctgttttgaaattttattgcaaatgtaaaacagaaacccaccccttggctcctattgcagtaggcttgccagctagcaataatgaaaccatggtcaccaacattccaggagagcaccctgccaggctgtttgctttccaggaattacctcagttgatcttgactaacaactacagaagcagtgacttaccaccttcatttcatagctacagcaactgagagccagacaggtgaggtgactttcccacagtcatgaaccaaggaggcattgagtatgtctcaagatgctcagaatagtcatagtgtcctgttcttcacagtgtcatccacctatgacaaaatgacaagacaaaaggatgaagagagaacagatatttgtaggatgtgtgcttctgatggactctggtttatgatgtttattgtttgtgtctacagtgtgttctcttagaatgtctccctctttttcgcactctgtcaatgtgtagaaatggatgttggctttgcctttgagcccaggccttggttggtctattagggttagttccaacaaagaaaaatgaggtgttagtggttgattatgcagcctggtgagcacagggtagtaattgttaaaacacacacacacacacacagacacacacacaagaggtgatgggtgtgccaattgacttggtatcatctttatatatgtatatacatgtacgcaaccttccaaatgtatatacagtttttgtatggtaatttaaaaaaaatgtaaaggggaaatagaaattcccaggtaaacttctatagcattaacatgggttacacaatatctaaacaacagtaaaccttttgttctctgtggccttgtcttaggtgtatacagtcagtacaacccttagcactctgtgtccccattgtgtatagtgaggcctcaataaatgttatttattaatgtttattgctgtacttctgaaatcatgcctttggcagggaaaaaagcacactgtgtttaaggctgtcaatcaaaccattcgatgggacggccagtgttgtgatgtggacatgttaactcatcacacgcaattgttgcttagagtaagcttcttagaataagatctaacctttgattagagaaaggctttgagtggattaatttctgttgggctggaatctcccactttgcctgatgtacccgccacacctgtaccctcgcagatccagtgggcttgttcactgatgcctatcttcctttgctgttccatgtttaaccaagaggattagaaggcattgatgtagtattttcttttcaagttaggccctaatacctcagtggggtggggatccatgggtggtggtggcaggagtctgtggtcaaagttcaaagctgttgtgtcatttagaaaatttaaatgtgcttgtgcactgagttctggtctgaagccataaggaatgagctttgtcgggcctagaaatgtccttgcagagtgcttacttcaccagagaaggaagggccagcgtgatgagagccaaaagactctattgcaacagggctgttcacttccattcactgtgtctggcctgtcatgcattctctggtctgaggtctgctctagagagctgagtaggtaaagaattgcaagtgttgagagtcacagccagatttgcctctgtgcctttagctggtggctccacagaaaacaggacatgtttatctcaagagtgacaataactgtaaacacccagtcacaaagttcagcctttgagactgcatgtttaaatggggcagaagggggatatggacgctagggctgtaggagctcatgacgaggagtacccaccatgggcctgggtggagaaagggtcatggaatttacagagggacagtagagttgttaggcaaagagttcatccacacatcaggaagaaagtacagagctttgccacattctcatttgattgttgcaagtaggtaaataaggtccatttagtaggaagatgggtaccttccactgcccatgaggtgagcattccccttattgctagcttagcagaaaggcaatagcatctctgagagctgttacttcttcagaccagcatgtcccagagctgggcattgaggtgtttctccctatcccaaccattgtggtttctcatcctacactaggctcccctctgggtctctcaggccttgctcagctcccctcttacagggttcagtcatacacagtgcatagattctcacacatacgtgcacggatcctcatttgccacagctgagaaacatgcaacacatagttcagtcactgtttctggagtctagtcttggatggcttcagtgagttttgactcagggacttgtgagtctgtaacttgaatgcaggtgtcaatgctgacatctttaccaagcatttttgggggtgactttagtccagtgaacttaaaagactgagaaagaacccatcaagactgctgtttccagccatgctcccctgtcccaacatggctgtttgtgtcatcggggccacacaggaacgtctatgtcctcaaaagagcctccaccccctttaaaaaacaaaaacaaaaacaaaccgaacaaacaaacaaacaaaaaacccaaatcttaactaattaggccagacccaccaagcaatatctctggttttctctggttgtggactataaacaatacttgcaaattttctttctgccattccacatagcacaatcagtggagtgctgtcccgttctgttaagtttcctgcgtagtcactggcattgcgtctgccatagttgccattactaatggatttcttttcagcttcccggaggaaagacagcagaatttggagctgggcaggtctgagatggctgttaggggagagtcctgaggataggatgagagagagctcatgagcacaagagaggatgcatcaactgtatccctgtgtccagagctggcctccattgatctacaggctggccttacatatccactgccgatgatgagacgtcccccggtgttttctggtgatcagtggcccggtcaccataagtggagctctgcctctagtgaaagaccttgtcatacatttctcctggcaggtttatgccctcagtcttgaggatgcagagagatagttttaaaaaatttcaggggttggtctgtcttcgtgagatggctggaagcttttgagattacccctgtgtaagccaggtgcggtggcacacgcccttaattccagggctcaggaggcagaggcaggcacatctccgtgactttgaggccagcctggtctatggagggagttccaggaagaaaggagcaaacagtagctttggggtctgtgtctacatgaacaaaataagcgagactcactgtgtccttgtcttttttctccatattcacagtctccttctacccttttcctttccttcttcttgaacaaggcagccttccagtgatattctggagaccagtgtttatgctagtaatagctgccaagttaatataataaaatatagagcagaaaacatacactcattatagtccttgcaagagcttgaatatactattcaagttccagtcacatttaagcccttggctaaagtatttctagttcatgcttggggcactgaagttggaatcgtcatgtgtgctaagcaggtaaatgaacccagctgtgatgcacgctcaggccagtgccctgacccattgaggaaactagctggtatgttgtcagtaacttcaaaacttggagcctgttcttggccagctgccatgttgtccgtttctcccatcacttttccacgtaatgtataacccactgcagccttggaaagctgaactagaaagatggctaaagacaggggagatggctcagctgttgaaagcacttgctgtggaagtctgaggacctgaggtggaatccaagcaactacataaagcactgagaaaggctgagtatgtctttaagtctaggacttggagtggggatgggggccttgctgcctggtggttcagtgagagacctcatctcagggtaataagatggagagaaataaacaggatacccagtgcctctgacctgcttatatgcaacaccccctatatatgtgtccgcacttgtgtgaaggaaaaagaaagaaggaaagatggatctgtgacactctactagattcagacaaactgtcctcctaggatgttgcaaaagagggtggggtgggaggccctaagagggcacaccagactaccatatgaagctgtcaacagccaccagaagagccccacattacaaatgatatctgtggtcggtttatgtaaagattcatacctggaaaatgagcatgggacagtgttcgttggagtgtaaatctggctcatcagtttaaattatggtcctcctttttgacaaagagggggaaacatagtggcgataattcccgtagagaccttgagggttagaaatctatattttgggaagctggagaatgcacttatagttgaggattcgtttcactgacagagatcagtaaaggtctttctggataaggtacgtattgagtttcaggactgtcctcttttctcctcctgccagactgtctgaaacttatctcacatatcatggtaaaaagagatgtggtggggagttatatgaactgccttgctaaatgcatatcagagggggactttattccagtttagtaggtttaatgatgtgatttcccatattaaatcataactgttttttttttttaaagaaaatagagtgccctgccttgtcactgccctggtgtccatcccactgcctccctggggcttgctgatttgaccctatctcacacccagccgtagtgttgctgtggaaacaggatgagccagtgtgtccagcaatggccttggccttggcaaacccatgctctgcttaggagtagatggcacttctgccaatatccagataggaataaattttnnnnnnnnnnnnnnnnnnnnnnnnnnnnnnnnnnnnnnnnnnnnnnnnnnctgagacaggaggatggtttgagaccaaaagctcaaggccagccttggcaatatcttcaaaaaagaatgaaaaggagagagaggaggaggaggtgaggaagggaggagggatggaggggagggaagattcatatcaaagtgagtacgatgcctggatcacttaggactacataatttgcatattggatgtttgtgttttaataaagcctcatcacttgattgtttgggtgactgattttcaattcttttattctttccacttcactagttcaaaaccgggaggtggtaaaaaaagaaaaggacaaacctacctgcattgactccatggggttgttggtttgtttctttgttttgtttttatatgagtacactgtagagctgtcctcagacataccagaagagggtattggatcccattacagatggttgtgagccaccatgtggttgctgggatttgaacctctggaagagcagtcagtgctcttaaccaatgagccatctctccatcccaatttttgtttgtttgtttgtttttgtttttaagattctattttatttttattttatgtgtgtgagtgtttttcctccttgtgtgcttacatatctcaggggtgcagggcccagaggccagaagagagtgttggatactctggaagtagaagagtcagacacagtggtgagcatgtgacatggctgggaattgagtggccggtgctcttaactgctaagccatcattccagaccctgcctgcatttttggataaaaatggatttgtggttcttgaacgcctatttttttaggccaactctgacttgttttgtcatgtactgagttagatgaagatacaccacattagtaagaaaccatccatagctctgtgtgtatgcactaccattaaatgcctcgtcctgatagcaggaaatgcaggacctagctttgttgttgttttgttttgtttttgtttttgtttgtttgtttgtttgtttgttttttgtgttttgttttggttttttgagacagggtttctctgtatagccctggctgtcctggaactcactctgtaggccaggctggcctcgaactcagaaatcctcctgtctctgcctccccagtgctgggattaaaggcatatgccaccactgcttggcaggacttagctttttttaaccaaaataattgtttctttgtctgtggttctttgatgtagcctcacaggatcttcataaattacagtctgcaatataactgttcctgcttaacagagagaaactgaggctagcattcatgatgtaattgctgaagtaattagtttgtgtcaaaaggaaaaccaggtcctggttcagtggatgatgctcttacagcttgcatgagaactggagtttggatcctcagaacccccatgagagctctgtggtggcctgtagtcccagcacttggaaggcgaacctgctagctagacaagcctgtgaattccaggctcagcgaaagaccacgcctactcaaaataaaatgtggagaagggtggaggaaaatggccagtgccaatgtggggtctgcacacacatacacacatgctgccagcacatgtgcatctttcatatcacatacatgtacacaaaaattatttctcagtgtttttagaaggagagataccttgatggtttttttccttagtgtgctgcaggctttctggcatttaggggccatgaacatgggttttagaaagaagtaggttaaggagaaagaacaaataagaaaggtacaaaattcttcgtacagtaaggttgactatttttaaaattttgagacctctatgttttctttcatatttgctaagtttctattgaatcttatgtccttatttatttataatgatttctatataccataaaaagatctaaggcctggaatgcaaatatttccctgttacatgattgttagtcatattcagctttaatgtgattttattatagtagctatttccacatggttgatgagatttttgtaattatatttggaaatacagtctcacttctaaaattacctctttaaaaaattaaaaaacaaacaaacaaaataccaagcatggtggcacacacctgtaataacccagcagtcaaggggcttcagaagtggggtagtgaattggaggctagcctgggtgatggtagcaggggctaggctctgtctaaaacactaaacaaatcttagtgaaaagaccaaaagaatcttctttaagtcaaggcaagtaaagctagaatcttagaccctcattgcgagtctggataaaagtagattgcagttcctgaatgtgctttgtttcatttgtgtgtcccatataattatcattggtttgttcagacaatattcatagacagagatgaataagaccagaagcataacccttggtctaggaaagctagtgtctgcggtgggggaagatgaagaaccagtttaggaaacagccatgcgtgttcctaaacagtggagttgtctgggggcagtggagcagcagtgttcaggtgtaaaggaccgtgtagagaaggagatccacatccaatccctcccttcaagggttaggggtctgtgcagaaggcgagtagaaagattgtaggagtcagaggtggtggctgactccagggagacagtgttatccagacataacaagactggtgcaggtgtgaactcacagagactggcggcatgcataagacctccacaggctcaaaccagacagaaccccaatatggagaatgggaggtgggcaagctccactcccaagatgcttttttttttttttttcatcaagaagatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaccagtagggccagacgtgtaatcacctggcttgcttgttgccagcaggtagagccaggcttgctggtgtcaatggctggctctcattgtactcgagtagtgttgagaagagaggacatcttaaaggccctaggaatggagacagaggcagccccaggcttttctctgctttgcttccccttggtattacagccaaaacatccggctccacgctacaactgcatgtcacatgcacaatgtaggcactccactctgctcactgcaaaaccattctctccttagatgggctgttattcacattttgacacattttaaactcaagggtctgaatttcaaggaaatgagagttccttgcagagcccaccagctcttttgagttgaaagagtgactgggggaggtgttgttgctataatcctcctttttttggaggtatgggatacattttttacattcgatttactcaaacagtgattatattaattaattaaccttgccctttaccctacaagctcctccttccaatgacaccccagtttcaagagacaaccctgttttcctagaaagtacccaggttgaactggttccatgcctgtgtgctatccagtacatcctggagaaaatggctactcttgctaagtcattttttaatataaggaggtccatgtttgggccttgaaattaatttcccttatctcaccatacaaatagccacagtggcttctttgatttattacctggaatggttcagtggcactaaaaacagagaacaagaagacatcacctttacgtggcatcattagtcacagctttaagagcatcgccctgaagggacggcttccccagccactgaggccttagtctgtcctcctcctgtatgctggagacagcagcccagccacagagcctgccttgtactacttatttcctggtaatctcttcaaacagccattcagtctttccttactggctttatagaaaagaattttatataaagtaaatgtatatatgtatatatgtaaatatagtcctccattaaaggcgagttaccaactgggagaaaatgttgttaaatcccatcttgtaaaaaaagggacacatacactagatacagtaccctgagaacgctgaagaaagagctaactagtggaattcatagatggcagagaacatgaccagccatttatcaaagtgctatactgcaggtgtgtgagcatattaggccatagggagctgcacacattgtaagaggcaaaggggcagaggggcagagagagagaggcagggagagagagaagcagggagagagaggggcaaggagagaggcagagaggcagagaggcagaaagaggcataggcaggggaatctcagagcttggggcctacctggtctacatagtgagtttcaggccagccaaaaatacataattagaccctgtcttgaaaaatcaaagctattcttggggctaggaatgtagcttagttggtagaatgcctgcctggcatgcaggcagcaggaagccctgcttggattcagtctccagaatgacataaaagcaggcacagtggtggaagtctttgatcccagctctcctgaattggaagcaggaggatgagctcttcagggtctttctcagctacagtaaggccagactgtgttgtatgagaccagccttaaaaaaaaaaagttatttctcttactttatggtaaaatcgtgatagaggacggtggagatgatgtcatggtgaaattgatccttatgtgcttactgacatagctggggtaaaggcttcagtgtgacagctgcagcaacgggagacagggtcttgtgtcttgctggtggaaatgtaagagggcacggccagtttggaaatgtttctttaaaaaaggaaaaaggagggggatgagaagggaagagaagaggagggggggagaggaagaggaggaagaatgctgtcacattgccaagcattgatgctctggagtgtgtgtgtgtgtgtgtgtgtatctatgtatatgcaaatatatacaaaatagtgcgtgagacatcttaaaggctttgtgcatagttgtcccaagctgaaaacatcactaacattcttcagcggatgagcatgtgcaggcaccccaggcccctctacaaagggttaatgccaacaggaatagtgaggtctgaataacactcagaccctgatcagaacagtcttagaggacactggtgaggaacagccgcttagagtgtcaccttttcattgctgtaacaaaatacctgaggaaaacagattagagcaggaagctctgtgcattcctgggcctgtggtgaggcagaacctcacagctggaacatggggcagggaagggtggctcacttcagagcccctgggaggctgagagggaggaaatggaagaagagaaaagggataatgtctgacttcccaggcctcaccactacttcttccaactagatcccatctcctaggaattctgccatctccccatagtgccatcaggtggcaaactcactgggtgtacccatgcatatgacatccttcaaaactatagtgatagagactttgttgatggttgacaggggcaaggggaagaggggagaatgcagccatgatgggtatcagaagtgtagaagaagggagtgagtggccttctcattccccctgatagtactggtgaccctacaagtatgtctgtgtatcaggtcttacacaatgtgctctttcctgccaagtcaccctagaggtctgaacttctgcacatggtctgtaatctgattttgctctcaatcactgcgatacccaggacccaagagagcaagttagggaaggaaagggttcattggcttcaggttataatctatcattgagggaagtcaaggcagggacccagggaggggacatgagagcagggggagctgtggagaccacagaggatcagggctgcctggattgctgtcctgggaatttcatgccccaccctggtgccccacatcatccctcactggtggtctctggtctgtcttacatgctcagtagtgtggatgggggaaccttattctactgttaattgtccccacttggtagagaggccctggagtcaggaggtgcacattaggggagccagccttggtcttcggttactactgacatctaatcttggatgtcattgtcattgacccacttactgaaatagcttacattttctttatcagtgtgatggtttgtatatgcttgggccagggagtggcgctatcaggaggtgtggccttgttggagtaggtgtgtcactgtggcttttagactctcatgctagctgcctggaagtcagtattctgctagcagccttcagatgaagatgtagaactcttagcttctcctgcaccatgcctgcctggatgctgccatgttccccaccttgatgataatgcactgaacctctgaacctgtaagccagccctaattaaatattgtccttataagagttgccttggtcatggtatctgttcatggcagtaaaaccctaaggcaattagggaggccctcttttctgttttgttcaaactacttgttaagaatcagtaaaggttttaagtattgaatgtacctcaggatgaagaaggagaaggatccctgtgagttcacgaccagcttgctttctatatggagaacagcccaggctacatatagagaaaaaaaggggcggggagcaaacgatttgaataactcctctccttggggttatattccaagactttcagttgatagtagatataattcttatccttgcatactttttgtctgtgatagttgatctgttaattagtgaaatgaaagaaagatccatgatatggtagtaaaatagaatatttctaagagtatggtggcataaaagtcatgcctgcctttgtcaagggctctcggatcctttcaccttttcttatgtagaggaagtacgttagtgtttcctttcagcatatccaaactgtcaggctcactgctcttgtgtttgggggctgttagtaagtgatgtgagggtctggcaagcacaagcagtatgatgtcatagtaaatgaaattgcttttcactgagtctgatgggcaggtggtgtatacagcatgtatacactggacagaaaagagcatcctttctctggtgtgatggagcaagatgccctgagatttcttcatactgctgcagttaacatgcagtttgaggtgtgtgaattgcccgttcgtggtgaagcaggcctttagtcctagcactggggaggcagaggcaggcagatctctgggagttcagtgccagccgggctacatagtgagttccaggaccacaagggctttgtagagaccttgtttcaaaaagaaaaaataatctcagaattcgtgagttatctttgataagttcctacttcatatttttagatgactgtagactacaagttactgaactgagggaaaggcagacatcagattcagggatctacctatacctctcctactttgaaataaagtgaaattatagggccatctctgaccggagctgtggctcactgttttcatcagtttgtatggttatagtatgcccctaaaaggaataagtgttagaatccttattataagtcagttttttacatattaccgagtaccaccttccaaatttctttgaagacaactttttgggttgggttgggctgagccataataaaagtaaaaaaagcacagcaggaacatgtacatggtttacccagggcccaaggcatcttttaagaggcaccacatatgtttgaaaccactaacttctcactacagccgtaacaggtgttgtcagagcatcgtctcctctccctacttcatgtgtgaggaaagcagcgccgagtagagcactcccttgcctgcctgcagggaagatgggcagcatggtcaccatctcccacctaccttctcctttcccagggaaatatcttttcctaccctgtgcgtgggctgtggaaaacatcaagaagggtttatagtgtcctttcttttctgtagccagagatgattttgaatttgtgccttgatcattattagcataggtaattagaataattggaagaggatgctcattatccagtggctcctgaaggaaatagcacaaaataaaaccctatgcggggggctgggagagagctccgttgggagggtactcgcccagcatgcatgaaacgctgggctcatccttggcactgtgccaaccaaagttgatggcacatgcttgtaatcccagcactttagaggtggagtcaggaggagcaaggtcagctttggctacatagtagcttatgaggccagcccaggctacatgagaggctacctcaaactcacaaaaacaaaataacccacatggattctaaattgcacctaccagaatgtcttcacctacctcttctcctaagatgctactcaccaaaaacatttctgttgctccagtcttacagatgaggnnnnnnnnnnnnnnnnnnnnnnnnnnnnnnnnnnnnnnnnnnnnnnnnnnnnnnnnnnnnnnnnnnnnnnnnnnnnnggctgcaacatttttctgatactttaatgtgtgtccttgttgctacattctatattgccaccaatatggcaacttgaaacatgtccttggtaggttgtgcttgtgtaggtccggaaggctgtgtgcttaggagatcagcagacataggtgaaggtcttcgctggcttgggttcttgctgaagattgtttggtgcggaggtatggacttcatggttgaaggttctgattcccttgccgatcgtgaacctgatccaaggctgtacccatctttagagtctcctatcatctcttgccccatgaccagctagctcatcacaaagaagccagtgacagtgtatccgatctttcttgcacttctgatctctgacatcttccatctctgatctccaaatgccagttaaaagggttcacgtgatgctgagggccccttcagataagctcctatctcacggcctgctgatcatggccttgtttacagcctctgattccctcagcatcaacaccgctatagtgactgatgaacttcctgggaaggggtggcaatctgtcctggaggtctgaatgtgcacctaggctcatcttagaattctgcctaccctgttacatggtgacttgaacaaaggtaaagacagaaacaagagctagcctgaactagttatgtttccatagtaaatatgtaaatgctttgataattttaggaagtgtttcggtttccgccatcaagatgtgttttgcacttactagaccgtttaataatatgcatatttgtgacctgtgtatgtctgtgtgttctaagagaacaagacgttgtattagttgactggagagtggtatatcactaactgttcagtaagtgtctcttttctttgttatctctgttccagctcccgggaccttccctctgcttcttttcttgtctggttccttctctgctctatcttaactatcacctgctcatagatgagttcccagatgacttaatgccattagggtaaaatccaggcagtggttcaagttgttcttggattgtggttctcttatctttcttagtagcaggtctctgcctgcatcttagctctcactccagctggactgtgtggggtgtcaggaaagggaggttcagctctgtcccttctcatcgcaaaggcccatgctccgctcgcagtagacacgaagccttctgtgattgatgacgtgtgaattcagagggctccagtgccggagaatggttaatgttaccgtgtgctgctagaatctgaagctaaggcactcaggaggtcattgctaaagcagttgctgtttgacaagaacctggttgacaatcataaaacactcagagatggagactctgcagatggacgttgaggggagcagtgtctacattgtactacagaacttggggtgcccccaggaaggaggcaggtggtgagcctaagtatcttgggttggcccatggttcatagcactaattctacttttttttttccttcaagaaagggtattattctctagcccaggctatccttcaactcaccaagttggccttgaacttgctgtcctcccacctgggcctttcaagtgctaggatgacaggtactttttattcagagttttcagtgccctacctcagacaccctgtctccttccattcatggtttgtttcttgaggaagccatagcaaagacccacagaaaagctgtggagagctctggagcccaccatcttagtacccttagctgaacctgaacacagtaccaccctctgggaagtaagcattcaaacccatgagcccagccagaccctgatttcctctgaaaactggagagatgattcccaccgtgcaggctaggaggatagtgaacacaaattcttgatgcattcttgagcctaaaagatactcttaacatgatgattaaactgaactctcttaagaatggctctgcacatctggaatggggtgcagatattcattttaacagcagatcgttttaaagtctgcagtagatgataagattgctagaaacactctgctctagctcctagcaccttccttccgctgcgttttgatgctctgtttaattgatttttccctccttataagttaaatagggactgcctatgttcacatcttttgtagataagcacatttcacaatgacacaacgtggagcaaagcttatctgactttctttatgattcagaaggcactttggaacctgtaaggcctctgggtttttactaggaactccagttagcattttattgtagctgttcagcagcattggtttttagccagcttggaaagcaacctctctacctctcttccttttcccattcagtataacacgtgctctaaaaatagtcaggttcagtaattccagaccagctcgcttctgccagaccccaacacacttggtcaacatcactgggttgtagacctgcatgccctggccagtgatggagaggacttgaactagcagatgtagcagcaccatgatgctgaagaccagtcctcagggattgccattgcttttaaaggattagaatttgttccagtgtggtcaggccgggagctggctgagaccaccattcttccatagaagaatggtggaattgaccaccgaggttaccttctcccatttttttttttaattccaacactctgggccagtggttctcaaccttcctaatgctgagaccccttaatacagttcttcatgtggtggtgacctccagctgttatattactttccatgctactttatgacttcaattttgctgctgtacatatctgacatgtgggatatctgatgtgtcacctctggaaagggttgtttgaccagtcacaactcaccagttgaaaaaccactgctttaaagggacacaatcagtgcattcattctcacgacaggttggacattcttagcaaatctgatgtggcaagaatggagggaactttgggtgtaaatatctgttgtgggtgtcattcccacacagggcactatgttactactgttgcctttcttctgctggccttttacttctcagagtgtgatttagagaaacctgcagtgccggttgttaccgtagcctagagtgagagcccagtctgggatgaatcctgtccatgcgccttccataccacaggacctatgagactgatgttcccccagtcatctgaaggatggggaccatctacatggtctgctacagagcactccatacacccagtttctcctctaaactggagctggctactgctcagctcgaaaggaaatgtctggtgcatgggaaataaatttaaaccatgagcaaatgcttgcattcttatttttatttgaaccaaaattaatattcaaagttggaatgccgttttcagagatgctggcattatttggttagattttgaggtgaagtatatgaaagtgattatagataataaataccttttttaagaaatacttattgcagaggcagtttttccactgttaatgagggcaatttgacttggttgagggattgcagttcttaagaattaatgcagtaatccaattcaaagatttaaagagatctcagatttttcacaggtcgcgtgctagcgaatgtgctgctatccgatagcagctaatgggcttgaacgccagcctgtcatttactgtttctctccgcgcagcagctttgcccttggtagggagtgtactttctccaggcaggttatttagaagtgtggtgtatttgtaacactttggagagagtattctattacccaaagcctctaatgactatgaaaactgggggttatctttcttaattacatgtttgaaaccaaattgctgaaggtctgatgaatactgggctcagaggagctgcctccttgccttcattttcctatgaggtccttttattttattatttatttgatatattttttaaaaaaactaattcatgtatcattgtattcacgcgtgtgggttaattttcacgaatgcaaaggttgcaggcgttatgggcctagctttgcatttttgataacagtgtatttattaacagctaactgagttctgtgaaggcttatttgtaaaggatggtgcaaaatgcccctagttcctgatcctattatgttctgaaatctcaagaattccatttgaaggcaattagaagcattcaagtctccccaagtgtgttgttccctgctgttctgcgagcacaaggacctttgttctttaattagagagaggactagagctcattaattgttgtttcatgcagtattggctccaacaagaggcaacaatgcattgcaaggtaaagtccacctgtaccagggtggctctccgagttcaccaggctgtgaaaagataaatggggtctctgacaggctctgcctctgacctgaacttttctcaagtacctagctggctgtttatcaatcttgagaacaaaatgtcttttagatgccaggaggcatcccagcttctgtagaaatctagaacttgacttttgttgaaagcctatcttcttccagaaagcaagccagctaggatctctttgcagctccttagtacgtctgtgaacactgcctagaagccttagagcccactgagtatgggtgcattgttaagaaacttcacagaaacagttactgcaatgatttgtagaccaatttttactgctaccatagccagagggtgtacaaacgaaatcagaaggcctatgctgcagcagttacaacagaggcttccagttcccacagaagcaggcgtgtcttctgtatccaggaaacccccacctctagactgatccccagtgcacatgactgatgaatatcaaggttgcagggaagaagaaagatgagcaactttatctccgcaaaaacatctcaagacatcattgaatggataaggtttttctgggactgggctaggatggactgttggggatgtcttgaaataaaaggctatggagaatcggatatgggggcatgaaattgggcaggggagcggtgagtttcatgttccttttcattctccctgagaaggggtcatgtgtctgtcaggtggctaactccagaaggactcgggatcctgggctttggtgaggtctcctctatcaagccccttaacaattctcctatcagtgtttgctctctccttccatctttgctgaagcatgaattacttgtggagccataaagctcatggaagacattgttaacaagagggctttgcttcataaaagaaacagggaccagggaactggaggcctggcatcccagaaaaggtgaatatcgaaaccaaaatctctcccccagattccctacctgttaaggaggcacatctaacttgctatgtatggggttttttgttttttttttttttccaccagcaattttttttaatgttgtatttctgggggaaagaaaaatagattttaaaatgtaaaaacctgttcttcaattgagtatgcaaaaatctcattgcagtatttattccaaacctgctctcataatgttcagtcaaggagaaaacagcgaaaaacagttgttgatggacttagctcagaactggattaaataagcattagtctactggagctgattacaggaatatgaaaatgtggtatcttaatggtacatatttttatgtggcagctcagttgcctttcattttgcagctaatatgtctattcttatgagtcatttacttccttaattaccttttgcaggcaaggcaccatggtatattaatgtgaatgatttttactgccagtttatcatacaatgccccagaagttgaaaggcgtaattgacttggaagaacagctcgtgaaggaaacaatatttagttgacagttttccttgtactctctgttgacgtttatgagtttacactatgctaaaggagtcataaacacaattttctttcaataacagcaaagggtagcttctaaaatacatttgtggaaaacacatttgttcatttcttgaataatgggaaaataacacatttccagtgataagacctctccgattgccaattgaattaaacctttgaaggtatatttataacctgtctcccagcattagaagagactaggattcggtgggggattgaatcggcttaatgaatatttaaattatacacagatttgggtaagtcatatttaaatctaggtgtttggggtgagactgagcagccctgccagcttcctgaataaaggggaggcgggaagagagcttgggaattgggaattgtctggaagattcttctctctgaagggaaagaaagtctgtcactacattttgggaaaatacaagaaggcacaatgggggcaactccttataaggtctggactttgaacagttaaaataagcctccggtagctttccctagctctgcagcctgcaaggatggcttctcctgaactcctcttggcaggttccgccttcagcctgcttctgcagccccccccccccccccacacacacacacacacacacacaccggggcctgtgcagactctagttttggcacatcggttcagagggagttaaactttgtcagggttttctggattgtttgcagttcagtcctgtgcaacataatgaaagttttctagccatctgttgttgagctggcggtgagcaaggccagtatatccaaacaaagtcctggccgctgtaaactgaacctgtcagcttagcatagctctgctgacccttccagctcacagggcagcccttggtaccaggcactcactgctgagagctttcaaaggggaactattttgggggtaggcagcggggcctgtttactttcccctctgtgtacctctcgctggctcggactagtttatacttagtgtttaaatggacacttctcctccctccgttttcagaggaaggactgacttcttgccaagggatttcacttttaggaaagggtgtaaatgttgataaatacgtgtgaggcggtgatgcttcaaagggatattttatgcaagtattttggtttcattagtttgtctccaatgtttgaggaacaaatcacccaggcaaagaaactcctgcatttatcacacagcttatagcatttaaaactgtttatggctttgaaaggacttcttactcctttttttgtttttgtttttgtttttttgttgttgttgttgttgttgttgttttgtttccttctgaaatttgtatttcatcgtcctgagttaatgcccaacattacttggctaagcagaacgtacacaatgctccctgctctatggaagaacaacctccttgtttgtactcatttatttacagtgtatatcttttgcctcaaattacgtagcttaaccttaaaacctttgtgtaattttctggcaccttttcccttctgcagcagtgaactattcttgactgtatatgaactatccttatacccatggatcccgtttgtaagcatgtatatgtatatttggacatggatacctgtatatgtacacacggcaatgacttacatagctatgtgtatatctattgcatgtataaagactattcagtcatctttataaaccggttcctacttgacctttgtggcttagtgactatgacatacacttacttcctgtcatgcactgattctttttgtgacttccattagaagtcagccatggggagctgtcaccaaacctcggtgtccatttcaagccattaaaacatccagggaatgtggccaccactgttgaatggccactccgaaggacttcttagttcctattaacgagaagcagatcccaaggtcacatggcaaaaggagaggcagcaaagagatgcacactcatacaaagcacctgtgtaaaggggccgagactctacagtcaaagaatgtgcaagagaccggaagtcataagtgggggtgaggcacacttaagccctcccttctaagacagtggagtgttacactagtgaacaaatatgcaatttaaaatttaaaatgaatgtgcttatttaaaaataccatggaattcttatctgtttagaaggtaactgacatgtaaagtgctctttctgtttttattttcctaagtgtagtgttttgggtggaaatgtcaggaattggatagtaaccttggtgtttaggatactgccttttggaacatgacgttgtatttggttgtgtgtccttattattatttttttagaggaggcctgctttaagaggtcatctattagctgtgttcttgctgtcttaaactcagcccttctgtctattaaaatcaaaccactatgtaaacattccagtgttgttcttagtctccacaatggccacggggatcgggtttcacctgcctgcacatcttcaagcaattaaagcaattagtgaagccatttcacattcaaagactcaaggtctatggtgacattcaagtccagcagaagtctgaaagggggaaaggacaggcctgaagcgtggctaccattccatggccctgagcagacaatctctctgctaaaaatggtagctctttaatggtgttattatgaggtttttaaatgacatctcaaaagttgtttacatcaaaaaagcccaacagtcatttaattatactaatgaaggccttcttacttggcagatttttttttaaagacctttaatatccaaagaaatggaatgttacttcttgcatcaaagtggaggcaattgcattctttgtgaaggaaaaatgtattttctaatctataagggaaatgcatttcacttttatggcaaacgtcccttgtttgggggtaaattacaatcatgtggaatatcaaagtcttaaagtttggggagaaaatgttggaagcagcttcttcgtccttttgttgttggtgtcagggaatagcagaggaaactggcttgtccgagctagtgcaatttaaagcaaaggttcagccctgaatatatgacattccatggaatggggcagaggtgacctgagaaaaacagcttagactctggaatggaatgtgctgtttgtttttttgtttgcttgttgtcttgggaatgtaagcgaaatcgttttagtgtaacctggaaactatgtccacaacatgtcatgctgctttgaatgaagaatttgttttgacaaaataaatataaacatgttttgacttaaaggggattcttgttgtaaaagtaggaaaatatttacaaacagtgtgaatgtataacgtgttttgactgtgagcaaaacagaaaaatatttatgttaaaaaatgtgcaaaatatttaccccaaagtcaaacacatggcaagcctgatataccatgtgttgacacacccaaagagtttaaaaactgaacctggacagtggcccctaggattgtactgccatgctcccaagacatgccatctagaactctgggcctatcctgttgcaaagggactttgagactgacccctgtgtgttagggttaggggctaggggttagggtcaggttgggcgccattgctgaattcacacatgcctaccagtgctagccactggccaatgttctcaagtgctttctggaatttccaacagtgtcatcctcctggctatagttcaaggaacctcttggatcaccctcaccatacaggattccctagcaaaagcctgaagcatttcctcctcaagggtctctatccagctctttgagatgataagactaccgtaatctttataatagcacagtttcatagggaatgtttttatgagtacagttatcacagtttgaaaggcagatcttatgtggctattctaactgctgagggagggcctcacagtctaccagccttgctcctcatagtttgtcttcacagttctatctcggttatccaggaatcctgttggtacaaggcaaactgtaaactcattacagcttggaaaattgtgttgtgcatttttaaacacatattttattgttgcttactatggacagcagggagagggaggcagcaataataaaaaatcctagcatcttatgaaaaagtgaatctcacttcttcagtcccagaagaaacaattccaaaagaagcgcagggtaaattgtgtagaattctgttgtcctttaatcgggctggttctgccatttccccttcagtgtttattaataaacaactcaagcacagaactgttcaaagatgtccttttctgttgttataggcattgactttaaaacgaaatatcattttaagaaaaatgtacgcctttaagaaaaagtcctttaaaattttttatgcccatgaagtagtccttgcaataatctctttaagaaactggctgagatggcatcacagctcctaggggtgaaacagtgacacatctctgggactgaaggaatctgaccatgtgcatgactgtaggtggggctcttgcagtcagttccttgcctcggcatcttagagtgatagtcccatcccaagttggcttatacaggagccttctgaatgcccacctcccctgggccagcctgggtgctctcctctgctacttctgggaacagaaagagcctggcagtgcggtatagcatggggaagcctgggcatgtgccttcctttctcccctgccccttgaagcacattgttagcaaatcctttgtaacctctgcaaatggaccagcccggttagagaagaaactctgctttggacgctccaccctcatgcagggaagaggcaggcttggaggctcaagagggaggtgaggcagaaaacccagattcatcccattcccccattccgcacccccttcccctcatcccgtttctgtgatctgccttttgaactgtttttgtggctgatcagttccacctaatatgtctcttgatttctgctattgtaatactcgggcgacatgctgttctcttcatttctgtaagctttagatgcttctgcctgtcatatcctggcggtttatcttcagcgtctggatttgctttcagacttgaatgtctatcaagctgccattgctttgaatgtgacatcaaaagaagatgaattccagtaaagaaaaaaaaaatttttttttccttctatgaagaaaagatcggggcctatgtaaacacctccctgacagctcccaatgagttattttagccgagtattagcacctgcctgacaggcaggccggcgttccatgcttaataacaagtcagatgcttctgtggcagggggactcagccccaagagcaatacattttaggaaggaagccttccgctgctatctccttgtttccaattgaatatggctgttcgactcttcctcccagtcttcaagctgacctgctacacctcccgtggttcactttttttttttttttttttttttaatggtacctgtcaggttctactggtgactgaagacaggaccttgataatcagtttaggacagggtaaggaagtgggcaactgggtgccgtacggtacccagtagtttccctgatagcagaggagaagaaagacaatcaaaccagagagcatcaaacctaggatgctggatgatgtgagctttaaaagtgtatgtgaccaaagtcctctaaggtcgcaagatctggattcattctctctctctctctctctctctctctctctctctctctctctctcatactgtctatgtaaatgtcaccacaaaaatatctcaagagcaggtttcctgaaggcctgttggtgtgtacttgcctgcgtgcaggagctgtgtttggctagggtttggtctacagggcacaccgtgtgtgctgtgtccctgcttgctaccctggagtgagttaggtgtgttgaacattaatagatttctttaagtgctctctgcaactttgaaaattacctgcaagctccaactgatcttccagctttgaaagtgaagaattacttgaggaattcttgtggtttccttgtcattgagtgagaggccaggcagctactgtggagacgaacctccccgaggttgcctacaaagggcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntccttcccgagctcctctctccatttaggctttttttttttttttccgtcatctttttcttccttttttttttcccccatagagatctgagaggagggaatcctgctaactccttgttaattctctcttgatttcacatgtggccttggctctgagcaggaagaatcagccagtgttgccagacacttccacgggctgaacgtagcctgtaactttccctctgcgtgcctgtatgtgccgcccgcttcttttcttcctgttatgctatctcaagttctgagagagtgtggggacagtgcctgtgacactctgcagagttgttctcgggggttgacatcatgacaccgtcatcacgggcgagtcggtcttgataatatttgtaccaatttcatgccaataaaagtcagactgccgaaacacgcacggtcattatctcattcatattactattgtttaatcggagaaggctgcaaagggagagagacagcctgccttgcttccagcagtggctgttaactttgatattggaccctcttctgaccattttcactgtgggtaattggggtggcagcaagctccggcactggggttggcagagccatgttactctagggctcttcaggagaaatgactttcaaacacatggtatgagctttttaaaaatggttccaccttttcctgccctggtccaccctctggcctctcttccctccctctccacccctctccccctgttcttcagcttcactgtaattggcaagccaggtgctatttttttttttttaagctatgtactgatgagggaatagacaggaagtagaaaattggctcttttgatcttaagagaattgctattattctgaacttggttagtcctcagactaaatatccataaacttcaatgttttcaacagtatctgttaatagagaaagaaatagaattttcatacttgtccagaccatctaataggagaaacagccacacaaataaacaagtcttggtttctgtgtgtactgctgtgtctgagatggctgtttttaatgtccagaagttgttctgctttgcgagggggagaggggcgctgtttgtgactgccttaaggacaatttgtttaacagtaggagtaattgtggggaagatggaaagagtgagctgggctatttactcagatggtggagtaggtgtgggggccgagcagcagtgtgggaacagtgggccgctcagcctgctatctcagcctgcttgatgaccggcgcatttcccagctcgctggttctgttttttctggatggcatgtttgattatttatcagaagggaagggaggcggtgaggcaaataaacatgtgaccaacgtctgttttgttttccactctgaaagccatgccctttaccagatacacagaaaataataaatgcattgttttagcataaaaggaaattatacatgtctatttttttttaaaaaaaagacaactgagttaaccctttaggctcaggagcttgctctctctttccttccttctgtctgtctgtctgtctgtctgtcttttaaatttccttctgatactttgtcatgctttgtaataagaatgactctattgctttgtatggatacagtttctcgggatgatttgttcagtggtttgtagatgccttcttcagtggcatcagactaccacactgggatatgttgtggctcactttaataggaaccctcccatagtaataatgaatagctgttagagttgtgtcgaaggcaaacatatttatttatttatctgtcagtatttgcatactctgtctggtactggggattgaacccagggcctcatctacattgctcctctagctgtatttcatccataccctgtttgggagaggggttcaatcccaaccctgaacagctcagctaaagacacatgcatcttcagtgtctgcggctagtgaagaagagagtttaatgccagccagtcgttggctcctccctgaaggctgtcacatgctgtgagacaaaaggtctactagggcctctgtgtccatcaaaagttccttttagggctggaaatagttgggcacttgcctagcatatgtaaggctcaaagtagaatccctaacactgccaaatggtgtgtgtgtgtgtgtgtgtgtgtgtgtgtgtgtgtgtgtgtgtgagagagagagagagagagagagagagagagagagagattatgctatataatactagtctctgcaatcatataatattttccacagttttaaagattgttatattcttccaagtactccagagtccaagagaaagtcccaagcctaaatccagtgtagatttaaaacaagcctgctaatattctctttgtattttattctctcagttttcaagtggggttggcctggtggcctgtggacattctctgggcataggtacacctgccagcaccttctgtagaaaaggaggcagggttctcaaagatccaccctcactcagactcatcctgtaaccgagatgtgcatggtcctaacctggtgactggcccaggcagaggcagccctgtaaatcacagctgaaatctgtgtgtttgcctatactgtttgggaatgtgaacggaaagtatgcacacagagggattccctcttcattgcctatataagggaagagtgcagccaagttcagatacagcatggcttccacttggctggccctgccttgagcttgggagcggtggggagctttgcttctgggaaccagtaactcgtttgcctccccccttgtcatcttgggtactccacaaaggtcgttgggttggataatcatactttgtagttctacagagccctttgtctgtagaaatcaaagtgcctgactaatgtgaacttgttgatactcggaacacccttgggacatcagttggctgaaggtgatcccacttttgaggtgggaaaaacgtcctgttgttaaaatagtttacagttcccgggtgtgtctgtgtgagtgcctagactggacctgcccatggatgactgggagagtaggagaaacatttttcccccttcagacaggctacttctgactacagatcacctcatgagaaaatgttctggcttgaaaaaaactggcccacaaagtatagctaatttgtgatgggatgggaacagacaataaggccaggtcctgctaaattctcgtctatttatggtcagagttggagtgcaattttttaatttttaatagtcaatatagctgaaaatcttaaactaagaatgttattggagacttaaccaagaaaaaaaatcaagttggtgtgtttgtggagagacacaagcctgttagctatgcaaagttgtaatttgttatgtgttttcgtttctttgtggctgaaagatctgaacccctttcattcaccctggatgttctgagtgactgaagccctgggctgtagtcacctcctttctgtggctcccaagcaccgtgtaaactacttgcttgaatgccactctctctggactgagcctcaggtgaacagaatttgcagtatgtggtccattgttatgtgggtctcaagaatgtttgttggaacctgcatatacaaattagatttggaaatctctacatttgagaagtaactttcaaaggactgtctggattccagtttggcttaggaagctgtcttgcagcaggctctctagtattgacagtgtgtcccggggcaggtggttgtgatctgcttgagttttatcttttatttcctcgcccagtcacttctttcctgtgttaattatgacacaggttctgtaatttattcccatccttactgataaagaagctaaggcccaggaaggttgagtcacttgctgaagctcacacagctagcaggtggtaatgcagggtccaggtgtaggcacaatgagtgcttgtcacttagccagcctgggagctgcttctgtggagacatgttaatgttgtttaaaaaaaaaaatagggttgcctgattttagacttgtgatgattctctcagggtcagtaattcccccaaattcccaacgaatcattatttcttcatgcttggatacccaagttcaaccatatgctaaactgtggttcctgggagttccagagaacacttacactccctgaacataactgttagctacggagcaggcaagcccagtttagattttaatgtttcttcagtttttattttaagcagtgtcccactgtgtcacccaaaattgggccctaagcctaaccctaaacctcttatcttggactttggggtactaaggatattaggcatgtgctaccattacagatttgtttgtttgtttggtttggttttgattttcagtttctactttttaagtcctgtgtatttgtgggggaggaggagtgggttgtgcgttcaattcagtgcttgaggcctgaggcatcaggttctttggagctggaactacagatagttgtcagctatcaatgtgtgctgggactcaaacttgcaccttctgcaattacagtatgagttgttaactcccgagccatcttgccggcccagcctggtctgttttcatttttcttccaaagaaagtttttgtttgtttgtttgtttgtttttaattctttgagcaatagctccatgtccaaacctccccaacccctgcccccaaatgtagttttcttttgctgctttccatatctgccataaggatagaatcttttaagaataagttcactgtgtagttgcttttgagctggggagaaggatataacacagtggtagaaagctagccgagcctgtgtgaagttcagattacatccacagtggagggagggaagggagggannnnnnnnnnnnnnnnnnnnnnnnnnnnnnnnnnnnnnnnnnnnnnnnnnnnnnnnnnnnnnnnnnnnnnnngaggcagaaaggaaaagttgcttttgagaaacatgttttagtatactttattttacatattttaaaaggtgtgtgtgtgtgtgtgtgtgtgtgtgtatgttgtactcttggtgtgggtgtgcccatgggcacgtagagcccagagattaatattaagtaccatatttgatcactctactctttgaaaatagggtctctcactaaacctagagctcacccattgtctgtaaaactgaaccaaagacctagggcatcttcttgtctctccttcccaaaccctgccccaatcactagggttccagacacataccacctgcatgcctcttgtgtaggttctagagatccacgcttgagtcctcttgtttccatgaaacatactctattgaccgagccacctcctcagccccctcagtatactctaaatgtgccttgattgttcttaaagtagttccatctccatgtgagtgtaagaaagccacatccatgcattttggggtatagggtactccctgaggtgctgttcttacgggactatgaagggattctctctagtcatgtaatcgtggccacaagatgtaaagcagtttcaaaccaacctagatacagaattggcactccggagcggatggataactgatgcccttaatcctccatcaggtttccctggtagtgaggtcacctttctctgctggcactcactcctaggccatcatattgtttttctaaaggcatctttgctttttactaggcacataaattcttacatgtgtgcacagtgctgatagtgtctattccttatgcgatcaacttccaccaggttctgggctgaggcctttacatgtgcaaatcaggtgatctctacagtttcatcgctctctgtcctgtcatctgctaactgcacatagtgagagcttgtgaacagtgagaatttaatgtagtggtgagtcttcactgctttgcgcttgtttggtgaaaacactcagcccttgcattgctgtgagggaagtgatttttgttatgcatggaataagatctgcaaagtcccagctggccttggagttgacatgcagccctgggtgaccttgaacaagagcttctgtgtacaccactccgttgctgagattccagtcacatatcaccaggcctggtctaggtggtgctgagaatcaaacttagggctctgtgccagcgaggtgtgaactggaccaactgagctatctcccctggcacttttgaaatctgcttctttgtcttcagtgaccaagtctgaaagcgatgtaaagaatgcagatatttaataattcctacctccaccactatatacattcacagacatatacatggctccatatttatatgttcatttttacatataattataatattgtgtgagaatatacaatggattcaaactgagggctgtggcagacatagtggcacatattttccatcccagcactggagaggcagaggcaagcaggatgctgattgtgagctctgccccttctatataatgaattccaggcacgccaacatacaaattaattgattaggaagaatgtgacacctggtctagggtgaaggcttactatataaactgcttgcaaaccatacaagcatttggacccaagctcatgtcctaaaacccacataaagtccagtgcagtggccagcatttgcaattccagagctgttgtgtcaagatgggaagcaaagataagagagtctctgcaagttcaagggccaagtaaccgggtccctatcttaagtacgagccatagctggcactgagggtgtccacccacctccatgtgtatgctgagctgcacaggtacccagactcactcacatgaatgtgggagagagggagagacaggcgtcatctgtgatcactttagccctaccttgggaaagggctttgttgttgttgtgttatttttgtttttgtttttaattctgaaacgtagttggatgtggcagtgcgtgcctgtaatcctagcactcaggaggcagaggcagatagatttctgtgagtctacataattagttccagcacagccaggcctatgaagagagaccctgtctcaaacaaacaaataagtaagtaaatacataaaaagatttaatctttttgagaatggtgtacatggacactatatttaaatcatttccaccactttctcttcccgtgcccttttactcccttttgaattgatggcctcttcctctatattactggtacacacacacacacacacacacacacacacacacaccctcccgactgaaaccattcagtgttgctcttgtatacatatgtataaggatgaccgcttggaattggataacctatcaggggctcatcatacaaaactattttccctctttcagctgccaccaatggcctgtctttcttcatcttggggtagaacatgtagaattcctcccatccacattggcaatcagagggtgctgtcactaggtaggtcttgtgtaggcagccctattgttgagatttcatggctgcagtatccccaccgccgacatgtcaaggacacactctcttgcatcctgttcctggctcttggaatcttcccaccctgctcttctgagatgttcccctgagccttccacataggacttgcattattgtaagtgtgtcaattggagctaggcagtgcctggccacttctttacatttgacagctgtgggtctcggtaatattcctcatatcctgcaggaagcttgttgatgaaggatgagagagatgactacctgatttttgcaattacttctcaaaagaaaatctttttaacgtagttaaaccaaaatacagatggcttgtcccctcacccctgttggattgaagaaggcctggggaccgagagacaggaatgtctgaatccgtgtcctcagagtaaatgggtggcacaaggtgaccaaagaggcaagaacagagggagagagtgacgagtgtgcctgggcttctgagtctctgtcccatgaagtaggagcatcctagctgctgcttggatcaaagcagtattggcctcctgggtatgaggatgtcatcgaactctgccatgcggaactggcttgcaaacaagggcaggtagagtggagatgggtgtctggtgacctgggacagagaacaggaagggtgggtaggcctggcgatgcgaccatcactcttgagcatcctgggaatgaaaagattgggtacaaaagaggagcagatccttttctgtggggaacagaagggctgaggcgttcagagtgtggcaccacgaggcagctgtccctgccctgaacacagaaggaaccaaggccactcctgtgtttttggctcccaaagacctcacatgcgtgtgccaggactcctggtcaccaccgtcttggtgctaatcagtgagcttggtgcagtgtgactatctggttctctggaaacaaggtttgtttgtttttgtttttctgccctgccactcagcacatttgcgaccttgagcaagtcacatttctttgtttttccactttgaatcaagaattataaaactttccccacctcccgacagtggcagagaacagtagataaaacagcgggagaaaggaacagcagagtggccatggcggctggcccctgtcaggagctgttgcatttcagcaacgctccctgagtggagcctcccagtccttccctcttcatttccagagcctgtcttgtttgtgcctgtggtgccaggagtagaactcacagcctttttgagtaagtgcacagtcactcatctgccttctcagccccttacagtgttacccatacagagtcactgctgctttctttatttgttggaggttggaggagaggaggaaggggagacagggtttctctgtgtcgtgctggctgtcctggaactcgctcagtagacccgggtagcctcgaactcagggatcggaccgacctgtctctctctttcaagagtatttaaaggcatgtatgtgcacccccgacctggcatccctgctacactgctgctgctgcttccagcactgccttgggaagtacaagagacaggagagcactggggacctctcctctccctcagacactccatctttggttttgcttgggcagcaattcttctcattattggttgtgttttcttcctttgttttgcttgtcttcccttttaaaaaaaaaaaaacatgatttatttatttttgtgttatgtgcattgctgttttgcctccatatatgtctgtgtgaggttgtcagagcgcctgaaactggagttataaacagtcgggagctgctgtgttggtgctgggaattgaacctgagtcctcgggaagatcagccagtgctctttactgctgagccatgtctccagccccctgcttgttttctatataagtagagtgctgatatccaaaatataaaaagaactcaagaaactagatattaggaaaacaaataatacagtttaaaatggggttcagatctaaacagagatttctcaattatttgctgccgtctcttccttttcctcctcgtcctcctcgtcctcctcgtcctcctcttcctcctcctcctctttaattcagattttaagcaagaaaaagaaagcctatgggaagcaaagccttcataggtgttagctgcctcttgggtatcctgagtgtgtgtgaagaaaaggaatttctctctctctctctctctctctctctctctctctctctctctctctctctctctctctctctnnnnnnnnnnnnnnnnnnnnnnnnnnnnnnnnnnnnnnnnnnnnnnntttctcacctctctcttttttctcctttctttccccttctcttttctccccaccctctctctatatagtaaccgtgtttctggtcaagttatggaaaatccactatgcgttcaagcactctttagccagactcttcatcaggcttcggcattaacaaatctgagtctgaggccccagaagatgtgaatctttattagtcataatgagtggctgggacacaacctcataaaaagcactggtagaaaacagggggttaatatcatgagttatagatcccgtggttgatttatgctcacatctgacccctgtattttctgtcttgagcaccaaggaaggactgtaccatttcttcagtctggactttaacaacgggagaggtaggcctgatgcaacatccaagctcacgtctatttacttactttatatatttttttactgtgtgtgaatgagtgctatatacataggggcacgagctgttctgtgtgtaaggtcagaggttgatgctaggtgtcgtctttcttctgtggctctccacgttctttctattatcaatttacatttggcattttgtctgcctatgaatgtgcaccacatgcatgagttacagttgtaagtcaacatgtgggtgctgggaattgaacctgggtcctctgtaagtgcggtcagtactctaagccaactaagccatctctccaggccccgtgttatttcctgagacgggctctctaactaaacctgcagcttgctggtttggttgggctagcttggctggtgagtttcatggatcctcctgtctccagtgtctggattgcaaacttgagcccctgtatctacctggcttttgtgtaatacttgagctctggcctcaggtcctcatgcttgcctattgaactgtccatccatctctctaatccccatgctcacactttagacagttcctaataaacttgaatctggtattctaccctagtgatcttcacgttgcctgaagtcagtagcccccaggctgtgatcttgttcagctcccatgagttcagcaagctggggcttgggcaatgcttaagtggaatctttccaaagacaactcaggtgcaggagccttggcgcgggtgactcagagtctggcatgggctccagtagagaacagccagccagtgctccagcaaggtggttataggttcctgtgttcacaggaggaggataggctggccttttccttctttctttctgtctctcttatgagacgtcaaataggcttcctgaatgtttatagccattaaacttatttcactcaattttgcaagaagatcacagattttatttttatttttttaaagtctcatgaaaatccttattctttggctagaagtatcctctgtgtgccttccaaataaaaaagcattagtcacaatcactggtgaatacagggtatgctgctccctgctgctccctaggtcttctttggggtgtggcttgttacagaaccttcctcctgtctggccttctctctctctctttctccaggtatctgcaggtggggtctcagtggcatttgagtttccagtgaattggggcttgctgctgctgtagcagcagcatagaatatgtctctctttcctcttcttctgtctttcttcaaaataaaataaaggcacaaatatcatttgctttcttccatcttaatacaatccaatctaacgagtagcaggtaaagaacaaagctcctgcctgttgtgctcctgtgtttgggaaatttgttaaagtctgcagtgaaggaaattgatgatgctgatgatgctgatgctgatgatgctgatgctactgagatggagctgtgtcctcatttcacatgtttgtattcatagtctctctttgtcttctttgcaaagactatgggccatgggagagaacccacacaggatgccctgcctagtgatttactgttgaagcatgtactggaaccttcggagactttcccagcagtcaggactcttgtgaagaggatgctgagagaatctttggcctctaaataattaggtccatgtggagtgtgcactctgccccagatccttcagatatgtgacttcactggattgactacacgtggctgtttgtccatgttccctgctcgagtcttgtagagtctactttgagtcaggtttgagggactcctgagtctctgggacatggctgttacctacccagacttgtagggaatgaattttgtttggttagagcattggtaacaggatctcacggtttgttgaggactttcttgctctgtgtctctaacacttacacagtcacctgcattgccagcttttcttgccatctaccatctccccgtcactggaaggctgttggcaggtcagcttgctttcccattgttcagtgatagccaaaggctccgtttataatagtcagcagtgtttttaaaatcgtgtttggacagcctaggcagatggtttagtcagcacagtgcttgccctaggaagatgagggactggagttatgtcccgtgacagtcacctaaaagtgggacaaggtgtgtgttgtgctgagaggtcatgagcctccagtcccatgagaaaccctgtcttaaaaataagtgtgtgtgtgtggggggtgatgtatgaggacactttatgtaaatctgtggcctccaaatatatatatgcacacataggcaacacacacatgcacagcacacacacacaaactaacacgaactctgcatacacagactcacacatacacacacacactcacacacacacaaagacacaagcaaacccctatttggagaacttgctgcttcagaatgctgtctgctctgtagatattataagctattagggtatgtgtgtgcgtatgtgtgtgtattctcctgtggaaggatacaggagtgatggaaagatgggttttcccacaggctatctgcagagtagtgtccatttgtgacacctggtgaacactagtcttgatagtgacacttgttgagtatacttaaaaccagtagtagattggcacaggtcgggaaaggcttgctagggtggacttatcgtgaaaaaatgtccacgatgtcttgtctgtgtctgtgtggggctgggtgtgagtgcacgcgcacaagccgactgcccgtaatggtcagaagaaggcatcaaattccctggaacttgcgttacagatagttgtaaaccactgtgtgagtgctgcgattcaaaccctgttcctttggaagagcagccagtgttcttaatcactgagccatcccaccccagggtgtgcagtgacagtttactaacctatgaaattatctgagaaacaggttttgtcttgagggctacagagagcccagagagaaattagaggaaaggtgaaccattctgacctacttttaaagctgcaagaggaaaagaaaagtcttagcttggattacaaacctacacaaattaacagtctagtaccaatcggagagattgaaaattacccaatgagaaccccacagactcagtagtttatctcagacttttgacagtttcggcctttgaagcaggtggatgtatttctcctcaagtctgagttctttttgagaaacagaagtgattttgagttcaagatcagctaacacacttgtgaatcccaaatgtaaatgatcttggagacgggacagatgcataaaaaacttcctcaagcacaaaagccagagaaacacacaaacaaacaacaacgacaaaaacatcaccaacaacttaaaataaggatcaaacaaacagagaacagacccgagcaggggttgctgcctccctcccataaagtaagaggctgtgtaggaaatcactactaaaatttgaattcaaagtcaggatcacaggtggcgatgcattcctctcactttcccctactcctttgaatgagtaaaatgtctgcctgttttatgaacagaccagatgatgggcaagatctgggctacaggcgacagtgtgtgggcctgtgaccccaaactttgtttttggaaggccctccatgtgttaatctcatcagagacccctccataagcattttctgcaaagtctcttctaaagggttcttttcctccttccagcttgctgtacttatgtgtgtgcttgcaaggactgtgttttatgtaaacatgttagtagttccttaaaagtggtaaacatgtttttaagtaccggctaccttgataaacatgctaaactaggattacctccccattcatctaagcacctgctatgaacctgagacacaaatagctcaaactccaactccgtaaacatgctgaagtaaaacatcatttgtatgaagcagatggcactcagttacttagaaagtgaaggcattgttgagcgtggaaccatcttgaatccagagagggaagacatactgcaaatgcccaggttcctggttactatggaaatatagcctggcaaagtagcatcccatccccacagtttacttttgcaggctctgtgtagacactcagagatggccctggaccttgatatctctgatcccttttgcagatagggccttagaggagagtcaaagcaaaggggcatccggacagtctgtctaggtgaaggttttgcatgtgtgcactccctttctctaagttcacagggctatttctaagtgctggctttatcagctgcttctgctgggtgacaccctccaactgagtctttattgtaacctgatctcagtgctcaaataagcacagagtcatccagagccaggcaattgtcacatcttttataaaggaagtgttgattcaacccagcccaggaagagccaccaagagtaaaaggtctccagagatggaattgggccttttaagttatttacattagtgcttggcctggaacatgagccagaagcgctgcgcgctgtaaagagaagttctttgatttattcatgcccgtgcacataaacgccctcacctcctcttcctctttctacccctcctgtcccttcttcttcctcatcttcctgtgttctccatccctccctgtgcacagctcacatccacacacttagtttatcttcagtgtgtctagttttatcttccagcagcacacggaaaatcttttctccagttgtcactgagacactgttaggagagtaggggctgccctttcccatcctctatggtactagaataaagatcatctcctgggctggcgtcctggaactccagttaaaggatgctggtgtatggtgataggaattgtggatcaaaatggcgaagtatgtgtgaagctcatataatcaagtctgtgggacagtctttccaaatcttcctcagatcagctgtgaacaaacatgaccccactcttttcctcactgcctcagtcctaggattacaggtgtgtactgtcaaacccagcgggagccataatcttaagcattgtgagcattgcgaccccctttactagattgtacagatttagatagtatggaatttctgcaaagcttcccttagtggctgatttcaaagtatattacacattcagatcatcaggtcttaaaatttttgttgaaacccagggtggtttttggcttattttttgaatgcgatatttgcccccacgtttgctagcatattcataaagcaagagagtcatcatgggatgtttgtaacagttctatacatgatttataaatgatttattctttgtaccagtgttcttgaaatatgtaaaatttctttacttatttttattcttttgtacactgaaccccaaaagccagcttgtacagctccgtctatcttcagtaagcttaatgacatttccttgtggatacacctgttcctatagcccctgtgtgtgtctgtcttcctttctcttttgtagtgaggctacctgtgaaatatgggagtctggggctcattatatgagcagataagttcatgtacccccatggtgagtcttaaaaaagacatcacagtattagcagtgtggctcagtggataagaaccctcactggccacacaggcctatgagtggagttgagtctctagaacacatataaatgtggaaggagagaactgacttccccacaaaaagtcctgacccacaagtgggtactcacaatcataatgcatacacatgatgatgatgggtttgttttttttttttttttttttggtttttcgagacagggtttctctgtgtagccctggctgtcctggaactcactttgtagaccaggctggcctcgaactcagaaatccgcctgcctctgcctcccgagtgctgggattaaaggcatgcgccacttgatgatgattttaaaagacatcaactgtattaatcacctttcccccacttgaaactgtcagagtaagcctgaggattcctactgtgtacactgaaacacacacacacacttgtacacacacacacacagttgtgagaatcattatatatgtgtgaatactatttcatagatatttaatattttccctttggctgggggatagcttgggttggttttagagacttcagttttttaaaagcctaaaagcctggtccctgagtttttttttttttttttttttgtaaatccaggaaaatcacatggttggttgtggttttctttgcataggtactgcaagtaggtagccttcctctccccctcccccgccccttgtatttctctacaataccttttactgtctgctacagtcccactgtctgcttccacctcacagcaggagcgtcctgttgggattagcctttacccggagattctttggggaaggctagtgatgtagaatagtttcctgtcctgcctgaaaagccttgagagctttatgggaaagagctaagggagccatagtaggggaggcatttgctcctgccggaaccttgcacaggggactatttttcttatatgatataaatgaaatcttcacgctgcccacttttccgcccacacatgtactgagcgtctccaaggagacaaggaaacccagagtccagcgatggtgaatcctccaccaagacagcaggctggagtctcaggcaactctcccaggcggcttgcctcttccaactgcccctctcagacagcctctctttcaagcaggctttctcgaatgtatctctccctttccaggcaaaggagcctgggcattccttatggggaccctggggtgagttcagtagcaggtggccagcctggaagaggagagtagatgccagtggtggtggcagaggcaggctctacttaggaggacaagattgttccttgtttccttgcctgtcagtgcttctgtttgtttgtgctcctctgtgccacttagccacaaagagtccagaaagttcttggtacaacagtcccttgggagctctatggagggagcttgccctaggagtcagtcctccaggcgcaggactgtccctccactgttcctcacgtctgttttcctgtgtacaggatatgttagccgcggccttgtgactcagtgttgtgactatattctcatacctgcacacgtcactatccaagtgacctggctgttcttctctgaggaagcggataccatggaggtctattatggtcactttccaagcccaaagtgtcagattttgtttgaggcattgaccacatctcttccgtggggtacaaataatttaagttgccacattaaaaaaaatatgtatatgatgtataggtatgcatgtggcttggtggttaagagcactgtctgctgtcccaggggaccctagttcagttcccaagacctaccttgtacagctcacagtctaaaatgactccagctcccagggaattgacatcctctttggtctccaggtaccttttcatatatgacacacatgcatgcacacacactctctctgtctgtctgtctgtcttgtctttttcaggcacacacaaattgaaattacttaatctttagaattttgatgatatgcattacttccccttttttgtgagtacgtcattttgtgagtgtcctttccatcttccacacgtgggcactcacttctcatctgagtagaccccaacattccgacttcccatgggattttctggcacagttcctacacaccttggtttcctatggccggtcctcatctcatcttcacagagctgtggcagcctgctgttattctttcttttttcttttgagacaaggtttctctgtgtagccctggctgtcctggaactcactctgtagaccaggctggcctcaaactcagaaatccacctgcctctgcctctgcctctgcctcttcaatccaagtgctgggattaaaggtgtgagctaccactgcatgacatttttttttgagatttatttattttatgtatatgggtacactgtagctgaacagatgtatgtgagccttcatgtggttgtagggaattgaatttttaggatctctgcttgctccgaccaactctgcttgcccaggcccaaagatttatttattattatgtataagtacactgtagctgtcttcagcgccagaagagggcgtcagatctcattatgggtggctgtgagccactgtgtagttgctgggatttgaactcaggatctttggaagagcagtcagtgctcttacacgctgagccatctcaccagcccggtctgctgttattcttatacttacttttatgacagtgaataatatctcaatgcttgccttatcggtgtagctaatacttctttcctcacttgaacttaaaaaccgggataggggcaccctgtcatccgttcagtctttggaggtctcctttgcatttcttttttcttattgccagttcaccccgcttctgtaactgctattttggaagtaaacctcaatacttcaaaaagcttgagaggttcatttagcctgcttggcctgggttcctagtgaaaactttgagatgaccccaggccacctttgctaagctttcctttgattttatctctgtctgtcagtctaggtaggttagcccaggctggactcaacctctgaggaggaccttaagtttctgagatactttagagatcccataatcaaaagttttaacatttagaagaagaacatctatgtataatcagtgtgctaggaacaccacacacccacacccacatatacccccccacacacacagacacacacacatacattcattcatacacatacacatatacacagacatacacacagacacacactcacaaatacacatattcatgcacacatatactcacacatatacacagacacacatagacatacacagacacacactcacaaacacacacagacacacatactcacagacacacatgcacactctcacacatatgtataatcacacacatacacaaacacacatacacacgtgaacatatataagcagctaaggatgaccttgaactttggaaccttgagtttccagctcctaatttcgaggactgcagtgtgtgcctctgtggccatttcgtgcagtactggaagttgacctggggctttatgcatgctaggaaaaccctctgtccctgagccatatcccagccagtagcttttcctcttccgtcttcaagggaggccattccatatatgcatccatctgttctaagctttctgtgggaatagctatttctatgatggctcacattcctgtggtcccctgcctagctctgtctcttcatttggatgcaggtatggtgaaaagagagaaaacttgaattctaaagttcccaaaaagaatccagtgggacgtggtctgtccagtaagaggccttccgtgtcctctgagcttcaaatttctctcatccctcctgtctcctctctgatatctgtccccacagtgccagccattcctacttatagatgtcatagcagctatttagtggggaagaagtatcttcttgcgtacgatactgtgtctgaggagtcatgggtaatttcgctaaaccaaaggaaatgtaaacatattctggtgagttttctctgtggactggcaagaagatttgcttgccatttcttttgctgagaaatgaggaaggtgagggtcatatctgaaggggttttcctgagatccacttcgtgaggacgtctccagacctgtgtgataatgaaatctttcccttcattttgtttttcttataggccctgcaggtggcaaggcagctcctccttcagcagcagcaacagcagcagcagcaacagcagcagcagcagcagcagcaacagcagcaacagcagcagcaacaacagcagcagcagcaacagcagcagcagcagcagcaagttagtggattaaagtctcccaagaggaatgacaagcaaccagctcttcaggtagcggtcctttttcaaaaaatgactgtcatacccttcatgtggctgagaagccttgcagaagtggatattatcgtgaccattgcaaaccatctaaggaaaacttgcgcaaaatgtgtgtgtgtgtgtgtgtgttgtagtttatgagatgactatgacatcatgagaaaagtctctttgaccagaagtttcttttttgtaatgttgggaagaatccagcatgctagggggttcgtgcatgaataacaccacactgaccagacccatccacctgacatcaccactgcacctttcctggcccatgtaaccatttttcctaccttcaagttgactctttctagttttcacaaatgggagggagcaggcaatacttgcctctctgggtctagctagtttctcttactgatatgccctctgtctccaaccattttgctacaaatgacagacagctgtctctctgtcctgtgggagaaatgactccatcgctgttaatccactgacgataggcacgtaggccaatcccatgtcttcgctatctagggttgtaccacaacaagcacaagtgtttgaggatcttgtcagtatgccaattgttatttattttctggtgctgtgatgaaagtactatgaccatggcagcttcgggatgagtaagtttatttaggcttactatccaagggatgagagtacatcttggctgagaggcacagcagcaggtgtcagcaggaagttgagagctcacatcttcaaccctgagcaggaagcagagagtgatctggcatggcatggtaaaagatctttaagccagacttgagtgatgtaattcctccagcaaggctgaccaaccacataaacttccacaaacagcgccaccaactggggaccaagtgttcaaatgcctgagactgtggggcacatttcacgttcagaccagcacaactgatttcatttcctttggccgtacacccaggagtcctctatctaaattatatgatggttttttgttgttgttgttgtcattttaggattctcatacttaatttgaaggtctgactgtcagcatcctttttatagtggctaggttaatggactctcccattgacaacacataaagtttcttattccggagacatattttattcctaactagggcaccagggtgcagagatgtttttaacacctcatagcctttggatcaagggagctgttcaccattccactatgtccaacatgtcctccagaaagaagtgccacttagcagctccacatgtctgcagtgtcaagagcttctatttggttccaggagggtgcagtgcttctgctctcatacccggtaatgagtatagtagaacacatgccctccttcactaaatgttttgcggaatgtttctcaatcattaattgaaagcagggagcaatttttatgaagtgataacaaaagaagattgtttcaacaacttctcgtgtcaggcacattgaggccaaaggggttaatagagtagaaggagaaatgagttcatcaaatataatttggatttgggtcttggaatagaaaaatgtggtataaattttttttttaaaattgaggcagggtatttaggcccatgtttaaggtagaaggtaggtattcggtgctcctcgccccaaatggaggccaaggatgggtttctcactggaaattttagaacagtttgtgatgagcaatagcacaatgtgttactagtcagtatgatctacacatgtcgacttcccccagggttagaatagactaataccaatttctaaacaaccctgcacatgtcgtcctgtccttgctaagccaattctagctttcctactgtgccagggaaactgtccctcatccaaaaaagtctaaccttatagtgacaggttattgggcaagttgaatatcagtatgaactgtttacagactcttctgaagacagctgtttagtaaactaccagcaactcgcaccctcttaaggctgtgtgggtgcgggtgtgcgagacagttataatgaggtgcagtgccatggagggtggatgtcaggtgttgtaagaagggctttgttgtgcagatgtcttaagaacagctcaggaggatgaaatatgactgtgttgacctttcagcggtgagcttatttgtcaggattcaaataagttgaaaggatcaaactgaacagtttccttagtcagtctgggaattgtgtttcaggggtcagcagcggaggccacattgcagattccataacatagccaattgttggtacatattaaagtaccagggcatctcctgcagacagagacacaattaaaattctaatttattaatgtatacagggagctggcccagcctgtcactcagtgattcaaatgcttgtccattctttggccttcctcttggagcctctcacagccttgagaacactaggagtcctgttgaattcagcaggccttaagtgcattgggaaatggcaatgtaatgttggtaagtgcagtttaggtttgaagttttgaaaaatatacaaagatattgtccagtcacagtgttggagcaagtaaaatatcacttataaataaaagtaaactagatttgccttcctttgtatgtgtgtgtgtgcatgtgtgttgcacaccaaagcttgacagtgagtatgttactcagtccagctccacaagattttgcttttgagacacatcaaagtcttagttggcctggaacttgcttctgtagaccagggtggccttaaactcacagaaatccccctgcctctgcaataagggttgacaccaccatgccaggcactccaaattccttttggagacacagtctctcactgagcttggctacaccaatttaactacgtggcttgccattgagcttcagggatcttcctgtctcctcccccccaccccactcccaactaggattgcatatgtacatcgccatatttgtacaggagcgctgtgaactcaccccctcatgcaggaaaccctttaccaatgatctgtcactctagccccagaactccctcttaaaatgtggcatttagggtaatagtattggttcctttggtgtaagtaggtatgtgatatatagtctcaggggatttccttttagttctggtttttcttaaccattaaagtttttagcagccaatgcaaaaatctgactcgcagcatgtcatcatcgtggctagggcaacatgtgagccctgagatgtattgtccacttgagtctgtacagaaaggatggaaggagcatggctgtcagggaatctagtctgctgaggacgaggctgagcttcccctaagctcagtggtagaattgacaagcagagaatttgcactgacttttaagggttggcgcttgcctgtgttcctctatatgtgtatatatgtgtgttgtgtttgtgtcctgacctattgctggacagtcacttaattgcataagctctgttagtggagtcttgccttctactaacagaaaggagaaattactaagctcagtcacatagtctatcaccttgttataaaatgatgagtgtaagtcgggcgtggtggcgcaggcctttaatcccagcactcgggaggcaaaggcaggtggatttctaagttcaaggccagcctggtctacaaagagttccaggacagccagagctatacagagaaaccctgtctcgaaaaacaaaaaaannnnnnnnnnnnnnnnnnnntattcaaaattctttgagtcaaatttccccaagtaaatggtttcttttaaatagaccagaagggctcaatggttaagggtgtgggatgttcttccaaaggacccagtttcaatctccagcacccacatggcatctaaacacttacctgtaactccaattccagggtaccctaagccctcctctggccactggaggcattgaatgcatgtggtgcacagacatatatgcaggtaaaatgtccctacatgtgaaaatacatacaaaagggagggaggaagggagggagggagggaaggaggaaggaaggaaggaaggaaggaaggaaggaaggaaggaaggaaggaaccagatgagtgtccactatggtaacccactgagattctccttctgaaatccaacagtgagaagaacacttggctccccattaaagtaactcaccaagcagctggctacagtgcctttatgttgtttaaaatctgttttaatgttctactaacataagcaaataacggtgattcagtggtgagtgcctttcccaccctagtgagccaggcttgctctggagtgtcacccaggatgagcctccccaccccacgtccataaccactcatcagaggtcaccacgttagtgttattgcaaagtgataaaacacccttccgggcattacacgtctctttcctgtgtaatccttctaagcaaactggcaagacccaaaatagtaatcatcaagtctaatgcagaaaattaaggcttttcagttggtgttgttggaacatcttaagttgatttaggatttctgtacacagtattcgtctgtggttgaaaggggccacgctgaggtcaagtgatgtagtgttttccatttttccatatgagcctctcagtgtgtgataaaagcggactcctttattttgtaagtctgcaagaatttctgatgaagtcagaggtcagtggcgttccctgtcagtctgagcagcttggtaactactgggttttctttatttctctctgtctttccctctccctcttcccccctccccatgtttgtggtgtgtgtgtgtatgtgtgtgtgtgtgtgtgtgtgtgacttttcccctgctctcaactccctgtacactgtgccacttttctgacacatgcccagtgaggtcctccaatctgaaactcattagcacacagccttggaccctgtccagtggttagaagatttcctgaagcctggaataacagcattcggtataacgccagggactacagtgacaatgggggtagttgtgtcccctggcaccctgcctggtcaggaaagccagctgacctcaaaacacagtgagacagaggtcacacatatggtatggactcacaaactttgatcctggaaaagtctcttctgaaatcatgggcatggcagccttttccctccactggtcacttctgatgggtttgcaatgtcgtcgccttcgtgagcggcaagaacatgaaagcaattagagactatgaagcccggatcctagtttttacttctgaaggtagtggctgtaatccttccttcatgcatgcattcatgcttttcaaactctattcacttgaaagtcactctgtcgagagccttgccctgacctcagaagagttatgctgcgggtcaagttcacttaagctaggttttcagacaggcatctgtccagaaagagaactgtaatgataacatatactgaagggttgtacagtcctttccagcaggcagctactccatagcaggggaggcttatcaccatgtctgttgtatatgtgtgtacatgtgcacatacatacacaggtatgtgagtgcatgtagaagccagnnnnnnnnnnnnnnnnnnnnatgtcatcatcgtggctagggcaacatgtgagccctgtattgtattgtccacttgagtctgtacagaaaggatggaaggagcatggctgtcagggaatctagtctgctgaggacgaggctgagcttcccctaagctcagtggtagaattgacaagcagagaatttgcactgacttttaagggttggcgcttgcctgtgttcctctatatgtgtatatatgtgtgttgtgtttgtgtcctgacctattgctggacagtcacttaattgcataagctctgttagtggagtcttgccttctactaacagaaaggagaaattactaagctcagtcacatagtctatcaccttgttataaaatgatgagtgtaagtcgggcgtggtggcgcaggcctttaatcccagcactcgggaggcaaaggcaggtggatttctaagttcaaggccagcctggtctacaaagagttccaggacagccagagctatacagagaaaccctgtctcgaaaaacaaaaaaaaacaaaacaaaacaaaacaaaacaaaacaaacaaacaaaaaaaaagatgagtgtacacgtggtgcttcttggaagacataactgtgacattgacgcctatcccagtataccttgttctcttccgcgggtggctcacctggagtggctctaagatgaactggaagccctgtcactctgcacagagtttctctctgatcttctcctttacccttcaagactttgagagctgtggtagcagacttcagatctgcacagaggaacgacggatgtcgaaggagtattcgatctgctgagagcttggatgatgggggaggggtggggttggagggcgggaagaagccttaaatccccaaatatgctgtgcctcatactgtaagcatctctcacacttctccacttcatgcttggcagcacacttcagtttcgcagactgatgagacaaacaaaagaaaagggaaagtgagcagaggctggagatgagagcccaggaaccccagtcaccaaccacatcaccaggagagatgcgcatgcgctttgcgcatgctgaacgaagcctgctgtgcgcagtctcaggacagagcctacttacctgaagaagaaggcttgagccaggaagataggctacttttggagttcttaaccactatccggctcaccatcctacattgccttctttgcttacactgttagtttaccttgcagatatttttttcttatgaatgatagaaatggaaattgagaattggctccatcccaagttcaccatcagaataatttgcattcattaagagcattttggtgaacatctcagaagagccccagtgtgcaggggagctgggatggcgcttatagaaaggacccttcactgtagacacagacattgccttcaggatgctgtgcgactataagtgaattaattcaattttgcttaaaaaaattagaggtgggtaaaaatagtaggctgctttttataaatatttatatacttctgaagattgcttaaacaactgaactaaatgcctaacggcgcaggtgccctcgtaacctccaaaacgtgtggctctcccagctagggatttgtttgccacagatgagcaatttttattgatcaaatttgggaactttggctgccattttggggtggtggttccttgtggttctttaagcatttcagttgttggctggaagacaacactggaaggaagtcaagtgacagtttctcctcggaagggaaaagaacacgtgggttacagcagcctgcaagtcgagacagagagcaagccctgtgtattatttcagtgggaagctgaccacagctccaggctgtctgtacagagtatgaactcaaagccaggcatctggttggttcccctcccataaagccctttccctccaaggctatgtgctctgcaagcccctgacccagaaggccattttttttaacctataaaaatcagtagtgaagccccccttgaggaccagtctttggctcaggactggaaggggtcctgctttgaggttaaaatgcaagattcaacaggtatctgattttatctgttgtttgtttgtttttgcagttaaataaaatgtgacttaggcagggaggttctttgcgttgccttaatgccacatagtatcccagatcatttctatgtcactcaccaagaaataatttgctaagaggaaacacttaaaggaaacttttgtaccaatgagatgggacgattgcagaataccagcccttaaaatatatctctgtgcactgggttaggaaacccagttgattcaggtaattacagtgcatctgttgatcttctaagtgaacagcgcctacagccagcatcttttggtctttaaaacagatgagaaaggttaaatgttgctcccttaaaagactctttctccatacctctggagaatcccaagtccctaaaactaagttttgataaaaaatttaaaaagtagaaatgatgattttttttcttttccagccagtgtttctctttgtagtcatggctggcctcgaactcacagagacccaactgcctctacctgccaagtgctgggattaaagctgtgcactaccagcaccaccaccagcaccaccaccagcaccatcacacagcagaaatagtgattaaaaaaaaaaaagttattaaatcttctagattacacagactatcagaaggagccagagcgatgactcagtaggtacagacatttgtgccaggagcccttgatcctccaaagccacagtggaaggagggaacagaggacacaggaaaggaacacacagagttgtcctctgactttcacacatgtactgtggtacacacacacatcatattcccactgccatccactaataatagtttaaatatatacatatatgatgagaacactggcctttcctcctctggcaaaatagctaggtatacagaattttgcacccaggttttaagggtttcatgtggtgccaggagcctaagttcattgtcctgacttcagattttgtttctaataatcctattctgttcttcagaatggtgacatgagttgtagtgaatgtcccacttttattgaagtgtaatatgaccatgtccctgtcacaacaggacaaccccagtccatgcctgagtatttttattggtgctcttactctcataagtatcctagtgtggacacttatatatggttagtttacctctgtgcacttgaatattacaatgcagataaaatgctaatgttttgtgtcaaactgtcttagggtgattattgctgtgataaaacaccacgaccaaaagcaagttggggaggaaagggttcatttggctgtcttttccacagcactgtccatcatcaaagtaagtcagggcagagactcaaacagggcgggaagcttgagtcaggaactcatgcagagtccatggaggagtgctgcttactggcttactcctcatggcttgctcagcctgctttcttataaaacccaggactatcagcccaagggtaacaccacccacaatggtactccattaaccatcattaagagaatgccttatagacttgcttatagcttggtaatgcattggcatttccttagttgaggttcgcttctctcagatgactttagctcatgtcaaattaacatggcataaaactgtccaggacacaagccatgtatacatcaccagaggcagagtatgttagatcacgaaagtttgttcagtgttcaacgtggaccagccccatagcatttctgtaggataggcaaccgtttcctgaaagagggacactgaaattctgcaaggttagccggcctttccttggaacaccaagacaggaatagaacactgatgggtatagccccttcttccctccatatatattaatatataatatatatatatgttatctattgctcctcactgagaaattatgtcataattcccataaattagcaaatgattatgttttctatattgtaaacagaaatcaaatgagcaaaacccaatttcactgtaaatatctgacttcaaatgaagggtcacttacatctacataatttcctaattacagctgtgtgtgtatgtacttgcatgagtgtctgtgcgttcttatgtgtgtgcacacgtgtttctgagtctgagcatcagggcagtgggcagcaatgaagaagaatgcttccgtttcctcaaggctgattgcccctctgagctgacgtgtgttggaacatggaatactgtgttataatcacggcacgggctaggaggtggagaaggacaggggaaaaaacatacttgactggtcaaaaatgtgtaaattgctgacaaaatgacacatgtaattaagagtgttcctaccattttaccttgtggtttccacctccagtgttgaaaaagagagcgactcccacctcgctaattaccattatcactgaaatgctggggttggagtcattagttccatgtgcatttaattagaggaaggctgaaattggatttaacttattactttttcatggatcactttcttgtcatcacttcaaattggattgcagccccaggtaactaattatgagagccacaggatcaagagtgaaaaaaaaaaggtaattaggaataacactgtcggaccctcgctggtcatctacttgtgctccaggaaagggggtgaggggaacaaaagacacaaccatagttttcagcactacaggctggggagttagagccctgtgtggttgctaagcatcatgggagtgtgtcaccacccatggtggcttctgtgatacacagctgagtttaagatgttgactccacatgatcccactctgggcttttcataccgagattaaacctgtgaaagcaacagattgggcaggggtatgaggcttctcaacgactaccgtgtcatttgaggacctcgtgggtgtgattacagcagagctgtcaaggcacctgtgcaccagaatgcagagcattttaagtccagggagcgagaatttaatgaacgtattaatgttccggagccatcattcatatctggtgggaggactcgtcagtcagcgttacagtgaggtttagagtttccatatttggaggttttgtcaaagtttccggcatcctataatgttcaggtcatttcctctgcttctggtttgttccccttccatacccacatagcccaaattctgtagaggtttcctggggttctgtatctctttccagcctcattgaaaatcccttaaattatattgcttccatgtgtcgaacaaaactcagagctacaagcaatcaattttatagacactgtctgagaaaaatgttgatgacagttagaggatgtgaaaggattggattataaagtccaaagtactaagtgtagaaacggtgtttgtgagtgtgtgtattgtgagtgtgtgtgtgagtgtatgtacatgtattgtgtgtgtgtattgtgagtgtgtgtattgtgannnnnnnnnnnnnnnnnnnngactcacaaactttgatcctggaaagtctcttctgaaatcatgggcatggcagccttttccctccactggtcacttctgatgggtttgcaatgtcgtcgccttcgtgagcggcaagaacatgaaagcaattagagactatgaagcccggatcctagtttttacttctgaaggtagtggctgtaatccttccttcatgcatgcattcatgcttttcaaactctattcacttgaaagtcactctgtcgagagccttgccctgacctcagaagagttatgctgcgggtcaagttcacttaagctaggttttcagacaggcatctgtccagaaagagaactgtaatgataacatatactgaagggttgtacagtcctttccagcaggcagctactccatagcaggggaggcttatcaccatgtctgttgtatatgtgtgtacatgtgcacatacatacacaggtatgtgagtgcatgtagaagccagagatatcttcctcagaactttccaccttttttttttcaaattttatttatttgtttgtttgtttgtttgtttatgtgtctatgtgtgtctgtgtgagcatttaccatatgtcaggaatagacagtatcagactccttagtactagagtcagagaagttttccgggcagggtgcgtgttgagaactgaagtcagggcctctagcaaatgcagcaagtggtcttagctactgagagccatctctccatccctctcgccttatttgccgacctcagagtctctctgtgaacctgaagctaccgatggcaggccagcaagcctcgggggtccttttgcctattgtctctctacttacggagttccggaagccccatactgcccaggtgttccgtgaatcctgaggatctgagctcaggtcctcgtgccaacataagggactcttgactgactcgccttcccagcctgcactcttcccatctcagcgatgaggaaagtgtagcacagacaagtgatcttcccacgcacttgagtgacccattcaggacgcccacccatgtcctttggcttcaccctgaagctgccttgagattctcttggcatggcacacagtgaaggaaacagaatgggtgttggtggtacttggtgctcctcagtaaccaccagaccacacggtctcctaatttggacatgtgtttatgggcatgtctgaaaaatagtgcctgtaattgaaatatgcactttctaaagggaaatgacgcttgagaaagagaagaaagccgggtattactcaaagcctgcagaccactctgtaagtaattgtctaaacgcagccgttgaaattgagaagcagtttggaaaatgtacagtttgggaaatttgtgtttcgatgtaattacggtagttgtgagctgatgtcatgcctagtaactgtttttgtattgcctacgcctttgttaccgagttgtgatatcatgagcaaactattataaacataccatggatatagcatgcttgtgtaacaaaagatcgggaacttttattaagtttgttttgcttgtcatattgtaaaaatttattatgtgtactgtgtatattagaaacagatttgggtaattctgtctaaatgaagtcatcccggctatttccagactgtctgtttttggttgtgaataattttcatacatcagatggttgtcatatttagtcgctctcaagattttaaagagaacatatcccattttgaactttcgctatacttcttgctattggggattgtttgagtttgaaagtattgcccactaaattacagcaaccaaccaaccaaccactcattgttttggaagggcctgggttgctgccttctattcatagcttgccccactcatcaaaagagcaggtttttaactacttaagtagtagagttttaaagcagccaggactcagctgggcagggagcaccagcccttgtcctttttcgttaccgcctagtgaattactctggtacatattcaggtcgacagagcccaacgcttattgggattcctggtaaatgtggacttgaaatgggtagttcgaagtctttggatggctcacaccttctcagacagttccttctacttcctgtggctgctgaatatttaaaaccaggatgttccagaatattctgtggactgcttcagcttttgttttgtttctccccatttttctcacccctgtcctccaaatctggctttcctccggagctggggtgcctctgaatcctgatcttgtgtccatgcatacccgtgttagcactgtaggtcacggcagctgccttatatttggtggtggggaatggcttccagtagcttcttcaggttggagttttcatttcattttctgtgccttttttccccacccccacccccattcacattgagaacccagtttcatcagtatttgatgccttgtttcctttaagtgtgtccctctcttttctcaggaatgcacgaatgacctccagcccttggcaactgctcttagctgcctcgcatgtccttacagaggcttgtctccgggcagatgactctgtctctggccgtattaatcagcagtgctggtgtccttcctgcttctcatctgctctctgcatttcctcacatccaccatcttcccttccgctgctgtcctttcaccgttcctgcctctgtgtcccccgctgccactctgttctggaagagtggcgctgatccataagcatggatccagtcgcgctgatacatacgcatgggatccagtcgcgctgatacatacgcatggatccaggcgcgctgatgcatacgcatggatccaggcgcgctgatacatacgcatggatccaggcgagggctttgtgtccttcgtactcctacccccaaacccaaggcaccgtctctcctttgtgggtatttcatgttctacacgtcactctaaacctttctgtggataccatatgccctgcccttcagaacttaagtggttccccctttccaggcagaccaggtccaaattctgccttccctaactcggcactaaagcaggagccccaagaagacagctacagccccactggggagaatgagagaggcacagaaacgtagaatcctaattgtttttacaacaacgtagagtaagcatagccctcatgataacattcgaaagcgcagggaatctccaactgcagccctcacctgctctctggcctgctcttcagaataaataagcttggtgattaatatgttttacacttcaagaggaatcaatctctctctctctctctctctctctctctctctctctctctctctcagaaagagatggtgtggcccatgacttgagcactctctcatttctcccacttctctgtggtcctatatctcaagactcttcttcattagttagtctatggctgctgtgtggcgtatttcttcccaagtccctggctataggacacactgacatgctcgtgaacagccacttctcagacctaatgaaaccatacttagtaagacagcaatgagattatggctgatattttatttaataacacaaatggattgnnnnnnnnnnnnnnnnnnnnnnnnnnnnnnnnnnnnnnnnnnnnnnnnnnnnnnnnnnnnnnnnnnnnnnnnnnnnnnnnatatacatatacatatgtgtgtatgtatatatatatatatatatatatatatatatatatatatatatattctgctaagagtgctatttaagggattccgggtcccggtcagactctgtaactgactacccatgtttgcccaaggtaccagtgttagaaacagtggtccgctcaccaggattgcccattgaccagctactaaaaaacataccaaagtggaaaagtacttacatttttgtgtttttattttttgtttgttcgttttttttaatcttggtttttgttttgctttgttttgtttctctgagatgcttaaaagattccttaatagttatggaaaccctgccccaggttcagtatatactttgtgtgttttcccaatatccttcagaatgctggagccaattccatttgtttccagcactatatctccttatggtcagatctaaagtacactctgccgtttacctgctttaactgtgtaggatggcgctttggaactcacatgtcccaatatctggaagcgaggaggttgatgcgttctactattaatagtgtggctgcccttgtcagactgagaaatcgagtcctgatagcaagttattcctgtgtggccccaggaaagtaacttaaactccctttctttccattttctcatctagagaatattgctggttaccctgcctaccgaaaggtaattatgaaggttaagtgattaaagcctgaaagtggctcacacggggcttgagaaacagaattctcagaagagacagctcttctcataaccgtgtcttaaagggaaacagctcacttgcaagcctccgggttacatatttcagcttacttgctgttgaccaccacctagtttgagcagtagactggggacaggctctgctgtctcccaactgctaagtacatttgatgaaaacctcaaacctctcccctgagaatcaaaatcatcatagctcctatgccagggtcctattaaaagatctgttgagttaatgtttgcaagtggcttggacagggaagtaacagatacttagtgcagttggctatcatcttggctcctggcgtgttgaattgcctaccctattttaaagactgatgatactcttcagagttactgtggcatttaagagtaagtaggtgattagggacatattcctgaaggcagtattgggacacccctgttttcttctttgcatctgttggtgagtaactttccctggccgtatatttctaccatgttaagatacttgaacacagaccttaaagtaaccccaccaacttgtgaaactaagaggtgcaaatagcctttataccttgtaagttgagtctttcaggtatttcatcaagatgacaatattaattcctgttgctgatactgttttgatgggttagttctttctgtatggcatattatccatgaatgagcatcatgctgttttgaaagacccatccttgtgtcctttatgaactaatgctagatagttttcaaaggcaaagagagttgatgattgacatctcacctggtcattcctgacatgcctataacaagtcaggcagtctgaaaagctcttcaccgtgtgtgcctgtgtgtaagcatgtaccagctagggaacagccttgggagtcattccttggttgaagacacttttgttgttgttgttggttggttggtttgttttgttttttaaagacagtctttcactggcctagaactcagcaagtagtctaagctggctggcccagtgaatcataaagatatgcctgtctcttcttccctggtactggaattataagcacatgccaccacacattgccttttttttcttttctcttctcttctcttctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctcctctcttttcttttcttttcttagcatggattcagggtcaagctcaggtctcacgctagaatagcaaacaggtgaacacctgagccatctccacaatcttcctccgtgggtggttgcgatgaatgagaccgtggtgaattagtaaatgagcgaatgagtgaatggcatatataagctaaaaaaaaaaggtaaattgataaattgctctcaataacgaggctgcacactatctcaggttcatcatcttacagcatcatttcaagacagtaaacagcgttaaaaagatttttaaaggcaatcctgcccaaatctgactttaagggcctgaaatgcatgttgggcagagagtggaaactaaggggcttcttcaccaagaggaggctgccctaatgccctttgcctgcctttataaatttgctaatctatttaaggcataatattaatggtacagaactttaattcacaagcttggaaaattaaaggagactaaaggcaaactacggaaatgtatctggtgtcaagattaagttcagtgaagcatagcgaagataggaaagattattaaatgtatgtggaaggagggtggaaaatacacctaaatctctcattttgataggaattggtttacttgactatttggaatactatcacactcaggaaaatctaagacaaatgcaagcaaaacagaatttaattgagctattattttgcagactttggcttagtttcagacagtctaatcaaattgtgccttgctcaaataactaatgttaaatgcagcctaccaacagatgtttaaaaagagcctaattggaaaatctacatcctggatttagtctgtctcgctggaaagaaaatagcttccaatttatgtctttgaggacgacactcagtgacaagggtcactgagaagacaatgttctcttcaaggaggcttggtgctccagtggaattattttgaagcgtcaaggatggcactttagaaattcaatttcttggaaattctccagctcaatgccatgtagaagcctccagagaaatctcctttatcatatgacatcaccggggtcctgttacacccctggactgtgtcaagggcttgtgtgctgaaatttatactgagctctccaagtcctgtaaggcatacactgattgatggcatttcaaggtgctgtcaaggggtctaggtgataaggctgaccttgcctcctcttctcagtttccagtttgtatatggaaactctcagacctgccatattgcctggagggtctcgtgatctctgccaaaattggatttggttcaagagcagctcctttctttctttagatgaggggtcagccatctttctctgtaaaggaccagatagtgaatatttttggctccgtgggccatactgtctctatggcaactactcactgtgctgttgtcgtgttaaaatgggcacagacaatgcagaaatgaatgaacatggctgtattccagcacacttgtgggcactgaagtttgaatttcaatttttcacatgtcatgaaatacttgacttttgtaattttttttcagttgtttaatgatatgaaagcaactcttagccccaaggccatagaaacacaggtggttgaccagatctgggtatagtattcactgaccagtcctttagaccacctgaaggagaactactgaagacagaaatccagcccacactgccaagtcccatgcattgatacgttttctcaatgctgtaaagagacacctaacaaggagcaagtcaagggagagcgagcttatttgggctcacagttccagggggtagagtctgtgatggcagagcaggtaggagcttatggccactggccacacagtgcgtgcagttaggaagcagagcgagagggctggtaggacagtgatcctgctttgtattcatatccagtatttgagccagtaggatggtgcccactcgccatacctacccgatcagaatgtgtcttcccacctcatttaacacagtgtagaaaatccctcttagatatacccagaggtttgtctcccaagtgatcctagctgctgttaagttgacaataattaatcatcacacccgttagctgctataaagtggggagcagctatgcttggaggaagagggatcttgtccccaacctgctcagggattctgctcacccccacattccctactttctctcttctaaatcctgtgagcacactgcagtcggtgcagtcgtggtagaaattctgttcttacctttggagttgtaggggggatgaccttggatggcagggcaactaatagcccataccatgtactaaaaatccaggcgaagtcactctgtcaggactctcatctgtcataatagcttcataatgtacccgactttatgacaatgttagaaactactgccatctgccagaaaatactttacagtataaacccaagctgtctaaggtaggaatggctcccccttgagctggtggcgtggcacttcttcaacctaaaagacttcttgagggctctgtcatgtgctggtggaatttccctccattgtttgcattttgaaaccaagcatgtctgatttcaacacagtatcttacctccaagtctcagtttcatgtcttcagatgactcgctcaaccctgggagcacagcagaataaatagttaccactaccaaggcccggcacccgatacttgtgaaaatcacaagaccctgggctgtgttggctgggtgagaatgctgagaagtttgtctgtgtgtcaccatggacaggaagctcagtgtactgtggaagagtttggtagcctcctctacatacactttggtgtttctctaagaagtcccagaagtgacgcacaaggagaatgtgcttaaagtcatgttagaggtctgtgttggggtgtacattatatagctcatcttttcctttctataacttcatgcatttctgccttgcaatcagtctctgttctccactttttttctctctctctctcataaaatatattctaaccacagttttcccttctagcaccccctcccccatccactcctcctctatttccccttcagaaaaaggcaggcttcccagagatatcaactgagcacagcatatcaagttgcaataagcctgtgtacctccccttgtattaaggctgaaccaggcgactcagtggtaggaaaggggtcccaaaagcaggcaaaagagtcagagacagcctccactaccactgttaagagtcccacaaaaacccaagctacacaaccataacctatatgcagagggtcagtcccatgcaggttccctggttgctgtttcagtttctttgagcccagcatagttgattctgtgggtttgcttgtggtgtccttgacctctctggcttgtgcaatccttctgccccctcttccacaggattccccacgtaccatctaatggtttgctgtgggtctctgcatctgtttgctggaagaagcctctttgaggatgctaatgctaggctcctgtctgcatggattttatcttttcaggattttttttttctttttcttttttttacattattcctagtctaaccaagttgggaactactgtgtcttgataaaaatcatttacctgattattttttttttgtctgagttctggatacttttccaataagtgttgagactaatccatatctcactgtcagactgcactgctcaggtaaggcatatgtcaatcaaagacttgagtgctgtttacagtgcagactctgagtttgtccaggactttccttctgtcagtgctccataaacaaactcctgttctgatcattatgcaaaatgcagaaagatggaaggaaggaaggaaggaaggaaggaaggaaggaaggaaggagaaaaagagaaagagagagagagacagacagacagacacattgctgtggaaccaggaagtcagactggagctctaaatactgtgcctgtcatactggtatagggcatctctactctatatgtttctttttttttgttttttaaaaaatttatttattattatacataagtacacttaagacacaccagaagagggcttcagatctcattacgggtggttgtgagccaccatgtggtttctgggatttgaactcaggaccttcagaagagcagtcagtgctcttacccgctgagccattacgccagccctatatgttcatttctaatattcctcagtcttcaatgttggttttgcaggttttgaactgagatggtgcaatatcatcttatagtggttttgcctgtacgatctctacagcatcttaggacagtggtccttgagggtggtccaggctgtgggagacccagatactcacctaacagcaagagctcatcttttctttgttgttgttgttgttttgtttgtttttaaacatagttttccgattggagttctacataagagagatactatatcttgctagtgatactatatttcgcttgtgagcacgtgtgcaagcacacatataacacatgacatatacatacatgcatgcataaagacttatcaactgcatttcagacatttcagaaatagtttggtagtagttagtgagttactgcatactgcacccactcagtgccttagtccagatctctgtactttaacaccttcatgtgagggttgaactgggcagaaacagttaccgtacaatgtcataaacgctctcatgaatggtctcagtgagctgtggagagacctgtgagtaggctgctcggaatgtagctagcacaaaggcagaactaaaatgtacatttttatctgattttatttaaaacatttttaaagatttatttatttttatttataggcaggcgtttgcctgcttgtatgtatgtgtgccacgtgcatgcctggtgcccatggagaccagttgagggtggtagattctccggaactagtgtttgtgtgtagttgtgagcctctatgtgggtgcttggaaccaaaccacagtccttttgcaagagcagctagtgctctttttcactgagccatttttttccagtcacattttattttacattttaatagccacacgtggctgacagctactggttttggacaatacagatagagaacacttccatcattgtagaaaacctccatgggacaatgctagtcttggtcccctcccctcttaaaacaatgtgataattaagtccttttgctgagagatggggtgggaggtttctttggggaaagtcgaacctaggacgttacatgtgctagacaaatgctgaggcacttctagcccaaagtgttctcttgtgatgtggcttgcatccgtgcatctctgagtggtctccttcactccttcccaccacatttcctctactcctcattcatcgtgctgttctcagcacagacaatatgcctggaagctctgagagcatctcctaccttcatcttctccccaggcgctcaaatctcccctccaaataagaaagacttgaaagccgtggaaacccagccaaaccccttcctccatggtgaactgcacagaccctttgaaatatttttattgtgcagatttcagatgaaaataagaacttcagaagaaaagttaaaaactacctctcttactaaagaaaaaaatgctttaaatcactgccttccttctgaggccagctgccgcctcctctcactcacaagaggacctcaggcttgggtttccacccatactgcacttcaggtcccctgaggcagagactggcccctgtcatggtaccccgcccatcactgccacctgtcctgcattcttttgctttttctaaatattcatagcttcatagtttcttacacctgttgcccttagaggaagggccactgatcttttattaatgtggtcaaattgatcatcatgtttacatttggaagtagagttacagttaatagctgatgactagtttatatttattttagaaataataaccatatataatcatggcatcaagttcaatggttaagtatattgattgaccaggaaaaacagtaggagctgtcctcattgacctgagctgtcaaattgtgataaagtttactgtaagccgaatctacctaaattcaggcattcttacttactaagccataggaccttagcagtgtgagcccactttctgagattctctgaggtaaataagacaactgatagaattgtgttggagggctaatccatattgttctctgtctctccctccctcacccccctcacacacacacacacacacgcacacacagaaacacagacacaaatgcaagcacacagtattcaaagtgttacctgcatatgcacctgatactctgggactcattgtgatgttgattgtaactgaggtcttacaaccaggagtattatacaaccggtaagtcctcagtatcaggttaggagcagaggactatactgatagagatgacgactagggagtgatctgattttctttttgcgttctactttatgtttgtggaagggaaacatggcctacaaacctcttatcacaaggccgtctagtcagagttgagtgtcctttcttgggaactgagtgaagtgtcactcttcgctgccctgtgacattttccccttcagggagttctcgttgcacctgcaggccatccattctttcacttctgcattactaacattattgactgcacttatgaaaacaaggcttgcgttccataacaaccatcatgacaactttgatacacagaagacaatactgttttaaaaataaaacagaacttggacctttccagaaaatatgagacgattaagacatggaattgcttggggggaagtgtggatgttggtatttatttcataatggaataaagctgctgagaggtttaaggctgagtaattgattctgtcttcgtgattacaaatggatcggcccacgggctagaccattttgcttgtacacacagcggttaacattttccagggttcgttgtaaaggttaagaaacctggaaatctccaattaaattgcaactcgtggcttctctagagtcgcagcaataaaatcaccagagccacttgcattgtctccacagcttgttcctgaagagcatggcatctgttctttccttctgtgttgtggagatggcctgtcccccttattttgtctatgaccttcttcaataagcacacctacaatattgaggcttaaggaattagttatctgtctgtctatttatctatctttgttatttctagggccagcacttagcctttatcctccgtggctgcaccccctggtatacatctgtctgtctgtctctccatcatcatcctctctctctctctctctctctctctctctctctctctctctctctgttatttctcagaccagcatttcgttttcatcctccgtggctgctctccctggtatacattcagtatacattctgtgtacttccctatccagccttttgagatatggtgctcagcttttctgtctgtgtgcagaagtgaccctctagggtaaaaatgaagtaacaggtcattgcaaagccagcagtctatctaagacagttgctccacctctacctctaacccacttataggttctgatattttggtgattatcatagacctttattcttataataacaatgccaatgcttagtatgttgcacagtcctgagacttgggggttgatgtctttgagtggttctgtcttgagattacaggctaagttaagactgaggtgtaattggggcgacaggatttcccacttcagagatggctcattcacatggtctttggcagaaggccccagctcctcatggtgtggtggtgtggacttctttattgtgatgcttgcctaattccatggaacagcatctagcttcccctgactcaggacttattaattctctttcacataaggaatacctaagctagttaacttaaagataagagtggtactgtacaaaatacagtttatactatcactcaggaagaagttagcttggtctacacagtgagttccaggtcagccagggctacatagtgcttccctgtctaaccacaaaatcaaacaaaatggggagggggtttcatagttgtgaaaatttcatcccatatttggggagtccccttcctttggggcctgtgaatgtatcataggagtccatgacatagcaagctttctttctgtgactgagaagtgagaagaggtgggtatctcacagtccccttcaagtaccaatgacttagtgccccacctcagaaggacccaccaacttccaagtgcctcaaacttagaaccaagtctttaacacattggcctttgggagacatgtgcccatactatagcagtttgcaagcaaacctagcctctccactcacatgccaatattgccatcacatctattgtgcacatagaatagcgctgtcttgaaggctggtttaccaatctcaaccttcttacctgccttatttactatcaacacatgaacaagtgccatagcttgtaatgtcttgcttctctcagctgtgcgagccagaaaacaaaatcaatgactaccatgtgatctgagccctggtgagcactgttggccaagcattgtgctgctcaataaaagatctgcctgttactaacaaggggtggccaaagaagagggaacagccagtgggcaaaggcagcttcatttgttcttttccatatcagtgggaaccccgtcgctccccagatccttggctcctagcattagttcatttgtcttgttttgatacaagagtcccactttggttgcctgggttgccttgaaactcaacagtctacctgtcttcttcgcttctcacttggtgggatttcatatgtgcaccaccatgttctgccgttttgcttctagaccatactctcatatcctggcttaaccttgttttcattcacacacacacacacacacacacacacacacacacacacacacacatatgtgtatatatgtatatatatatggaggggttgggggaggaaggaaggaaaacttttgcatgctgatcagattcatgtggaagcctaattatgcggtgactggctttctgtgtatttcccctttttctccccacaaagattttacaacattttcatatgcaaacaggtgtttttgtttgtttcacatcagttacttttgcataatgtgatgagcccatgtacagtaattcatagaaagtgacagtcatctggctcaagtgccctcctcctcacaaccagcctactaaatatagaatcttcttagagccataaaaggcaccaataaaaaaaatatgcatttttaaaaaggtcagagtttccccacccacgaatttggttataaaaacagcaaagcaggtttttggttttttggtttttttttttttttttaacttgaatcagtaaatttttaatttaaatagtatcctgttttgacaaagtgctaaaccacagaagtctctgtagaagatctgacaagcctctgtcaatatggatggcatctccacaggaaacttaggatgacttcctgccactctgcgatgctctgacagggaatgtgggcctttattcattgcatccaaggagtgctaaaacctgctggatcctgattacatatactttactgtgttgtgcagccctctggcagacaacatctgtatcgttccttttgtgcagtcagacaataccaaacagtggacttttgacttttctgaatgtgaacaccaggattaaaggcgtgtaggaccaccgcccagttgcccactttttaatttttggttttacgagacgggatttctctgtatagccctggctgtcctggaactcactctttagaccaggctggcctcgaactcagaaatccgcctgcttctgccttccaagtgctgggattaaaggccactattcttttgaataaagtttcccattggcctagaatttaaaggaaaggttaagcagactccagggctccctactacccttcacagagattataagtatataccgtcatgcctgattgattgattgatttgttgatttatttatttatttatttatttatttatttattgtagatgttgggaatctatctcaggtgctcaccacatgacaaagcaccagtgtcagacagtctccgcagtcccttatcattcttgaatgtgcccatagtcaacaaagaaatcccagatgctctaggatgctttgctggagttgcgcggctgtgccttccttagttttgcatgttcaatagaaaacaatgaattttactgtgaaggtggctgcatctttcttatggggcctcgagggtaaacagccattcattttcatctgtgaacacacatgtagcttgtgtttggtagggtgcctgctggctttggaagtcattattttctgtaatgtctattctccatggttgtgcatagatagattctatgccccagcgctggacgcagaggtagcctatcattctggccgaatgtgttacagttggaagtcagaagcaagtgatgaaccaagaaaatagcttttaattttacacaaactggttttccgtttggctgtggggtagatgtttgtagctcagggtcacgttaagatgccactcacacttcagaatggagtgctcttggagagtttgtgcccacgtgccagtcatggacttggcgagggtggagattgtcatctctaaactcagaaggcaacctttatctcctgaccagccagagacactggagcttagagaagatgatgattccagagtctgtaaaaggaaattagcatgacatttatcaaatgtcttcttcccttgctttccctcgaattcattacctgctaatgacattggtattgtgtgctgtcctattaagggaaaaggagacggttaccttttagggaaagttcatacatctgtttaatacagacttcaccaccagctcagagtggataaactaggacaacaacaggcaccatctgagaggcactgaggtactcttgtccctaggacagttgtttatatggaatcctagcttcaagggtggggttgtaaactgtacagttgtgacagatatcactccaaaccgtgtgcatagctccaatttaacaattgccccaccgtgccatcagaagtcttagcccaggatgaagaaacagattcctaccagcacctggtctgccattattattattaggcaaattaattaataaatgtcttatgtttgttggtgcattccctggaatgtatggattacaataaagtacttgctaacagattgttaaatcatttattgccagactctatgaacgtataattgtcacgatttggcgtactggatctagatacccatcatggaaggaccaaacaaaatggggacctcccagaatgtgccagtcactcagcaaagccgctgatactgtgacgagaagttgggcagttggtgacaattctaggaacccagtagtagtgctggacagagaaaactcaaagccattgggcttttctggtcatctgcaggatttgcaaaggtacatattagtggggaagtaaaaagactaaataaatggaaaacagacagtagttgtgaaccactgatgagctgggcaggacacagagcagcactggttttagtagatttcaacaagataaccaagtagaagaaataaataggccactagttgggagtgggtcttttatgcccaaattgggtacatttaagcaatgattcattttaaagagaggaaatcaaagcctgtagaagatactgttagcgtcattcaagacaaggttaatccatgaataacctatcctgcattttaatgcgtttattctcagtcaggaatttcagtaacttaacttacacagttagatggcttttggaaggggccaccatgaagaaaagctgcattccctagaatgtatggattacaataaagtagttgctaacagattgttaaatcatttattgccagactctatgaaagtataattgtcatgatttggcatagtagatctagaacagaaaagaatctgaaatgtcagattcagtgcaatgggagaaacaagctcgaaaggaactagtgtagagttttcctgtgtgtgtgtgtgtgtgtgtgtgtgtgtgtgtgtgtacatatgaatgacagtatgagacttagaaacactttgaaggtgacccattggaccacaagacacctcagttggaactttcatcatgagccttggtgtatgtatgtttggggcagtgttttaaagatcttgcagaacctaagatgtcttttaagtattccgggattttcatgtatagagggcactttattgaactttaaaatggtattgtaggtgtatcctgataagaacaataaaaattcgtgacccagtcagtctctggcatgtgtccaggacacgttgagtgtggcatggttttagagccttccttctagcagaatgttagaagaaaggcgctgtgcactggccagcatgctttctgtgaagtgacaagtcctcagtgtgatttctggggctcctctcactgcttcctgatctccccatgaaaggaggcacccgagtccatgccaatgtgatgacccagcaaagatctgcaagtgatgggatcagggttggggctgtagctcatggaacctgcaagttcaagggttagcttgcactccgacaacctggccctccgggaagatcctcaggactggctcttgctggcttgctcaggtctgcttcctttctgtgttggcttgttctcactcagaaccgcagttagacttatttatagcttggcaatccttttggtgaagactgggtctcctgcccagtaatctcaataaaagcctctgcatttattgaatggcttgggtcacttctctatcctgatgccctgtgaatgggagaggggaatgaagtgacaggtgagcttggatggtgtgcccactcctgggtctcctgggatggagttggctcccttgaaagtgcatagatccagattagatgtagtagtatccagtaaggtccttcaatttcccttttaaatcttcatgttcctgctagttattatatacatttttctcactcctattatattaaagggtgggtccatactgttccacagagatctaattcatttttatgtggcttccatattatacccatttcacagactactgtgttctatactgttagtattatctgataagattttctatatggataaacatgttctcatggcacatgtatgtgtggaggtcagtggataactcgaagcagtttgttttctcctaccaccgtgtggagtctgtctgtcaatctcaggttgcccagcctagtagcatgctagctcctctcactggcccagagaagaagttcaatgtcctcattgtccaatgatggttgtcattatctaccttgggtgctaagcactttcaatacagctaagataatgaaggaactggtttttttttttttcatcttaaaagtaatcagttgaaatatcagtagtgatatgagactactgtttgtcatattgaacaagtaaggtgtagatccatacccaaataagcttacatggcttttgagacaaatgaagtatctataaacatggcccatgacttaaatgtcaatgtcttttcctgataatatgtaatattcatatgtagcttttcaatcataatttatagctacagtggaaaacacaactcattccagtaaatactggtttatttatttttatttatctatttactacctgttggaacttgatcatcttagctttgtggcagcttgtggccttgccgttgttgggtggtctgaagccatggaaagaatgtctcatttaggcgtcaagagtttggggttctagtctcagttctcccaactatgatttagcaacatgacctttcctctgtcacctttcctgggcacatgtttcctcatgtggaaagtgagggggtgagatgaagatgatctctcagcctgcttgctctcagaatgtttgtggttttgtgattttttttggtcttcattctcgtggtcagggtagtagttggaatttctctgtgtagccattgggagctataatacagggttttgaaagagttgggggatactttgaaccacaggtgaaacgtggaatgggcaaataattttcaccttctttttaaaaaaaaaaaggtttatttatttatttttaaattaggtatattcttcatttacatttcaaatgctatcctgaaattcccctataacctcccatcaccctgctcccctacccacccactcccacttcttggccctggcattcccctgtactgaggcatataaagtttgcaagaccaaggggcctctcttcccaatgatggccgactaggccatcttctgctacatatgcagctagaggcatgagctctgggggtactggttagttcatattgttgttccacctatagggttgcagacccctttagctccttgggtactttctctagctcctccactgggcgccctgtgttccatccaatagctcactatgaacatctacttctgtgttttaattttcaccttcttacagggatctgcagagccccagagggcagatatagtctacttccttattgatgtgcatgtgtgcatggactcctactgtctctctgtctcttttttgtctgtctctccctgtgtctctgtctctctgtgtgtgtgtgtgtatgtgtgtgtggggggggcgggggttgatatctgatgtcttcctccattgctttttatttatttatgtttaatcagtatcagggattgaacctggggcctcagatacgctaggcaaatgctctgtaactaagctatcttcagtccttaccttatgtttttgggataaagttttcactgaacctagagctccattcatggattcagctaggcaggctggccagtaggcaccagaaatctgcctgcctctaccttcctctccctacccccagtactgagatcatagagccgccgttctagctgtcacttgtgttctagggatctgaactcagggccacatgcttgcaaggcaccgttctaatacagaagaaatggagaagaaaggcaaaacataaagaaataatgaacaacttcgtaaaggtttcatctgaggtcatctgttgtgcgcctttcgggggttgaagtcactgcagtgatgaaatactcaagcaagagttttcgagggatagaaaatttggagcttcagaccattttctgtgtcccttgaatattcataattaataatgcttggtaattgtgaaaaagggaaatccagagctgataagactggcctggtaaccaggggagttagggttaaccgagctatttggagtgatttcgtttgtagaccttggatttagaaggaaaagatgaatcacaaatgaagatcaagaggaaggaaagaacactggacagatttgcaagagcaggtaggaggctccagagtgttccaaaggacagtgtggtaggatgcgtcaaaccagtacagagggagccggccatcggctgggactggagaggagccggatgattgtttggtaatttcttcctgatcttcacgagtgacgtgtgatgggtgagttgctctctcgtggtgatgtgacagagctgaacatttatgggggtggtcatgctaaagaactcacattgtaaatagccactcctctgcactgtttccgatcatttagaaagaattgcatctcgaagctgtatttttgctttttttgctggctatctttatgtatgggaacagtcatctctagagattcattttcatttcaaaaaaaaaaaaaaacttccaaaggtgttaattgcattttttgaaaaacccttatgtaattatttaaaattattctaccggccccataaatcagaacttcccccattatatggctgaggaacatttatgacctgtttagacagttttgatttataggtttaggaaacaagaatatagaaaccattgccaggttttaatttggaaatttctgtagccacatttgtttttgtaggaaggagaaacaggaggccaagaggagagatgattggagcactgtggcccacactagtggaacacaaggatgagccgggcagacccctgctctaaagggatgtcactgtgtgtgtctcttgtgtgctttcatctcacactagccatggtccatgacatttcttccatgtaactacaggcatgcaactctatgagtcttaagattcatcttcatacttagacagacattttcatatagacatttcaatatgagctccctcatttatgcattttaagaggcagtttaggtacaggagggatggttcagtgttaagtgcttgccttgcaaggttgagggcctgcgttctgtccgtaggacattccagatgtggtagcacaggcttctcgtcccagttgtggggattccccggggctcactgatctgtcatccaaacatcctcagtgggctccaggccaatgcgagtctcaagagaaaatggtattcttaagaatgacatctgggggtgtcctctggctttcacacacttctgcatgtgaatacacatttaaaacaaacaagcaggctgggcatggtggagcatgccgatagtcccaccactccagaggggcaaaggcaggtggattactgtgaatttcaggccagcgtattctacatattgagaccctgtctcaaagcaaacagtgtttatgaagtgcagcagagcaaggcactgtgatgtatgcctgatgaggtgacttacctagttcttttcagaatggaacaggacatgcttggaaaacatccctgacttgacaaagctcgttgtaatggtcagttaataacagtagcactccagtttagatctgtgaaatgcgggggcagacaaatttagaaatgtgtttgagtgattcaagtaattgagaaaagatagaaaaaatagacattgtcttattgaaggaggaaggcgaagagttaattttgtgaaatgaagaaattttttaaaagtctcacaggctgaatttgtagatcagaatgaaaacggtctttaatgggagtgaatgcaagcccgtaccatgatccaggcacagagtgaagaactccaaggtagcaagcagttcagttcatgtgacaattagtcgaggaatgattgtcaaaggagcaggaaccaatcaggcccagcaggaggtagggcctctgctggaccctcagctggctaacagaataatgaggggggaaatcccctggccctcttctgaactagacagagggtttcaggaccctttcccttattgatggacactccagcaatgaaggaaggcacaggaaacccaggttaccaagtacctaatgagaggcaaaatcagggcactcctgagtctggctctgcaagggaagagtcaagttgcctgctctttgggaccgtttagtggctctggggtagtgtggactgtagcgttcttacagataagccatgctcattttctttctctttaagtagtatatatttattactatttttattactactattactactattgagtctcctcttatcttatctcacaatgttgtattactaggatcgcttgagcagtgccatctagcctgtgttgatgtgtgtgtgtgtgtgtgtgtgtatgtgtgtgtgtgtgtgtgtgtcacttaataagttttatgttttagacaggccattactgtatagctcaggcaggtcttgaaccccccattcacctcccgtactcagcaagtactgagcgtgctattgtgccagatgggttatttctgttagactaagctagtccgaacaatggaaggtggaggtgttttaagagtggacaatggggctggtgagatggctcagtgggtaagagcacccgactgctcttccgaaagtccagagttcaaatcccagcaaccacatggtggctcacaaccatctataatgagatctgatgccctcttctggagtgtctgaagacagctacagtgtacttacatataataaataaataaatctttttaaaaaaaaaagtggacaatgtgccccttcttagaattgggaacaaaacacccatggaaggagttatagagacaaagtttggagctgtgacgtaaggatggaccatctagagactgccatatccagggatccaccccataatcagcttccaaacgctgacaccattgcatacactagcaagatttttgctgaaaggacccagatatagctgtctcttgtgagactatgcctgggcctagcaaacacagaagtggatgctcacagtcagctattggatggatcacagggctcccaatggaggagcttgagaaagtacccaaggagctaaagggatctgcaaccctataggtagaacaacaatatgaactaaccagtacccctcagagctcatgtctctagctgcatatgtatcaaaagatggcctagtcagccatcactggaaagagaggcccattggacacacaaactttatatgccccagtacagggtaatgccagggccaaaaaaatggaaggggggtagggaagtggggggaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggaaagtcacaaatttaagtgtttgagcttttagttcagaaaaaacatttgcatgagaaaataataaacacacacaaatgtacacacacatacaggctcacaaacacactcacatacacatgcacatacactcatactcacacatatactcacatatgtacatatatatgcatatatatgcatacatacacacataaacacatatatacacacatatatacacccataccacacatactcacacaaacatacttgcacacacacatgccatatacactcatttacacacacattcacatatacatacacacatacactcacacacattcacacacgtacacacacacacacacacacacacacacacacacacacacacacacacactggttattctggcatacatatttaatcctggcacttgagagacagatagaggccagccagaccattcaggccagtgagacccttgcttaaacagaagagaaaactgagaaagcatcaattaaatttgtttgttctttgtgtgtaggttcacctgctcatccgatagttggtgaggcccttatgcacgacattctttggcattagctgagatgctagggcgtcaggaagatagtatcatttttggttctgtgtcatggataggaagataggcgttttttactgtgtgtgttcatctttacattgaaaaagactttttttgcctaataacggctttgttgttgttgttgttatttggtctgggcttctttctcctgttctacaacattcaaattacagacagatctttagctgtgtttgccctcctcctgccccttcctttattagaaacggttgaataagatgcataaaaacctgtgcagcaagaagccttaggagaaggtatgataaataaaactaggccccatgagccacagatcccagccacactgtggaattgagagctgtctttatactcagagctctcctgactgcagttgtttgtcagggccctgttcattcccacgaattctaaacagattgtccctcagtccataatgctttgaaagttgcttccacttgtataagaggtccccaggcttctgttgtatttgattgagtaatagtcgacctggatctgatttggtgcttctcaaacttgtttgaaaccaaaatatctaacccttgaatgtcttctcattcagtttgtgccagtggtttctacatcgcccccccttttggatctcaaactagccacctacaggatgtagcaacccattacagagccgctaaatcaaaatcctctacctcgaagctcaggaatcccagcttgcaagcagagcagggcagcatacagcagctcagactgctggctcgttaagcaataggtgtgtgtcggacccagctgaggacaaggccccgagaccatgccacacgggaatgaggtcgaggagagacatgggagtgaggcaggaaatggataaagcttggattgagcaaatgcagcggaagttcggagaaaaagaaatgcttgtcagcgtcccgaggatgccgttagaagatgtattttaatggccaggacaccacatttacgtgtgtctgggctcatgtcatctatgggtgacgtttgtgtgtactgtttttctgatctgaatgccttcttagcctgaccatggaacttgctgagccttgcaccatccttttaagattcagtctgacctttgtctcatttcaaaatgtcccttatcctagaggtccagggcccctctgctaggtcccagcatgtccacttggtgtttactaggcaaataaatatgactgagaggggccactccaagtgtcctgaggtcactgagcagattccattttttccacattgtaaagtatgttaggttagaaactttacaaagagtcttaactattagtttgttaggccattaaactgtggtactgtgagggtacaggctgagccctctctagagccaagctggctgggagtccgtggaaggttttcttttctggagacacactctgtgcatcatgagataacagaaacaaaatgttggaaaataggctaaaggttctgaaaatttaggtctttaaggattggagagatggctatgggtttaccacatttgttgaacaaagattaggacccatgtaaaaaggacaaaatagtgggtatctgccttcccactgctaccaagacagtgggaactagagggaagagccttctctgaagtgtgtgggttggctgtcctcacagtcaaagcatccctgagacttaccttgaacaaagtggaaggcaatgactgacaactgacattttctgacatccacacacattgtgatattattcatacacacatgttcacacatatgaccacacacaaacatactcacatcacaacaggcaagatttctcaaaattaggtctctttttagctagttgtagttaagagttcttgccatttggggcagactaaccctctaaaaacattggctcagtggatcctggggagcttggtccttaccagatcatcacactcctctggcacatccaggagatgctctagctggtagatgttgcacacctggtcacctgagtattcaaataaggtagccgtgttgccttcagggtaatgtttctagtgaccttaaagttcagacacaaaacaaccaattgtcttcattcactgcatgaaagagctgttgaatcatgacatttgggaagttaggatatatcatcctccctaggaaaacaaggccagtgaactaaaatcatcttttggtttgtggaaatgcattataactgaaggagaaagtcctctgtggtgacagtgacaacgatggggtgcagttcaatgttgacagcatcctaaatggtgtcctgcccccatcttctctaagcctccggtgggtcaaggttgaggaaacagaagcacggagagatcaggtgtttaccagaagtatagtcaggaaacagcctgtgcaagatgaggcagccatgtccttccagggtcaccgtgccgcacagtgtactggttcactgctgtgtttaagatgtgtgccagtaggacagcttgggcgttatccggactatggctgatgtccacttgttgatgcacaagtcagttgtctcagcctcttggtgtttttcagttatcctgctagcttttttgaggactgtctctgtatatttgtgtaaaacaaaaaaaaaaaaaaaaagtggaaatgataatggaacattactgctttgggattaatttgtatctattagttgatcatccatagtcacattttgcttctgggggaatcaaacagggctagcttctctgttcttttaggctcacacctagccccagccttctctccagtagggtattatggatcattgaagtcctgactctccacttactaacaataagacatctgttaagggggctggtgagatggctcagtgggtaagagcacctgactgctcttccgaaggtccgaagttcaaatcccagcaaccacatggtggctcacaaccatctgtaacgagatctgactccctcttctgaagtgtgtgaagacagctacagtgtatttacataaaataataaataaaagaaaataaaaagacatctgttaagtaggtataccaatgcatactttataaagtttcctgttggtgagttacaggagctacaggaatgctacatgtatcacacacttccataattacctctgagtttatcttccatcctgttgccagataccactcctcctttcattttctgttaagttgctgtttctttgccagtctcaggacataacccccatctatgaccttaggtaagctcttgatggatttcccactacctctctgttgaagactggttatgtttgttgtcattgttgttgctgctgttgctgatgtttttgttgttgctgttgttgttgttactgatgttgttgctgctgtttctgttgttgctgttgctgctgttcatgcttcagagttgcctaagctctacattgagcacaaaggttgtccattgagaaagctggagttctagtggagagaatggctagagaatcccatcactgacattcactagctgactgactgtggagggttaccgttaccttacagttaccaccatcagagccttgtagtctcatgtctagggactggggtcttgtcaaacattgcagtcatttacagctgcactctcagatctagaaacacaattaatttaacacctgtacagcagaatgtagcaacagctatcctctgtgaggcagataattggatctaatgtggatgaagaaatacaaaatgtacttctatgactcactggtaaccagtagcttctatggagtttagtcctacatctcttttgtcataactccaagtagctgtcttcaagggcagtaggaacagaaagagtcctgtttcatagactctggtgtggcagggtttggcactattggaaggctggccctggtgagtggccattgccactgatgaggttggacttggagccccagtccaccaagaggtcaggtttgcgtgtggtggagggaagtagtacgagcaagaccctgaagtaggacagtagactctggtagatgctgactgatggcagtacatgctgcctgatgatggagggtgtcaggagcagttaaccacggtgccctttaatcccagaggtcctgcctgttaggttgtgacattacatagatgtgccctgacccatctcaaaaactggacatcagtggatttaattaagatcaattagacatccctcctttgttcagacacaatgccttatttgtttgaaaagagggaaattctatatgacctgaaagcttcctgcttcatctgctccttttcctcatgaagaatgaaatgccatttggaataatacaaagaatacataatcagcctgcaggcaagggctccatactttctctgtgcgcattttctctagagatatttgactcaacagggacctactatcttagtgatgcgactcctgaatttcccctccagtccagccccaggtgaggcttccaccctgtcatccccaacatgtatacgatgcatgagactgccctttcacctacttctaggatgcttgatgacacagagtcaggtgactggctcgggaggaaattcagaaatgattctggtgggaggaggctttgggcaattgacacaaaccaagcaaggtggttaagggagagagggggaaagttgcaaggtcaaagagcacaattgtattgggaaattagggcatctcatgtctgcatctaaggtctcatctatgcagagtcagccgtgtcatgaagcatgtgtgtgactgtgacttaatctatgcagcacaactgctggtatttcataaggtccctccctcatgtctgccaccctctcacccctgcaccttttctgatggtgtgtcgtttgtctttgtgaccagggcttgctgcttacccaggcttgctcaaactcatgccccacctgcctcagcctccctattcatgggattgctggtgtgcaccaccacacccaggcaacagggtttgttctctagaccagaatcccagtcaaggctgtggaaagtttccaacccagttcttgtggttcttcttctctgccttactggtgacttgctagtgattgttaaactctaagaatcttagcagttgttgtttgttttgttttgaaacaaggtccatactatcaggctagctttaaattcactgtatgttaagggtggtcttgaactgcttactttctatcccagtgctgggattacagctatgcatcattacccgtagcatctctttcttctttaacgaggtgtgtgtgtgtgtgtgtgtgtgtgtgtgtgtgtgtgtgtgtgtgtgtgtgtttacatgtaggtacccaaggaagccagaagagggcatcagatcccatggagctggagttacacatgatttggagcagtcacataggtgctgggagctaaacccaggttctctgccagagtagcaagtactcttaaccactgaaccatctctccacctctctttctatcttaaaccatcttttggttgttttacataggactgtaactataagcagataatacctatagattaaagtcagctaggccatgttctatccatctttctctttgtctggaagaaatatgtaggcccgaagaatggaggtgacttacccaaagccacagtattcattcgtgaccatgtcagagataggatctagcctacctcaggccaccttggattctgacagttctgcctgcctctttccgtgcctgttggatgtggctccagcacttagtagtgtcgagaaacatcatgagtcttcagaaactggcttgaggagtctgaggttgctatgaggatgtgccctcagattcccttcccatggtcctgtttctgcaggaatcctttctcttcagtctctgcttccttccctcactgtgcccagagcaggccttctaacttttctctctaaaacagatacactcttacactttgctaggctactcttaaaggtagggtgttaagtgtctgagtgtgtgatcgctgactattaaagaaagaagagcgagctgtcaggagcttctgggctgcagaaaatgcttcccatgtagtggtttctttgccacgccgtgtggaaggcaattatctttggaggggattccgcggccctgtgtgggcttccctggtgtaagatttattgtcggacggattgggtgtcctttctaagagcatttattcggcatctaaagcgctgtcagaagtacaacttctgaatgcttttgaggttgcaactgctaagcttcatcttcccatcctggagatagagtattgaaatgctgtgcagggatttgtacaagcctcccgcttcccattgacaccgacagggttgcactgttaaagctcagcacaccactgtggaaatttaccccctaaaagccagagccctcccgcagcctccaggctggcctgcaagtgctggctgggtagctgaatggggcctgaggtagacaagcctccctttgcttgggggacatctctgtagctactgattcaaaagttaggctgtcgtttttcactcccagacaggccaaagtgggccctcctccttttatggatcttccgaatgccagaagaaaacttgaacttgactcagctaaatatactagatcatgaaaccttagggactattgagacaggaacagtggcctattactgcttagaaggtgttttattgaaaatgagctgacatattctccctggagagtaagcaagtaaaggcaggatgcccagcagccgtgcaggttgctctcctaggcaagctaaaatataaagtttgcactgctgagccgtgagccagcaggcagtagcatagatggctggagcttcatccattcaaagtaccacacttcgtcgttgtgacccctgcctatcccctctgcttagcatcagcctcttactctatgtatttcagttagcagatccttacagatctctctgcctgccttttaaaagttgtcttcgaaataaattgagatagatggaatttcctaatcctggcaggcttaccagcagagggcaggcgtaaagaaggttttgacaccagggtgtgtcaacctagggtcagaggagggtggcgaggcctaggaggagtatctgtgagctttgttcccagggcaagatggggcatgcctcccctgcctctcttcccctgcctgtagcacactcacaccacggccctcctgaaaagctgactccactaaaggtggtcagtggcttcatctaatatcagcgagtttctacataattaaacgttaaaaaaaaaaaattaaaaaagaatgtcatttcccccaagagccatctcttcattcctcttcagtgccctcttcttgttaagcttcttgcccagggttaacatgcagatgagccttgggtgctgtcactctggggagggggcgtgatgatgtcacttggtgctgatggacttgaatttcctccctgaagtgaaggataacaccggggggggggggggattttcttctgacctaaaatatgtacaattttgagaattttgcacacatccatgtaatctgttataaccccatggcagaagcaacacactaataaatttcacatcatattaaaggtagggattatagtttgatcataaacaggagaggataatttattagtcagttagaagcagggcttggagagactggggctgggttctttggacgattttgtttatctgggtgtttgagaagtgcattcacatttatcatgaaggatttctttttcttcctctttttcttttgagacagtgtctcagggaagaatctttaaactttttgcatttattttggtaaatgttttctgtagctcatgcacctattataagttctctgaatgttgccatggcctgctgtgtgtatgtatatacaaattactccatgatactggcattataaagtgttgcaatcagggaagatgcgaatggtgatttggagactgtcgtaaagagaaattcaacctccagtgcatcagagactttttcccttggccaaactaacaggcacggatgaaaaacaacataattagtttcattgtcaacgtagacgtaacagcgacacaaacagtatcgataggcagctaactgctctggctccctgcagatagatgggtgatgtattaatttatatttttaagtaaaagcactgcttaaatcaagacagaaatggggttccttagagacagatgtccaaatctcaggaaagggccacggctgttgcaatttagtaactctaattggctggccccgctgctgggctttggaggacggtaggggagttccttgtggagaagcaatccatcagacgtggggctgggtggagaaggacctaaaagtctccatcccctggcttcagtaaaggaatcacttgatagatttttttttttttaattctgtcattgtattctgactactctactaaattagttggaaagggcgggggttgttgatgcaagcactgtttggaagaagaccatgaacttgcattagattttggcctctcagacacagttcatttttggacccatcacggtgtcctttctctagctgtgtgcaagcagctcagggtaagcagttgctgagacgcacgtgggccagggccctgtgaccatatctacctcatggctgtggcaccattcatcaacatgtcgaataatgtcatgagggtgtgctctttctgcctcttcctctaatgcgtcttgtctccagtcccagctccgaacaggcagtaaaacctttcactttcttctctgttcaaggctgaggctctgcaaaaccaaacagaatccccaactcaagtcccaggtgtctgattcggtggttagagtttggtatgggatcatagtaacctgttcctaagtgcacagccggctgcacaatggactcatttagcaactgacaggtttcttaatatgtggtgtttgaacaagactgtgtctgttgtgggtgttaggatgtgggcatcacaaatatttttaagtacagtatttattgtttccttcactcttccttaaacaaggagccacccccacccctaactcaggtatccggtttgtgtaatcatcannnnnnnnnnnnnnnnnnnnccccactccacccttttttttgatcatccagtgtctgctttgccttatagagctgtggcgtgaggcatgcttgactcacagggaagcaaaaccactctgcctttccgggtttttgtttatttgtttttgtttttctgttttgagacaaattgtcatggagcccaggctggcctggaacttgttatacagtcgacgataaccgtgaactcttgactctacctcccaagtaccggtattatagacatgttgaccaccaagcctggctcccagattactaaaactcagtttcttcctctgaaaaatgggatggcaatttccattgaagttacaagtgcatcagcctcaggggctgagtaagtcaagctaacgcccccacaataatcctaattatttttcttcctccttttttccattttctttgtctctttgcccctgctttccaaaacagcctcttgctggaggtgattaaaaatggcagtaactatgacttctctgttagtggaaggtttaaaatttttatattttcctcaaggcatagaatgtaccaactctccctgaatgctagtctcagggccaaaaatcttatgaggccaccctaggattctcaaagttagcccaaattgtctcaggctcctacaaagaaacacaggtttctccctggtggtgtgattccttcccagagttagcctccaagccactgcgccatctatctgttcggagagtgtggactggcctccaggtggcctctgggctgtttgctaagccatttccctcagtctggtctagtatcctcttatccaaaccatcagcccttcacacatagcttccccacgggggcttcccagccctcccagtgctccctcctgctctgcagtcccatggtgctcccagccaccactgtgcaatttagcgcttgcgttaccatgagcattgcatcagtctttaattattttgtgtcaggccggcctccacagctgggtcctgagcgtctgtaatgttgttgtttgcctgtttgtttattgttttgaagctcccggagactcttaactgataaacgctgacctttgtggaggaagccctacttgtcacagcatgcatgagttttatgggtgcctcctgcagatctcaggctggaggaaacacgtcgtttgtttcaagctcacctcagctttgttcacactcataaactctcaatttaatttattaatttttttgtaaattactgtgttttaaaatggctgtttctactttttgaggggtgttggtttggggaaaacttcctcaattttcatttcctactttggggcttctgcctgctcttctgggaaaaaaaaaaacacccttttttcaaaactcaagagttctactgatggaggagttaggatgttctggcagattcaaggcccttctagaacccccattctcaaagccacccaggttctttattgaatattcatgaaagggtggggtgacatttatgtgacccggaaaaaacaaagaccattaataaatttgttatctgacaaagaacacttcggggtggagagtgttgtgtgctgaacccatttaacacctgaatggatggggaaggcaacggggcgctcttgcattttccagccagattcctggggtgggatggggaggggatgtctatctcttgttgacctcactgaagttcaggcgatttcttgagtagaaatatatctgtatcctttctagtttgtagcaacctacatttaatgcatctcaaattgaaaagaactttcaagtaaaaagtcttggaatgtactgggttatactttgttgctgttgttttttttttttttatggttcatattgagaaatggataatcattgatttcactagtatgtttcctggttattttcaagaaaataataaaaatttgtgggttggctttgttttgttttaatcaatacaccaaccagaaagtttttctctaagtttggaaatagcagaattgagaggtgatttctgaagcagctgataccttgtaggctaacctgccatttaaatcctgacacttgagccaacaaagtttagcattgttggtaactttaaaagaaaaaaaaaaaaaaactgcccttcgctcgtgctctcagcatctaagcagtgagggtttctaaccgaggtcatctcgaagtgcctgttgagaggcgcttttgttgtggctgatgttgcataaataagaaaggaatttcaagaattatttcttagcaaacgtgtggcagctgtcgttccaaaggggaagtagcgaggacgcacgttgcgtggtgaattatttggagccccatgtggggttccttccctgcgtgaacaggcacactctgtgaggtggcctctggatccgcaagggtggcagggagatgaaggctgggccccaccaccgacgtgaagtgaaagttcaccgcggcgggttttcgaggaaaggcacagcctggcgccccgcaagcctgctcggtagcccagagcagctggggctgtaggcttccttggcggagggcgcatggggggccctcccgctccgcgtcccggaaggttagcacaactctttgtcagtttcgaagaggaaacaaacaagccctttccccaaagccggctgggcagcggggcccagggcgcagagagagaagggggtggggggaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagaatcagcttgagattccacttcaaggtttgatgtgtgttgctgttattgctgcttacgaggctagcaggatatcttggatatttcagattcatcactcagtaaagcaaatcaagatgagcaattttgcagactggggggtggggtggaggaaaggaaagcctctattttatgtggttctttgtagctgcctgacacacttaagtgaaaagtgtgtaaaaatgaaaccgaaatacagactgcttgcccagacactggctgccagtctcactgggatgtgatagaactctgtgggctgacacttgataatcaaagttgatttattgttcattagtactgcattagccctttcagacaagacagttatttgtgtagtagccgtccagagtgaaactgcaagcacctgtcatcttgaaggcatgacataagccaccaaatatcaaaacgatgcaaattcaaatgcatctgactgtgttaaacatcactctgccaccttcctccccttctttaagataaattagcacaggtcaaatctactgtagaggaaataaaaatgtatcaaagacacttgttttccaaccttaaggactccttacagaatgctaggagtggactttctgtttgccaattcgcctaaagaattaccttttctccccaaatctgcctgcagcttgtggaacagaaagttgaccatttaaaggaataggaaacatggccttgtcagtaatctaacccaagtaatggaaagaaggtaggctgttgtgttgtgctttttaataaacacgtcccatcagatgaaacttttgagctttgggttgcttatatgaaaattgatgacatcatagctgagctatgataatgtcggataataatgtcaacggcattttctgcagcatgtctcacttggtttgtttttttttttttcttttttcattctccccccccaccttccctccctggaagggagagatcttatggcaaacaatagaaaacaacccagtgtcaaaagaacataaaattagggaacttttggtctgcagccatagaaacgcagtttaactcatattttttcaggggtggaatggcaacattgtacatgaagctatgtagagtattgtcttctctgaattttcatctgacagggattttagaggctgtgatcttaattaaatctcaaccagctaaagcggtgcatctaaaggcatgcagtgttgcataatgttgctcagttggtgaactaaatcatcagaaagcttatgataggaatagttgatttggattttttttttttttttttttttgcagttaaatgtaccttgaaaacaaaccctctccaccgcagccttacatttgcacattgtcaggacctgtcacttgaaagataaactcctttatgacactgaccagttctgcaacttttcagccagcctccacacaatggcaagagacagggaaattaaaatccagatgaattaaaagcaatcaaactctagctttgtcgtggctaacgtggcaggggtggcgtttgaattactgtgtctctgtgacgatcaggagggaatgtggtggccagattctcagctcatactaaaaattggagtgcagtttgtattggcaaaaaagggaagcctaggagaaattcattttattatgtggtttcgttgtggacgaacatcactaaggggaactttcaaacgacactctgagtaaccggggaaacagcgatcagtgagaagccccttgaggtagttccttgtgatttacagtcaagggaaaaccgtagcaacagttgaccagaaaaggttagagtgactaaaggcatacattgtgtctctctgtgtgttgcgtgttaagctctgcactcagtaacaaggagttacagtcatcaaatagccttgttaaccgtcttggtctttataatatctagtgcttgcagatagtgccttattcgtcttcactgtctttaaacagatgtttgtatctgcttgcatctatttgtttcaatatatgccttggtagaagctgcttatagaatcatcattctgcatgggtccttgtcataaggtttcatagaaggcttgcgtttgtgttgctgttgagacgttcaactgtactttagggttagaattggggcaagatgtctataacttaatgcttacctgcagtggtagatttgcgcaaagtcttgaccctgtaagctaaaactgctgttaggtgtgaattttgtcttctttttggtgggggacagcatggtattccttgaaaactgttttgagtcatttcagagtgcctgtcttctgcattcagtgacaaccccccaccccccactccagtttaacacagaaaactcaggtcctccagtgctgaacatctgcctgtctgtacatctgtctttctgtacatcatggggccttgggttactgggcaaagctaacctgggcctctccttttaggtgagaagaagggatacccttttctgagtcctttctccagcctgccagttgtttgggggagaaaattaatttagagtgaaaaaagaagacttaccaagcccgtgcattaggcctcccgttctcatcgggttaaagcaactaatcaatgcaagtgtaggctaaatatgccggtgagcttcttagagctgtttagagcacctcggtgtcgtgttttaattcttacgctttatcttaccctcaaatctgagacatcattgttcaaataaccgagaacaaggtaaatcaacaacatcaaaaaggtcagcctctgtgatttctcaggggcttgttattttgtacttcccaattctatttgatgtcttgacaaaacaagatgacacaggggagaatacattaaaatttgatttttttttttcatctaacctgttacagttgtggcagcttaatttctttcttttacttttttctttcttttttcttcttctttttttttcttttttgtccctgaagatagctttttgctctgttgttcttaattgtcataccatttcatgaggcaggtcttcacgggtccctcatttgagctgattttacaaggcttttttttcccccctttaaattgtattttgaacccttcccatgtagggagctttcggttgggttttttgtctttattagaaataaatcaatgaatggagaaattgtcaaagaagcaactgatgtttttcctcattagaatctcatttgcaccccttggcttaactgtgatctatcaggtgaaggtgttggagttactcatgagaaatgcataagtaattctagaaaagggagaaggcaatgggagtgccttagtaaatccatattcaactttggaataatccaggttgggcctgcctacttatttgtttgtttgtttgtttataaataaatatttatttgtacttaatcatgctcacaatttttgggctattatccctgaaggaaggagaataatcaatttaattgttagttttgaaaacattcttttttagggggaaggtaaacaatttccccccatgtaacagtaactcttgatttaaaactatcttcagagtttgcttgcttgctttaatggtgcacatttctcaacagggctgatgtggttactgtctccctttcattgtttgtaataatgttttagttgaagagaacttgcttagctaaagtcttttccctgtcccttcaagagttaaaagatttgtaggccaaatcttttctaaggaactttctggactagtcaccccccacctccctgttctcagcaaaatcaaaaatgattttgttgtttttgttaatctgaaatgtcagcatattttactcactcactctaaatagtttcccagcccacctacgggaaaaggagaccgaggaagggaaggcgaagcattttcctcgatttaaataataatagtaataataataacaacaacaacaataacaacaacaataaataatagtagtggtttcgaggtggaggagattagctcttaacaagtgataattttcatgtgctgctctcattgtctcctgtatttaacaattgctaatgggagaagcgatttaatttatgtaaactttacatttttatgcaaatgaagctgatatttatgagagcttaaacaattaggctggcactcagtggcataaccttgcctgcctgggaagtggtagagaagctcagggcagcctccagtcactcccgcgctgtggacaaataggaattttaccatttgtttttaatgtaaagacaaaaagagctcagctctgcaagacatggcttcttggggttgctaacctgaaataactcctgactggcaggcaagtattagccctaacaattctttttggaaggaagatagcctctctgtgatagaatgtaataaacaaaatgataaaaaatgaaatgctaattgtattttaaagaggcctcttttttgtgtgtgtgctaaaattttaataggtggttgtattgttgctgagtgaacagttaggctgatgagtgagtactaggatgattttgcattaatataataaccattacctgccttaatgctttttacagtattatggcaaaatagctaagtctaaaagagttatacaaagagcagcattccacaatgaaagagaattatactttccacatgaataccataccttttttctttttctttttttctaaaggcagaaatattatgtcagaaatacattttcccccagtttgtgatacagacattgcatggtacttgatctgagttccgggttttttgtttgttttgttttaatttttttttagtgacacggggactttggtgtctgctgatcgattgtatctattagctattaattctgaaaactggcctgaattttcccaggtggctactggtacacatacaagctagcttccttgtgatcctagaaaattgggcataattcctctattttttttcttaaaatagagccattttctttgtttgcttttgttttgacattctagagccttctaatttaatttgttttgctctcgttatgtggctgactgggtgacattgcttaaccgcgttggttgccacccaaacactgctcgaagtatggaaagcaagtgagtttctggggccatccatgtggctcacgatcagaggctggaaaatagttcccaagtaattctttgaaaataatttagtggaattactgtggtagacagttaatgaaaacagtgcttcatttttaccatctctgttatctgatttgtacacacagtaattaggagagggtgtgaacgtacaaagtctatgtgtgtttatgctgggcagtgtttacttgtagttagcttcagtgtaaaggaaagggagagaaagaaatgatagcatgttattttcagtatttatattgtgtcatcttgcttcccacccaattccttcaattgtctcctagattagaagcaagtattgtttctatgagggtgggtttttttttcttttattgtttgtttgtttgcttttgaaatttcaacacccctcttccccattgcctacctccccccacttgcaaacaggacattgtttaatagcctgcaaaccttccaacgacagagagtccttttggaggaagagaggaccattgccagcagcgcttgagcctttacccgcagtgcctggtgttcaggatgctcccttaggtgccggtattaaggagcagcaggcccgtactagccacgttcagatggccaagcacagctgtatttctgccattcaggcgggcttgtgtgcacctgggatgggccacaccccgctgctgtcagtcagtgttgtaccctgcactgtttttcacattttgtttttaattcctgccatcccctggaagctaaaatggtgttaactgtgggtgcacatgtgtatttaagttaggtttccagtgctttaaatgtctgccagaagttttattcgagtttctgatccctgaaggcagctaagacagaatcctgctaggtcttcataaatgcctcctgtgattcattgtgagtccatacagcgccacacagcagactggcttctgtacactcaaatggttaacacagtacagggattttttttttcctttgccttatatttaaattgtcttttgaggaagaaatcaggtattagcttcaactcccagataagtcacaaacccttgtagctacatgaagcatcagaaaggacttttaactccaggagagtaaggtgggtgtcagggagtgtgtctgtgtgtgtgtgagcaaagtttagtttttttgtggaacactttcagtgagggccctataaatattagacagctgtagttaaaacctcacatgactgttttaaatactattgatttaaaccactggctagatcttatgaatcaaagtgtaatttctaagcttttggccgtatttctcaatgctaaaccaccctctctcgtgtgcctttagccgctttccagacattcaacacaggattaaatgatagcagttacagtgatcaataggtgagggcttcgacaatcactcttgccgtttaatgacctcagtagtaatgggtaataaagtgtgggctgtaatagcccctcgctggtgctgcatgccctttgattccttgtatgagtatgcacagggtacgtgagaaagctggacactgggaattagggagtgtatatataggccataattctcgagtagttaaaatcttaaactgtgctccatttttttcccctcttgtttctgttccactccgatacttttctgaaaccttgctacagcctcttgtcctaatatatgttgaagcagaaacttgaagggggtggggagggggccaaccgaaatctgttctactgcatttgtaaatgaagctcccttccccactttggtggctgggagctaaactggtgtgaaactgtggtttcagatggtaaaagccaagtttgaagccatcaggctataatggcccannnnnnnnnnnnnnnnnnnngctgggctgcgcctgctgcttgagcgttttattactcatcagtaccctccatcaaagtgtccaaagggaacaggcaggggagagtcaagttcattccaccgttctgccgctcgactgccaacaatgaagaagtaactgtgggaaaaggagctggaaaccattggctctctgcgaggatttaaaaattacccgcacctgtcagcctttccctggtcacccttttttattgacagtcaaggggccacggtgtttctcgttttaaaagacacatactatttttaccatgctttaaaaaaaaaaagaggctttaaaaaatatatgataaaaatatccagtaaaaagaacacattacctacaacagtttaaatcgcctttattaaagggtaatgtatatactgtagaatacactctttatctagttggaagggatttgatattcatatatctatgtagtccctgtagtgtgcccatcaaccccctccccccagcttacctgtgccactttctaacacaggagtttcaggtctcttttaaaattgaggaggaggtgactgtttcagtattgtttctctgccatggttctgttgggtttgtgttgagcaccagttgagattttacaccaccctgttcctgtctgttttcctgtccattgccattagacgcttggctcccaagtatttgtgttgtacgtcatccaagaaatgcagagagaaaaagaaatcctaaacatggctcctttgtttgcttcagcgagcctcctgtatgactacgagactctcaaggaatagtaaacttctattgtgataccttggctccaggagctccgaagatagcagctggcacccagtgcacagttagaaattctgaaagtttcttctggataaagacaaagtcgactaattggaattaatgcgtagatggttagatgttttcataatgtcttcttggcgtttgccctagactgtacgcaagttcagtgttccaatcattggtgatatttcatgctgcgaattatctttttaaaaggataatttatccattcatatacatctgtccctttttgcatataaaaatattcagacatgcccatctgttttaaattacagtgtaactacatctacacttaaaagaccactgcaatgggaagagtccaatgggtgacctctccgagttgggttaatgacgttttcagggtgttctagcttgagctttctaaacatgtgagacttgcacgtgaacctcccccagattctctgcaacacacaacacaccaccacaacaggggagaaggctcactgtatgtgagtctgaccttcaggaaccatttttagttcatcaaaattagtgatgctgagaaatcgggacgtcagtgcataatgagtgtgaaattaggaatgagagctcgctatgcaaatgacagggcaagtcatgtgaaaaagtcaagataaactgcatattaagacattatgttacataaaattaacactccgtttctctcttttgcttactgttcccccaaaagatttttttaaaatcttttatcttttgatcagctattgtctgcaggattttttttaaaatggcacacaggcaaagtgcaaaacatgttattaccttttattgtaatacatgagatgacagcagaccttttaaacaatatatatcctttacagcttctggctttcttgctggtatacttgcttaagaaacgaagaaaagtaagatgcctaaatattactcttaggagacacttggctcttgtctttcttttattgtatgtatgtgattttctctcttttttttcttatctttttatggggtggggggtaacttttttttttctgaagtatcttttggagtacagggactgacaaaatggttctcatgtagtctggaaattaaacacaagcgcggtgattattttgaatagctaaattacattctaggaagctcgcagcatccgtagcgttgtcattaggtgtccgcttgaatacaatttgtgtaaccttggccaagacaggctgtcattttaatgtcagagttttatctgaacaagacatcatcctttcagatacagtgtgcaggttccttgcaaagatgcccgtgcagaaacgtgttaacagttgcaaatacgaaatgctatcaagttcatcacagtagctgtttgtcactgaaatgtcatggaaagcggcttttactggtatcacacgtaatagggaagaattgagacatctgtatgctcagtgaagaaggaagggtaaaagctatcccaggaagggtccgtggtttaagttcagaaggtgtgtccaaggttctgccagcagcaaagccaagcatctttgatgatcctgaaagtcactgtctacaagtgacgtgggtcatgctagctgtgactacagacctgcttgttcttccttaatgtcccccctaaaacaaacaaacaaacaaacaaacagaagtgtgggttaccttcttagcagctcattttaatgagaaccaggatggatctgtccctaatcctggtaacatttgttaaggtgtgcttcctgctctgcttgtaaggttggccagaacccatcctgtctacaaggtctttttttacatctcttgacttgcccagcatctgtgatgccctgggttggatacctgacaacaacatcaccataaaactgatactgataatggcacaagggtttgcatagggtctgtgcttatatctctttgccatctatacatgggaaagtcgttttttgaagaaggctgaacctgcgagactgtggctgtgtggcttcctcgattcctactgacacttcattactgttctaggttcccgtgtcagtggctatgatgacacctcaggttatcactcctcaacaaatgcagcagatcctccagcagcaggtgctgagcccccagcagctccaggttctcctccagcagcagcaggccctcatgcttcaacaggtaattgtctccccacccagagccctgccactcagtccacacttcccctccacctatccagttgctttccctgttggagaatggacatggcaggctaagtgggacagaatcccacctggttcctggatgataagcgtggtgtccgcgcccctgaaggactggaaagatgccacatgtctagggctccgtcctggagactgtcccatggactgagattagggctggaataggacttagttagtagaaaaagatctttcaggcttagagggcttttcagtcttttattttggtaagccaagagcttctaagtggcatgaaccaaagcggcacgaggtgcacattggaagcaagtttacgtagacagctcttgaagccccaagttcaaccccaaagcttacctttaaaggtattttttccttagatatggaaagaagcattttggagttcataaatttccaagcagagtttactttctccacacacgttgatgctcagatacacttgtggctatccttgcatctcagggtcgtaagactcagactgaagaagcaacctaaacccaacagatggacactatagggaaagaagtcactaccatataacccgataaggatggggcttgaaggacgttcccaacacgttgaagcatccaagtgtgggaccctccttgccccacctcccataatttagaaagcctgagctagaggccgagcagaccctgcaagggcacctcagctttgttgtacaatcaaaggtcatcccttgctatattttaattaatttgtgtagaaaatggtatgtttttcatcagttcatttttgagattacttctcagaccttaatgccaagaatagtcagtgtgcgtggaatttattgtccggtttcaaagtaaaaggtcaggccattccagataaaaggatgctatttttcatatcacagtttgtgcatggcacggagagggacagtgggtcgccgtcttctgttacttaccgtcccctcctctctctcttgtagcagcagcttcaagaattttataaaaaacaacaggaacagttgcagcttcaacttctccaacagcaacatgctggaaaacagccgaaagaggtacgaatgatacatattttactttcagaccacagatctcgggggactatctagtggctattaaactgtcattcatcttttaaataattgcccaactcagctgactctatcggttctcggctttcagacggagagttattgtcctgttggtgctaagatttctcgattccttacattaaccaccgcagtgcacctctgctgtggggacagcaccctgagcagtcttctgtcttcctttgatagaactgaggaccggcatacagctgggctggggagggacagcgttgaaataggatgcacacttaatgggtttcaacatttaattatgggtttgtttgttggtttgtttgccttatgaacccaagcatttgggaaggtggcaatggccttctccattggccagctaccttcttgtgaggttagacaagccaggcgtttagaacgtgcttaaacaccgatatcttcatctagcctcttgcatggtgagtgtgtcctaattgcctaacacatgtgcatgagttaaagtcaggggactcacctgtacttagcaaaacaaagctaaacagcagcaaacccccaccccctacactgtatttacttctgtgtcccagttctttgcagtgtttctaattgatttcatttggctgctctgcccatgcaggtgacccttgtagaccttcccagggaccatgcaccatgggaccttcccaggcaggggttcccacctcatcttctgtaggttgccatgagtctggggggtgctgtcacttctgagagcccttgagtgccactgcgcctaggtattaggatctcctcccagccctccacatttacccagtggtccaaagctttgccttaagtatccctcctttgcaacaacaaaaaacgtcataccgtgcatagcatcctatcttcttggcttccctggcagccctgcgcagccacgttcgctcggtggagggagtcttgccaggtgactgcctccacatccctgtccctcataggaggaggatggatgctggttttccacatgggagtcacccaggtttctctccccatgccagctcctccctttacacgctctctatgctctgccaagtttccccacccgggagtcctgtttagcaggctgcttgtaaaccccctgcggagaaggggcagttttggggtaaaggggaggaggcatattaatgaaaatgctgacacaaccttaagggccgtggctcgctaccgggcgctgctctaataaaaaagggagcagattaaaaagtgtctaaaatgtaaatctaaaggactaacagtaattaaaatggaaatggcacggggagggaaggcatgtaattgtgagatatcaccccgcagaaggctctcagctttgttttcctggctgtttttctaattcagccgggcttactcatcagtggcagttcaatgcgccttaatgactctgggattgcaggcatcactctggacaaagaaatgattattgtgcggtcaaaagaagttcaaagacaaggagggaatttcagttttttcccttagagatccacattcaagagcatataaattaagccaaatgttaaaaaccacagtctgaaagctgacttcaaagtcacaactctctaattaatgaactgcgagcttcagtttggacaagttggggtttgatgcgcccataaatcaacatgacaggcctgtttcacagtctcagacagtgcttgtcactgagtcacatcagatgtaaacacagcagaaaaaagaagggctaggaaggaggcgcaattgatcaacagaattggtaaaaacccacttttgaagcacattatgcatgatcacaggaaatggttgcagcctcaagaggtttccccgtctgccgtggcttttttgaatcagatttctcacagccttcaaaagggagaagaagaattatggagtttctcccccgtggcttgcaggcaataaccccctgttgttattttgtgcttctttcttttcaaaggcatcaaaatttagttttttaaagatctttaactctccatttgaagacacactagaaaagggctgccagggccactcttatcagttaccaggggctgcgttcttccttcccatcgccaccgatgattaacctcttatttggtcttgtagacagcgtttggaaagcacatcgcgtgctgggaagacatgaaagttcaggcgagctctgagggctccagaaagacatggagcggggaagttccccagcagaagagttcccaaagtgctgatgttgggaaggggaaacaaacataagactgacatctgagcttgagcagagagtgctggctaactgagcatattgtgtccacgggcaaagagggaagcattgtagtgggtgttggtttttggtttggttttttttttgcctgtttgtttttttcatcttgaggacactgggctttctgtgacctatggtttggtgacccaggggatacgtggccataacctacctagacgaaggcagagaagtggagtcagagtagtgtccttgggtttccctgtgtgttcacagtgccctggactatcacactagggattgggagatcctgatcctctgagatgccaagggctcctgtccccaaatcgtcatgcatctgatggtccttctgtgctgtagtggaagagtcacttggtagcagctgtgtggtatggcctggtggtgataattttgacaaggtttgaacatagacatctgcagatggagcaagtgtcttactcctttatggaacgagctgtcattagccgctcatcattttctacagccaggtacctcctctcctgtccccccaacccccgttgttgttgttgttgtttgcttaagtctggtcctatagccagagcacaatacatatactttttcttaaagttgtatatgatacctccttgggaagttggaagtcacactgaaccagacccacgatgctcctttggagatagctgtttgctgatggtgtcagaggtgtacccagtacacaatggaagggacagctcctgggtcctggactcagggcagttgggaaagtagatggcagaattcactttaaaatcaagctgggtatgtgtggggggtggggtggggggtgccatcctgtgtgatgaggtggcagagctgattgttttaaaagggccgtttgtcctgggcagttatgacagtttatgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttatgttaggcagtagggagtagccaaagaaagaaaaacagacctttgactgcagctctagggcggggacccgaaacgaaaggtttatcagagcatttgagcattttaacactgactgctgacctgtggggactgtgcagagaccttttttgtatgcattcaactgtgagaggtaaacaaacggactcgtatcctgtgtttggtaactgggtggggagcacaatttggcaaccagtgttgcttttaaattcttctttggacaatgggccttgtatacttttatatcctggcttttcaaatgcggacagctttcatgggcactttcctagggatggccacagacagcagaaaatggcatcagtcattttatataaatacacagtttttaaacactcacttacagtaagacaggaagcacccttcccagcctccatcccccctttatgttcgacctcaacagtggctaattccccagtctttgactgtgtccctcttctttaatgtcatgagttaatatctgttgaagacgtgaaaaaatccttttgacacgaatataaccatcactgggtttcacattaatgtggtaacttggaaaggggtgagaacaattggatcattttctgcatgctgttcttaaaatgaaagcactggcttttcatttaaatttatttaaatttttgttgtcagtggtatagaatttgttttttttggagtgaaactcaattaactttctcagtggcgtggtggtaagtctgaaattggttactaatatgaagacgatggctttttttctttttttcctttttttttttcctgtaaaataaactacacagaggccaaaaggaaaccaccatttttctcttcctttgaactttgcatcagaaggtcttggtgcacacaccattttatggccatatcagatcaaggtcatgtgttaggttaagtgaatgcagttgtttgtaaagtattgttattgagcagagcaggcaggctctcaaaacactgggccatcatcttcttgccaagacatcactgaccttggaataatattcaaaattaagcgctcttgtgtgttccttaaagatgtgtgtgtgtctgtgtgtgttggggggtaattcagctaggagagggttaatttttttctttctaattgttagccataacgtagccaagacctcctcctcgatatgattcctagcagattaaggatattagataatttccttctatttattgtattcctgcgccgtattatctttctatcactcagataattactgaggaaagctacattaattttttttgggctggggcaaagcctgctaaacacaagaatgatgtattgatgttttacacaacaaaagttttcctcctgtcattgtgcagtcaacagagatatttatcatatcataaagtccctcctttccgagaacaaagcgggcgggggacacgggacaacctgaggacccaaagctcggcacgcctgttcacattaaacactcatggtggagtctgatgttgtttgctaaattatgaatgtgcgtaattaaaatctagtggctgtttctatgaaagatttacaatgttatttcatcgtttgtcatggctaattaacaatattagatgaagtttttcttcttcaaaggtctgattttttctcatttatttatgtcagaagtagtaagcactagttaaaggcccttgctagtacaggcagggagagaggggcactttgttcttttacacctcaagggttcagggttcaaatacctccagatgagaaggttgtcgtttcctttctattatgaataagtacggatttcagagtctcaaaagttcatgtctttgactacagaactcatgcttttcctgttgtcgggacggtgggggtggggggaagcaggttnnnnnnnnnnnnnnnnnnnngggggaagcaggtttgtcagaggaatccttttgctggggggggtggtgggggagcagcagaagagttaacacagacccccacacacccttgccttcagacatggtactgtgtccctattaaaccttgacacggagcccccccaccaccaccaccaagctaaggtggcagccctcagattgtggaagatggcggtgggttttaaagcacgcacatgtacactctgacccttcccggggattgccctgctcattcctgctcctcactgtttcttacagcagcagcaggtggctacccagcagttggctttccagcagcagcttctccagatgcagcagctgcagcagcagcacctcttgtctctccagcgccaaggcctcctaacaattcagccggggcagcctgcccttcccctccaacccctcgctcaaggtaagcacacggcaggggattacgtgggaggcagctctgtggagagggctggcggaggggatggagtgactcttgatctctacctgcttggcatgcagggatttacggacctgaaacatgcacagagaggcattagccaccggacagtaaagcagacagcccttgcagagcctgttggtgtcagaggaagggtcagggatctgagtgctcacagggaccctggtgcagtgttgggaaaagggaatcagatgttctgcacactcactgaacattccattgcagtcctttggcatttcagttctgagtgttctcgaaacttactatgtaatcatgttaaagcatgttttacaacacgagaagttcttttcctcttccctccttcctctctgtctctgcaatgcaccccttctctttctccctcctctcctcctcctcctttccctctctgtcatagcacaggttaacctggaacttaaaaaccttctgcctccacctcctgagtcgttgaagtatgggtgtgtgtcatgatgcccagctccttgtttaaacattagaaatattttataggaacaccatctaaaaactttatttttgtgtttttatttgtattggtgttttgtctgcatgtgtgtgcctgatggctgtcgaggccagaagacagtgtcagatgccctggttctggagttacagacagttgtaatctgccatgtgggtgctaggaattgaacccatgtcctctggaacagcagtcaatgctcttaactgctgagacatttctttagctttctaagtaccattttttaatattcaggcacactatcaattttatttccaccatgaatgttaaaaatcaatctaaattataaaaattagtgtgtggtttttgtttgttttgtttctgtttctttttacctttttttttcccctgctgattttgagttcattatctacccattcatttccagttattttttttaactttgattccctgaaaaatatcaaggagttttggtgggtttttttgttgtttttgtttgtttgtttaattatttatgggtatgggtattttgcatgcatatatgtctgcgcaccatgtgcatgcagtacctgtggaggccaggagagggcatcaggttctatggaaatggagttaaggatggttgtgagctgcctttatgggtgctggcaatccaacctgagtgctcctggaaagcagtatatttaaccagccttgcaaagtattgatagtagatatcttgaaaagctgcagccatccaaggctaagggaatctgtaggtgttcttaggagacctgtggaagcaggagggaggatgtagataatgccgtgactgtttaaaggccgtgtccctgtccgtgccttcgcagtgcatattctcagactaccaagtacacaaggaaagaaagaaaaggagcaacactgatgcctgtgccaggcatgcacaggtgactttcttgttattccatcaacagtactacatggcagtggtttaagtattcacatagtgttacgtgccataagtcaggtagggcttctttaaatttaaacttaggagttctttcaaataccacgccatcctctcctctcttttcctttcctttctttctccctttcttcctcctggcctctttctttctttctttctttcttcccagccagattcttactctgtaacccaagggtggcctccaactctgatctcagttccctgaacagcaggtgagattatagatgtgaaccacaccatccagtttatgctacacctctctatatgagggctttgagcatccatgtaccctgctgtccacagtaggatcctacagagaagcaaaaatgactgcatgtgatactgcagagtccccgtccttaggtcctgcagtccttcctgctgtagcgggtctgtgtagtggccactggatggatggtagccacagcttcctaagttttaggttccgttgcctcctggagcagcgtgagaataatggctctcttttgtgctgctgaagaggtagtcatttgtctcgaagtttttggtgttgtgtggagccagtggggtgtgtctgtttaggtttttgtctctggagtcagccacacccaacatctgtcccttatgggttttgttgttgttttctttgcttttaatgctcagactcaggctcttcctcctttcacttcctcctgccctcccacctgcccttgtcctgtctgctgagctgtttggtatctgagaggcatggcttccattgccgtccagtgggcaggagtgggaactgagcccagggcaaaggaaggacacgttggctaatgcgtttctgtgcttccataatgtcataacctgcattaattacaccctatggtttattgttggaaacatggcaggctgttctgccacacccaccggaggactcaagccttgctccctcgctccctcgctccctccctggctctcatcttttcccaccgctcctacactattaagtttgctcactgaggttcattgttgcagtacatcagttaagctgtccaaaagagggcaaatcggcagtggcaagacaagcgcttgtgtaatgtgaaagacgtgaacacggggatgcatgcggcgtgatgtccacaggaacacatgggagccaccgcaggctgctcactagccgtggctctgactgatgcgcttagccgtctgctgtaactattagcgtctgcaacattaggaagaagcctatgtaaaagactaaggggagtctgcatgtgcacccaagatggcatggatgtaaatgtctgccttgctggcattagacgctgggtataaagtggaccgccgtcattgctgctgtcttttgtaaggcagaagttccctttggtctccccaatctctgcaaagtggctggagagctttcagtcacgttgagctacaacacaattctttttttatccgagagatgatggcttaaaactgatgtcattatgaggtttaaatcaactttctgcttgcttgaacatggtcacctgggtacggatgtacaaggacaaaaaaaggttgatcaactgtttgtcttggagccagtgatacctggggttgtaaaattgagttccacgaccagtaatctgtcaactgtccccacaacatacattttttttaaacctgtgcctgcattttcttttataatgaaggggcaggttatcctgggagggaagaaaagaagaagaaaaaaaaaaaaaagaaatgcagtgaggtccaagggttaggtgtttgaaagtgctggtgctgctgattctaataaaaccatcaggattcttctgccaccccttcacagccttgttaagttacttcaaatctgtgtgtaaatctaaaagtataggcatattgaatgatattttaaaggccttccctccctggagattttatggtcgaatgttttctttttggattattccaaagtagttgttttcaacctttctaatactggacccccttaatacagttcctcatgttgtggtgagccccggctataaaattgttttgttgctttctcataactaattttggtagtgttaggtaccataacataagttgctgacatgcagattgtcttaggctacccctgtaaagagggttatttgacccctctgccaggggtcacgacccacaggttgagaactgctttagagtcccctgtttgccataataaacctatctgttctcatccaatttcatttcttgtttgactgtcctttacacctgtagtttcatgcagagctgtcctattcctgtttctataatcctttacttttttaaagtgtaaactgtacacacttgatcatataccaagtaatggatttgtctaacttggtagtctcactgtaccgttctggaagagacacatggtttctgaaagtggagcatccctgtcgtctgatgggtaagcagcttggctgctatctgcctggactctgccatgaggtgtaggcattctggggtggccagtagtcctgaggagttgaatcgaccacctctgccatccattgagaatgcctccaagcctaatgaccacagtgacacctggccccaaagtacctgctgttgctcaagagtctctctttctactgagtctgtatggatggcgagcccaatctgccaacctattggagtaaaagaagatcagaagcccaccagtgcactcactgtgcaggagtaacaagtgctgaacccatttctcttggtcttggtttgccagagaagtgctgtccctctggtacagcctcagaagcctgcttttctcagaaggagaaaggcgacaaggccagctgttgggagacccaaggcttttcctttgtgtttgacccagaaatcaattagtctaagtcggaaataggtggccatttctctccctgtgtttactcactagaaaatgcaagtaggtgttgacttgtgtgcatctcctatcaatacaccctcacgcacagaccagcctgtctccccacccccaacccccattgtttctcttgagtaaaaggtggtctgttgtctgagggtcagctctgtttacgggtaattgtgagtgtgcggatcgcagtggcagacctgcttagctatgggcacatcctcccgtcactttgaaaggtgtttgaaaataatagctcagacgcagcaccaccggacccaggatcgtgtcttgacctttccctttgtttaatttgcctcaaggtttgatttcagggcacaaggattaattgaatatgcctaataactaaatgctcatttgggacaaaatccatcaaaatataattggcatttgatttttatgaagggagaaggaaatccactcagctgtcgaggatgcgtttgaaggatctctgaccactcaatgcattatttttagcttcctttataatatatattaattgcaaatacttgagcatttgaacattttcccggagcactgctcagagagaccaactgtttttgttactgctcctcttagaaaggcggggaaggttattggtctgctgtgcaataatttactcctctttgatatgcaaacgatccacggtgaatataaaaaaatcctatcagactcatttcacagttcttaaccactgggattctctggagtccgtcgcctcattaggccagtgctctccaatgctagcataattaaaatctttaacagtttagcaaagtaaagatgtttggctgatcacgttgagatgattatctagccattgtattctaaatgacaaaaataaattaaatttagaccttggcatttttttttattatgtgttccaaatgaatataatgcacacagccttctcttttcaatccagtacattttggtttggtaagaaacatgcctgcttcggctgctgctatctaaccagaagatggccggctttctaggacagctgtgttccagttgacggatacagtgaactgcagtccagacatagcgttctgaggcagagttgccttgtggtatacagggtgtgtggttgcttttcctccttaagaggaagctgtctcctctgctgttcttaggtacagctcagaacctatctctcctgggtgcatgtgccctaaaatatacattgaatcgctgataggataaagatgcagaggtccacattgctgaggttgcataccgattatatcacatcttagagacaagaagggtcaacaaatatttttttttttaaatcctgtccatcttgaccccatgcaaacaagagaactttattccctttagcttattttcctttccatttttatcctgcaatggctcattagcattgagcccagaagtgacagtaataatagtgttacttgtataaaaagttacacagtctttggtagacacgtccatcaattaagcatgtggtactagaagccaaaattaatgaggaagataggtgtgttaatgaaataatcatagtataatcaatttgactgttaaaagttgaaaagcatttcagggagacggtatgaattcataatttatgtcttaaagtgattaataaaaactatatttaataacaaagctatttgtcatcatttaagacttaagcacaaaaattactcatttctgtgggtcccgttgtcaggagactaaggttgagcagatttgttttgaggcctcctttgtgcctagaaataagctagcccgtctctgctccccttctaacggcggggcgcagcccttggatggaagagggagcgatgttggtgcggagtagcagtgctctgcatcccttccaaggtatctgttctgtgtgaagagaggccttcaatggccgctcagtgggaagatgcgcttaccaactgctgcagttgcctgaactgggagggggaagaacagaaagttgtgaacaccccaaagcccccctcacactgggctttgtttactgactctttgatttaattactgtttgaagaggacggaattagctgttaattgatttgattatccaatttgtttgtttcaggcatgattccaacggaactgcagcagctctggaaagaagtgacaagtgcccacactgcagaggaaaccacaagcagcaaccacagcagcctagacctgaccagcacatgtgtctcgtcctcggcaccttccaagtcctccctaatcatgaacccgcatgcctctaccaatggacagctctcggtccacactcccaaaagggaaaggtaggaacatgcccaccctgcctgtggtcaatactgtcttccacccggaagtggggctaggtggcctcgcccagtcctgtgactctaagaaacctgcttgtattcagggggcttggatgcgcacataagtacttcagaatgtattcgctatggtttgagtgagaagagcatctaattatctttacctattcaacatggcgtcaccactttcttaggtctgtactcagcgtagagccctggcaggagtctagtagttccttgttggaagggttggctctcggagcatccaggccaactgtgtgctcttccaggagctctttgcgtgcaatctaaacagcttggtactgagcctcttctaaggcgacagtggtctatgctgtggacaatttcaggtcttggtttgaggaaacagcacttaatgctagtttacacagctcccccttgaaggcagggaaacccatgttattcatcatgtgtcccttaaggaggcacgaggccttttcggcataggaaaagggtttttccttttcgctaaggaaagatttaaatgatggtgagcaggaccacagcctgctttctcctgatcgcccctgagtgagtgctgtccagctggtatgttcctgtttataagttaaggctttatattttcaatgctctgagctatcgatgaatgacagctgaatcttggactgcgtcgtgttagcttcaaaatcctaaggaaatgaagccatttgttggttccgttgcacccagaaacagtattgctagtgtctgcttgagaaatggagtatacaaggctcctcaaatgaaccactttttctttcctgtttactagttttggactctttcctatatatttccatatatagagcttgtaggcatggagggcaagaaggcctgtaccaagaatttctcctatcgaaatactttctatcaggcaaaagcagatgctgtgttttgtttgtaagttcgaacgaaaagctgatatttgaaaaatgctgtccgagatactgcgtgcaattctgcataattgtgcagcggtgtttaggggtgtggccacctgtacagtggaaatgaaaaatcctatcacttaccagcgtatcagtgtagctgcacagatggagacattaccccatggtcatataatgaactcactgcactgtcaattgtataaaaagtatagcatacacagttatttatagggcacgacccttggcagcgataatgtgtgcagtcaacatgctcactgtactgtggtgtataatccttagttcaggatgttactcctacccataacctatacgaagtacacaaaagtatttcaccacgttagtctggcagcaacctcctacatcacgtgtcagctcatgccttggttacgaaatgcttttggtttactattgggttattttgaccgtctcctcatgtctgtgggagcactaggtgactgtacctcatgcgcttggcacatgtcacacatagcctgaatgtgtagtcttgtgccattaggtcttcataggtactcattgtgatgtgttcctgtctcagaatgtatttctcccgagtggtgtgcacacacataccatcaaagattttcagaggtgagggtagcacatgttataactaataactgcaagcctcctggaagatctccttgggatgtctctagtagacataggaagaactaaaaggtgcttgaaagtcagtggtctggaagggatggaagaatgggatggcgaacaggaagaatgggtttgtagcctgggctggacactgcttcctgcgtttacagctttccagtagtgacggatacgtggacctggaagccagtctttcgtctttcattggaatctattataatgtctttattacttttttttaaaaaaaattccaagtagtaaaccttagatggctttaaagaacagagtctaggctgctgccctttgtggtcccagcttctcgtgtccccaggttgatgctgtccgtttactgcagagtgattgagttacatcgttatccgtaggcgaagcaggaggctctgcactgaaaaatgccgactgctgcacttaaggtatttgttgcaatcttgtcggctgctgtggagactgcacagattttctgtgacacagaaaacgctccctgtttagatgcactgtgctcagtttcatcctaaaaggttacgtatctacagtctggtgatggaacagcaagaaagcgagcggggaagaatagcccttttcatgtcttaagacacgtttgagagtgagtggccagtggacctaaggcacagtccaattcccggagactaagtttgtttgatttttttttttttatggtccttatttgtctgcacaaatgttgcatttaatctcgtgctaaaattagactgtggatcagaagagaattgagatttccaccagcccgaatctggatgtgcgaacaggctgagttttggttgcacatgcagagaggaggcagctaggaaattatctgatgttacttactctctccattgtcccatggtatattatgtgatatgctgccagtggtgacgggattcagagggaactcccaacagaagcacttcgctttggtttgtggtgaacgcagggccttgttcatgttaagcagaagctatgccacaggggtaaatcctttccttccttcagcagagtctgaactgattataacaccctacattaaagctggctaagtagctttaagcttatggaattgatcattcagcaatcaatcgtcttttcgctggttttatatagatacaggtactgtaaaatgagtactagtatgctttcaccttatcaggatgtctgtctgtctgtctgtctgtctgtctgtctgtctgtttattggcagtgctggagatatgctaggcaagtggttctaccactagtcctcagccccttacgatgatgtattttaaaatcccttgggtggtggccacttcacagagtagaaaagggaaggaataaagaagcgggggtggggtggggtgtcgtcccttaccgaagtatcttctcactcacataatgagctgtcagggggaagacacctcaggcggtctccttgctgtcacaaaaccccttatcccccccccctctctctctctcatttgtgaaatacggatccttacaagctcccccttgattgctagggaatattcttctttccctccatcctcaatagcggaaggagtaagaggcctcgccactgcgcagtcatccggcctggtgaaccccagcctgagttagcagctttcaaggggattttatttttttccctgaaaagatctccaagtgtcttgtgcgaaaactggttggcgagagaaagggagagattttattattctcgttgttgatgttaaagttgtgggacgtgcaagcctctcacctggctcacacatctctgtgccgtttggaagcctccgtcttcccactcttgccccgtactttttttttttttttcagcttctgggagcagccgccacagcattagctctggggtttggtgagctgcaatctgttaaggagacaaataatgtgcttggcaccacactcctactcccctctttaatttgtcttacacaaggaaaattataattaaatcattcagggtaaacccttgagtgtagagaagggaagagacacactttggtaaagattgccaatagaaaccacttccgcgtagcgccgggtggagatgtccatcagtattcagcagcctgtgaggaggaggagcggcccatgggatctgggaggcggatgccagcactcagatcaagccttgttaagatcctgtcgtggacggtcagcgtcgttagaattcagtgcgggtgccccgcttcctgctttgagtccctcctgacaatttaatactgtttattgtgctgattatatataaagccatcggtgcaataaacacccctgtcgtcagtgcctcggaggagcacagggagatcaagttgagcgcgcccgaagcggaaggagagccgagcaggtgtgctcaagcctccttgcccgagcgttgctggcacggagtcggaacctcttggtagttagacagaggagagacgtgggacgcctgcacacatgaagacattaccttgttcactttacttgtggacctgtctcccttcaggaaatttcaagttttggtgtgggtaaacagaatcaacagaatgcaaatgaaacgtttattaaaatgctaaatttagtaagccctttgagcttcttggatcaaagcagctatgtaaatacaaatagcaattactacttaagtaattgcttgaattaaaattctaaatatcacattatattatggtgcaccagggaagggaaggcacattaaatcagtcccttcttgctgccggttgccgctagacccctgtgtatgcagtgatgactccttttatgtgtgcgactactgggaatgcagtggggaccatcgccccatttcacaggtgaagcagccgtgttacagaaattacagggcagctctaaggtcgtatgcctgattcctgccatagccaagatccatattcaaatctgactttaacttttttccactcagtataggagtacttaagtgaaatttaaaaccagtgccccaaaagaatatttaaatttcatcacagtccagccaaatatctattaatgtgtgcagattgcaacatgtaaaggaaaatgggttccctatttatctttctataaatataaatagttcctaagtctttttatctttgatgaagggaggtgaggttcataagagatagatcacttatggtctgaaatagtacacaagggttaaaaaaaaaaacaaatcccctgcaggaaatacagacagacgaatgcaagcaagcctgtgtcctttatggggtgtcccccttgctttctgccctgccttataaatcttggtgtgtcctgaatgaatgtgtcatgtggtctttcttctatgtcacctgccttctctccacagtccaaattagaaacgttgtgtcccaccccggcccccaccatcttcagcttcttgacttcagccactagcaaatgttttatagcaagtatttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccttccctctgtccaggcgtggtattgctttctgcgttttcatgcccgcttactggcataggccgcacagttggcagccgccctcacataagccctgaccacttttgcttggcttctgtgctttggactgctccagctgattctcaagtttccctttttgatttatggccttgaggacacagtgctgtgtatttgtctgtatcccagaaacatttgtgtttgtggtctctgatatttgtgcacatcagggaccttgggaatatgggcgtccctggtgctttgatttgcttaccctttcaaggaaaaaaaaaaaaaggtaacaaacaaatgttggttgataaagaaatattggtgcccttggctgaatcactaacattctagaggtttgttttcagaactgttccgggctcaggaacctttaactttgcatattctcacagtgacatttaggggtccagtgaatctgaaatttcagcagtaaattcaagtttccacttttgtgaataatgctttcatactgaatttttgtttcttgtaaatcactttttttaatataatttctttttatttaaagcactgagaaaactcactccccaacctcatcattgtttccattaaagcctttctgaaagatgctgtacgatcaaatcccaggtttgcacttgttgcatctccaagctgccctgtgagacacttaagaggggtaccacataggtgcacacttgggagacccaccagccaaattcagttacacccccccccccttaattctgtaaatactttgttaggatagaggtgtgctcatttgcatattttcatatttctcaaaattgcaaagatgagtattgtaaacctcagtcttgtggcccatggagggcaaacatagttaccaaagcaaaggtggctggggtagggggaaaacactgtctgttcagccgttaggctgtttctcagatcctgcggtgagtggtttgcttgtctccaagtgttagggattcaggacagaagaggttttgttgagtgttgagctttccaggcccctctctgtaggacttgagttcctttggtctatttagggtgtatgtgaattggtactgtcacacagatactgtggtcattcaaatgtgctcacctggagttgttttgtgtcttgattgagaagtcttgatctaataagcttggatggatgttgtcatagattccccagaacttggtcacagaagcccattcaagtattagaaaaacagcttcactaggccatgagctggtaggaaaaggcacatttattcccatgagttgcttagcatcctaggcatgtccacagaagtaatggcttgtcactcttatgcgggctagtagacattgcattagaaagcccagttttgaccactacctgtccttgagttgaggtccatgttttggctctgtagtcagaggcaagtgtcataacctcttttgggttttctgtctttttgttctttgggaaatcagagcatgccaggtgatggtgatgatacaaagtgcatctgtaaatgtttgtgaaacttcatgcccagtggagcttcaagcagaggccctggtcctgatttcttttcctttttaatcctccccagtaattttctggtctcctttgcacagatgttgcatccagaccacaacagatgttcaagcttgcagaagttagatcagtagctagtgaccacccagggattagactagaccctaggtcttccagaccctcaagtactgagctcccagggggatagctcatcagaagtactataactcaaagttggacatttgattggtcaaattcagaggtcaagacttagaggcatttctataacccccaatggctgtagtctgtttcccaggctgtctgcctgtactgctagaattggaaagacttccaagaacttccacggtatccattgtctacctcacttgcctgttaggtttcaaagaagggagtgaagaggctggaataggaatgtgtgcatcagagtgtgaggcatgctctgatctcatgacgggcagaggacaggaggacaagtgttgttatgccaatcacccttgggctcagcagcctattggctggcaagcatgatacagggtgtgtggcagccatagcaccctgagctgcaggggtttatttatttgtttcattgctcttaagtgatccttcggggtccccttagaaggaggagagaaaattctttcagggaagtatggcacgatacctcatcacctcctgacacctacacatttagggagggcgccgagcgggaaaaactggagaggttgaaataccataggggaaaggtttgtagattttttttttcttgactgttcactttgtgaagtgattaaaagaagggggaaaagaaaaccccaacgatcattctctataacagctgttgtatgctacctcaataaagtgccttttaccataacatagcatcattagactctataaatcttaccctgtttattgtgcttaactgacaaatgctttccaataaaatgacatcattggcgtgaggagttatgttcattttataagtttctcttaaatttagatgattttaatctccccccctttttatgttggatgatacgagcccctaactgtgtctgtctgacatgttttccactccaaataatacttgaggcctcatagtctttgatcttgtggacactctctttcaatgcaggactattgccagtgggagcttatcacctaatccatgggtggcaccctcccactcgggggttgctccctcccccagctccaagcatatatttgcatctattctaatactaacagctcactgagactgtagggagagcacctacccatcagagaggagcgagagccacgcttcagggacccttgacggccctcctatggtattaggtttttactctttacttataatggctcatgctgaacctcacacttttaccacctggattaggtgaggaagatgtggcttttcagtgggcattagccattgagaggagaaaaagaagcctagagtatccacctaggaaggcatgtgacttggctaggtcccagtgtcgttctattctcatataaatggcaagttcccatgttcctaagtcaataccggggccagtgctaggacgtcaagttgttgtcatctcaagattcataaaaatgctcatctgcgctgttccccagctgctctgtgcagtgtttgttttttgcatctgtcttcccccaagcctggctttgtgggcctttgtaggggagaagcccctcttgcgggctggctcaccggggcgattcacaggagcgcgttacatatgtacagcatcgcctgaagttctttattctacccccttttgtgatcagtcagggcccaagtatattatagagtgtagtctcctcattaaaacaatagcgagagctcacaaagggaaattgttaatatgtgttcccgcctgtcacttctgcccgtgtgaatacagaagataaccgctcctttgggaaactacttcgggaattgagcaacacatccgctagccagagaattctcctaactgcaattttcctttttgtgtgtactcagaaataacatccttatgggctgctcagtgccacggcgcagacagagcacaattgccacagcccaggtggcgttaatatgggacaatcccccgggcacatgtcgccaagagttgtacagcttgttcagtgtcttcatccatatggcaatctgtcccattcacagaaaggcatcagggctgtgccgggtggggaccgtggtcaatgtagtgtgaagagtcaggctctgttcatgcctcctccctcgtctggaatatttaattgtagaccagcaagcactcatctctctctctctctctctctctctcacacacacacacacacacacacacccttgttaacctattattcagtatcaggagcacactgttaagtgagcaggcaacattctagtgtacaaaactcccgtgatgactaggaaatcagctaacatcccacacagagacctttctaggctcttgttcaggagtaacttagcataagtactacatgcttgtactaaaattcttccagaaaccgaaatgatttttttgttctctgtggtttttcttccttacaaattgtaaatgcttttattgtccaatttgaactgttgagctaaataattttggcttctaagtcttaaaattaaaagaaaagaaaagaaaagaaagaaagagaaaagtggagtgtgtgtgtgagagagagagagagagagagagagagagagaacattagaatggtgagagtaaaacatgcccctggagagagtgggggaccctccatgactcccgaagtgaaaggagggacgttttttaaaggcacttgaaacattttaccagaagtcactacaagttccatttagacactggccccacatcgtgttctgcttttgtataactatttgtgttcttgtttggtaaacagaccccatagcaactgtgggccatgatgtgttctacctgtaagacttccctaaacaaacagactctcatgaccttcaacttgcaggccttttatagtccttgagagaagctgtctccaggctggctggtctgtgtctctctctctttcttccttccttccttccttcctccctgtctgtctctctctctctctctctctctctctctctctctctctctctctctttctctttctctccttttaaaaaactaccctgaaggctatctttgagggacaatctcacaggttttgtgttttgcatgttgactgtgaatagtgaaagagctgaggactgaggtggttggcggaagggaaaaagctccctaacacgtgcaggggaaatgaagtgtacagtgtgtgctttcagagaggcggcctgagctccctgggacaattcaaggtcactgtatatcatgtctgtggttatttctctttgtgtctaaacccatcgctgggaacattctggtgtacatgagccccgatactcaacccccatttctctatatgagtcatagctatgacaagaaacgagacatctcgtgttcaagatcagtgtgagagataaatggcagtttactttaattagaaaaaaattgacaccaagagctgggagaatccagtggcttttgaataaattagaggatggtacagactggaataaaacagaaacttaaggacaaatgggaagttgtccacagtttaacaacaacaactgaaaaaagaaaaagaaaaaagtgtttctaagtgggacacagtctggggacagtagtaactaagtatctgttggacaagagttacagctgtgcagcttcaaagtgtttcctggggaagataaactggtgtcaaagaggaaatagagaaaacacaaggccttaatgaaaagacagttaagtgggccaagaaggcccaggaagggcctaagtgtcaccatgtggacataaggtcactaattggatacatgggcaatgcagggctggcgaatgatctttggacaggtcaagggatagctctcccgtttcagggcacagcacaaacaaaggtcctgaggtggaggcagcagagcctgccctgaaaaggctaccacctgtcttagttaggtcagggtctttgtgtggggagatgttagggacactctcaccaaggcaaagctgtatagatccagttaattcctcctgatgggcccctgtttcctatctctggagttagtgtgatgtttcttactaggtttgtccaacagattaaaccatggcaaccatagaacttataaatcttctagttgcctgcacacagtaggtcctccccgtcagtactcactgttgtcatcacttttgaatatacttatcaatggattcaaaacacatgggttttgtcccagttatatagattctgggtattcaaagatgacagtggtacagctcttgccttcaggagctcagcgtaaccagagagacaaatgggcagacagacactcatgacaaaagcacgcagctggatctaacacagtatatgagctgctaaaaatacaaatggctgctagcagggaagcagagtacagttagcccttcacacatgtgcctcctgtgaggattttaagtgcactgccccccccccccccagtggggataagttcagctgtctcttctaatgtcgacatccttgtcacccgttacaaccagcctggtgcttggtaggtgctgcctccactgccgggactgggtgcgctactggcaggaaagtggaccaatgagatggctatgggcacaaaccctttagcccactcgtggcatatccacctgggtagcctgaggcattacctgcagaggttcctatcaaaccgaacagttaggtctctgtgcagtgtagattttaagcttaaagaaacatgtaccagaaagacctggagggctggctgagcggcaggagtgtttgattcagtaggtgagtctttatcagccgttctctgagaagctcttggtacctgtatgctgccccgtcctctatgggtgtgtgagggtccttgctgagtgggagggacagagagtcggtataaagtgtggcaactggaaaaatctgggtctcactgccaaggcataccgctccagagagagaacccttaaggctgtggcccgtgcaaaggatcctgggggtggcctttgtgttatctctaggtaggctctggttttgtctgtataaagtcctttctttgtgtttctccgtctgctgtgttttcactcttgcctgagctcctacagatgctctaaggcccagatgacatatcacagcactctgtgctagagtccagtcccgtctcccctgctggggaactggacatgaccatttcagagtaagagtccctacttctcattcacagcccacgccactctgccggttcaccatcaactaaaacaaacaaacaaaaacccaacatttttctcctattaaatgacttgtgaatccggtatgcacatattctattacaccacccatgctaaaatttcagagggcgagagagtaagatgtgtgtacgccagcacaaatttaaaaactagatccacgcatgctctagacagttcagtggtatgttagccacttggaaattgcacgtatcttgactagggaactcatgagctgcgttgcttacccagtgaacatttacgaattagcatctgctggggcaaaaaaaaaaaaccacaaaagcgtgatggttttgagcacgttgcagcgtgtgctctgcttgcttgttccttcctctcctgtctcctctgtctcctcatctggctgcccatgcatgagtcttccacctctggagatgaggtgactcctgacagactcccattgactgacactggaagcaatggcgttggactcttcaactgagccactctttggggttctgggtgtcacacgttggctcctctgacatatggccaaggttccatggtgaccccatgactcgccagtgcacacacagagaaggagatccctgcctggtggtgttaataacttgtggattagtggcccctgtgtctgtgttgacacagttgctcgcggtgctccttggaaagctttctgctttcttaatgagacaccggtgttaattcagccaatggtagaaggcctcagtcaccaactctgaacaggccttgctggtgtccaggacaatggctggatcgtggccgcctctcactcttcgcttctgtttattccctcattcagcacatcacaaatacaggtgttctgcctgtgtcaccacctgccccgtgtgctgcactgacatctgaagaccctggccagccttcagttctagagttctccccacccccaccacatccctttgttccgatgtgctccacactccttgtgagttgaaacacagataccaagttcctgtcagtcagggtagcttacaaaaggtgtgtgtgtgggggggggggggggttcaggtcgcattggtgatatgatcggagggtgaagcaggttaatttccagacatactgccaagtgtggtactcagcctccagtgctgacggctagccgcatagctagcccacacatgagatgtcctcacctttacagtaaccagctctgctcaagagtactggacacagcagtccttggagtgaaggcccccgtgaggcttacccatgttacatgtagggtgactagaaggtttttctcagtcgacatcaaacatgcagtgtgtcttcagagttttgctgttggggtggtgtcagcatagaaagcgagacatacagctaccacatggttctcctggaggctttagcttgtgactctgcagtcatattaacaggtgcctctctggtgtggggtttggcgtatttacttgtaggattatttgtggggttctctttaaagcaagtcatttttaaaaatttaaatggaacacatctcaccctctgaaatggcacttgtgaagtatctaatacacataccttgtgtcagtgggtcttctcgctcatgcctgttccacctgaccccgtcagcatacctttgggtaaggagtatttcaataggagttcctccttttgtagaggaaaggacctcggctacgtatatactgtccttagtgcttctaaatccagcctgcatggcagacctagtttctgagaaaattccacactttgctcccactgccttgagtctctttatctcctgcacagattcgtttacctccaggtgcaagggtagaatccagacttagaagatactcagagcagatctagagttttgaggtgtggcccagtttgtaggttcagctatgtatgctggaatagtcttgaccagtgtgaaacttggcaaacataattcagcagctgtggctcaacatgactcccctggtccaatttggtgtttggtaaacagaaggagagaaggacctggcattggcctttcctgttgttatgtatgtatgtatgtttgtatgtatctcaaaagcaacaggagccttacatgttacagcgggctggtgagccttcttaggagcctgtagctgttaaacactaaggccacccagtggcaccatattacctgtttctgtatctcagctttgcattgcaaaccacattcgatagaaaatgtgttctgagtgccatctttaagcccagcccttccagagattagctgcaaacaaggggtgtcttgagattccttcctggcatttaaatttaaacatcttaatggcctagccacactagtgaccccaggagcctactagatatgcagattcctgggctcttctggatttttgcatcagagtccacacacaaccatctccaggtgatttatatcttggatcatgtttgagaagggctattcttagactagtactgcagtgaaggtgtgagtgtcctgagccctacacacagtattctaagcctgaccagctttcatgagggcattctcctcttctgttcagttttgggtacctgttactgctttcttaaaaattagcctttcctgttatgtatacctgagttttgcctgccttatgtctgtgcaccacatgggcacaggaggtcagaagagggcatcgaattccctaggactgaagctacaaacagttgtgggtacttgggatcgaattaggatcttctggaagagcaagccacagtcataactactgagccatctttccagccccccccccccaataaactgcttcttagttactattttgtttagcagagttcataaaatgttaagccgagcagttacgacgctaagacattcagcacagtgtcttatgataccaataagcagaagggtattaggagaaagtggtagtatttggagcaatacctaatagtatttgtatactattcagacccatccagcccaccaggagtgggccaggccctgagacctctgcaggatgggtgaacctacatttgttagactattgcccaatctaaagcagcctcggcatgggctgttaaccacttgtattccagaaatcacattagtgaggggagtgacctgatctcatcttaaggcacagtgctgacaacagatatggataatagtctccattattgattaaaagcacaggcctgacactcaggaattaatccacggtcatttcagttgcaagtcgacctggtgactatcctatcacctggtgacctatcacctggtgacctatcacctggtgactatcctatcaccaggggtgtgaagttctgtagatgacatgatttggaaaggaccactgggaagatacgctttctaggaaggagagctgaggatttctccatgaaagagaagcctgggcatttgttctggtaacaatgtccatctgtatttactcttgctaagttggttcatgagctacagtaaatcaacccctttctctctgacagaatctcagaagaatgaactggctggtaactaacacgtagccaggagtgagaagggacagttaggctgttgagtgcgctgtcttctttattagtaaatgcacggtgtgaactacgaagcctgtttgcctgtagaggtgtctttgggacagtaaaggagaaaggtttatacagagctgtgtggagcacatctccgtgctggagtgagtctctggacttcccgctcccacatcgcatttgctcctctgtatgtaggtccaagacctttctctgctacagagtaaaacttgacctgtgattggacttccagccaattttgaggtgaatagagcacagtctaaaaacactccaaagctggggaggtagcttgagtgagtaagggtgcttgctgcgcaggcgtggggacccgagttcaaatccccagtaaaaccaggtaaaaaactagacatgacagcatactcatctgtaaccctagcacagtgggatgcagaagcaagaggacctttggggctttttagactccagcctagttgtgttcattctcaagataacaagggtgagaatattatatccacccaaaggacttctctgacctccgtgcagacaggctcatttatgtgcccgcctccacgagtgtgcatacaccgcacgtaaagataaatatacacatagaaaccaaaacatcctgagaataaacactgaatgtgaagttggacagctttacgtatttgaatcctgttttacattgtgagtctagtgggcctgtgtgatcaaagtctgcggccatctcctcctggttggtgccactatttgtttgtgtttggttcaagttggcttcacaaactttttacacttgtttttagaaactacaaactgaaaactgaagtctgatagtgacttcttacataatgtcctccttagaaagctctcaaatcaaaattttcctcatatatttacacccaaggagcttcttaaatggtgcttagagtctcataattgaatgcctaccatcgtggcaaagcagtgggtaagggctgtagaaagtgggcgaggggaagggaacaaatagcctattcctttctttctttctttgttcttttgtttcgtttttgtaagttaacattgaagaatggcatggatattaggtggaaaagcttcaagcagccatggcttacagtaacatttgctgttactatgagcattggctaatggtaatggaaggatgcttttatttctgcaacagacagccctggaactgtgtatccagggaacagacttctggacatcagaagcagctcattcagtgtttgggctgggaatgtccggaaccttctcactcaaagttacgtgaggttcacatgagatggcaggagtctgtgatgacactgttactatgtgaacccgaggaaggttggggacgtgaaaaggagtccagggaactgggaaaataacagggagagccttgagctgtcgggagtcatggggtacttgtggacaaaggggcttccatcttcagtacattggatgtgtgtcagagccagagttccatacatatgggctatctgctccctccctcagtgcacgtttgaagtggtgggaaccaagggatagaggagagtctgtcaggaggttggaaaggtgattggttatatttgcagcaggcaggagatggatgagagggtagcagcctgttcaggtagcatggcacctcactatccagaaagcatagctcacacagtattcagtctttgaatgaactattgttggctgattgggtacaagatgtgccacgtggacatattttagctggtgtccttggcagaagtttggtggagttgttttttgttttgttttgttttttaccacagggagggcctcctgtgtggttggttccttctgtctttttaatgaggaagtagcgagggagagtagagaagccattagtgcagtgatatcaacaaatggagacttcattggctgagctcctgagtccctaggtggaaataatacacatgcagtacacaggaaaggaaggggtttggggccagtggggttcaacccaagctcacacttgttgactttcagcaaaggcttgggccactccaatgagaatgcagtcatctttccctcagattgtgataggtgacattcaaaaggataggacagaacccttgccgtgcatcatatgcaaaagttgactgacagagggtggaacacagagcaggaagggagaaatcgacaaaactggcagaaaccaacagtctctccgccttcagtgtcttgaatgctatgtcagaagtgaaaggaaacaacataaaaatgcctaagttggactttatcaaaattaaaaatttgtgtgcttcatagtacaccatcaagaaagtaggagacattccaaatgagtgtaaatatttgcagttacagctgttgagacatttgtatccagaagaagaagaaaaaaaaagcaacagtaaaacaatgcagttaaaaataggcaaagaatttgagtatttctctaaggaagacatttctctaggcacttctctaaagcagatgcacaaatggccagtcagccagagaataccttcagccctgctgcgtacttagcaggtgtgaactaaggggtcggggagtgggggataagctgtccttcccccgagctggtgagtaaaggagagagctacaatagcaagtgctggcgagaaggtggggatgttgcagcagcccttgcgggatgtaacttcgtgctgggactggaacaagttaccatgtaaccagataggcatgggcagcctagaatccaggccttggaagacagagaaagaggatggtaattcaaatcctgccagacagacagactgagagtcagagattcaaacaagtaaataaataaattaaagttactatatagccccacagttttatttctacatgtgtcttctggctggttgatttgctttagtttttattggtctgtttattttcaaagagagaggcaggcggggggggggggagggaatgagttggttgagtggggatgagatgggggagaaaccatgatcagaataaaaaagaaattactttaaatttaaaacaatgaggagggagcagtaggagtggaagcctggggaccaggatgcctgtggtgggtcagtgtcttctagattgcagggaagctgcacctataagatctcaaaaatatgcttccctaaattagacctgcataatgacaacccagctgacctgccaacgtggataaaggaaatctcacaagacctgagatgcaggctgctgagtcagggagaatcagtcttctctagagatgggtcccctgagaggttacccagtcccaagtggtcaatccgaaacacatgtacataagagccatgctaagtgggctcagtagacatacatatgtgcatatgtacatagtaataattaaagaaagacaggtcaggaatttgagagggagttaggagtgcataggaagagggagggggtccaattgatatataatatttatatataaaattctgagaaaaaactttaaatgtgtttaaataggtacataaatggacatatctgtagcagcaagtgccaacaagtgaaacagcccaaactgttcaccaagtaattattgactttaaaaatgtgctgcatagctcttgctctcttcctctcttgcctctcttgcccccttgctccccctcttgcctcttgccactccccacttttcctccattcccttctcccctctctccacgtcgccatggctggcctgcctctacttctctactctcttcttctctctgcctttctctgcctctactgccctcttatctcccctccccatgccctgaataaactctattctgtggtttaaaaaaaaaaaagtgctgcataaacatagtggaatagtattgagccaggacaagctgcagtttggatatgttagcctctaaaacatgctaagtgaaagaaaccatacagtagtgagctcatactgtctgatggtatttatatgaaatgtacagtacaagcaaaggtctagggcctaggagcagataatagggagactgcaggcaggaaggaggtagggagtggctgttgctagatacagagtttctatagcggtgatacaattattttctaaggagtctgctgtaatggttctgtaactccaaatacatgcaaactcattgagttacatcctctaagtgggtgaactcttcaatatacgaagcacgattctatggagcagcaacaacaaaatcatgatcttaagcaattccaaaaagctcagcctagctctccatgacttagcttattaagtacatgccagtttataattttgttgtgatgggtggttagggagaggggcgtacaccagtagacactattgttggcttttgctacaaatgaatcaccttttaaaagaccaggtaggcaaatttgggataggacaaaactgagctcaggggggactcagagacatgtgcattcatgtgctccttgtgttaaatatttagttgtagcttttgtggacggaggaattgttttatatagcaaggccgatgtgtaggttggcagagcatgtttgattggtgcggtctgtagtctgtctctttagtcaagaattcctcttcctttggtcaccacagtggcccacagctcgggggtcactgaagtctgcacagtgttaattttgagaagtagtccttgtagcaggtgacaggaatcactgtaggcagtgaacgagggagcgtaaagagaactcactcatccaaactaacccaagaggcctgaggatgtagctcgggtaggacgctcgctcgtccagcattcagaaggcccagggttcaagctctagcactgactgaaaagaaaatcttttccaccaccaatgtggaagtaaagacggtggctggtgtatgtcagtgtcgggaaaataaatggaacggaaatagcatagcaaatgtcattgggaacggaggcatcacaccagagcaaatgtaaacgcattgataagtaccatgtagtgtcaggagttagctcatatctgtgtgtaattatactttccctggcacgttgactccttcacgtctgcaacgctaccactgttctcctggtaaattatatttagttcttacgtagcaaggattatcaggaaagatttaaatcaattggcttttctggaacgtatctgtcctgtgtttcacatagacagaataaaatttagtagtacaaattgtcttcagcaatattttctcctgggggtttgcataatgctggtctttacctacaagaataagagaaaacaaatattgagtatatcaccatacaaaaacgaaataggatgaggcgtttgctgtcttctcattgataaatctccacagcatttgttgagcacggcatgaggcgctcagtatgtgagaatgagtgatcactacctctaagaacattcagcctgggagttagagtaaaacaaagtagaattttattgagcatttgacctggggcctggcatagtctagtgtacacttgtaatcccagaatttggcagttggcaactggaggatcaggaattcaaggttattcttggctatgtggagttcacagctacctgggcaaagaaagagagagggaggaggatggaaaggaagtgaagaaaaggaaaggaaaggaccaattggtccaaacttttcacaggttcattttgggtaaatatgcttgagcatcccaaaaaccagcctggtgagcatttctcacgttaatggtccactctatcttcaccatcacttgtgaccagtttatgccatgctgagtcttggttgcctctgtcagaagctcatgtgactgctgtctttcagcctgctttctttcctggagcttgaaatgaactgaagtcgatgggtttgcgttttctttcttagcccctttgtcagaagccaagaaaagagcacaaagctcatgtcccttctgttctcttgatgaaacatggacgatgctgtacctgggccacatggtggctgggtacagaatgactcagggagccagaagccagcctcagctgtgctccccgtggctgtgctgctttcctgtgacagcagagccaatggcaggctgtgagtctggtcttgagtggtgcttgcggttcctcctactgtatgcatgagtgcacacaacctaacaattgcccgtcagcaggtccctacaatctacaaaataaaaacctcctaaaaggtgtaagaagttgtgaggtaatactcagccttccttggctcccatgcatctcccaggattgaattgttggcctctgaagagtctttccagagatcccactggggtaccactgccaacctcttcttccatccagacctaagcattttcttcagacagtggaatattgaaatgtattcagttacacagtacatagggaaggctggtgagatgcagagcagtggccacaaaaatgtgacctgtgatgtctagggagggttggggtgagcgggtactgtgccagccaactcagcactgtgacaacaagagcatgcgatcttttcagaagaaggaaaggtggtgtcagttaaattaacaaatacctgttgttcattaaggctttgggtatcaggacctaagtcttctctccatcctcgagctgactccaagttgaagtagaaataaacacttggaggagaacagttttttatttgtgagttcatccaaaaaacaacaacaaaacaacagcaacaaaacaaataaaaaaaaaaaaaacccaaaaccaggcaggcagcaagcattgtagtgagctgtgcatgttgcattgataagttgagaatgcttgactagactagcgtcatttacagttcctgaccgatgataagaactctatggtctcagtagccggtggatgacggtgcaggttaggtaggtgcaggcactcggcaggcacggctgattccattgtcctagtgaaggcaatctcagtatcatggattgctgattctgagtttttcggtgtcttttagtagagatcagtgtttgccaagatgtttagcctaatacattttatctctgacattacttatacacttattatttcatacttataagaaatacagtgggaatccgagtgtacaagtgataagaatggttaaagttagatgcagaagacggttccatgttccctatcagtaggtgaaagttttggagactagttgatcacttgagttttgtttggttttacaaaaggacactatgactagagagatggcccagtgggtaagaggacatgcggctcttgcggaggagcgaagctcacttcccagcacccacgtggtagcatagctcatatactggacctaactccagtgtcatgggatcttgtcaccctcttctgacctggaggcaccagacatccacatggtacacataaaacatacacattaaaaacttacaaagcaaaatggcattaaatgtaaagattatagttcctcgtgccttttagtttatctaaagttatataaacttacatatatttttaggctatttattctcagtattttccaattctttctgtatatacacacatttatacacacatgcatatatgttctaataaaactaggaggatacttcaattagcttctcatcaaatagctagagaaaatagtgtggtagcgagtcttcagaaagcactcagaaaggcatctttaatatattctgcctttactnnnnnnnnnnnnnnnnnnnnattattagtgattcataactgctcatgcacaaacccaaacctttgttgggtccagtggaatttcttcctctgtgcctagtgagtgcccctctgccgttggcttcacaaatttccctactgatagccttgttctcgggtttatttccttttcttgcaaggtggacatttcagctaccattacatattactgtttttaatttttaatttttcttttggtttccatgtttgcattctttctgagagcaaaagtaactcactggtattttcacgttgttagatttttctgcaaaataattttaaaagcatagagagaccttattggctatgggaggcattacttacactctggcgtgttcacgctgaatctctgtgatttgaaggtttgggatgtgctcgaagtggaccggttatgttgtaagggaggggccaggagcatcacagtctaagcatgtggtacatgaaaaggtatctcactagtgggataaaatacaagacagctgaacgtgtgtgtacgtgcgagtgtgtgtgtgtgtgcgagtgtgtgtgtgtgtgtgtgtgtatctgttcaaaccaaggagaggcagcagagtaagttacaggatatttcttccctttctgtaaagggagtatgcctgcgtatgagccagaacacttgttcactccacatttctattggatgaaagctaaggttatggaagtgactgtaaaaataatttgtctgagggaaatgtggatagaaaaaatatttgagactgtggctatcctcctccctgtgcaccacatggctcagatcaaagcatctcctgactttatcttagtggccagatcattacttatcgatcggcaccccactggagcattaaccccttcctgcccacgcttactctcaacgtcaactttgctgtcggtaacttgagtaatacaacttcccacaaccacaagttaattctaagttaattgacatatttgccctggaaaaatattttttagtattgcacattttttattttaatagtttttcctggacaaaattcattttataatgagaggacaagacaattaaattttgtgaaagtcatttccatagagaggagaggaagaagcatgaaatgtcctacgtggaaaatatgagagccacagactcatacagacttgccagtcgtattctgttaactcagtatggccattttgcagcagcctttgctgtctgagtagagacctttgcttcaaacaaaaccctgtcagacacttttcacacatggaggtatgtttctaacatcaggtaattatacttaaatgtgtttagaacataatctcacagctcatagtttaactcttgcttaaaagaaaagagaaaaaagaaaggaaaaaaaatcatcagaattaattagattccttggggaatgacaattcgaggtttgtcacgtgccctcctgggccacgtggactctccaggctgggttttactcattctctgtcttgtgtgttttcttgcagcttgtcccacgaggagcacccccacagccaccctctctatggacatggcgtatgcaagtggccaggctgtgaggcggtttgtgacgacttcccagcctttctaaagtaaggatcatctgccttgtcttctcttgtcacacagctgtccctcctgctgtcccccttcacccattaggttgtcttcctgttgaagactgccacacagcccttcagagggtggcttctgagtcaccatcacaggaacttagatcatccctggagggttgccctgccatgggaaggagacttaaagggaagtcaccaatcaccagtcagtttttgagactaaccctgatgcagagagacgcccactgtggacctttaattctttagctctccctagttttgcacatatcccaatctaactccagaaaagctggtgtcagtgactggtcctttgtagtttagtgactgggcccctttgacatcgagacagtgccaccattttggtttcttacctctctatattgggtggcttctgtttaggtcattcttctctcaggaagaagtgggtagaatatgatgtaaactcgggctgtctcatcccaagctggggagctgatagtcgctgccaaaacaggctgcgaggcttctccatttgaagtggatctctctgcctcacaactctgagttcccttaacctctcccatgctgtcaggtcggttaaaaatctgaccagctaccctgtgttcttgacattacttataaacaatgctgaatccttgaccagtgtactgaatacagtcgtctaagtgttctgttgctgtaaagagataccatgactaaggcagctcttaaaagaaagcctgtaactggggctggctcagagttgtagaggttaatctatgatcataatggcagaccgcaaacaggcatggtgctggagcagtagctgagacctcactatgctgatctgcaggcagcagacacagagagaggcactgagcctcctgtgggcttttgaaacctcagagccctccctcagtgacacatctcctccagcaaggccacacctcccaatatttctcaaacaattccagtaactgggaactaaacatcgaaatctatgaacctaagagggccgttctcatttaggctaccacaaaagtaccatcttctatttagcatgcatcacatacagcttctgtacatcaaggcacatgatggtttctctagagtgagagcatcctttatggctatctttatggaccagacacgaacactgtaatgcagccacccctagagatgcttgtagtattgcctgccggtagttttctgtgaatattttattataacagcaatgctataagaggctttgaaattactatatagcttctcatattgtatccttcacctcaagattattttgtggtcagtgcacacgtaggccatgtcccaaaaagctaggaagtctcaacatctagagcagcaatagtcctcgccaactgcatcattagcatttagataagtgggcgctagctttgtcctctgtgtagctccctcatggaatctgttttgttaccatcctgatcttggcctaatggtgtttatccaatgagaggaaagaacttcccgggctacactcagaaactctgatttcccgggctgtaccagtgctaagtaaatacggtactgatttcactctcccggagagtggctgacaagcatcggtcaacatgttttacgtttataaaatcttgaattataaaattgctgtcatcactcgtgtgacatgtctcatcagctctagggacagaaaaggcattgccagttcccccactttgacccaatttaaaaactttcattaatggtcaaagtattcctatcctaatcgtcttcatgtcataggttcacatgctatgagccggcagttaagctatggcgaggcctcaggatagaggaagagcgaataattcaaaccacttctaaggtcggagagggaaaaaaaagcagagatcttttgaatcgaagcctaggtttacctcctacaaacaagaagcccgctcaccgctcaggctgtcaggagcctggctctgagctggaaaccctctctccagcctttattgtggttttgctcatggcatgacaagctcctggttcctgtttgcttggcggaactggagtgcctgctatcaacttgcaatatagcttgcttatttcctactgtttgcttatgtgccagcattttttcagaagactttgtttgcaagttgtacaaacctgacttgagttgatataagaaaaaaagaatagaggcagtgggtgaaaatgagctggtatagaccggaactcctacagcttagttagcgccaggcgtgccaggatccaagtggctgctgtttggggttcccattagctctgattctctctctattgccttcattcttgggacctttctaattggaattggagaaaacaggattgtatgttacggcatgatccctcccgagatgcgggtttttctcctgtcctcttagccttgtgtagagaccgccacccatccagattaagccccgctgctctcgttttgagccagactccattccgtttctgcctccagagcaaagggactcagacacatgatgcatctgggaatggggatgagagatgtggacccagaaaacaaaagtgagcattcctgtggcagaagcccgatttcggatcccgttttcccctccttttgcagcaagatttcaacgctgagagactcagacttatctttaggttcaggatcttccctgatgaagtagaaaacaagtaagaaacttagagtggagacttagagtagcacatcgccactcagcccccaaagagaaatctctccgctctgggtgctcttgcagttccgagaccgctacgcggtttccttggatcctatgttgtgagagaataatagttcaagcttttctccttatgttcctgggtagatggttctagaagaatcttctctgctctccttgtccacaagccccccccctccattcttacttgtggtgtaagcaaactgacactagtcacttcttaatggtgtataattaaacagtcttaaatacgtaatgggcatggtctcagatatataacaatatatattaatatatattaatttaatcctcacagttgccttggaaaatgtcatagtagcgttttgaatcctcagttaaggtggttgggagcagagagtttgagtgatggacccaaggtcacccagctacggtgagctctggtctcagagccttccgctgtgccacggtgtcatctgggagaagttttttaagtgagtgagttgctttcttcttgctttaaaggcagatcaggaatagaggagctactcctacggctggtcgtctgtgtaggtttcttggatctcagtccctttgaccatttgtgctccagtgtattgatctcgtagaattgtcaaactccaaagacaaatcatggaaggtgcccttactcggtacttacaaacaccggcactttcatctacttaagtgtattttaggagcaatcattttaaatatccagacatccccagcctcgtgtttagagaaggcattggtgactgttttctgtaataatgtaaaaagttgcttacagtctggccctgagggtggtatcgggagtcagcacatcagactatgcaggcctgagtcctgtcccccatcactctaaaacaggcagagtccaagtgagggagaagcatgcctatgcccctcataccagccagcaaatggcctctgacctaaggtcacattttggctctaccccatatttccagctgaacactgccacgtgccccctcgattctgttggctaggtggggggggggggtatgcatgcatgggaaggcctgtgatttcccccaacaccacaggttttatgctccttcctggctctgggcttctccaacctagcattatgggtttggtgtctgaaaggaacatgatgccagctcttgttttccagcggtgtatgattccagatagtaggtgtgattgtcacagggctcggaagaagtgtttgaggatacggctccagttagacgacttcaaaggggagagaaggctcaagggcaaagacagaagtgggttttttctcttcttgatgaagaagtattagagttgatggtggaaaatgaaaagcagagactttacaccataccttcaccacagggcttgttcccaaggcgagggtgaccacaggacctttaatttcagagatatacacagccgaaatgtatgctgttgtctttccctccgacctgcagagaccctgcccatattctatttcttcccccacacgagttgaattttttttgttgtttgttttttttgagacaaggtttctctgtatagccctggctgtcctggaactctgtagaccaggctggccttgaactcagaaatctgcctgcctctgcctcccaggtgctgggattaaaggcgtgtgccaccacacctggctacgagttgaacttttagttctgggcactgtcttctttctttcttaaatctccccagccagagttgtcatgtgactggtatgttgggggtttactgatgccagcaggtgttcctgcttgctctgatggcattttactggcctttgttccaaatccttcaacaactgggaacaaaagccaacccacagccttctgagaggggacgctgttctactctttccatctgctcagtctttccagatcagtcagtattcgtcttcaccacaaggacatggagttaggattgctccccttaacgacacaaacaacaacaaacaaagccaacagcccctattaggcttcagaaagctagaatgtggacgggaaagctctcagtcagtaccacactccccattttctaactggagtgtatggtcagaccaggctgcagattccaagttcttggacccagattttccattaatcacccactcctacccaccccgccttgctttggaggtggaacccagggcctggtgtatgctgggccagggccctgtgagaccctgagtgacaccccagcctccgaattagtcttctgtatgatttgatcactttatatccttgcatagtattccatttgaaaagggttccccccaccttttgattatttttcatgcagaaaagttccatacagacaaaggcaaacaaaataaacatgcctttacacgttagtcagatgcgtgtagtttataaaagccaagagacattttccaaggcttcctaatgggagacacaagaatggcatggaagagaatggccagagacagaactctgaccctttccaggttggggcctgcagacagaactagagggttttttggtaaattgctttaaacagttttggtttgttggtcttttttgggggttttgttttgttttgtttttttagtgaattttactttttaaaaaggtgggagagagtttcatgtgaaagaaactaagtgtgttctgtactgttttcacacgtgtttttatcatggtaacatcttgtttactttagttccctgcctaaaactacttggaacatgttaagaaaacatttcaagaaacccccgacaaagaggcctttgtttctcagggctggagaggctgcacgcctcaccaaggtgttaacctccagccccttaagcacttctacacgaaattccagcaactgtggatgtggttttggaaaaacaaggcgatgcgaaaggaaccaggtatatgctaatacatgtctagggagaccggataccataaattgtttcagacccatttgtggctctgcagcttgcctgcctgaatgttctgcagggaaattacccccagttagctcaggaggcagcagaagtggggaacagccacccttaatttgggtgtgtgcaaattgaggacaagcctcaccggtgcagtctttcagaatcataggtatgaatcttcccccatcagatctgaggggagaagtctttgcacatcgcaaaatgagctttgtagttctacaaatgtgacttctccacgcaccttgcattttctagagttgtttttaaaggaataaaagctgggtgttcccaagaagggggaaatgctttttccctttaaaacaaaaaccaaaaaaaccagcttctttaatctttttgactttgcttcagagttcaagacctctagtactcgaagaggtcaaagtggcccaaagaccacagtgccctctagtgatacggagaatattgtatagaaaagtttaggcaaatttgccagacaaacaggcccacagtaaacaggccacttcactaggggggaaaaagaagcaaaggagtgtttgaatgcactgttccctgagagatgaaagttcagtcttgcatcccttgaaaaacttggcaatatttgtgagtgttgccctgggaaggtaattctgcatatagctgcagaggtgctgcagatgtgtaagaccacagatgcactgctttaaggagcattcgttaccttaggtgtctcgtggtcacttccggccttacttagaagacaaggcccgcctctgtcccgcacttttatcgacactgtctaccatattatggccatgtctaaatggtaaaatttattattagcaatagtgtcgcaaaagtctgagacagcgattttcctttcaataaaagtagttaaaaaccttttagaaaatccataattttgattgctggtacttcataaatgtataactggtactttttagctgtctctttagggaaaaatgagttttatcacctgtggtacctgggttaatgaaattgtgtgctggaatttagccaggatgagagatgagatcattccaagacactcatattggcaacaggtctcataaaagctctaactcctgagtgaagtatcattagatttttttttaaaaattattattattattttatgtaaattgagagattaagttggttgtcactcctcaagtttctatgctagtgagatcctcatcacattcaaaacccagggacctaaaaaaacagcctgggagccaagagcaacagcccagtgtccatcagtgccttgccgaagaatttgctcgcatcaggtttcaactccagttcctgttcggccttttacaaatcacggctctcagctcaaatgtgaaatagcgctgcctttctctctgtggtcctcctgcgtgtgattgtttgtggatactagctgtccaggaaatcccatacttacagatataaatccagaacgagctggcttttccgcagccagcccaggatgtatgagacagttaggatgacttgttaattttcgtgacccgtgtttattttatgtgcgctgtatactttgagggtggaatcagctgttgaaatagccggtgtctctcacacacggggaggaagcactgcagtttgtccctctctgcttagcattcgctggctttatttttggaaggattttttttcttcttcttcttctttttaaatctctcactgagcttctcccacatggtgataaacaagaggtgcattgtgccagagacttaaacggatcgtgtccagggcgggtctttggagatgtgtgaacagggtcacattctttccaaatgtgtttttgatccagaatgtgtcttgactatataattctgttctcatttttatgaggatgtacgttccttccagataatacacaaatcctcatgtctcacaggtatttaggtagaattctgcctattacagattttaccaagttacagtcttcaagaaggaaaatcaagactcaccttgcctttgttttggtttttgctttttctcttctgctctttcttaaggataggtaatctgtgttttattgttgtttgtttgttttttgtttttttttttgtttgtttctgtcttgttttgttttttggagctaaacgtttctatccacatcagattcccttcctatctggaggcccactctcccttcctgctctccattggtgtccattcactggccgtgagctgctgccagcctatgtttgatgtctcaacttagggttgctgagaataatggaaactgggccattctaccaaaagaaaaacaaaaacaaaaacaaaaggagagaggaaagtaatgaaattccagtccttgctaacagcctatatttacagtagcctgttgttttcacagctaaattttagcaagattttacatctgcatccatttggatatagaaagctgacacacgccagccttcataactgttcctgagacctccacattttccatacccttctttttttatttcgacagcatttcagtgggctgcattagaggccatttgaatatttcatttcctattaattatgcactgtggctctcagtgtcattataaaaaagagccctaatgtaacaaaggatgaaaagaaccatcaagcagtgtgaccaaaagaaaatattccaaagcttgtcacgtatgaccggcttaacatctctaatttgaaacccattgcattcatcttaaattaaagcttgcggagtctacctttaccttgtggcttctgctgcatgttttaggtgactgaatttttagttaaaatattaatggattctgaaggtagaaagactttcctttttaagtcatcaaaatatgcacaacattaagtatttagttctatctgtaatttttgcatttcacctttaaaccctggttaaagatgttagctgttaatgagaactgtgcacttgagttaataggttaatagccattaactattcggctaataattcttaactattattaatcactacagctctcttttcgttttattggtgttatggaggaaaatacagatacagtgtagatgttaatttaccagaaggattctcagaatttcatcttgtatttctaactcttagaaagatgatcatattgattagactaggtgaaataatttgtttcctatctttgtggacttagcatggagacactcccccccccccccccatagatatttcttgtgggtgcagtgttcagtgcatgatagttctggatcatttcaaataaacaatgcaaggtattggatatcttgcaaaaaagaaaatgtttgccccaaatttgaaggttccatccttgaaaaaagatcatttttgcttcaactatattaactttcatatagcaagggaggaaggagggctccctgttcagtacagggctgtgttttctttatgttggctagataaagaaaacttgaaatgattgtaatgaccagcactgccctccccccaaaatgcccaaaattcccaaagtcggcttgggcaacatttgctgaactcccaagttgagcacggaagcttgcttagtgacagtgacctacatggtcactgaagatgtgatataatttatgatatatataatatattggatccattagcgagcataatgaagtagtgaaatgaaagggtatttgtgaaatcagttcaaacatcctgctaggattatgattaaatgattaatgaaacgctcctgcataagcattttcaaacagtaattcatgcagaggctgataaaaatcctccaatcatatttccttcagtcgtgaaccttatctcgaccattttatataaatcatgaaatacgttgtctgccggcaagctacttatttagattagttataaatgtgcagaaaaagggaacatctttgcagtataaaataatcacgcataattatattcataattcaagcttgtgacagattccatctttcttactcttgttgtcctttgccttccttctggcttcatttgatttctcttatcttgatgacataattaactgctgaagctatgggggaaaaaataaggagtcttcgggaacccgaaagggggttgttcatttatacatacacaacagccccacagaatcgctgcatgcgttaatgcacagatgccgtgtttaaagaacacccgggatataagctgtgtcctgcacagagccaggcccccactgaccacagtactgtgagtgtgttccctggtcttgggttctggttagaattctatggagcagtgcaaacaaggtccaccacgagtttgcttcttgactcttgggctcagggatggcaagagaaattcctcagggatgctacagcccagtttttaggagcatctgccatgttgtgagtacttagaatctactgacagagggatccagattctcgtggtgaataggtcatgggtaggcttgatattattccctttgcaaagcccctcaaatatttaaggggtcctagcaggccctgggctgatctttggaaataacttaggtgtatcaaaggatccttatgcaaactatgtcatcaactggaaggaaacttgggcaaggctggagccaggcctctctacatctcctggcaggcaccactgtgtttgagcagaatcctctgaggtctccaaacctccatttctcaactaatgaactgaggaattgagtgaagcctccttctatcttccccattctgaagctctgaggcctctgggctttgttgccccccccccaaaaaaaaagtcttgaaagttgcagagataattccacatttccaaactaaatttccattgtgttctttccctctctctctctctccctctctctccctctttctccctctctctccctctctctccctctctctccctccctctccctccctctctctccctctctctcccatccattttgaaagagttgaataattcctatttaagcacacctgaacttggacattttctcaattacaccatgctttttaaaaccaattgtaaactattattcatgcaaggtgagtaactgctaagactctcagcttgggctacattgtgtggcctgcacttaaacagagaagactgtagtcattatttctcactaagatgggagctaatgtctgacccttcaccaccatgtctccattttaccttttatgtatgtatgtatgtatgtatgtatgtatgtatgtatttatttatttgaggggaggggtaggtattagatatttaataattatgaaagtcacaaggctgtatatacattttggatttagggtaaaagtcgtaactgcttttaggacacagattataactgtcttgcaagttttcctcagtaaaggatatttcctgacaaccacatggagtttggcttctcacctcatgaagtcaaaaggtagacatttgacgtggatagtttttggcctaaattttatgagagtccatgttagtagaatttaaggcacattcatttttatttatattctctcttcctctcacccttcccccctgccccttccccttcctaatgagaaaggattgagtaactcgggtccatgaatttttatttttgagattttaggcagtgattcagccctctgattaccagagttcctgcatatgttagaactgattgaatttttactgtgttagccttttccctgttgtaaagtcgaataaacactgaaaggaccacaagacaggcatactcagcatggggccagcatcatccatggtccagggagtgaaactcttgacagtcagggcactgggcagcactgccctgggtcactgtgtgtgtctccctgcctggtacagattctatacctatgggttccggtcttacgtgtctgggctggcttttcactctttgaccatctcttcttttcacacaaacgtgacacattgtcagtgtaaggacatgacatcttttctggaaaaccagtattcttgcggccagacgattctgtccagacccttacaaaagtctgaagcacccaggaggccttgccttggagccaccactgccctgacttagtctctgctttcaagtttatgagcccatggctccctccagatacccggcacaatgtttccctgtggtgataaccgtgtgtccaattctgtgggatgatggtggtatgaacaggtgggagaggtgagcaagggccagcccccccctcctacacgggtgtccccccccacgacgagacccgctgctcctgcataagcatcctggtaacttgtttttttttttttcatttttgtttttccatttcacttaccagttttctatgtattgttgcagacatctcaacagtgagcatgcgctggacgatagaagcacagctcaatgtagagtacaaatgcaggttgtacagcagttagagctacaggtaaagccacatttctttctaatatttcttgagtattcctcagctcctacccctctgcagtgttcgcattctctgatggaaaccccacagcctgttgtccatttgatcttataattgtaacctgttttttttaaattattatctggggaagcttagcttcatcgaactctgtgggactgacacacctttctaggctctaagcagctctctctcctctctctctcccctctctctctcctctccctctctcttctctctctctcctctcctctctctctcctctccctctctcctctctttctctcctctctctctcctctccctctctcctctccctctccctcttcctctcatctcttgtcagtcccactttctggtcatctgttgttgctgtacctcccagaagttgctaatgatgttgaagtggagctaaagggagtgagtctgagggaacatgtgcgggagcgggcagaagatgagtgtgtgagattgggatgggcgagtgaacccacagacgtgtgtgttccgagccacgtgtgagccatcggaacattcagtccctgtttggccttggtcccttgtctctttcctgtccctgagagtaattgtgttcactatatatttcaagtacaaaaacacatattaatacatgatgcatatgctgtatgtatgtctgccatatctgcaacatggttttgggaaatgctctgggctatattgagtgtattttatgactggagaatgaactccagagggagctggggacattttaaatgtgtgttggacttgttggtaggacttgtggatgcacctccatattttaacagtaatccccccttttggtgtaattaatcgaaaattagtttctgaaagtaaaaattgggtcagaaatggagattatgaaaatgcacggttgcaaaagcctgacccgcaaaccccatttatgcaactgagttccagaacgcttttgagtggttgatgactcgggacgcttcgtcccccagccggtccagtgtaggcaagaggttagccgacgaggggaaattaaaacaatgttgtacattatattggtaccagccatggaaaagcctattttgtatgcaaggcagcaatgccgagatatatggagagccctaggctaagtacagaagataattacatttggagttttactgagttaagtcatttacagcttcaaatagttgcagagaaaaatcagcccaaacacacttaaactttgtgttgtgactttttaggacagaaaggattttctttaaaaaaaagaaaaaaagaaaaaaagaaaaaaaaaacctgtcttatatgagaaactacaattctgctaggatacttttttctcatgagttattttcttgagcttgttaatattttccattcagagggcaaatataaacttaacaaaaatagtgagatgtttgtacaagcttagaacatagcataaaaccagttttcagaagcatatttaacctgagcatatctgtagagaagaaaagcaggtaggattaacccactccccacatctgtttaaaagtnnnnnnnnnnnnnnnnnnnnaattcctatgacaggcataaataagttgttggagttgtcacagtttgcccaggtaggtcttcctgtctgcgtggttgattgtgggccactgttagttattagggaactgggaataaaccttatcagcctcatcagttattagacactctccacagagaagggtgggaggatgggcagagtgagcccatcggtcagccaggctgttatctcctggcaggccctctgatgattttgggtgggtgctgcataggactagaaatggataagaggaaggctggactgttttcagttttcacgtgctctgagattgcagccttcggcctcgatcaaaccaaaggcaggcttttcagtaggtgatagaaacaaagctgatctggatggaagtcagccaggtgcttatagctacctgggaagtcaccgagttttgactgagagttgctttcatagagaagaggcatggtgagcacggcggtcctgcgggccccatttcttcttggcttaagagtgtggatacgaggggtgcatggagcttcctaggagttagcacagtatgacaaagtggtcagggagagagaccgtccatgagaggtgaaaatcacattccattgtgtgtacattgcgttatactgagacacagacagggcaaagcccgttcacctataacgtgcaattgttcgcactccatggagatagaacctggtaattgcaccagaagcccgatgggctacaaagctgaccacattcactgcatggccattgtagaagtttgccaaacaacctctgtcaggggatgagaaatgtccttatattagtcacttgttccactccccccccccccaccggggttcctggctgtctacagctctgcctacccctccatatgcctcctcagccataacgtgtaaaaccttcagttctacatcagtcagggcaacatcccagcaacttcataagacaagcgcttgcccacctttgattgagggatactggctcgtttattcatctccttgcagagggcagccctctttggaggctctgtgaaggatggtaatggttagaagtgggtaaagctgccttcctgtttcttgtattctacaaggaaaattgaactataaaatagatggcacgtgggaagctagacagtgcctcagcagttaagagctcttaatggcccttccaaaggatggagattcccagtatccacgtgacggctcacaactgtctggaactgcagctacaggggatctgacacgttcctctagccccgcgggcacctttgcatacacggtgtacataaactcacgcgccacacacacacacacacacacgaattataaataaaataaataaatcttccaaaaccatgagtgagctgggctggaggtgcataaccttaataccagccctcaggaggcaaaagcagctggatctttgggagttcaaagccggcctggtgtacacagagttccaggctagccagagctaggtagcaataccctgtctcaaataaaaaacaaagcatgacaaaatacctcatagataacaagcaggactgccattggctgggcaattagttgacctgggttcttcacaacagcagaaaggtacccaaaggagtgttccaggactagaaagggaccagccaaaactagcttagttcttccatcaggcaatcgaaacgttgagtcattcctatttgacttgtttctgtggtgctggcgattaagtctagtcagctggtgctggggattaagtcagctggtcagctgtctacccctgagctgcactcccagtttgagtttgcctgagaattcacagctctcctgcggactagaagaaagagagtttggatcgcaagcctagcaacattagtagctttggggacactgagcaaaagtgcttaaagctggattccttatctgctagccacttgtataaatttcattatttccatattttttgttgatttatttttattttggtgaacgtactactattttctctcgtttttgattcaagggacaagttgtcactgtatagtccaagctggccttgaactcatggcaggctgactgcctccacctcttgagtattgggattataagcgtgctcaccacactccgcctgagaacgtccactttaatgtacttaactacagattgcagtacccataaaagcagagcagtgggggcaggcaggggcctgtgagaatacttgggggagaccgacttggacacagacagcttctcattgctgttccctgtactcgtacgtgatctcccgttctcaaccacgggctggggcagcgtctaatctagaggagaaagcctgcccagcattggtccaaggaattgcttcttttcgcttagggcatttctttcccagtccagggaattcctgaacgtcttagtttctcggagttaattataaaattgctagttattaaggtgtaaacttgagaaatatttgtagtgccgtggcaaaggacggtgatggttccgacagttccaaaaaaaactgatgctgtatttccgtagcctgctgcctcactcacctgctttgtgctaggagaggtagaggccactcgtgtgcccctatctcacacgggctcacacgtgagagttcctttctaagccaaaggataataaaggctttatagaactagacagacgagtcaaacccaaggaactgaagctggcaaaggccacttcggtgctgtcctgtgtacccaacagtaccctcggtccatagtgttacccagaacaggatcctcgggtctctactccatcacttgcagccatctaaagaaatgaacctctgttagccttgagaggtaatggctacagatgtttccctcctggagtccttactgcagggctctactccaatccaatgcaaaagctttggagactctcttaccagcactggacatgagtttccctatatccatgtaggtaaaatatgcctggacccacaagggccatgtgtctgccaacatattaactaccaagcaagggaggtatgcatctttaaatacataatgaatgttttcttaccaatgaagaaaagggttggtcaatcccattcccagtttgcccttgaactggtcttagtgagaggaaaagagagtcagaatgtctcagagctgctgatctgtgacttttcaacatttctttccttgtttcgctatttaaaatccagttagaatgtctttaccaatggagtagatatgggtcaaccccagctattacttaggaaccaaacattatgaaccctgggaggacatctgagaaaatgtagacatgtcatagcaagagaacatggaccacaaaagtcatttgagtcaaggactttttgttcaggtcagatggtagtattctttattattccatctgttaaatattctctttgaatgacatataaaatgatatataaaaacgtaagatggatttgccgaggttaaaattgtggtcttaacatgggttatgaaatgaacagctttccctccaccctgcctctgccaggagcgagggaccctggtgcaggaactaggaaagctttaaaagtaaggacagcttaccccatggagcacggtcaggagagtcgagggtcacgggatgcctctgggaggccttgacacccactgcctaccaggtatgaaactgagtgggcacattcatagtattttaaccggtgaccccggctggtgacatgcgttatcagtttgttcaccctttaagctgtggatgagataacacacacacagacacacacacagacacacacacacacacacacacacacacacacacacaaagacgtgcacaagacataattccacctttggagaaggaaatactgaaaatcacaggccaaaagaaagcccagcagtgctggcctcttgggaatatattcagaaggcacggccacattagccacttctcatcctctacagtagggtatgtcttttgaattaaaaaagaaaatgtctggagatgattgttttcattgtgtgccacagggccgtttctggatgggcttcccccctagaccctcaaacccctaagttggtactgaaagcagatgagggctggggatatagctcagacggtgcagagttacatgtactgagccttggttccatcccaacacacacacacacacacactcacactctgcaaacaagcgggaaaaggaggactctgtttaaaagggtgggcatagaagattatgtcagtaattagatttcatgtggccgtcactacttcccgagtactgactatactgtgtactgactatcctgaagcactggatggaaacgagcaggggcccctgctgtattaacagtagggaaggagggctagcatgcctccaatacttttaggtgcccatgccccagacaatgccagaggctatgagcaaggaagctccagatcaaggcagccacccaagaatgggcccagattgtatagaggagacagagagcctaagaagacagttctttttaaaatttggtctagctgagcaacaccagagtgaccagtcatcccagcctgccctcctaggttagaagaaaagtttaaaagatgaggcaatcccaactaaggtagagtaagctcccccggctgcccctgtgggaggcattgtccactggtctgtgtcctgcttgtacagagctcagagaggagccggacatctcttggctggctgctggacttctcacatacaagtcactgtccctgcggttttgtacccacagtttatcaacccccctgttaaggacgcttggccacttccccttattcttgtttgtttttatataaggaatggaaatcggtatgtggttgtatctactgggtgtgctcatagtaatgtgtctccatggttcccaagggtagcattctgcctgtggggatctgagattgcttagtgcagtggttctcaaccttcttagggctgcggccattgaatatatactttctcacatttttggtgaccctcaactatacaattattttttgttgcccctcatagctataattttgctactgctttgaattacagtgtaaatatctgatatgcaaaggtgttgctacccacagcttagaaccactggcttagaacattgtattcatctgcttcaagcaaggggtgaaccagcctggttaccatgttattgctggtgctgctgcctgcggtcccttcctttccccagaggatctgagcttacccacctagcagccagttactagatttaacatctggtctaggatgcttatttatgtgttccttgcctgtcttcgagagctccctcccaggggaccctgcccagtgactctggaagcgctgggaagtttggcaacgtgtccacactgggaactgtaagctgtatggaaatgtcagcagagagaagactatacaggtttcagtagcagggggagacattaatcctaacacaaattaattacagtatgggctttgcatgtgattacccgccattagcagggctatttgtaatcacaccagcttcctagactttagcaaatatattatctgtaatgtgtccccctttggccctttctaaccccatttgtggccatgctcgggacatagcagcggccccaacagaacctcagagagtgtcggggacagcaaaggcctaacattactggtgacctcctgtggccgtggctttgaggctggagccaggcgaggggagagggagcgtctgggtttctcacttgcacatcctcctttgaaaacccgagacacttatttttcataatttaaaatcctgcctaagtctgcaggcattaggattccaagactatgacttgagtattagtatgtgtctgctttaaatgtcaagagagtctttagtaacaacatgtgaagaatgttaaaatggcgacagaacacaataaaagcagggaaattcttgagttggggtgaagtgaggtgtgggtcactgaacatggtagttgatggtcaagaaatctttacaagtttgtcctggtgctgaattcagaaagaacgcaaatggcggtggagtggatggatgcagagttactgttcggtcactgaccaggttggtggaggagttgtggtccttctttccagagactcctgtttaggctatgtggattttacttctgagcccttgttccttttcgctttggtcacgtgcagctcggggagcagtgtaactgtgtaccttctgccacagtcagacacagacagtccgactgttgggtcaccgtacgtaaaagctggctttggaagtgagatagtctctggtgaagtccactcgagaacggcgtcacccagtctcccttgcattcacttgggctgttgtggccctcacacaaacccaggcttcctgtttgctgtcttgagaggttggttagcaggctccttgggaacatctcagtcccaccagctcctcaggtgaggtgcctgctgtcactgccaatcccaactcctttatcagagtggtgccattaatcagggtgaagagtgatatatggaagattctccccgcccccaattcagggacggtaccaagggagtctgaagatcagactgtctggataatgtcacacctagcgttcgttataaagcaggtctctagttttactcttgtcctttcttggcttcatggcctcacaggtgttcatcctctgtgcctcagtttccccaattaaagaacataaatcaagtggacccagagccttattatctgtccaggcagataacttactggtccctaataactgcagtgctcttacattagggacactcgtttcagtagagccctatgtgtcactagtaggaattacgagggtgcccttacaaagtcctcccaacagcagataggaggagaatggtgaaggaaccgcaaactctgctcccttctctctggcatgcggtagctggtggctctcatgcctggcttttgtctttgcagacactgagtggaacaccataaatttggcattaatgagtggtgtttgagcaatgtatgagttctgagcgtccacaactttgtctctctgaaaaacccagtttgaggcttggctaatagaagagggtgtgactatcaaccaatagagaataattgtttgcccaggacagagtgaggccccgagataagtctgtcagccttagaccccatcttcccacacttcctgccttattctcgtctttaagacatgggccttctcttcccacccagactcccagctgactccattacaccccattgtgtggatcctgattccaaagatatacccagccagtgtagactagactgatttaatttctccttaaaaaaaaaaaaaattgcagcaggtatttttaacctccatgaagcattcattagcagcactgagcttgctctgtgcggaactcaagctcagaacaaccctgcgagttcagagacgaggattccatatttagaagaaaaaatgaagtgctccgaaggattacagactgctctgaggccagaatttgacacagcacaggagagtgtatctgttacctgcttccactctgctgcctttcaagagagttggtatacagactgggtaattccagtgaccccctccctgctcaggagcgccctctaaggggactcactctcctgcttgtgtgccacccactggggaaagcattagggcagagggagttataccaagggtgtgctccctccggtcatactcggtgttctcacactatggaaggaaaagacccagggaatgtggatggcttggaggagttcggggaatgtgatcttagctcagtcacttaacttcagggtgtggatgtggcttgtgtccacattgtagttggtcctgtctgctggaaggtcagacttggtggataccgagaggatggcgcccccatgcttggcctttagattttttcctctttccacactacttattccttgtaattgctacatcggagatgtttacccccaaattaagtcaaaattaatattcagcagactcttccataaataccacctctcaccctttaatttgtgttgttcggcatgggcagtctacttacttcacggttttagaaagagtggcatgcatgatgcgtgacttaattcctttctgccccatcctagttttcaaaacaaacttaaaaaataaaataaagcaaaaaacacggcagaagagtattttcgttttagtgtgtctccagaaaaaaaccccacaaaacaaacaaacaaaaacactttagggcacttaatgtaaaaagaaaaaaatgaataaccatagaaaaatgctattccccacgctttaattgttttgtctgcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctaaaaatgtgaagtagatttaatttgggcataattttaaggctcaaaaaaaaaaaataacctgggctttctaaagatttaaagtcaactatgagatactaaagggataagtaagttcctcaccttgctcctaaggctttgtttttgacacactataaagctttggaagatgcacacatgtatgtagaaatactcctccccttcctatgtccacattgtcccttaatgctacatctgtctcctcagcttcactttttgttgttgttgtttttttggttttttggtttttgttttggaggccatatccttctccacttacctgagagtcatcattggaggtccttgccccagctttcttgtgatgtaccaaagttatcactgtatcagactggtccaaagccagcataaaggttctagcacctaatgaacagtgaatgtctgctctgcccatcccgtttgaaatatctataacatcagaagataacttttttttttcctttgagacagggtttctctgtgtagccctggctgacctagaactcactctgtagaccaggctggcctcgaactcagagatccgcctgcctctgcctcctgagtgctgggattaaaggcgtgcgccaccacgcctagcagaaaataacttttttatgaagtaaagatactgggattattaaggaagcatctagtggggtacttgatgttgaacccctgaaacagatgttcttattgctcacctaaagatgggaaccccctcagttctggtatccctgctcctgccagcaagacagactcagctaactttccacaagtgtatccaggtatccatgagtttgtccacaaccacaacagatgaatttatgagtgtgagctagctgctcatcttgccatggcctcgtcatgattcagcttggctaatgggcatgattcatgcttgcctttgagctgtccgtgttccccgggactccttggtgccagcaggtctagaacgtgccagttaaagtctaatacaccttgtgttgggaaatctcacatcaacacctccggttacctggactttggcaggggtcctataggtttcagatgatgaagcaataaaaatgatgtgctgtggtgcagtagttagttgggacattcatagtttggggtgttcaaaggagtcacacatctgtatttgatgacataacaaagtcttctcttcccatcagcttgcaaaagacaaagagcgcctgcaagccatgatgacccacctgcatgtgaagtctacagaacccaaagctgcccctcagcccgtaagtactgtccccaccagggggaatggcctggtggcattccctctctgccccccacctcaaaggactgcaggaatacctcctagggcagatgtggatgccaaagcccttcccccacttgactctttgggcctttcatggggagaccagcgggaagctaggcagagacctggggcaacacagacatgatgttttgaggagtctcctttgcaaaactcctgcctcgggctccattcttcaccatgagctgacatcaacgctggtatcactcatgtacattgctgaacatctcctagtagctttagctgattatttaaaacggaggccatgccttggttcctgattttaagatttgtaaaatttaaaggtacgctgactttatttgattttgcagggagttcctgtgtgaaaattaattgagcgttgacaatctatagttagtagcagcaattttaatcaacatgcaatgatgcagcataatggcaaagtattggtttatctgttttgactgatttttttttctataaataaagcaaacacacacccctatatgtatgatgcatggtgatagaaataaaacggagtcagactattaacccagtaaatatggtagcctgccaagatgcagttggcagacagaattaatgtctgaagcagaacacattactgagatacaggacataaaatcattaaacactccatgcgtccatttttactggggaagaatcttagctaccatgtattccacagtaaatggctgcaggaccagatgactaagctaccaaaagaggaagcaggggtcggggcatggggcaaagcattaggagctgttcccacctgtcccttcttttcagaagagcgctgggaagacatggacccagctgagcaagctgccccgagtgctgccctgaaatgatttgcctgacttctaaaagagtcatgaccattggcaaaggggagtgattgtcttggacctctctggaagtcctccagggctttagtgaagtgctccccctaggaggaagaggctgcctgcatcttcactcacacctagcatcagggagagcatgaggttgttcctatcttcctccgtgaattaatgacatcaatgatagagtcatgattgaatggaacactcgagtaataggcttgtttgggatcaaggccgaggaggaatccacatagaaagatggaactacagagtcccttgggatcctcagcgggtaatgggccttggactagctaggaacaccatttatgtaagcccacccaggcacaagaggacccttgatgatctgtcaccctgtggacctgctaagtagccaataaacaagagaaaagcagcgggggtgagggaatgaacagggaaggaaggtttgtcttgattagtattgaaaaaaaatgttttacattctagaaaattataactttggaggggacctcctactaaatttatttttaactgctctattgaaaattctctaccactagtcaacattatctcttagtagcttagcacagtatttctttattaaaagaaataggcacgaatatttttgactgaaaaattaatagcttttgaattcacacacagcaggttttcttttgcaaagaagtccaatatcgctgcacagcacttctataaccatttatttagagtctaagtcaaacctttgacagctagagcgctgctacaagccagtataaagaactccaagatgtaaaccaacaataggccgtctgtgtgaggtttgccattgtcaaatacatagattgtttggattagtttatgtaaatgtactgttgtattaccctttggaaaaaaaatcacatttgtgtatgaaaagtggttctcctcacaggcagcattataaattccttatcctttaacttacatgtaagaagtaaaaattggtgcctgacacgtagatattgtgtgacactctgttgtcggagtgaacctgcctccttttcatttattggaaaatagaaaattttattatagataccatcttagaaatcaggaattattaaaatatgtataggtgaggcattggaaaattaattataaaagatagacgtgtaatgttttgcataaattttcacttccttgccaaaagaaaagaaaagaaaaaaaaaaggcccatgcatatttcagaccctgtgatgctttcaactgtagggactgggagctatctggtgactgatcctaacattcaaaatattccctacagcccgtaattaatttattcctccctaaataatggaacggctggtgagcgtttgaatgagtatcattctagaatctgtggtttgaaagaaatagtccccaagtttcacatctcaccataggtggggacttccacgttacgtccttgccagtgggcttatgaagctgtctctttttccattcctctttaaaagggaacttggtgttcattttaaaacttagtcactaagtgatagagtgctttgctgcaattgtggcccttcagtgagtgccatctgggtggcaagagtctctcgtatccagtggtccaccctgccccccagttcatcccctccaagagctgccaatccattctcagatggttcttatgtcagcccagagatgcattttccgtgtcttgagatgtggatagttagaagatgtgcacattcttaaggctgtgcccaagggtatagatgaggctttgagctcaacccacgatgagctggaagcatatggccaatgggaacagtatcccaggccttgggtccttgggcagcatgtcttctgacagccattgcacctcttccctcagaattggaactcctaaatttagaaaccaattctttctgtcctgagatagttacttggccaccatgacagaccgagcatgatcaaatgagaaagacctaacttgccagggaggtgttgggagtcttgcggataagctaccagataagtgtatgcatgtatctcatacatactcatacacatgcagactgtttactgtatagagaatgctgtatgcgactaggaaatgtgacctgggggaatgacgtgtcatttgaaacctagaagctgggttggactctctggaaggaaagcgagggatgggagtggaagaaggacatgttcagtgagggtcagcggagaggagtggaaagaataatcaatctcagaaatccactgccatttcagccaggccctgcttagctagaatctagcaagttctagagtgcccagagagaaagggctgttgttgacatgtgtttacagaagccaaatttgttgtcgtttaagattttaaagttctgctgtttcccacggaaagcgaagcaacagcaagggggaagaaaatagcctgcaattcctttgttccaaaacctagttccattcccagggcaagcagcacactgtctatacttaactccatgaaggattggctgagattgatctgtaggtgggggaggacagaactcaacacagagcgaccaaaggaaacatgctaggccttcattaaggggctgatgactttttacagagacatttggtcatgctgtttgttaggagtgtgcagtggaaattccacttcataactcggaatcggggagcaccttcaggttcattttttgggggggaggggtgctgggggggggtcctgcacttgtgagaactactccccatgcctggagaaaccacattctttgcgatttggtgggcaagtaactacagcactggtagaagagactgctttatgaaaaactttataatacacttttggagtgaaatgcagctggagattttcccctctgtacattcccttctagactccaactctagcaattaggactgttttgaaatagcttttagctcctatcaaaacagagtgctccctctactccacccccctttttaaaaaaaaaaatcccatgaacttcaaggggtgggtgatcaggtgtgggctgcaggagccttggagcagtaatggcagcctgtctgtcataaagaggagctctcacatgcagcacacaaaagctgttttatagactggttttgttaagtccccttcctcacctcaggtttgttgtccctgtccctgccagaaatgccaccctctgagtctgtagaataagcctctctccctgtcagtgcacagagtcctctccaaaggcctctgctctgccacccactgccctgccctctgtccctggagtctgaacttggtgattcatgcctacaaaggcagcttgcagtctctgaacgttgcaggtggggggcaggacctgagcctctctggcccatccagccaacagcagagaaaccagttctgcgagcctgcagtcccttctgtgccgctggcctctgctgttttggtttcaggtttttcttttgttctcagaatctgttttcatgagaagcaagagcacaaacaaaaacaaaacaaaacaaaaagttcttgtgggaatactccctagcaagtcagtttctgtctcgaggttcacaccagcggtttgtttgtttattattttttaaaatgtgagtgactcactgtccttactcgggagggaaatgtgctgtggaggaactaaagattgatttttgtttttagaaagaacaaagtaacattgggctgctgatagttgggatagtttcagtggtagaagcttccaagaaagtccttcagtaactaaactaaggttgaaaaggcttgatagcacagttgtttgtatttttacttacagtctaaaagcctgcagcaactttaactgacataagaatttagctcctggccagagtttgaaagagattatctttgctgaaatcatcccctccgtggcaacttgccatggagaaaaatatctgcgttactagcttttctaaacatagcaacctcttcctaaatagaaaatgagcacaatgagaaaaacgggctttccattagggagagaaaccctcccagtcggatgccttcctgcgccatgcccagggcgctcttctaaaaccttacttacacttagaaacataaaccatcgaggggcttccctttcttattgatgactgtatagagattcaataatttccaattaagataaatatttcaaggtaacaggggaaaaaaagaaacctaccccaaactgttcccaatgatttgatcttttatctgtgcgtgtgcgggcacgcaggcatgtgtatccgaggtcagtgccccatgtgttcttcaatcatttccccaccttattttttgagacacgatctctcactgagcccggagggcctgtttagctaggccatcttgcttagaaagccctgagagtcctcctgtctttgccttcccatggctggcattatagggcacggacccatcactcccgaaatgctgaggatgtgagagctccggtcttcctccttaggcaagctctttcctgactgagtcattcgctgcagcaccctagtttgctcttctaggcttgtggtagggctcatgattattctgttttcaatgttcttggtagagtccttcttggtaagaacaggctttatatgaacacagtattttttttttaatctttcttggtagcccccctactcaaccttttctccttgagagtgaaacacacacgcaagctcgagcacacacacacacgcgcacgcacacacgtgatggccagacagacggttaaaagttaagaacttgcacagcagctgccagggttgtgtctcattaacgtgttggtccggacttctgatggtcttggatggcaaagctccctgtttggagttcccagttttttttgtttttttttttgttcttccctcacaggctacagtcatgtttaatttagaatccaggctcctttggcaaattagcaattagaacaattttgtgggaatatgtatatgtgtcattagtttttctgcaaattaatagccagggcagaggtcaggcagaaattttccacttgactgaagcttttccattgagacgtggcacttgggtttggaatggccgcagctgttcccagacacccttttcctctaggaactgtcttttaattagtttacctcatagccatcattacaaatattactgtctcccctccctgaaataaaattactgtttctacaaaatattccagcgacattgtgcaccactgcacattcatggcgggggtcagtcgaatgcaccatttaaatcattagatcacctccgtccgcttctcctaattagagtccttacaatacatttttatctggtaattagctgagattggctgcttcctctgtggcttattagagacagcccagcagtgggtgtgaatcacggtgtcatttgccaagcctggtaaacctctcttcaggctcagtgtttactcccagttcctacctacattcaaaagcatccagaaaattcggcctgcgttgctgtcttccagtctcgtgccagcactagaaggatctgttttttcattgttgctgtcaannnnnnnnnnnnnnnnnnnncaagagtcacattctttgcacacctaatggcatgtctctgtgtgtgggttcaccagttcctctcagatctttcaaaacgatgggttcgtaactgctgaatggttccataggacttgccggacttccttacagagctggcagggggcgacgggataatgttcttaggctaggaggagaagtcaggatctagggtgagaccccagagaagctgcccaggttttatgcctgcttttgacagtaagtgcttcaaggacagcagctctgtggtttagttcagcttccaagcctgtggaagttcttggtaatatttattgagtgtcattcataagcgtggataaaagctgttctcgggatcttttccagaagcaagcataactgagaggtagagatgtttatagcattcatttagacattagctgggcataagtagcgggtgcagaggctgtagggccatacaagcacgtggattgactttgagtctgagtcaagagatggacaagcttctctttcagtctttgtaaaccacgagtagtttgtaggacggtgaatgaaatgaggcctctcagagcatgggttttagagtgtgtatttttatgaacggtatctgtggctttccatgctcaggcttttcagcattcgaaggatcaaacctttgtatttaggatctttctacactaatttcctgaccctcccaactccagccgatgctaaataatacagtggccagatttgggcacttgttaaggcctgaggggaaagggggtcagcctttgctcttctccgttggcatcttgctctgccctgtccctggcctctactctgaactatcagcacttggtttgcaagtgtgtgatgctcagctctctagcaccattgggagggcagattaccacaccgcccctgcttgttgaaggtcaagcaagactatgccccagattgctgttcttggacactgggggctggtagtgtacggagtcaatatttcaaactgaacctggaaaagcagagctgagtgctctcagcccaccactcagcaccaaacctggggttttctgttaatgttcctttcatgacatcggtctcttcacgtctcttcctttggaacttactgcacagcagggtagttagtgtcttacattccaactgtgtgaattgaagttgagtctttctagtacactggagcaaaggactcactttcaataccatccagaaataatacttgtgcttaatctgatggtggccaagtgacggccaccatcagactttgtagaagtttcttgggttttggagaggctgtctaagtactgggtacctccataaacatggtgaaaaccactaggttcttctgcattgtcaaactcaaggggcttttcttgtcctgatcggctttagagaagaatcattctctccagtagtgtgtgagaatcctgaggaagaacgcagtagagcagaaggaaagaaggcgttcattaatcctgctccaccctgcttcagagactcttcgtttccacagctggaccatttcaatcttttaagcagccaaatgttaccactgtataaaaagttcatgtctgcctcctcagtcagggccactgttgagccagagccacgggtccatcatgcacagccctgtagtgccttcagttccacagtggacttaagtcccgtaacttcttgctggtctctgtagtgactcggagccctgtgtagcctcttagtaaacccattgcaattttaaggttaaaacagaaagtcaggcaacacagctttccagttgtggcagtatgctcctgagagttacactggacaaaccaggtttatacccctgtagcttgctcagctggcgttccttcaaacccccaaccttgctgctgtgcaaaggagaatccctttcgttgaaagtgtgtcccgtgtaaacataccagtttggagaggtaaccctcgccaggtgcccgccagtctttcctctgggacaagagaggttttcacggttgctcggatttctgtggttgtttgatttgtgctttttgttttgcctttctcaagttcttctaacccatatccttctcctcacagctgaatctggtatcaagtgtcaccctctccaagtctgcctcagaggcttctccacagagcttacctcatactccaacaacccccaccgcccccctgactcctgtcacccaaggcccctccgtcatcaccaccaccagcatgcacacggtgggacctatccgcaggcggtactcagacaaatacaacgtgcccatttcttcaggtagctactctctgtctttgcctggggcggcatggggaatctgcagttcctatcgacgagcccctttttaaaaagcgatcattaataggacaatgattctcatttagcagatattgcgcagaaccaagaattttataagaacgcggaagttagaccaccatttacatatgcatctttaatcaggcaggtaagtaaataacatggaccgtgaaatgctatcaaaaggtgtacgtgggtatattatattgatgaagtagatttaaaaccacttagtatgcaagcatgctaaaaccttttctataaggtttttaaaaactgcaatatataacataattgcttttgattaagtattacaatacgatgtgattattagggaattcatttcacacaacagtgagaatgaggctgtttaaagatggcaagtcaattatcacaaagctacagtaatctctgatccctggaattaatctgagctctaaataattactgagctttaatcagctagtgaaatgttttgcatttctctttgattctgctttatgaatgactaataaattaatatttctgtacggaaacagaaataaaaactccaaacaattagataattccatttcgagttttgctactgaactgcttaaatacaaccattaatcttcgatcattttgtgaaacctgcctgaggagtttgctccaaattccagttttggttccggtttggttgggttttctttttctacatttttatgaacactgtcgaatgaccctgcctattggatgatgaattaccttctccggattctttttgcctcgtaggccattctcgaatctccagaaaagcagctaacactaaacgaaatctataactggttcacacgaatgtttgcttacttccgacgcaatgcagccacgtggaaggtaagctttgcagtcttgaatttttgacctttatagaagagaggatcttctggagaagcatctagttattaggcaaagagagtattccccttgcactggggaaggtgactaggagaagtgtttcattgtggttgaagtgttcagatggaagagccactccagcccctgcccctgcccctgcaagagaggtgtgtctggatttgctggagaatcctgtgtaggggaaggaggtgaccttgtgacccttaactcggaggttggccctgtgctgacacacaccgtgggcaacccaacagtcattttcaggggcgtaactaggaaccaagctggataagatccttcagtggttagatcagagctcaaccccacaagcagcggaagctgtgtaaccctcatactcacacggccaaaaggctgatttctgcagactgcaaggtatccattataagaatgggttcatggctaccctgaggggaaaaggtagtttcagaattatgtaatgtaatgtgacaccatttgccatagaagaggtcggttgctagataacccctaaatgcttggagtcccttctaaatctcataggcatttactccgtgctccattaagccttcctggttaggcatggtggtgcatgccagtcatcccagcatttgagaagtggggagatttttgagtacaaggccaggctaggctatacagatagccttcacaactttttctcagcttcctagtttgaatttattacacaatgcctatacacgccgttctatttagtatcgcctagcatttaagatctgtccttatccatggtttcagtacaacagatgctttataggacgtggcttccttagtttaataggaagaaacaggttttgtttttttttctcctcgcattctataagaagattaatataggcacggaattaattcattagccacatgggggctgacaggaagttatactgcagatcttagcttctttccagtcctgccccaggagagaaaatacaacagctctttagttaccaatctctgaaaagtttaggatgtagaagcataaagaagacatttttcttcaaattgctttttataaataccaaatgaccacatttcaaaataattatcagctgaggatatgaatttcaactcacatctcccttttccagctttgcagagtaaaggcagaagtgtcactaatacaaacagtcccctgggaagtacccagggactcgtcaatacagatagtttttctctatgtgtccttactgggacagtgatccaaaggacactgtggaatggtgtcctttgcagatccgttttaatatacagagcgctctacatcattctgtgagcagcaatagcccccggagtctttggatttttttgtgcattttgatacttaggtaaaattcccaacagtgattgatgctgccttgttgcccagccgtctccctcacgggtgtacatgtgctctcttgattttgaaagggaagtggctacaattgctcctgtctcctccgtgatagtggaggagataattccctgtgcaatataaagaagaagttgtttccttaaaagccaggttaattttataggtgtcgagttttgtttttaagcagcccatcagaaagctcttccatcaagggtagcctctgtcagtcacgtcaggatcagcaggctccttccagctgtactcattctcctgggggctcactctgtggagtccactggtgagcaaattataacagaggtaataaagatgtgccctgttatcctctaagtagggtatcacagagaagactaacttttaggcaacccaattagtcaccaatgatcagttcccagaaatctgaaggacctctgagagtttgaacatttgtcaccaagaaagcaaattactgtgggagaagactgtagcttgtctggacaatacaatgctggggattaagtgagggcttatgtaaggtgccaaaatctcagcgtatatgtcctccaagccacttactctgaatgaacaaacaagcaagcaaacaaaaaccaaaaaaacaaacctgccactggccacttgtaatagtctcaaattcatcacccagttgctcagccaggcaaaactagagtgtatccagtttggttatcccgtcagggttgcagattttcctgaaaatatgagacatttcgggcctctttgcacttaagaatgcccgttttgttagatgtgaaggatcgcactcagcaatggccgtcagtgacttttaaacataagaaacgtagaaaccaagtaatgcaatctagccattttgccattgagaggcctccttgtaagttcttggcatttgctcctccaagtaattgccagtgttcccaaatattccggaaggtaaggctctgctcaattgttgagactgaactcttagtgctgagttagcccccgatcacctttgctatacaagatggtactctcagtggtaaaatcctatttaggattttccttaataaagcctatgcctggtttcaaagccagatattgctgtggatttaaaactgttcacctttcatgatttaaaaatgaaatatcttttcaaatcctacatcaatgggttcgtaaagaatagtttttatacttaactgatttttgacatcctcttaacaatattttagatttatgtggagggacctgcttgggacttgcatgcatgtttaccagtgtgtcttctgatcacatggtaccagaaattaggcttaaatgccagagtaccatccattcataatctgcggtttttcttaaaagacactcggaagaagatcctccgtgggggtgggggtgggggtggcggctacggctctggaggtcggttttacacatgtggggctgaatgtactgctgtgtgtgttttttttttttttgagtcttttcttatagaaaaaaaatgtcaatgttctctcttttatacttgctgcagaatgcagtgcgtcataatcttagtctccacaagtgttttgtgcgagtagagaacgttaaaggggcagtatggacagtggatgaagtagagttccaaaaacggaggccacaaaagatcagtgggtacgtccgccatgtttgaacttcttagcccagctcggattgtgctaacgagtgtactgtagaggctgctaggcggtgtcagaccaaagacctggttttcacgtttgtctcagttaagggaagcaagagaacatttcatcccttctgtctcgtatacccaccagtccccctgcccctgcttgctggtctctgttacatcccatgcgagtagcttttaggcggcgttgcatattaaccctcacgagccattcgcttatgcttattgcattttattttctttttcctgttccctgtattggatgtctgtcctgcccccaaccccgcctccttttgttgccactccatctcctttgctgctgctcctatcccagggtgccattcgcaccaacctctcactgcataagtgctttatcagagtagaggatgagtttgggtccttttggacagttgatgatgaagagtttatacgtggccgccatattcaacgaggccgtcctcgcaaatactgccccggtgaaaactctgacgagcttggcgcacagtaagagcctttacttgctttgttctcttgtgtctgctgttgctttggctttgcatggttgactcatcccatgtagtatgacatttcacccaagagcagtgccacagctttctgcaacagaaactaaacagtgtgaactgtacacgcacctcgctcgtttccctttggaacgccagtgcctagaagatgctttttctgtgtctctaatgccgatgatgactgactgtattttgattcagcagctaatggggaccctcaaagctagatatcatcccccatgttacccataatccctgcaagcgaaaggaagcggtggtttacagtatatatctagtgggataattcttttcccactgaatactcgagtaacaataatgaacaagctaggtgtaggggtgggtgcctataatgactcccccccccagggggggaaggaagctgaggcaggaggactgcacattccaggacagcctacactctgtagagagactctgtctcaaaaaactgaaaaccaaattgtcctaagctcaggggaaagattgataatgtcattcccttcaaagtctgttgacaaatgaacctcattacagactggaagccacactttctctcaggatgtccaatgtaattttgtagtgtttttttaaaactagggcagggatatttttctttttttttttttttttaaaaaaaggtattgtggcttcttttacctagtcaatagaaagagcaccaaattagagcttgctctcccagactgggctattcaggaaagacagcagccaaagctcctgcttttacaaaagaggagtaaacatggcttccctcgagcagtcagggccactgagaatgaagcctttgggctcctcattgcagtaccagacatcctgccactcagcccttaccttcctcccggagcctggcagcagctaaccctttgcagactggtccccagaaaatatacccaagtgtgttataatttaacacagtttcaccaggatgaaccactaggttcatcgccagaggtattttcccacaccaaccccgagaaacatacataaagcttaactttccttcagtttggtgaccgggtgggggaagaatttaaaatgtggaagacaaccagcgaacttgaaagagaaaagttggcgaggacctctggatggattgtgtttaactctgagtttttatctttttcttacacagtaacccttcccttattaaaaacatgcagagcagccacgcctactgcacacctctcaatgcagctttacaggtaagattaacggccatcccccagccgcagcgcagacacagggctcccccactcatttcaaaatatattagcctcgctctaattagatattaaattttaattccgttaaacttttttcttaagtgcacaaagcatcgttctccccggaggcaaacacatcgggctgcttcagcaggagcaggatgctcagcattttgaatattgtggcaaaaaaaaaattaaaagttcacttattaatatttatcagcagtatcataatttccatcctcttatttcagaatttcacttgaggcaaaaataccacaagtgtaattactctagcacagctattaatgtgctggatgacagggccagcatgtcacatgaccttccattgttcccaggtttaaagagaaagtggggctttattaaagtccattccaacaccttttctttctatgggggtggggcctgggtttgttttctcccttgtaaagtcaaccatctagacaacagaaagcataagaaaagtggaagtggccatccagttgttcaggaaaacctaaccatcgtagactggagtttcctactgactggtaaatcacacactacctcagcgagagaatcttagaaggggtgagcgacaggaggaacaatctgtgtgtccagccaggctttaggtttcttgttcctcatggttaccacaccacctactgatttctaaaattaatggggtatctggtattgcttcttttaaatacctgacgccatcctcaggtctcccataagagctcagacagccactgttagtcttttgggctttgggttttttgtttgtttgttttggttttggttttttaacccacctttattagtctagaagacatacctaaaagagttttgaaacatttgcattacgtactctgtagacaaatcaaacgttagttatcacacaccccccccagcactgttgagtgtgactactgtagcacccctgaactggttgttggattctgtgatacctctggctgttctgagggaccataacatgacaagtgaaggcagacacagagaaacaaatgcccccaaaagggatggcagtgggaagaaggcttggagcgcgtggcatgatgggaactagatgggggaggggaggcagtgacagcagcccgattctcaccacttgctaagcaaatattgactgagcccctattctgtgtgcctgtcttcccagctcacccagcgcatcctggggctccttgtggataacacgcccctgacacagttgaacgcagactcgctcaactgagcatctcagtaattctatttatttcttcttagcatgagctaaatttactgggagaaactactctctgcgtttcttttaattactcgtagtttacacagttacttcacaagagtaaatgaaagccggcttataccctgccactgtaaataccatgcattagtaacttattttccctggagtcttgtgaagtatgaatttaaaggcagctctatctggaatggtattaaaattacaagcacattttacattggattccctttactatgtgactaatttcaattagcgtgctgtatcgttacagatgcgttcacgcttcatctctgagacttttgttttcctacccctctccacgcttctgtgtttcccctactcgcccaaaaccagcccgcggctttccaggaacaatttaaggagtatctcctttgcccctcctcttgaatttggattccccaccagtagacagccagtcatacaagacagcttcctgccatgcaaattaaataaagatcccaccagcagggccttccctttctttatcacccacttccatttttcaaggcaagtaaaaataacagcgcaacaatatcatcttaaaaaaaattactagagcgacataacggcgtgatatacaatttataaaataggacagcagaatctactacagaaataaaacatggggctcgggacagattgcattatgctctgaaaaagtgaggtaactaagggtaaccataaagcttcgtatttatagactgccttttccccggggagcgcagagcagttaacattccaaaagcctcggtacttagggacccaaagcgtgccatcacttgagaacctctgtgttgcgggtagaggtgctagtttgatatgaagccacacactgtgcccaggatcatttctatcattaagtctattataaacatggtggcacatctgctcctaggagcatcagctacaggaaggacctgtttgaaggtgataatttgggggctgctctgatccttcactctgcaaaggactactcaagagacacggcagtgacccaggtctcaggatcttactgtagcccagtggctactgttttgtttaaaggaacaagactggttctctgtacgtattatattataatacctcttatattatgtctgagaggaaagggaccaagacaagggtttactcatcatacttggaaaatcagaaagaataagcagatacttgctcatcttaataggcagtcctagaactgtttcctacaagtcagtcaggggcttcggaatccaataaaatactgtggtagcctcggttccagcctcagttccatcttgactcttgaacagcgcagttgtcccgtggaagcagattcccatggtacatccacagtgagagggccactcagctggcagtccaagcagaacttacatggcagggaaatgtgaccactgtgtggtcccacataaggcagctgaagatggcagcctagctgcagctgccagtaatattactgtgccaacttccctgctcagaaagaatagaaatgccttattgcaattataaaagatgcattcagaaagtgctggatgcaaacagatgatctgataaaccatcgaggagtgggaaatggtcactgtactgggaaatcatgaggtgccacccccaccccaccccctttacttttaaaaaaggaagcaggtgattccataggggaaagagggagctgccgagagcatgctcagggcatctctctgggaagtacttcagacactgggtctatccagggagcaagcctgcagctgactaacaagcagactccccgcagcccagcttctctcctcctctccctttgtttctggctcataccttctctttggtgccagcttttctagaatagttaggactcttccatgacgggccaactgaagccactctgccagattgtcttgtgatcatactctctctcattaggatggaaaaccaggcatagtgtagtctgcaagaagacaattttgataaatcttcatctaattacagctgcctcttttcccaagtctgtcctcttgaataataaaatgaaaagtcacttgggcacactccctgcacaagtgaaaacaaatggggtttcttcagtccggtggtattgtgacaactgtccacaatgcacacagggtggccatcacgcttacgtcgggatgacagaaaacgaagagtattctaccagactttagtttggagtgggttttattggagttggggggcggtttacatactttttttgctggcactcatttggaatgggatggctttgtcacctttaatatggatatacttagtcataaaggaaataagatttagcctcccccccccctttttttccttccttccttcctggagagttttctacacatccagacttctgcatgactagtctgaggctgagagattgtgtgatgttaccatcgtctggttatgtcagccttcactcagcaggttcaaaaaaaaaaaatcattaaaatgggaatggtgggggagaaacaatgattcctgttcctcctttcctctgagtgcttatggaagttctcataacttttgagccgtgtggccatataatctgatcagatcccagctacccaatagagaactcatcaaaatggataaagaaatgaaaatcccattgtatttcatactcagttcctctcaaaaaaaaaaaaaagtcagtggctgtacacctcattttagaaacctttgtctaaaccatatgactccagcaggcaggagccagcaggcagcttcacctgtagactcaccggtgcccagatagcttaaccaaatgaagctcaaggcccctaaagcaaaatcctacagcacttggaaattgtcagccacagtacagtgcgaacttgaaccaaaaagctatcgaagacaccacatatccatagctttcttgactggcctcccctactgcttcatttgatttctcttggttgatgcaggcttccatggctgagaatagtatacctctgtacactaccgcttccatgggaaatcccactctgggcagcctggccagtgccatccgggaggagctgaacggggccatggagcacaccaacagcaacgagagtgacagcagtccaggcagatcccctatgcaagctgtgtgagtattgtctacccaaagctctctgtcacctgacctcagtctcccggctcttctctggcccttctgggcacctttcctatcatttccgatttcttaggagccctggagtcacatgttggtgcatacaaggactagttagtaattttctcgtagaagcaattggcttcatccacggtaagtgcacacagcaagaaaatgagaagtctcctccattttgggtctcagaccattacttaattcacactgtgattttcctcctaaaatcactatacacctcttcgagaaagctcacggtgtgtccagcttcccggcaaagccaaccaagcctgtaaggaagcttgtttacttgctcacgcactcagtttaaccacttgagctcgccgcagcattattaccaagcattaatgatggcacaaatgaaaggtggcatgatttatagattgctcttaaaatatcaaaaggaaaattaataggagcattacagcagcagacggcgggataatgagagcacatataactgaatgaagcagtgggccatggttgcctgggatgaatgtgaatggtaggtaccagagccacactaacctcagggaggccaccgagttgaaactcgcccctttgtggcccctgcttcagaagagacaccatgtgattccagatgcttcagtgcgcagtgaacccagctgcgaaggaccgtcttcctttcagggactctctccaaaaccatagcccacttgaagtgactaaaccaattcagtgtttccaccactgtccgctccaagaataggctgcttgtctgcacattctttgtggattactgaccaacatcttattttaggaaatttgcgtgatggggatggaaaatgtgacctttaacaagtacggagagaatgaactggcgtctagcgacaaaggggggcagggggataaatgggttcttccagcatggtgggcaaacctgaagttttactttctagcattttaatcccatgccctgggtgctcggagaggggtctttagaggtagaagcgatggtttgcgacttgtgggcagagtcccccgaaaatgacacaccagcattttaggcaagtgtatgatgccttccccacgattggcacagaatttcatctcccctacagcaagctgctgtttctctgactcttttgttgcctcactgatactcaccgtggtggtgatgttgtatgtcagcatccaggaagttcagagcaaactgtgagttggtaatgtaagtcactcccagatattcccattgagaaaggatatgtgatgttacccagtggaaggcacagtgttttcttagagttccaactccaaggtatagtacctatctaccttcctatcagtagaaaaagtaaataaaaattaattaattaattaattaattaattaattaaaaaggcccccacagagaagcctctcaatgagggaagttcatttgcttaccaggactgagcaaactgcagacgtagcaaacatgcagccaccatcttaatgtgcagcaaagcaaaagcctcacagctcgagggacagaaaaagagccccgagtggagctatcaggacgtgatgcccacacggcaggtttgcgccccgtgccctgaggtcccctgtgccgacaacagcctccctgtgtagtcagtacagcagccagttagtctcactgacccccttgcttccactaagtgagtctataatgagagatttcattcttgtccagcgtgcattaccctgctaggatgcaaattgttttttaaccgttccagtctattgaaataaatcaacccataaactttacaacaaggcttacaagccactgtgaggacgctggcccgcccggcacagaggcagccttgtgatacagcgctctgctcttcacacaaaccacggtatcgcctttctctttcaaaaagagaagaaggtagtcgcataatgacggtttgcgggcagtgtactttcattctggtaggacctgaagggccaccacaccaaaggccctgtgctgtgtgtgtaccctgaacaggatcacaatgcctttaaagactagtcagctatagttaaaaatctcatgtgttcccagaatggctttacaaaaggactactcagatgtaagcggaacagagagatggtttgggccccattatctgttaggagcctttttggaaatagtggatgctggagagaaagggtgggtctggtgggggaaggctcaagaggggcacccattgtactgtagacggtacactgagtatatgcccagtgggggggggggaagccttttacagtgttcatcttacaggaaaggtcgaagaatccttgctgtcatgctggtgtgggttttcaggttgtcacagtagatctagttggtggcattgccttccatttgatgagaggcactgggatagactgtagatgcagcagcaccagcacctatgtttggggacagtgaatatgcagtgcattccggagacaacaaactagtctctggtgttggggactctctttgggggaaccgtcagttggtctgtcatttggagctggatctggaaagcagcgatttacagttgcaaagcaagaacttaacctgaagacgagtctgctttctctagggtttctgagccttcccgccaaggctttgtgtaacaccatcagattgcaccctgcgaaccagagattaagtactaagtatgatagctttcaaacatcgaagcacaaaagtgttactctggaaaaaaaatagcagttgaccctcagtaactgattaaaactaatttttttttaaagggcaaattcctgttgctggatattactccacccactttgttggtggtgactgacaaagtcactgttctcactagtgaaatcaggaggcagacacagaactccacggtggtcagtaaagctaggggtgcagggcaaggtacctcggactcacacccccccccacacacaaacacctgctcgagaggccacaggctgtgtttctgaattaacgctggggacactgagatcgagtctcacttgatagagcctctctgcaaattaatatcccaataaatcaggagaaccataaagatgttttggcctctgctccaacagttccattcttagacatttatcccaaggaggtaaatcaacaggaggagaaagattaatggctagcagtggtttactgtactatgcaaacagtggagggaaggagggtgattagagaacgccagctgtaaaggtactgacctatcaacagaaggaatcacacagagccacaaaaacagtaatggaaaagccaaaaaaagaaaaagctgtaaagtacgttcttcagagggagaagcaagcactcactgtgacccgagctgactgcacaggcatggggacacgtccatttacattggtgccccacgcctggaaggacactgcacttgttcacggtcacgtgttcgatttttttcttaaaagttgtgaatatttttcattcaggggttctacaagctatatagcgaggcctgggccttatttcagaaacaaggatgaccacactagtaaaaacttgaagaagctggaacccacatataaaatgtactgggaggcttgggtttgttttgcaaatggtttttaagaatgtgggcataattgtttaaagctatttatctgacatctagccccccaagactccctctatgctgtgctaattttagtgtcaattgatcttgaaggttcttgtcttccagagcagcccaaagtgtgcctctgtttgtttttaaatggttccaggcgcctttggggccccgaatacagcatcaattatttaggaagccagccatccccagtaccacctcttattactaatacttgataatgtccattataagtccctcccactcgcagcctgtctgggagatgtgtgcattttaacttgaatggttcttttacatatcaaaagccccctgcaacagaaagtcatttgtattggcaaaagatcagttgtaaatatgatttacgaacagcttttcgcagttgttatcagagtggttttgtgtgatcgagccagccctctctagatgaaccgagcccccaatccataatgagaaagttggcagctctcaaggtagtgagagtgtcccagtggcggctaccagccgggcctcatgttttgccttgtttacagctgacagcgttattattctgattggggctctgctctcttatcatattgctgtgttgagcaagccttttcctctccgtttgtgtttcctggcagggcttttcttgccttattgacagtttgtaaaaatatgcattaatttggagcttcaagcatgtatcatggtgtctctttgctgtgtttgcttgaagttgattaatgatagagcctcgcttggggtcgtcctctggagggttctttcacaggttctgcatgttaactagcaaaacagaacacacagcaagccatgattagcccagcctcctgtactcagtggtccccacgaaccactgccgtattacagattctcatttcacataattatttgcagggtggcattcgtccacccaggatgtcactacggggcctgttatttggtactccaaaggacggtcctgggaccagccccatcacctggaatctcttagaaatgcacagtctgagctccatacactgtactgtcacaagggccttgggtaacttgtgtgtcctgaaaagcaagagaaatgatttccatagagagtttattctaaagcagcatccaagactcttaccaatgcagctaatacaccgagcagtacagaagcccctggcctcatatggcccctaaccccttgggctgcaggcagtgaaaatgtccagcagtcataggaagtttcccaccgtctttgaaaaacttggttttggctgtggttgtggccaaggttaccctgcctccactgggcggcatctctgtagcacctcttgtaggttgctccaacaccagcgtcagggcaatccgggtgttcccctaagcctgtttctctctctttctctgtaggcaccccatacacgtcaaagaagaacccctcgaccccgaggaagctgaaggccctctgtccttagtgacaacagccaaccacagtccagattttgaccatgacagagattacgaagacgaaccagtaaatgaggacatggagtgaacctctgggcgggccgacccccgagaccgaagattggggaaaaaaaagcaaaacaaatttaaaaaaaaaataaaaaaagaaagaaaggaaaagaaaagaaaccacgtcaaaagttagcagtgaaacccgccctccgtttcttgtacagtctggaggattttcgctacattttgacaactctgaaacgtgttaactcttagtgccatcaagaatcccatttgggagtatttttgatttttctactttttgttgacaaaagggatttgtactctgtgcattggatggacctgtttggtacttgggattttcctctttgagtcaacatcagtgttgtaaattcgataaacggattcacttttagcagcagactttgaactgcagcttcgcccggctgatgctgggcgggcgccgaggacacccgactgagctcacgtacctgcgctgcagaccaagccttcgcccgagttcaagactccagtggacgacctttttgcacagcgctgcatgttgataccactgcctttactcactttggtttgttttgtttttgtttttcgcttccagttgggatgggggaaggcctttgtgtgtgtattggggggaggggttaaaaataattatcccaaattttttaatgtattgcttttttttttttcttttactgtttttttttctttctttctttttttttttggcttctttaccattttaagttctgacctcaggcctccatttgggcccagggcctcttggaggcttcgcgttttctgtaccttgtgatgaatgttaataggcgtttttattatacagagctgaatgtcatttctcgtctgtagttttctggcactcattccattttcctatagacatcaccatgtttctctcaagtttaaaacaaaacaaaacaaaacattccgttttggtctttttccaaaaaaaaaaaaagagaaaagaaaagaaaaaaaaagatcccaaaggctgcaccttacacctgaaggtccccacacggggacatgacatcctgccagtaagagaatgaatgacagaaaaggaaagagagaaacgcacgcgcgcacactctagggacatggcagattcatttcacaaaaacagtattgggggtgggatgggggactgttggaggtttttcttttttttctttttcatagcacccaccattgtgagtaactgccaccacattctctcagcatcaggaaacacagccacgaaagaaacagaagagaataaacaatcctcaatagttagactgtcacagtggccatggaagatcttccctcctataatcaggtgaccaggaccacagggccctgtgccatcctcacccgcacaggttgctctgtttgcaaaatgaccaaaaagccagcatggtgacagggctaagtttgtacagtagttcagacctgctcggtggcattcatctgttttaatgcaaatgagacttcacattgaacttgttatgggagttaatgaggactgagctcagcagacgctaatgtgtcaggttccagtgtgctaagtcggtactgcagcttggtctgcaatgtgagcaccacacccaccaccccagtagcacagacttcacggaagaggacaccaggtagacagaccagggcccacagaatgagatggctctaggtcaatatgccctcggcccttcaaacccctccacatttccgtctgcacccgcttccctggcatgtatttatctggggctgtagcttttgtttgggtttagtttgagagcctttcggagcttaatttatatactttgtacctttttttatttctaaaattaccaaagatattacgcaaaggtaaattattttcttttatactttatctgatgaagccaaatatcctcttattgttgatcaaaggaggcgaaaggattcagaggcaaatgatgaggtccaggctatttgccaacctgagggaaattactgcccgtcagcagagttcatttagcagactatgtaggcaatggaaccaaagttttttactttttttttcctgttttttttttttttctctttccttcttttctctacctgtagagagaccaaaactaactcctataaggagaaaatccggggctactgcagagaaaagaaatcaagacaacagtattatagctcctgtggaaagaatgggctagcatctcaaagaaaaagaaatgaatgtatgatgctgaaaattagtatataatcgaggagacacttaggatgaattcagagagaacggagaagtgtctggccgctcgaggccacttctagaataaagagatttttagaacattcgtacgccacttttgtttaagggctgtgctctgatcactgcgttaatcttggtttatcctggcatttatcctctggtttccttctgctttttgttgatgttttgttttatttttttcctatttcagattatgatttggtcagtgtttttcatttacacacaaaaaaagctaacattcccacccactcataagcttagagtagaacacctttggcaatgacttctgaaggtttgctctgctttctatagaggggcggtctgtggttattcatgccccctccaccaccaccccacccatcttttccaggcagcttcacagtgtgcaggcagtagccaggccgggtcatgggaagggggccctgtgcttctaaactgagtggttgctggttagatatacaaaagaggataaaactctggtaggttagttcattctcagcatgtgtagctagacaagagtaaagataacagcatggggactgttagtacgcacacctcagttcaaacctttagggaatgagtttaaaaaaaaaattaaaaatatacctttcactcagtcgtacttagtcgtatgtcttgcatgcttagtctaaagactgtagcaaagaaaataaataaaagagaaaaaattagattttatgtatcttttcaggtgtcatagcctggcagaagaaccaactgaaaaaaaaaaaaaaagttctcaggctttacagcaagcaatcttcactctgatttttagaattctgattctgtccctcggggggttcccgcttcgtttgaatggggttgattcggttgtacatatatcccgatgtgtctgtgtgcatctttgtcttttgcgggggagggccgaggggagggtttttttggtttcgttttgttttgttttgttttaattattttattttttaggtattgttcctaaaaaggaataaatgcatacacctgtttgtcaaaacatctttgctttttgtgcaactgcattttattaataatacatttaaaaaaagaagaggaagaaggaaaagaaaatagtatctttgagggaaaaaagtctactgtctgtaatggctttgcagttaatgctgcgtgtgtacttcattttattgcccttgatttacaaacattggatgacatgttgataatgggaagaaagaaaaactccacacacacatctctttctttccctccccctcctctctctctcaaattgtaacatagttgacaaaatgtgtttcctatcctcattatttggaacattttgtacaggtttgtggaatgggggtgagagagtgagtgtgtgagtgagtgtgtgttactgtttttgatacattcctagtccttgtgttttatcataccactgcctccttgactatcttaagttcctaagtttgaaaaaaggaaaaaaaaaaagttgtttaaaaaaaaaaatgttctctcttgctgcagtcaatatttttgcatgatgaaattccaggctcatactttcaaagttttatgagtaaagtagtgattaataatggggagtgttgaaatattgaactttttgtataaaaaaaatttttttacaaggtcccaaggtgtaaagacaatttgttacctttttctttctcttcttagtaaatattagcaaacgtgagggaggtcagcctgtgtcagacacacacagtcactgatgaggacccaccctccatgagcttaggggtctattcatgtgagaaggcttacagccatctcagggtgaacagcctaggcttacctgcatggtgacctagctgacaatcccctccccacatcaaaagacagttgagttcatattcctagcatctcatcagccataataagagaaagccttggtttaaaaaaataaaacaaaatgatagagccaaaagcattataaatcactagctctttttatttatttatttttttcagttacaatattgaagtctctcctctcttttccacattctagctgagctctctgtctccaagggcataaagcaaactctgctatttgaatcttgttggtacctgttggccagtgccataccctcctgacagtctggaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctgacctgctgaggctctgggtcaggcacacaccccaagctgcctcttagcagcttttccaagccagattcacaaccagccctcactaaggtcgtcggcgagcaggccagaggaaaggtcccaaggaaaggcggaggggccagctccttcagagggaacatactgtcttcttcatcaaatttgataaagagaaaaaaaaagtttaataactaacatgaagagccaaactaaaatttcagaggaaagcaatttcatgaataattcattgacatttcacatctgcaagatcagtcatccaaataaaatgctaacgtcaaaaccacgcaccatctacagcattctcatcaagaaagctctttgcatataatgataaatgcttagattagaacaaatgattatataaaaatgtcctatcaaaagtgtgctaggttaaccacacagaagacagcagtgccgaatggagaaccccaggtcccaggaaaccacctgtagagatgatttttttttcattctatacctttagaaaaatgtgccttttctcttgggcttaattacatcatacatattctaaggactaatgaacttagccacatttgtttttcaacacaaatttaacttgtagtatattgaaagaaacactgtaaagcctcatgcggtggcacatgcctttaagcccagcacttggaaggcagaggcaggctgatctctgtgagttcaaggccagcctggtctacatactgagttcagccaagtgacatagcctgtgtctcaaaacaaccaccaaatgaaccttttaagtggccaaaccacagcatcttagccctgtgtctgtaattccaagcacatccataaagctttcagataacagccttacaaacaccttttccacatcactgtacctgcccggttaagggaagcattagaaggttggttcctgcatggtttgtgagtctacattttacattttctacaacagtatggtttttatttagggttgattttatttttcattttgagaaacagggtctcaccatgtagccctggctggtttagaattccccctaggaaaatcaagaagcccgccttattaaaattacaacaatcctcctgcctcagcctcccatgtgttaggattatagataggtgctgccatgcccggttcctcttgatgtcatttgaaacaagtagatgttgttgctgagctaagaaccatcaccctcttctccatgatggctccgcccatctgagagctccctaggcggataattagcaaaacactggggcctttaattctcacctggcgactaagaatatactatcacggttaactgagatgctcttaattgctggacttaaatgtaggtgctgcttgcaggacatactgtgagctagctgtgcacacacattcctaccagaacaccccaggacctatgcaagtatgagggtgtgtagtgaaggcccagctagctgataccatattttaaattgcatttcaggaatctttctgtagcaagaatactccttaaactttcatttcaggcttgctcctcacataaagcagctaacccaaaacacagcttcttctattaaacagggatatatatatatagtctaagctctatataaaacaccagcagcactggcatacacatgaatctctcagcaaaatggatgaacaatgcaatgagcctttctgattggttgtcttctttggtaatgccacatatttatatagaatgagtaatcacaattttgcttttcaatttagttacaagtattccatactcaaagttgggcctcaaaacttcatttaaggtgctagacagataaagttttaagacagaatagttcacatcacagagaagttaaatgcaaagctgttgggataactgtgggataatatgtgtattagaaaaccattctacaacacttacattgtatatatacatatatgtgtatatataataaaacagctctatgctgtttctgcattgactgcgaaagtatactgcatgcctagtatcaagtacacatcccgttaattttcccatctgaaattatcaacagtcgcctctgttccccagcctcaaagcgagatgttgggctgggaaaaggacaagctttgagttataatgttaattgaaggtaaccggcctttcaagtattaatctcagctaaggcgatgatcattatttaccagcccatgacatttttatcacccatcattttagcacgtttccatcgaaaatgctaaaatggttcgtcataaggcagatgactgcttgagctgtaaaaatgaccaacaggagtggcggtgctcagacattaaattatactgtaattaatatagacagttaaactgtctactaccaacagcaatttaggtaaccacatttgatcagctataaattgtaactacattaaaattccagaaatattagcaatatggattacttgatggaagtctgtgctgatcaactatcctttttcttctctctctctccctctctttaagcggaagcacaggtcaggtggaccacaaatccatgggcgaagaccaggccttagcacttttagtctcgtgaaacaagcaattacaaatagtcgtatcgatttgctaaaaggctttacgtgacataaattgtttcctgtttagcttattgctctgatctataaatgtcaccaagtccagtattaattagggccccagaacaacatgaggttgccagcatgggttctgggctacaattcgttcctccttttgtgagccttttcgggagtgtctcacccacttatttctcattagtgacaggcagaggaaagaaaaactattttgttccatgaagttttaatgcccacccactttcttattccaaatgaaactgtggagttggggacttgccttactgcaagttgacacataacaccacatttcaaaaatatcttctaaatagaataatatttagaagggatttcagcccccaacaagctaacacatcttacccttctcagtgtatggcactgtatgtggttttggggggggttatatttctacccttaaaatgcaattttaaatggcttgcacacactgttgacttaacataaatcaaatgtatcatatatactttctttctgttggcatgccacgtagaaaaatatgtgagattcagggggaaagggggtgatggagaaaatttattaaatataagtttttactgtaatacaatattaatctaagccaatgctcatttgccattaaactgatccttaaaaaaaatacacatgctttttattattttgcactcaagcaaaaattccacattcaaagactttccatctagctgggaatgtctctggcaagcaacatgtcaagaaatcttgacctacagaaagacagcagacagtgtcacgctgagcattaacccacaggcagggaaagcaaacttgattctcccatacattggacaaatggcggtcaacagcacagacatgggacaaatgagccttccccagaaccttcctccttgctcctctatagcacatagttgaaaatgtttgatttgcaacataaaagattcattaattaccacttgaatatttaaagctattttacagtctaaccgagatagataaagcagtgaattaaaacctctaataaaattgtaaaaatatttcagtaagtttacccgtgttatgatttagggagaggctcaagcattcttagagaatagagtctttgcaattttcaagtgtgtgtttgaaggaaggagctgagtgctctgaagtaatttgtttctcatttgcaaatgtttactaataatttatttttgattcaagctcgctaccttaggatgccatagacagaagaaaatacctaccaagtagattggaaggaagccttcgatgtcaggaattaatcatcagtcactagcgtttttagctaaaaacatggaacccagggatgtgacaaagcagtgtctgcccccctcacctgtgatttgtatttctcagctactttagagagaatttatttggtccctgtgattccccacaggagactgtgccagccacagttctacttgagccctgaccataaggtacagagcagctttgacaagctgcttcatctctttcctcctcaactccctcttcctgtgaatttaggacattttactaaccgataacaaggattcttttccattatattatactcaaaatttgttcacatactctctttgtggagttttcctagtggaatctgcagcaaagggagtttgcctgctctgtaccttcccactattaagattgtcccggcatgctctctgttgtaacgtggcctgtttaaaacagattcccacccatcacatacctacccaaacagctgcaagcactcaataacccactcaaacccaacaccgggtatcagctggggagcaagaccgatacaacccttgaattcgtggtccctgacagttcctgggggagatgagttccggttgtgaggcagtgtgctgggtactagtaagaggcagagtttggaaagacaggaagaccacttaacctcactggggaccaccagggaggcctttctagaacatgcaatgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctcaatcttcctaatgctatgatcctttaatacaagttcatgttgtggtgacccctgtcccaaccataaaattcttttcgctgctacttcatagctgtaattttgctgcagttatgaaccataatgtaaatacctgtgctttctgatgctcttaggtgatgcctgtgaaagggtcgttagacacctagcttttagagggggtctggacccacaggttgagaaccactgccctacaccctttcttttctgctacactggccttcttgctctagctgggttgacgatgctctgcctcaaggctcataggtccttgcaggcagtgttatcttccagtggctcatgcatccctcccctaaagctccctccatgccccatcaaagctgagaagcctttgctgaccatgtagtgtcactgccattactctagctgcccactctccctcctcctcccacagctcctcgcctttgcttgtttctgttaggcttgccacctctccacgttctatagacactgcttgttttgttacggagtgtctccaagggcatggaccctgccagctcggcccacctcagaaaggccagagatggttgcttaaggagtgagcaaacgaaacagggctgggaaagggcagaggtcaatctgaactccctgcagcatgcccacacagcccatcctcttatgttgcatggccagccaaaccgagtctctttcccaacattctggccctgctgctgcaagctaggaagactcacccagacaacggatgagcatgcaggagcttcctaaatgatacagccaaggctgtgtggcaaaggatctggcaacttggctcactttagatccacctatgagtctacctataatgagcctctgagcccagttatggtttcatatataagcactaaacatgaaacacaatttcatagctctaagccatcaacatcactgtgtgataaagaatgcataactgtgattactgcaagccagttgaacctactgttgaacccacagtattatcaggaaaggcatgactaggtgagaaaataagaccaacttggagtctatttacagggaagccacttggtatggtgatgtctgccttggaatatgtttgctcctgactggggt

SEQ ID NO: 224 - DNA, 2554 bp, Mus musculus
atgcaagaatctgggtctgagacaaaaagtaacggatcagccatccagaacgggtccagcggtggcaaccacttactagagtgcggggcacttcgtgacactcggtccaacggagaggcaccagcggtggacctgggggcagccgaccttgcccacgtccagcagcagcaacagcaggttcccgtgtcagtggctatgatgacacctcaggttatcactcctcaacaaatgcagcagatcctccagcagcaggtgctgagcccccagcagctccaggttctcctccagcagcagcaggccctcatgcttcaacagcagcagcttcaagaattttataaaaaacaacaggaacagttgcagcttcaacttctccaacagcaacatgctggaaaacagccgaaagagcagcagcaggtggctacccagcagttggctttccagcagcagcttctccagatgcagcagctgcagcagcagcacctcttgtctctccagcgccaaggcctcctaacaattcagccggggcagcctgcccttcccctccaacccctcgctcaaggcatgattccaacggaactgcagcagctctggaaagaagtgacaagtgcccacactgcagaggaaaccacaagcagcaaccacagcagcctagacctgaccagcacatgtgtctcgtcctcggcaccttccaagtcctccctaatcatgaacccgcatgcctctaccaatggacagctctcggtccacactcccaaaagggaaagcttgtcccacgaggagcacccccacagccaccctctctatggacatggcgtatgcaagtggccaggctgtgaggcggtttgtgacgacttcccagcctttctaaaacatctcaacagtgagcatgcgctggacgatagaagcacagctcaatgtagagtacaaatgcaggttgtacagcagttagagctacagcttgcaaaagacaaagagcgcctgcaagccatgatgacccacctgcatgtgaagtctacagaacccaaagctgcccctcagcccctgaatctggtatcaagtgtcaccctctccaagtctgcctcagaggcttctccacagagcttacctcatactccaacaacccccaccgcccccctgactcctgtcacccaaggcccctccgtcatcaccaccaccagcatgcacacggtgggacctatccgcaggcggtactcagacaaatacaacgtgcccatttcttcagcagatattgcgcagaaccaagaattttataagaacgcggaagttagaccaccatttacatatgcatctttaatcaggcaggccattctcgaatctccagaaaagcagctaacactaaacgaaatctataactggttcacacgaatgtttgcttacttccgacgcaatgcagccacgtggaagaatgcagtgcgtcataatcttagtctccacaagtgttttgtgcgagtagagaacgttaaaggggcagtatggacagtggatgaagtagagttccaaaaacggaggccacaaaagatcagtggtaacccttcccttattaaaaacatgcagagcagccacgcctactgcacacctctcaatgcagctttacaggcttccatggctgagaatagtatacctctgtacactaccgcttccatgggaaatcccactctgggcagcctggccagtgccatccgggaggagctgaacggggccatggagcacaccaacagcaacgagagtgacagcagtccaggcagatcccctatgcaagctgtgcaccccatacacgtcaaagaagaacccctcgaccccgaggaagctgaaggccctctgtccttagtgacaacagccaaccacagtccagattttgaccatgacagagattacgaagacgaaccagtaaatgaggacatggagtgaacctctgggcgggccgacccccgagaccgaagattggggaaaaaaaagcaaaacaaatttaaaaaaaaaataaaaaaagaaagaaaggaaaagaaaagaaaccacgtcaaaagttagcagtgaaacccgccctccgtttcttgtacagtctggaggattttcgctacattttgacaactctgaaacgtgttaactcttagtgccatcaagaatcccatttgggagtatttttgatttttctactttttgttgacaaaagggatttgtactctgtgcattggatggacctgtttggtacttgggattttcctctttgagtcaacatcagtgttgtaaattcgataaacggattcacttttagcagcagactttgaactgcagcttcgcccggctgatgctgggcgggcgccgaggacacccgactgagctcacgtacctgcgctgcagaccaagccttcgcccgagttcaagactccagtggacgacctttttgcacagcgctgcatgttgataccactgcctttactcactttggtttgttttgtttttgtttttcgcttccagttgggatgggggaaggcctttgtgtgtgtattggggggaggggttaaaaataattatccca

SEQ ID NO: 225 - protein, 642 aa, Mus musculus
MQESGSETKSNGSAIQNGSSGGNHLLECGALRDTRSNGEAPAVDLGAADLAHVQQQQQQVPVSVAMMTPQVITPQQMQQILQQQVLSPQQLQVLLQQQQALMLQQQQLQEFYKKQQEQLQLQLLQQQHAGKQPKEQQQVATQQLAFQQQLLQMQQLQQQHLLSLQRQGLLTIQPGQPALPLQPLAQGMIPTELQQLWKEVTSAHTAEETTSSNHSSLDLTSTCVSSSAPSKSSLIMNPHASTNGQLSVHTPKRESLSHEEHPHSHPLYGHGVCKWPGCEAVCDDFPAFLKHLNSEHALDDRSTAQCRVQMQVVQQLELQLAKDKERLQAMMTHLHVKSTEPKAAPQPLNLVSSVTLSKSASEASPQSLPHTPTTPTAPLTPVTQGPSVITTTSMHTVGPIRRRYSDKYNVPISSADIAQNQEFYKNAEVRPPFTYASLIRQAILESPEKQLTLNEIYNWFTRMFAYFRRNAATWKNAVRHNLSLHKCFVRVENVKGAVWTVDEVEFQKRRPQKISGNPSLIKNMQSSHAYCTPLNAALQASMAENSIPLYTTASMGNPTLGSLASAIREELNGAMEHTNSNESDSSPGRSPMQAVHPIHVKEEPLDPEEAEGPLSLVTTANHSPDFDHDRDYEDEPVNEDME

SEQ ID NO: 226 - DNA, 653122 bp, Homo sapiens
  misc_feature (1)...(653122): n = A,T,C or G
gagcccaccttgaggttctcttcaagttacagtctcatcttaagcactctgttatgaaaagaaaatcatttggttatgtatagagccagttacagatagaaataagactgatttctgctcttctttatggggaagttatcagattaatgatacaccagtgccaggtaaaggtattttagtggcccaaagagaggctacggcctgcctgcctgcggggcatctagagccgtgcttcttgcctgagggtaactttgaccccctagggcacatttggcaaggtctagagactttctggttgtttctcccacaaagggggataggtgccatacttacaatgcttaacatcctataaggcacgggacagcacctcaaaataaagacttatccagcccaacaagtcaattgtgctgaggttgagagactctgatctggaggaaccccactcagcttcatgcagatgtccctgcctgggaaggtgagtcttcttttgctattttccagttcttttaagaaagtatctccatcttattcttgcatcaagaattgtggaatgggaagcagatctgatttcagaagtgggcagggcaggcagcctaggtggaatgatttgaaaggcacagagacaatccagacataaaaaacattcctctacttctgaggctccaaggcctagaattctttctgttgaaatccagagaagagctgaactggcttcctgagttttgaatcaagctctgctacttcggaatgcattaagatttgctgagcattcactgtgcactcagccctgggctaagtgcggtgcaggcattctctcgttccattttctcagcagccctgtgagatgtgtccagttattggaggcttggaaatgttcagaaacttgcccagggtggtacactgattaagcatggtgctggtgcagagattttccaccaggtttgtctaaggcccaagaccctgccgataaccaagaccttaccgtgtctagttctgaggtaattcaaccaaccttttttgtgactctctttccacctgtggaaaatgaggactctctttccacctgtggaaacctgagggaaaattccaccatgacttctaggaatctttgacaatgcttagctgtcttgatttgtttcttttatgtcttgccctttttaaggcttcccttttaaaatggagacagtctcagagtaggtggcaattggaaatctccatagaaggattccaaacctcaacatacagcataacaaactatatggtgagcttctcaaaatgccaacttccaggcccctcaccaatgctgatttagcaggcttgaaatgggctcctggatcccaagaaattaatcaattctttttttctggagccctgatactaatgacgccctccatccaggtgatgctgaggcctgtatctgagggccacactgaagaagaaggccagcctagccccttctggggaattcacctaattgactggttttctcaaagaaaggatactggtcactatggaaggacaatgtttagggtaacttagggctccaagacccctcacacaggccgagctaactgtgcactgctgtcctcagactcacccagatcaagggttcccaaacttcactgcacattagaatcacctgggaagcttttaaaagtcctgatgcccagatcatactctgggtcaattaaatcacagtgtctgggcctgggagccaacctttgtaaagccctccagctgattccaatgcgcagcagtttgtgaaccagtcctgagcattgtagattccatatcattgctgctgctgcactttctcttgcagtgctctttggctatcctagccccaagtgccaaaatcttagctctccaggaagacccagctgcaaatgactctttgctgtattgtcttgacatgcccccactgcaatgtggttccttactcctctgctgcttcctctaaggtattcatcttatgaccttctttgtatttactacgtatcttcagccagttagactgcaagttccttgaaagtatggactctaatatatgtggctccggactgatttgagcagaaagagtatgcaagggtggacacaagagagatgaggcaaagaccaactcaactcttttccttggctttcttcaggatagatcagagggagggtaataataatggttgctagaggtcacctatgcatgaatttcttgagtaaaatatcccagtaaaatttttaggtttttaaattaaagaaattgtgttttatttttatttttaagacaaggtcttgctctgttactcaggctggagagcagtagtgcgatcatggcttacggcagcctcgacctcccaggctccagccatccttctgcctcagccttcccagtagctgagactataggtgtgcaccaccactctcagccaatttttaattttttggtagaaatgaggtctcactatgttgctgggggttgtctcaaactcctgggctcaagggatcctcccacctcagcgtccccaagtgccgagataacaggtgtgaaccactgcacccagccttgaactcactcttctgggggagaaataaagaatctttctaaataacagcaccttctaaatagtgatgttttgaccttttggtattgtgaaaatgtgtgtctttgctgccatgactcagaatgtaggccagccttcctccccaggatgtttagggggcttatggggacttactcatgcctgggaaggaatttaagaggaagtcagagtaccctctaagtttcttttcatctcttctgattgttttcaccctgctcacttgagaaacaaatcctgttatcctaaactgacatgggacttagtttctgcaaagagtgacaaatgtacaaatgcacagtggccttgacagatgctgcagctctgttttgatttgcccatttagaattttaaaactgagaaagactttgatttcttgcctcccttgaaaactcaaaagctcttcccgccctgtgcttgctttcctggtaatagcaaatagcacctgccacttttagctgaggcctgtgtgctcaaatttgctgtagcccctatgcctatgcctccttacttccaagatttcagttgcctgatttgagttctataggctgtggcagcagcagcacctgttaaaaactgttaaaacgcagattgctgagccctacccatcttccggaaggaagaggtgtcatttgtttatgtatgtagatatatacacatatacatgtgggtacatatatacatgttagtatggattcatatagatttccttctgtggattataatccagtactattgttacttcttttcttgctcaggatgtctcaactttgggcatttgggagctctctggggttgcctcctgtggcctttcagtaagcctctacagagctgccccccgccccccattttgttttgggtttttactccatcacaagatgctccgtgcttattttgtattttccctaccccaaccctggaattaactagctcctcaaggatccctgatttattgtattggagaaaggtatttagaaaccaagatctgggtgctaggtgtgctcattgctattggatcatcattgcttctagtcattctgagtggacagagctagggaatatatgtgtgtatacttatgtatactaatttacacatatgtacacatatagatttatgtctatatctatttatcatgtgtatgggtgtgtgtgtgtgtgtgtgtttgtgtaaaacctgaccccatgaataccttcaactccagtccaaggccaaaggagtcatactagctttgggaaaatcagatttttaatctttgtatagttttaaaattttacaagtagttcaaggacatcttggggaaataagaaagcttctttttatagctattttatagccattacttcaaaaaactcaacaaatcccaagcttatggctgagatgtctcatcaacataccaccatgcttaatatccttcagtccctcctgaaatcttccatagtttggaacacacagccttactgttcccgaaggtaggtagacctgcctcatttcccttctcataaaacacagtttgtctccagctctactgaacaatgcctattgtaacgctgagctggcacttgtgcattctaaatgtaggccaagacacttcgcggagattacaatcagaactttgctttacatgtgaaatcttattttgaatgcaggtacacaattactcactcagagacttaattacactgccttaggatagtattaaaacaatggttttaattattttttgggggggtgttacaaaagtaacctgctgtcttgttaggtgggtgaggggcctttactacagtctttctgagaacttcacagatacaaattaaccttcagctgtgaggtttacctgtgagtccttcatgtttattcagaaagaaaccatacttggatggggtcccttactctcgttatgcttaatgtaaatctagtactgcttgatgaactgtttagagaactggaaagataatccagccaggatggctcatgggctgctggaggtgtggcccctcagtggtttggaaaacactctgggttttaaacagcagcacctataattatggaggcgtcatcccttccataaaaaaagaaaacaaaacaaagaaagcaaagcccttctactaacaaggtgtagtcatagcatgtgttcagccttttcaaaacctgtctggcatttgtttctggcctggtggagagtatcttccatctttctctgagctctcataaaacaatacaaaggtaaacaattggagggcaattagcagtctctttggggtaacaggagagagaagtcaccggactattaatgtcaaaggaattaattatggtttgcataggtgattgagtgacttaactttgcaaatggttgaaaaataaggaaccaacaaagtttataaaagatgccagtttggagaatcatgtatggcagacttacaggactacctgtgaaatagtttaaggctatcaagatattgagatgcagcctgttgtataaggggccacatgtactatagatcacctttgtccaacttgaatgtgtgtgagacttggctgggtgatttttttaaaatacagatatttgattcactaggtctgaggtagggcctgacattctgcatttttgacataacctggaggtggtgctctgcaggtcagcacatctcattttgcatagtaaggctgtagattgttctagtacctgtagcagatggggttgagccacccatactccttttacatgtttccaaggtaccaacgttgcactgggaatgctcagggcattagaacagctttttggattgatgatacttggccaaatgcttcaccgtaccttgtagtttatgaggattacagtccactgagacccatgttcatacagtacagtcatgcacaacctcttttcacaatcaccaatttagaaaaacataaaaatatttgcaggccatatttatttatgtttatataactgcatactttaaaaaaaagcagcaagtgcagtcttggtaactaaggtctcactctccagttagaaaaacagaaaaagcactattgtttctagatttaactctgagcctcttaagttttgttgtgggggaaaacactttttaagctagggtcattccccgttccctgactagcttttccacccactcaaattatcaaatgtggttttgtctcagagtgtgcctgttaatattgtatactttaaaacaagagatcccctgctgatttccggtgtggacatatagggacatgaggacacagaggatgggctcctcttaccacttactgtgaagcacatgattttcattagccatttttatcttcttggaaggcaactgagtttaagctttcatttagagaatggtctgcccacgcttactaacctcccctctctgaatccacttttctcttctcaaccctcccttctttctttgctgtgttgacccccacctggatgtctgtcacatctatggagagagggtggagagaaaggacggtgagcagggggttgaacttgttcttgaccctctgtggcctcagtttctcccagatctgtaaaggggtctgtaggttagctgtttctgagaagctagacaaaccacttaagtctgaggattggtcactttagtggaaagagtgagatggaaacccacaaagtcaggacacctggattctaatccttgtccaaccagtaaccaaatttattttgccttggagggcaaatgaaatccctgggccttagattcctcatctgtaatgcgatattcttagttatgcccatgttttttaaagtgtaggaaccttggcactaggatggcataacactgaatcacacattgagaactgtattcctttccgatcactttaaatccttctggttgttaaaaaaaaaaaaaaaaaaaaaacagaaaaaaagagagagaaaaaacaaaaattcaaaaatttccattgatactcttgtccttaacccttctcaacatttgccactctccctccttttttcaaaaatcatttttaatttttgttttgaccctcaaagagaaatcagtgactttgtttttactgtgcttgtttttaatttatggtgggtgatactgatttcccatttaaggcagtaatagaaaaaaattaaaagaaggttgatttaaatgaaaatgtttgctacaattaccataataagtggcctccaatgagtatggtatattaattattcgggaactgttatgtcatatagatatggcaaaaatcaggacaccagtaactgtggttaaagaaacactaaattaagtggttttagtttttgttcaactcaaaacttacaagagcattcaggtacgtcgtcaggtggtaaatgtccactccagtttctgttccccaaatgtacatatatttagtgacatggtatttggtgaatgaagctcatgtttggtgtatacaatcaacagtaatgtgacaggggactaacatattctgatacgtttgggaaaattttggctgcagttaactataatttgctaattttgcatttacattggttttttttttctcctgttacttaaaatataacgaaatggggacaagcacctttgccttggtgtaattaaaaataaaattatgtcaggaacatctgttttcagaagggatttctatttgttttatcaccaaaaggtggcgtcctacccccatgccctttattttaaaacctttcttgctttaatttaacaaaaagaaacttccagttgattactgataaagaaattaaaatctgccccccacgaatgtaacgtgacagtgttgaaaatgaacaatatgttaagctgcagttaagtttccctctaatgtaaaccaaatggacatcgagttctttaataaggcagcacagcacattagacagtatcatacaaaattgagtacaatatatcatgggatttacaaccaggatttccttttgtctgcaaaacttgttgccaacctgactgtggcccccacttgcaagtgaatgtagaatttaaggcagttaaaatgcagaatcagattagcagcaatctaaagatctttttagtattgcgatgataataatttttaataaacacactgcttaatctgaaaaacaagatcagaggatgaattgttctttacagactatgaatagatctgttacatttaaataagtcgttattcccctgagttataattctacagtcaggcatataccataaacatgttatatttggcataaagtactttagaaattaaaaaccatttttaataggttgaccactacagaaccagtagactggctactttgtagatttccacttaattccgtgtgaattcagcatatggaatttccagtgatgtcaaagagttgttggcagtattaactgagttgacataaagcttttagttcagtgcctagatcatagtatttaataaatgttagatgttattattgacagcttagactgtgagctcctcaagggcaggaatttttattttttcatccctctgtgcccactctgtggtctagcacacagtgggtatgtcattaatccctttatgtcttgacaaacaagacgtcgaaccctagcctctaggaagctaggacattccatacaaactaaaatgcattttattggtctagattctagtctaaaagattcagtgaatagtcttatctggatagcatggaactttatgcagcatgcatgcaatgtgaattctaccaggctgaaattaccttagcagcctccctttcttttattctgtagcatcagcgaatggctttgttattttttttttttaacttgcgaaagatacaatttcaaagcgatagtcttatgccacccttgaaattaagatttaagttcttctgtaaattaatgtttaacaatatttgtaaaggggcattacgcgaaagaatttaataataaccttttcaggatattatctacaactgtgctggtctcaagaccaaagggacagtaagcctctcccctccccgcaaggggaagtactttgtaggaatccacaggggtgacttttaatatattctcataaagaattggcctggtgtacaccagccagccagtagctggaaatgctggtttgggagtctggccacttctgtggtggtgggtctgaaaaaatttacttctgttaacaacaacaacaacaacaacaacaagacatagaggtcttacagctttccaagtcacgttttggaaacacatactctgcttccttctctatgcgtattgataaaagtgaaagaaatactagtgtcttttgttttatgtatgtatatttcaaaacatttaattcaggctcttagtttattccttcgaatttctaaattcaaccaaacttcaaaaaccgcaaaaagaaaaaaaaaaatctcaccttttcaaagaattggacaaagctttttgcacgtgactgatcactgggagagcaggtaatttgtgttaaacaacggactgacatgctagcccccaggcgttttcctaagaggagtcgtggcaagaacacagttcctgatgcagccaccttcccccaaagtggactcgattgcacattcctgcagtggctctgacaagggggcagaagctcgtcccacattcacactctcctgattccgagaaacaggggagaaaacccctcgctggctggcggggtttctgtttccttgcaaacaggggtttgtccttctgctgaactttcacctcccgaactcgccttctttcattggacaaagtgcagaaagaaagaggagagaccgagggaggacgggagagagggagaaagggggttgaaaacaccacctcccaccccgctctccttcaactgtcactgatggcaaaacactttcacttttaactggaggaaactcacattctagcctgtcctctcccctccctttcatatttttagctcagaatccaagcaaatagccatcgcattcccatcttcgtccctagttaacactctcccttctcgttttttccgctgtctgaatgggccccccatttcccatctcctgaggaatctccccctccgcccccctgccccttattttccaggtctttcctgccagatccctctgttgccagggactgctctggcgttcccttcctctctctggtccgcggggctctgcctccctctcctctttccaatcctgcctggacgcccctcacttccccctccctggatccctccccccaacccccccccccattctttggcaattgcgattttttttttctgggagcccggttgtttaccccgccaggtggatgtgacgtcagggacgccacaccagcaaaaaataacaacatctccctccgcgacgtgttggcctctctcgcgcgccttatttatttatttgttccgggatgtcgggggggaggggggagggaggaggggggtgggcgccagcgccccggcgaacggcaaagagggagccgctcccgctcggggggccgctggagtgcccagcggggtgcgtgaagcggagaggggacccctgcgggaggtagagggtcgggccggggtgcgcccccgggccggtgctgcccgcgcctctgccgccgccgccgccgccaccggcgctggctgggctccgggaagctagtccggagcggaggaatctattgttatttattgtgtggcggttgcacgctgtactcgcggcggcccggccctcgcccgggagtgcgtgtgtgcgcgcgtgtgtgcgcgagtgagtgtgtgcgcggggtgcgcgcgcgggcgggagtgggcgcgcgcggggaaaggcccgaaaacaccttagtttgcaccgagagaccatttgcagcgggtgagtttgtatttttccatttctgctccactttttcccaagccgcctcctgtcttgtttccgccactttaaacaacaacaacaaccagcacaaaaaaaaaaaaagaaagaaagaaaaagagaaaaaaaatggaaaaaaaaaaacaactactttccacctccaggctccacgtgcatctcccccagccctcccctctcttcctctcccccccgggtcgaggcccagctctgggatgggtgggggctgcgggccggcgcgcgggtggagggagctccggcggcgcccgcaccctttgggtttatttgcataagtcaaatgggggcgggggcggtggcgactgtgaggaggcgagatcgcctgcccgtaggccccttcacgcctctctctgcgctctccacgatcgcctaggggagagaaatcaataagcccaggccgcctggcgcaactttcgatgtccggcgttggcgtccggtggccgcccgggcgcggggccggtgcggggtcccgggtcctggccgcggcgggagggggcgcgcgccgggcgcctcctaggcccaaagtttagacttggagcaaacttttccccttctttccccgcgggtgtgtgccccctcggtgcccttgagctgccccgcgggccccagcagactgactgtggtgcctggccctgggccccgcactggggaacttccccgctgccacgcgcgcgttaccccgagagtcagcggcgaggaagctctcccgccaccccctcggagcccggaaaattcaaacacgcacctgcgcacccccagccagacacgcacccctacgcgcgctcggcctccgctttcccgagacgagtccgcaacagccgtggccagatccacgggtgggtgcgggagccggatgcgctgcgaggagtcgccgcgcccggatctctctcccaccatcacacacattttctgattttacccccctctgaagcttgggggacggggagatttcccaagctccgatttgtcctgcgtcgcgcgcgtgtcgcctcgtccctccggccctgtcctggcggccgatggctctccgtccctcgcttgcgcgcagccttcctcccgagctccctgcgctctattcctgtcccgccgagacgactccctggagccagcgagccgaggcggcgtgcgcttcgagtggggaccacggcggtggcggcggcgccgggagccgaggagtttgccagttgccgcggggtcgcggtcatttgctgcctccgccttccctcgcccccgcctcccgcctccctccttttcagacaacgtcgcgctcggaaacttagattccttcttctttttggccctcgacgagcccccctccccacctgttgtgagctccgccttggtcccgggagactggcagtgacacacacgggctctggggagctccgctcccggaaacaaagtcgcatgcccccctcccatgtgtttgcttcgaaatcgctgcctgcagccccccattcccgcgcagctcccgccccctgtgagaataaggactaaataaacagttgtaactccaaaccttgcgcccgtgatcgtatccccatcccacccccttctccctattcctcccccctcctttttgttgttgcaactttgtgagatcctggggaaggtgctgagactttggctcgggccgatttcccggtctctggatccttgcagggattccctgagccgcatcctctcttccctccacgcgcactcgcgggtcctcggagcccgctgccctctctgtcctggcccctcggcctactcacccgtcccgtccccttcagttccccccagcctgcacggggaagacttgctgagggtcgccccggtttcttgtcgactgcagaacccgaaagtttgtaagaggaagagagcgcgcggcgagcgagcgagcgggccgggggcagcggcagcggcgccggggaccatggtgctgccggcgcctcctccgcgggcgtgaaggcggcgctcctactccctccccggactccgcgggtaagtcgaggcggccgcgggcgcggggtccagggacaccggagagccccaggcggcactaggggttctccgtccccaaagagccagccggggtggcgcgagcctagcgataaggcaccgggagcgaggaatgtgcccatcctcaggccggtaggtgcttcgaaatactggacttcctcccctccacccttttcccctctttctttcctaaatctgaaaatctggagatcaaagtttagcgtggagtgtaaagtgctccgataaaatatggtgacatcctcgccccccttctcaccccactcccctcttataactattaattatttccaagtcattgtatccaaatacccttgctgggctgattacaaagtgtattgatttagtctgggctcatcctatgctttcgtcttaattcattttctttttgctctaccagaagacccaaaatgaaacttatttcttcctcttccctacctccccaccccacaagccctcatctgtgaggcttgggcagaataatgaaattaatataaacatttcatttggttgcatttgaccttatgcagtccacttctgaggggctggaattgcgctcatgtctgctcacaggtattttccaagttagcattttcttttttgtcactgctctttaaacaggaatgccggaggagcattctggattccctttgaaaggcatctgtacattcaaaccgtctacacttcaccattggttgtacgtagacttaagggtttagggcttggacaatagctgagttgagaagacctcaaggatatttaaaggaatttttctgctactgaaaatatattgaagaatcgctgcaaaatttttccattccatcccctttcccccacccccgttttccacagcaagaatcaatttggagggagatgtgtaaactagaatttttaaagaaatagtaagacttcaggtgttttctacccagggatagcctacataattgagaaagaggagttcctgctatttttctgttccagagagaaatgtatcaaatcttttttagaattccactggagttttgattctcaaagtggaaatacccatccctttgggtccaggaaaagaaaactcagctcacagtttcagaaatttggactgtttttttcccccctctgtctttctatttgaaacgtctcacaattaaagagcaagaaaaatataaaaaaggaactcaactagttaccattcaaaaggtgtcagctaaaatctcactgcaaagggaaaaaaaaaggtttaacatcttgccactggctgcatcccccaccccccttagactttggattagtcattgtatgagagagagggagaaaaaaaaaatcactttttttttttttttggaaaagtaaagtaaacagcctccaactgctgaaccttgacaacccaaattaaggaagcaggagagatcaaacagaactgctgctgggtggttgtcaggagctgctacacggagaaccctggactattcgatcaagcagcaaggctatatgttcacttatgcagaaatggaccattgcagatgctaatctttgttgtgcaagcgaaggctcacttggaaggaaatactcagcccctctctgggcagcatttgagttccttatggatgccgagtcgcgaaacaagttattttttttaatgtatccttctttatgaggagaatgctacccaaaaatgtattaaaggaatattaagtcgtccagagactgtcttgctaccaagaactgtgcaatggaattctttttaccaacattagactcctacactagagttagataacgttttctcacattgagtttagaagatctgccttgtcagggaagccaaggttttgtatgtgagagtttaaatctgatgtgaagctcaaaaaaaaaaaaaaaaagaaaaaagaaaaaaaagaaaaaaaaaatctctggtgatgaagttttgtgtcagcccactcttggaatttaaaaaggcgagagagagcagtctccagattagacaacctctttttttagattgacattcaacatgaccacgttgctacttttattcaagttctctgtaacttgtccttgcttgttgtctaggaaaatttaactactttacatttttaaagggagtagtaacagtaattactgtagcattttgttttcacaggtttatcaaagtataatgaaagaaacatcaactattcaaattaactgtctcagataaggggtttatattgctggagatgtctaagattttgtgtttatatttaaatcgtggagtataaactgtgtaacacttttttttttctgggataaactatccccaaattaaatgttattttaaattaagtagaacaaagtaggaaacaggataagtaaacacatacagaagaataaaaataattgtcatttaaggattatatttttaattaacaagtgtcggtcacatagtaagcagtttatatattttttgtaagccagagtttcataaccatggtgcacaacatgtttcaaagtctgtagtttttactagatatacctttattgtataattaagcaatgtgggttaaacatacacatggatgctattaggcaattttctgcaatatgtaatgttttgaaaacgctataaatattttctagttaaaccatttatacttataatagcaaaagttaactgagttaatattgagcctaggcatggttttctgttactgagtttttctttgcctttttaaagactatacccctggccttgtaaatttgcatcttaggctctgttgaagggtatgtctgttttcagcagttgtttaaattaacagaagaattgtgatatttttcaaatatatttatattgcagggggtccagtgccaaaattaagaaagagaaggaatatagcagatgtgacaacttcttttgaacccagcttcctctttgcagccaatcttattgtgcatatttatttgattttcatgttttacttatgactcaaactcagttttgaaacactatcttgtaagattccacatctcaaaaagtatgtatatttagacaaggttaggtgttacagtacctatcacatttcagtgggaatgccaagaatatttacagggtatagcaagaattttgtcctttaaaaataattttaggtatacgttaataaaaccgaagtagattgcaggctgtcagaacatagtataaattttgtttatgattctgttactttaaggtacttacattaaagaaactcatttaacccgtgactgaagagcattaagtggggagggaaaccctctgaagagctcctactgccctttgctctcccgataatcttaaattactacaatttaattgcaacttcaaggcattcagcatgagctgtttcttctccacgaccgagaaagggtttccagagcatggctagatttacacaggtggtatttttgtttttaattttttttttctttttgctaagggcttttcctttcttccttatcctgtcagatgtcacacttcttttatagatttcagtcatagtaaatgccatttttgctataccagcaatattggccttctttttttctttttaaatgtgtttttttgaatctagagtatataaacctctcaagcaggtaggggtttgttttctaaagaaaataacctcaagaaaggcatctgctgaatagacaggtgaactttatacctgagccaatgtatacttttactatttgcaggggattttttttttttaagttgatggtagttagtcccaccaggtgatcaaacattgagtttgtgagacaagccagcaagccaagtaggtttgcacttgggcccatgcatttttttaatgatctttcttgtcatttgttactctactctgcaggccactttgctatacatatgctatccaaggaaccatcttaaactgatttttcaacatatttctcttctccggtacttggatgaattaaggataaaggctccaaaagctggaatgccagcaggccttgagatgaggcaagttcctgaaacgggcaaacctggcgaaatttggggtatcttctgcatgatagtttttttccttttttttttttcctgggacgtttgtagtttatttcaatgagcatgtgaccatgtgcttaatggaaattaagcagatttggcttgtgtcgctaacctaaaaataaatgttgtaaggaatatttgatttctagaagtgttttggttttgcatcccatagataatgttcttacagttagggctacgaggctggtattctgcaaagaggaagtacaatgggggaaagtgcatggcagtcaggaaagacaattagacagtgttctttgtttctttaataaattattcttattaattacagtcagtttgtgctaaggcatttttcaatccttgtttagaagtcagctgccattcacaagaaggttgtgccagaagctgtgttcttcgcacgcactgttgttttacccagtcgtgaaatctattgaccagattggcttgtggatgtctctgcaaggcttgtttttctttttgcaatgccctgatgccagtctttaatacatgccctgccttgtacacaacaggtgtttgttcggtagttattttatgggacttagagtgagaaaaaaatgtttcctatctagccagccgctgtgagaacgagtgcctgaaagggagaacctacctagtacctgaacaggtgtaaatgggtgtttcctcatgaccctccccaagctgttttatttcaaaaggaggggaggggggctcagtttagtgccatgaaatttacaattcagttgtaataatttaaggttattggtagagtgcaaagggcagtgggagctttctagtggtttggccttgatgcttaaagctgctcagttgtagggttaaattagttccttcagtctgagtacttaaagtaactaaatcgtaaacaaaatttatattcgattctgacaactaataatctatttaaattatattaaagtatctgggcaaaaatttaattaaagacagaagtactgtcaagccctgtaaatatcttgacaggtctactcaaatggaactgatatcacgaaatatttacatatgtctgctgtgttcgggaacatctcagcagtgcctgtgcaaagctaattgcactttccttccaaattgtatttttaataaaatagttttttttttaaaaaggaatatgaatacatacacagttgtgttccagtgttctgtttactatttacttctctatactcagaatcatgttgtgatgagtgtatttcctcaaactgctgctaattcagataaatagctgaaatgggatcattgaatagaaagcccatgtcattctgtttgatttcaacagtttgaagatatcagaggctagcatgttataggacaatttactgagggaaaaatggatctgaatgtgggattattgggccttgtttatgttcaatagaatagatttgcttaggacaaacattttctctgagttttatgtttggacatatatttatttattacttgtaagtcaggtggacatccacattttaccagatgctctgattttagctaattttgtgattcactttgtttactaggacactgaagaatatttctagcatcaaactgaatttccgaggtgtcctttctccctcccagctgtgcaattgagtcataatgtgactttctctgctccaggttccctgcttttgaattaggggtaatattttaacatatgttctttgagcttagggatccaatgatacagggctttgttattactcacatttttaaaagatattcttggtgctctcaggacagtgaccgcagcttttgttgggggagggtgtgatgtgagttttgcttgagtttcttttgccctggtgcctacctcctgatgaccagtggcactggtggcttcccctcctgggggtgagcacagagatggaagtgaatgctcatgtctgaagtgaagggaggttgcagttggtcctaattcagcctggttcaaagtgaggtcctcgctcacctacctctgtatctgtgtgtgtgtgtgtgtatgtgtgtgtgtgtaggttattaaaatacagatccttgagtcagaatttttgctgattgacatggtaacgtacatttataacaaacttcccttgataattctgatgcatgctagagacctgtgaatcaagtgatttattctttcagatgtgtggaactgaaatctctatcttcacttggattttactgatgatttctttgattttaccttgaggcccatcctgtgttgtttttaatgtatttggatttttattacgaatgaaaaacggtggtttttaaccaagcacgagtattggaatcacagcagagctgttgttcccaacacagacacagttgcacgactcctggatgtgccgtatctggggtggggccagcatctgtgtttttaaatcgcatcccacatggtcctgatgcccaccaaagtgggaaaactggacctgtcaattatcagagttggaggaaagcctgcaacccttcttaagagtttaattgaattggttggccattgtgaaacctaagagaagaaaacggagctcctttttcaggagggcacaaaaagaaaccttggagacttagagaaacagaggcagaacaagagcctcacagttcaataacgtgataggaacaacctggaacatcggtggttttcaccaaatgtcaatatcagataatttccttttgaattttgtcttgcctgcatccatgtttcccaatgggtgttgtcatgctgtagctaccaattagtgtcagatgactctctagaatttttttttctgagtattccatcttaattttaaaattgtaactgtttgctctttggattaaccctgctggcagaagtattttgattttcccaagcatcttgggaaattctctatcgtatgtgatggggcatgcacgaatattgatggaaatagcctagccaacgatgccacacaaataaagaaaccagaatcctaagaagaaggcatcctacaagattatgaaataaaggaagataaaatgttaaggaggcttatttaaatattcagggcttcaactaaagatctaaccactaagatcaaaagagttatttaaataaaagttgttgagacattttttcatctgtattaataatgtggcttttgaagttacccggtaataatgtgtccataatgcccacacctaatttttaatttccattttggctttaggtgtggctttattttaatagctgccaaaaagttggcaattgtttttacgtttagaacttcacagtttgcttttctgtaggtttaggtagcattggggatattcgtctaataaaaacttttaaaatttctgttctgaccctgaggcacttaaaaaaaactcttatgggccaaattttaaaagtagagtgtctctactactgcataaagaatttctataaaagatgaaacatggagctgattgaaagaatagacggcgcaatggtagaggacacatagttaccactgtcactggtaatctacagcttgatgcgaagtcattccgccttgtttgttgaaatgttaatcatttcattaagaaaggttaagtaattaactgatatttcattagggaatcaatgacagacctttttttagtgatgtatggtagatattttctaatagaaagtttgccccatttaattatttggaaagaagctagttgattgagccttgggaaggaggggtggggcatcttcagataacatctatgtccataagcaactttaaataattttggagaaaatggtctattagaatagaaaatcgttcagtccccagttttcttttatgggctccatcaggcatgttgttgcagacctgctgttgttttgcatgccttctctgggtttaagaagggttcagctgcttaaatgtgttcatcttattttctaaataatggcttttgttgcagtgtgatgcatgttgacagtaaacgcgcagccgtaactttggtaagcttacaacaaattcttatacttgtagaagcaagttatcctccttgctgctgactgggggtgcttctcccttttgtctggctatccttatggcaactgcagcaaaaggtttaagtattctgggatgaggatggggtgggggtggggacggagggactctccacctggcgaaagttcaccttttctgatacctttttgtcctgaaatcacacacaaagtatgcttcttgcatatttttccttgtgtgtgtatttatgtcaactcaaaaagatacttagagagaaatctcatttctgtgtttgcttttgttttgcttaagaagcaggacagtcacatttactaaatacagagtatctctttgttagaagtgactttcctgcagcagactcctgaggttaaaaattctttaaatataaggtaatcctaagaacttttgaaaatgaatagattttatattggattgctgggtttttcagtatttgtaaccagtgtccgaattactgaatagagtgtgatgccttggtctcaagcattttgttctgtgagttgagaacaactcaacttacctttttaagaaaagaaatcaggctgatatttacaaagctatttattttaaaactgtatgcttatatgtttccattttcattgtgaaatatgtaaggcacaaaaaaggaacaaagagtaaatcagtgagcacccatgtacctgtagcccggcttaagagagaagacgctgctggttcaggtaggagaggctcctggaatatcccatcctcatcttacctctgtccttctttcctagaggttactttaccactgttcgcagctgggtggttttcatcttgtgtagttcttcatatttttaatatgtatgcatgtacaggattcctcaaaatacaggattttgttttgcacgttcaaggtttgttctgatagcatcctactatatatgttttttagtaacttgcttttttaaaaaataaacaacagtaaaattcatccatgtggatacatgtagctatagcttattgatttttccatgtgaaccttttgaaatactggatattaattcaagacaagttctttaaatttgagcctaaaacccagtagcactctgtacattgaaaatttcagattcataagaaaccatcagtcctgactggaacttcataatttgttcatttgtctgtgttttgggggaaaaaactttaaaacctcaaccatttatcagggaatttgattaaaaaaaataatctatcaagtggctgatctcttacattaagggaaaaaacaggcaaagcattcatttgaaggagcctagccattttctctttcttatttaaagacttggcttggaacttagcagttacatatgcagggtagcgagttaaaaagccatgtttaattaacaggcgctttatacttctgtatccttgttatgatatagcaccttgttcttcagtgtagaaagtgatttctgcatattttaaaggactggcatctttatggtaagaaagccatataaataaagatatacttagatgaaaatcggaacatgtttttaaaatagtgtgtgtctactttcatctctgttatcaaacttgctgcataagccagagttgatgctctgtgattatgctaatgaccaaaagaatcgatgatgcgagactagatgaaatcagtggtataatcggggaaagttatcagtttttttgtcattaagtattagtgataaataatacactgttcatttcgagtggatagaacatatttaattctgatgtacagagtttcattttagtcaggctcattgctgagtaaaatgatcatcttttgtaatttaagaggaaagagaaaaggcatttttgtcagcctggctaactgacttgggccatctagaaatgtttaccttgaccagccagggaagattggaaaaacttaattttttttcctcctagacaacttgcttatttgtactgacattttattaagaatatcagatactcagtaaatagcataaatgactagagatgttaaacaaaatgagtataaaggtagatagtgtttccctgaagaatggggaaaatgataacaaaggggcaatgtttggataatgctctttttaaatgactagtctgcattaaccaggggctattaaagtcggtatcacccattagacagcagttttaattttttttaattgagtttttcatatcaaataagatcatacttagtaatggtttacttaaagagaagtaatacttgtaacttagaatcttttcctgggttactaaaaccttaagggaaaacactgattctaccttccttgtcaacaaagcgtttctaacacaattctctgtaacagacatttctctgtggatagagtttagcacttgttttactactgtatgacagtacctggtgacaagagagaaaataaaagaataattagcaatgttctgtaggacatgaaaagtgattgaagtctacgagagaaggaaatcagatcgatgttattttaaaaaaatgcatcacaaaaatgattctcttcaaagcaaagcctcctacccaggctggggccagctgtgctctgccatttccctgccacagccctgtccgtccacgttggctcttaccagcagtaccatctgctgctccagcagtggccttctctatggtaaggcaggccaattgggtcaaatcttgtgatatggcagatgtccactgagagctaagattgggccaggctcatttttatgtgtgtccaaagccaagatttcaacttggtgaaaggctgtggaatttatttccccaagtgttgcccaaactctgttcttttcttcaactgcctccttgggctgagatgattgcttaatgctcttaattatgctggatccctctgtattttcgaacacctgtgggtaattcagatcatgggtggtcacagaggctggctcgacaaacggcttccctttccgaatgggaaaatcccagggagctggaccatgcaccgtgtgtcagggagctgagtggaggctgaaagaggatggaacacttcccttgaacttgaactggcattgtgttgtgtccaagtatccttcacccttggattggggagagtcttacaatgaataactcagaaaaaagttttcaaaataatcctagattgtaagatatctacgaccattatccatagccatatctttaaaaaaaaaaaaagaaaagtagaaaacaagaaacaaagtgtttctttacccaggccaagtgagcactaaagcttcctgtcataatgaggaggcagtgggggccactttgcttttgagacttggagtcccagtattactgggagtgccctgacccctcaggtagggacttgtcagagctccagaagacctaaggtacagtcagagctgagccacgcctttgtccatgaagagaatggggttgaaagtggagactgaggccgaggcgggtggatcacgaggtcaggagatccagaccatcctatcctggctaatacagtgaaaccctgtctttaaaaaattagccgggcgtggtggctggcgcctgtagtcccagctactcgggaggctgaggcaggagaatggcctgaacccaggaggcagagcttgcagtgagctgagatcgcgccactggactccagcctgggcgacagagcgagactccgtctcaaaaaaaaaaaaaaagaaagtggagactgattttcactgagtcacatagccattaggatcgtaatgatatccataactgtatttacatacacttgtgaatgtagatacctacgttggcacatatgtgtctttctctctctctatgtgtatgtgtgtatatgtatatatatgaatatactactcatatttaaaaatataaaatatatagatgatgttccttatactgttttgttacatgctgttctttcactctgtagcagagtattttccagtataatacaactgtcttctatatgattcttaataagtacttgctcttccattgtatgcatttatatttggttttccttctttctttgagggcagcactataaggaccaaatggtctctgcatttgtaatttacattacatgagatgggaataaggccgtaatgggcctgtggagttgcaagtgttttctgtggatatgtgtgctgtacgtctgcatgcacttgtgtacacatgtgcatatttggtaaacggaactgctctttcataagtagttcagactctcagctccttgaggtagaaaatgtatcctgtcccttcatacccctattctgcccattagtgacatctgtgtcttgctttttcttgagctctgacagtcatacttaacacattttggtttgcagcttggagcatgtattagggatgaagtgaaaaaaatgctgttctctgcattaaataaaaatttttgagaatctaggacaaccaggtctcatagagtgtaaatagcccatgaaacaagttgtctgtaaaaatgtggtataaaaatccaagtcttatgaggcatttgaaaattcagagaacaggctgggcacagtggctcacgcctgtaatcctagcactttggcaggccaaggcgggtggatcacctgaggtcaggagttcaagatcagcctggccaacatggtgaaaactcgtctctactaaaaatacaaaaattagccgggcgtggtggctcatgcctgtaatcccagctacttgggaggctgaggcaggagaattgcttgaaccggggaggcagaggttgcagtgagctgagatcacgccacttcactccagcctgggtgacagagtgagactgtctcagaaaaaaaaaaagaaaaaaaattcagggaacaaacaaaaagcagaagaccagctgtataatctgctggcccattgaaaaattaaaatttggggtccctatttaaaaagtagtaagtatttcaagaaggtgatggcagagcattaaaccaagggtggggctcttctgagcttggggcttttctgtatgtggggccctgtgggactgcacaggtcacatgtccatgaaaccagctctgcctgagattcagaaactgtcttgaagggctttgtttctctgcaccaagggttcttcctctgtagaacaggaggaccaggttgggacaggcatagcagcctgaggccctcctgtacagcttgcactcatccatctaagtgtactctattgctgaatcaaattgggttcaaattcctcaggaagcacataccttctcctagatatgcattgagtacaacatcttagccatttccaggactgggtattctctgcaggccttctgcaaggtcccatgagggaggcgaatcctgctcgagtttctttccttccctccccttcccttccttttctttctttttttaatttcccctcccctctcctccccccctcttcccctcccctcccctcccctccccttccctcctttccttccttccttccttcctcccttcctcccttcctcccttcctttctttcattttctttcttttcttctatagcccttctcccaggattttaccattttgactgtatcttccatctcagtcaccttccctgcccttcttcattgtcacctgcccttcattgtgacctgcttcattctggaagaggcctgcagggcctacaacctgaaggcagcctcaggaaagaacgtccactcttttctttcttttatcccaaagtgttagttgttaaataaggagattctttccggaagtgcactatttgtttcactgctttcaggaattgcaagctaatcgagccccatcaagtagagatgtggttgacccaaggcttacagaatgcaaaagtcattttatggacgtgcggtaccactgcattggacagttggggctccctcactaataaagctaacagcttccctaagggtataagtccaactggtttgaagccaagagtggattttttggtagtaccacattttagaatcttaagataattagatcattctggaatgtttcaccttagactaagtagcttgaattctctcctttaatatgcactgattatctgccacttagtagctttggcatcctgagcaaatgacggagtctctgcgtttcggtttatctcggtggcagtgatggaacctgatgttaggattgatgggagacataaatgagcaaatgtgtgcaaagcccctaacagtgttggctcatggtaaacacttgattcttggctgtttattaataatgagaattgtttctgttacctgaagttgtgttttatggaaacaatgtattgaccgtccactttctcatttttctttagaatgtttgatgatggaaatggggaagtttaaaaatcttatctcctgtgcttttttgctttgttcccactttgcccacattgtttgggccatcagcctcttttttcctatcctcatcattccagcacaatagctcctcctgacacaatggtatgcagcagttttgtgggggctgtgaatgttgggagggagtgctttgtgaggtgagggagagactgattctgagagcccagggagaagatgggtgtgtgtgtgtttcaggggatggggtgtgatgagattattaggagcacccagggcccaggctcaaggagacacttctcatgtccctgtggccttttgaagctgaagatgagcagagcaggtgggcactggtgtcagcccagcgccttcaggagggtgctctttcaaaatcaatggagggcacagtgctttttttccagagaacagcattgacttccccacccatgggtctggtacataataaggaaaggaaggaaaaataagttgaaggaaggaaaaatgcgtgatcccctgttgggcttctctccctcacagtcatagattttgaacgtcagagcattcctatctattttccaaattgcccgttggattgccttttcacaacaaccttaattttcacactacagggactggaaatgatactttagttgggtcaaacattagactacacaagggttttatagtcaggtttgggatttgaatgtgtttacgtagtctgtctgtattatttttccctggcaaggtgtctggtgttgagttccttggggaacgagaatgtggctcaggacagctcaccatttgcaaaccagttattaacttgtaatccactcaccgttttcaatgtctctatttccccacctctgtcagggcagttggagaataaactggctgtgctgctttgcaggttgggaagagggacctcacatttgccaactgtcactccctaccgtgatcataacccccgtgagacgcacattcagccacatctgtgctgagtgcatgaggagcggctcgggcagaatctttaactgctgtcatggtggtcagtgagagatgtggatgttcatatacctgtgcgcttttgggagattatacacaatagagtggagaattggttgtttccttggccattgtggaagtaacacatggatctgtgttcatttattgactgattcactcgttgatttatttatatctcatttgttcacctcttctctcatgtactcctttatcgaccccaaatgacttctggggcagaaagtattgctctgtgatcacccagcgttaccccctaccttatttttggacatcctcagttgggcattctaatacaaacatcatttaaacatccaaacccaacatcattatgcgtagagatctttgtcaacaagcttatgagattcatctgcttcaaccttttatttactaaatagatggccgcccaggatcaaatgggccatctttatgcatagttaccatttctgcaacaaatacggcttttagttacattttgactaccgaaaatatactaggtactataccaagtataagctgccgctttttctttctagcctgagcacttaattaagacctgacagattgatttttccattaggccagaaggcaggtgtcgtcttgagtaattcttgatttgaatttcttattaagagtctgtttagctccccccccatcactgccaccaaatatgtgtatttagcagagactctctcttacccaacgagttttacacaacgaattggtaacaaccaaaataaaatatcctaacaataaagtactgtttcaaaggtaccaataaggaatgttgccttcctgctgcagtgtgcctggtatccctatagaaggcctgcccgtgggttaatgtggtctggtagtctgaagcccgtgaagccatcatttctcatcctttttttaacccctaacactccactatggacaaattgacagaagacattggtatctgtatagcccctaactcctcagtggatgatttgacttctttcatttttcttttttctttgagacaaagtcttgctctgtcgcccaggctggagtgcagtggtgcgatctcggctccctgcaacctcgcctcccgggttcaagagattctcctgcctctgagactacaggcgtgtaccaccacgccctgctaatttttgtatttttaatagagacggaatttcagcatgttggcctggctggtcttgaactcctgacctcaggtgatccacccacctcagcctcccaaagtgctgagattacaggcctgagccactgcctgtaatgatttgatttattttctttctcttttcaatttccatcctccaaaaatgttatggaaataacttccccaaaatgattgtctgcccgtccactgaaatataaattcccacttacaaataatttttaagaaaactctgtaattgacatttaactccagggataaagagtgttgctaatctcagcctgcatcactggccaagggtgtaaccaaatcctcatccaatgtggtcatgtgtgtcagtcacactgcaacgtggtagttacgggcagcgactcaaggtcggccaaccagagacttttaacacttgttgggtgactcaaagcttattaacctttctgatttaccttgatcttccataaatgtgtgtgtatgtttgtgtgggtttaaaaggacagaataaagaacttacctcatcaatttgttcggtggattaaatgagataatccatgtggaatgtgacacagggtgcctggcaaatacaggagctttatatatgttagcttttctgattattactattgtatcgttattggttaaaagtcacattaaatagccaaggcagataacggatgagaactttgcaaagattacgaaaaaactgaaggaagcctaccttgtatatgtggcatgagctttggaacatcaggttaattaccttattgctgtgttttggggtttgtgttgacttgctttggtttttgtctgtttgcttttgaataaggtcctaaaatacggttttgctgggttttttatttgcttctgaaattagtgcaggtgcaagtaacaggaagtgaaaccttaagtggcctgagggaacctcattcaaatggtgccaagcaggtataatatacaagcattatcaccttactgataatctggcatactgtgggtattcacacgtgccattcagatttcagagatgaagtcatacggcagtttggcaccagcttgcccagctccttaggaaaggtgagagagaggaaagccctcattttttgagacagtgttgaaaacacggttttacttgtcgagtggcacaggattgcagttgtcatttggtcacattgtctttgacgttccaccttgggtgcaaggaaaatatctttaataagtgaattcacaccctgtttatagagttacaaagtctcctctgggtttgagactgtgttacatatatcctcatattctgaaatgtagaaaaatttacatattgaagacccaagactagaataccacattttcatggctacaatacaaagttttccaaatgtttaaatattctcacagcccggtggttatatctaaataaagcattgtccttaagacttactttggttctttgtcctgaaggatttagagagaacccacagttgctttgcctttgcggtaggtaaggtgactctgttctcagccagttgccgatctttgcatgcactgagcccttagacatgcattgagttgaataaaatttgcccagcttggtctgccatcctagggggcctctccatgtgcccttttttgttaaactcagaagtgggtcatatgtacaagatgcccatctatgtcttgcttttagtaagaaagcatctgaaacaacctactgcaccccatagagtagccagagcttttgcatctctcccctagggctccactgagccaggatgttgttccttttccttcagcttgctcctccccagccactccctggccacagtcacacacatacacatacacacacccctctgcagtttgctcccactttgccttgcatggccagcctggctcctcattcatctctccaacctcagcaggctcacattctgtattttcctggaagggcacttgctaggggcacaatgcttctcttcccattgctcttaaaggaagggatgagaacagggagcgattgcatgagtgggagggaataccaaataaaatagagacaaaggaatgggcccaggaagtccagattatgtatctgttgggcccagaagtctttgctcaacttcttatttgagtaagacccaagaaagatccagttccactaatagaaaaaccaaattattctattcctgacatgtatcatctctgaagcagacaaaatagaactgagcctcagtgtggtcccttagtatttgggtgaccttgggtcaatttcttagcctcagtttactcttctgtaaaatgattttgttgttgataataggtacctgtctgggttgttgtaaggataattcacatgatgcccagtgtctgtcatatcctaagccctcagtgaaaggtcaataatattagcgcttatgactctgttggttaaaggcagtagttcattgtgcctagtcaagaatccagcccaacacatagttcagtagatactgagccagagtctggttcacatccccagcctggccactgacaagccgcatgacccttagacaagctattaacatttctgtgcttcagttttcttacccacaaaatggtatgatagcacctgctgcgtaaggctggtggtgaagattaggtaagttaatgtatgtaatttacttggaacagggcagaaggcctagaacataaggagccctcaataaatcataggcactactgtggttgcccttattatgcccacagtgattatcattgctccctgtccaggcagaaacaaccattgggaggactcatgtagagttctttcatatccctccatttcttgacagctcggaggatagaagcccaagactgagacttggttggagagtcttggttttaaacccaaactcctatcatcaggcctccatgcttggccctttttcctttttgtctaggatggagacatatggaagtactttgtagtggtctagaatcagcccttggctttgcaagtagaagatgaaaaatgtttacttgctgtttgctatacttacttgcattttctttctttctttccatatcccccaagagaaagaaaaaaagaaactgaaggtgggaatgcatctttggaatttcctaagttagtggaatagtgaatgaaaatactgtgcaaagaaatatactggtgctcgatgatgattttcatgggatagaatttgatttgcagtgattctgtctaggatcatatataagggactagtcagcaaatgccagctctgcaaccaccacggcattcaaaatgcttagtgagtgccagcgctgttgtaatgttttatatgtgtaattcattctatcctgacagcaaccttacagggaagagacttgcatctccattttatagatgagaaaactgagttccagagaggttaagagcttactcagtcacatagttcgatcttttcctatttcatctaaaatactgtaatcacaacgggtcgtggtgactagggaccttggccatagtctggtccagctggctttttttttttttttttttggccagctttattgagatagaattcatatacataaactcaccaattttaagtatacagttcaggctgggtgtggtagttcacgcctataatcctagcactttggtgggcagatcacctgaggtcaggagttcgagaccagcctggccaacaaggtgaaatcccgtctctactaaaaatacaaaatgagccgggcgtggtggtgcatgcctgtaatcccagctactcaggaggctgaggcaccagaatcacttgaacctgggagtcggaggttgcagtgagccgagatcgtgccactacaatccagcctgggtgacagagtgacactctgtctcagaagacaaacaaacaaaaaagtacacaattcaacagtggtttttagtatattcacatagttgtataacatcatcacagtcaattttagaacatttttatgtcccacagaagaaaccctttagctgatgattacctttagcactcatcctctctccaccccatttccttccaactccctcagctccaggcaaccactaatcgactttctgtttctataggtttgcctattctggatgtttcatatgaatggaatgaaactctctgtggccttttgtgtctgtctgctttcagtcaggatattttcaaggattacctatgttgtaacacgaatcagtacttcattctttttatggctgaataatatttcattgtatagatataccacattttgtttatccattcatctgttggtggacacttggcttatttccacttttggctgttttggttaatactactctgaacatttatatacatatttttgtgttttcgtatgttttcagttttctttggtacgtacctagaagtggagtgactgggccatatgctaccttctatgtttaacctttagaggaactgccaaacagtttcccaaagtggctgaactattttatattcccatgagcagtatataagggttccagtgtctccacatcctcactacttttgtttttgaaattaggaaactgagcttggtaaggtattaatgacttgcttccagtgccatacctggttgtgtgagccaggttctttctaggcctggaagatgtgaggatgataacataatctttattgcaggagttcactgtctgtggaagagtcaatcgtagtcacattacacagtggtggtgacaataatgatgcgaaaacattatggagcaccgttattttttcttcttgaagaaacagaagataatttagtgactcacgtaactgaaaagtatggtgatgattagcttcaggtacagatggagccaggtgctaaaacagtgttgtcagggggtggctgcctctttccatctcttgtcttgctttctcattgtctccttcattcttagctctctcatttctctttgtaggaagatggctactagcagatctaggtttatgttctgccatgtaagcatttccagcagaatagaagtttttccttccccatagttctagctggcttatgtaggtctgtcattggcctagtaggtcccccccgcaacccccagcagcccccagacaaggtttccttctgtcacccaggctggaatgcagtgatgcaatcacggctcactgcagccttgacctcccaggctcaagtgatcctcccacctcagccctctgagtagctgggactacaggcacgtgccaccatgcccagctaatttttttaagtttttataaagatgagatttcacagttttgcccaggttggtctcagacttctaggctcaagtgatctgtccctgcttcagcctcccaaagtgttgggattacaagtatgagccaccatccccagccctggtccagtaggtaacgtaacagccttccaaccagttagagccagtgctctggttggccattcttgctttattgcctaccctggagttagattagcgggtgaggggagatcacttttatctagactgcaggaactgagaatgggtgaggggtgattcccaaagagaaaatgaaggttctgtttatagaagaataagaaactatgtttgtctggtaaaaatagcagttgtccattctatcagttttcattcccatgttacagaaattcttaccaaacaggcttaaatagtaagcgaatgccttagttcatttcactggcagttcagagtgggggtagccctggggcatagccaaatctggtgattgagttctcagtgattcctgtcattgcactggaggcaaaatggctgcagcaatttctgcctgccattaacagccagaggaagagagaagctggctggtccagttgccatctcttaagagtgagaatggcactttgtgaggccaaggcgggcggatcacaaggtcaggagattgagaccatcctggctaacacggtgaaaccccgtctctactaaaaatacaaaaaaatttagctgggtgtggtggcaggcacctgtagttccagctacttgggaggctgaggcaggagaattgcttgaacccgggaggcagaggttgcagtgagccaagatcgcaccagtgcactccagcctgggcgaaagagcgagactctgcctcaaaaaaaaaaaaaaaaaagtgagaatcggctgggtgtggtggctcatgcctatgattcccagcattttgggaggccgaggcgggcggatcatgaggtcaagaggtggagaccatcctggccaacatagtgaaaccccgtctctactaaaaatacaaaaattagctgggcgtggtggcccatgcctgtggtcccagctacttgtgaggctgaggcaggagaatcgcttgaatcccggaggcggaggttgcagtgagctgagatcaccctactgcactccagcatggcgacagagtgagactccatctcaaaaaaaaaaaaaatccaaaaaaacaaaaaacaaaaacaagaaaaagaacgagaatcttccttcctcatcagcctcctagaaaactttctgccatcttagcccgaattgcttattcctgtgagtagatagaagtcattccctgattggcttaaccagtcacgacagccagtctggtccacctctgggggtgggtagagccagctttccctgaggttaatggcccctgttagggaaggggcacgtccgagtcagaggaaggtttccttcagaaggaggaagataggaagggaggctggcagttcagctggcagtgcccacatatggaaaagaatgatgagaggccaacatcagtcatggggagggaaggaagattctctgaggaggctgtgcatacactgtcttaaagaaatacaggtttgctgggtgtggtggctcacgcctgtaatcccagcactttgggaggcctaggtgggcgggtcaccagcccggccgacatagtgaaaccccgtctctactaaaaatacaaaaatcagccagatgtggtggctcatgcctataatcccagctacttaggaggctgaggcaggagaatcacgtgaacctgggaggcagaggttgcagtgagctgagaccacaccactgtactccagcctgggcaacagagtcagactcagtttcaaaaaataaataaacaaacaaaaataaaaaatacaggtttgcagggaggccctgtgggtggggaagcatgggcaaagccattctctcctaatgtggcatgtaaggtagaatgcagcatcttggtcattcttccctttcatcgtttgaataaagtacttgaagagcagaaagtcggaggcaggactggcagtctttctattacctcacctcactcttccgtgaaggtgggacagacagttgaatgtgactgccaggcctcagagctgccttcctcttgtgtctcactgcagaagcagacacacagaagggcaccttttctttttcgtagttcttggcttgggttgaccaccatgaggtgaaggagttttggaggacattttctcagggtggtcagtattttgtgctgtgtgccatagctggggtacacaatggattttttttttttttttactttttttaaataagcaggatttttttttcagagaaagatataaattgaccatttgagctgtggaagataatatggagataatgccaacatttaatcattttcatccaaacatatatcttactcatttcaatatttttcttctctcatccgtgtagcaagctagtcatttcccagttcagaaagatacctgtatgatatacccaacttttagaattttgatgctgtaaaattcctagtatgtctctctgccataagaaaacagctattgacatttttgtgtatttcaatctaatttaaaatgtttttatgaacaaacccctacaaatgatcttaaacagttttgtttcctgctcattttcacttaacattatatcatgaacactttttttttagtcattgaatattctctgtaagcatgatttttaaagattgctgcacttccagtcaatctacagtggaccatgattttaatctttctctttctgttggatgtttacattgtttccagtcttttgctgaaataaataatattgcagtgaacattgtagtacatacatttattagcatctctgatgattttcttaggataaattttgtaagtgaatttactaggtcaaagggtggtgaacattgatattctcttgactatgtcacctatttgttatggtttggggaatgctagtaagaagagttacaataaaaccttaaaaaaaaaaaagactatggcagtttccacttcattgcagtttggccaacattgagtaaactaacctttctagatttttttttttttttttttttttttttgagacggagtctcgctctgtcgcccagcctggagtgcagtggcacaatctcggctcactgcaacctccacctcccgagttcaagcgattctcctgcctcagcctcccgagtagctggaactacaggcacctgccaccacgcccggctaattttttgtgtttttagtagagacagagtttcaccatgttagccaggatggtctcgatctcctgacctcgtgatctgctcacgtcggcctcccaaagtgctgggattacaggcgtgagctttttatttttgacagttttcaaggtgaaagatggtatagaattctggaaatgtgctttctttaataactaatgaaattgtccttttcacaccctttggtttctggccatttgcagtgcttttgtgatttacctatttgtattatatacagggtttttatatgtgatgtttgatttattagaagtctttttacgttatagactttaatacatattacatatatagtgtgtttgcggaaaattaccccaatttttatgttttccttcctttcatttatgccttataacattctgtaagacagatttttctacccatcccatttattttcttataattgtttaattttttttccttttcttccttctcttcctcctcctcttctttctcttcctcctcttttttctttttccttttttagtatttaactctatcttaattgtatttcagtgtatggtatgaggtaagagtttgatttgattattaaaaaatcgcagttctagaattattaaataatacttctctataatggattttaaaagctgtagtatacgctaaattttaatgtagggcttatttccatgcacttttttcggtttcactgagaagcaatattaagtgttgattatatgcatggaccctggaacacgttccacccactgtaaacatctaaaggcaacattttcttacatgaaaatgtggattatagtagaaccatctaatgggggtgccatgggcagtaaatgagataattatataaagaagtgactatttatgtcagtttatctgggacagtgactcctgggttagcattgtctcagatttttcattttatgctaaagtattattacaaggagactatgtgcagttcctatttcttcatggtcttctcttgtagtgtgtgagatgcttatatggtgctctgtgaaagatgaccagcaatcccttttctcctaaccctttctgtgcacaccattatgaacacctctgtttcagggaatgtgtgctctggtgtaagtggctagggaccagtaattcaatttggtcagtagggttggggacggataggaaactttaggttagttttcatgaaatttatctgaaataaaggctgagaagtcccgctgcagagtgtaaagaagcagtctgagtgttcttaataaagtaggttttatggttttgtcatttttgaatactgtaaactcacaaatatttatttttatcatttggtaaagtttaaaaaatatatacattgtaagaaaccattttggcagctatgagcttaaaaataactgagcttgtttactgaaatattacataatttccccctatttttcaaggaagttgaccataaacattaacttctataaaatatttttgacatttactatctactcttggggacataatgaaatcaccaagcatatacaaatcaggggacccatttgctaaagaaggtactgcatctgtttcagaattagtacatattttcaggagactgtgtccacacaaagtgaaagaaaatgtgtttacattttatcctgtgaagcatgacttttcatttagattgaatttttctaaattaatttcacttacgttggattctaacatttttaaaacacattcaaaaagaggattgataacttttaatgtattgcactgtttacagaacttctttatagacaataaatggtgccagcttcacattaataccattggatgtttcaaatagaaactcagttaaggtaataccaataatagtttgattttttccatccagtacacggaatcaaacaacaaattaagtcaacagaatttcattctgttgaaggtaaagcatctaacattatttgaaataattatgaattccattaaaaagtttaacattgaacataaagttatttgattttgtggtgattaaacacatttgaatttttaatttttaaaaaaatttgttaaagagacagagtccccctctgtcacccaggctggaatgtagtgttatgatcatagctcactgcagccttgactcgtggtctcaagctatcctcttgcctcagatttccgagtagctgggaccacaagtgtgcaccaccatgcctgcctaatttcttttttaaaactttttgtggagacagggtcttgctatgttacccaggttgattttgaactcttggtctcaagtaatcttcctgtctgagactcccaaaaggttgggattataggtgtgagccgctgtatccagcctaaatttgaattttggtggagaacatattgtggtaaaaactggttttactagattcagaaacccatggagcaaatatgtaccatacttggaagtgattatagtgaccatatattttataattgcatccaaactgcaatatatatcacttgaatagaaactgtagctaactaccaacatttataaataattttatatatacgtagataaccaaactacaaagtttctgttttgagactaatgttgaatacaaataagtacttgagctatcagttaggttttagaaatgtttgagactttgagaaactattttgtaaatcagtgtaagtgttccattgatgttattaaacttttgtaaatgtgcactctaaattgtagttacatgttgttcagactctgttggaaattttaataactcaaagaatgaacatacatatgtacacaatttcttttgagactgttagcaaatttcagttgttggtaaaaaaaagattgcaaacaggacaatattaccatttttatccctgaaaaaaccagtgaagaaccgaacaagttaaatgtgagctcaaaaagtgaacattttttaattctgaaattctgtaactgtatttggaagcctctcaccagtgggaagaagcttttgatggaactcctattttaaatcagataatgtgaattccgtatagaaatgaaattgatgaggcctacaattttgcagcatccaaatttggccaaacatttcaagcaattataaagcaagtttatttatttgatgaatttcatcttgtaaaaatatttgtcaaagatattcagaatagagtttaaatgatgacctataaaatatttgggctgttatatttagggacttcaataccacatagtagaattgagaatatcctcaatttagggaaatttggtatgctaacaggtaactctagtacctgtggaacgaatattttctcagttaatattatgggccagaaatactgacatttgaaggtataattaaataaattgtatttattaactataaaatacaactttgaaggatactgtaggcaattttatgaaaataataaaaataataaagactgacatttttcctgacattcttctagaaacttactggtgatgtggtaagagacaagtacagccaagaaactgattgaagtacaggtgtatgtactaagaagattattctgcttatattattgttggtgttcaaataccaatttcaaaagaatctaatagtctatcttaggatgataaattatttggtaactgtaaatacaaagcacctggcatttaagtaactacgcaaatacttgctgtcattataataccatcaatattattattatattttgcctagttctttgccagttccatactgtctgaattattgtactttataatatgtttaatatcaaatatttcatagtccctatttgactttaaaactttttatttgcttttattttttagtttttctaaatgacctttggaattttttgttaaaaataatttccttttttattttgattgtaatactaaatatttaattacctcagaaaaatttatcttttctgtattacatctgctcatccaggaaactaatataattatttattcaagtattcctttttatttctcatgaaaattttgtagttatgtgtctgaacctagaaaataaagaaatatttatattttcttactggttatttttaatatgtacatagttctgttttttgtacattttatatttgattatctttttgaaatttcattagggctgtgtttttgttatatttccaaaaactaagaaatttgacatctgataggtagcaatatcagcaccttttcccatatttctttctcctgctttattgcattggttctgccttacagaataatgttcagtaatactggtagcagttagttctttatacagttctctttcaagctagacttaattctgttgaaggtggattttgttttgttatctgtgtgtctttgtggaatctttgcacaaagacaggcacttagtaaaggatgaatggcatgcttggttgaatattgttgcagaaaattaggataaaataaaggcactaaatgctgagtatttcaacacttcctggagggaatggtttagaggtgattgatgcatttgatgaaattaaataatatgaaaaacttaagggaatttgctttaatagtatattccatcctttaaattctttccatgtgaattatactagaagcccgatcatagatggtagagatcaaaagattcaaatgttttatatctgaggcagttttgttgtatcacagttataaccactcccacctatgtggcaatgatcctgtctctatttttatgttatctattcaaaacagttaaaattggtttttgaatagaaatgcaaagttccatttaaacaaataactaaagatagaatgtttgtttcatatgccagaagtttatgtattgaacataaactataacttgaggaaccaggaaacgttatgcatgtgaatcatggctatcatctttgtaatctgtctgtccaggccattgccacatttattactttggtttttggtatgcttctaaggttttcttttgaccaaggaaatgccattcaccaaacagaaaagtagttttctatgccttacccttgcgtttgagtaatccctggagtattttggggaaaagatagttaaatattgttgtgttcagaatcaacaagtagaaatatcctgtaatttatgtcattttgttttatagcacacttttataaatgtcttgacattttatagaatgtttttgtggatggaaccttgatagttttatgctgtaggaattgtttcctttggaaaaatttgtatttacccctttgaacatttaagccagaacacgaacaccaaactcaacactaaagctatccattccaggcattatttgcctcagaatctcattcagaagtgcataaatattagataaaaaccagttttctcagtgtttcctggtaatattattgaagtgagcatgaatttttgtgtctctagttatataatttgtctcctaagtgaaacccaactccgtgaagtctggaaggaaaccctggcaacaatggcggcttcatcgtgtctgaggaggagccgcagagagtgccttctgtttgaagggggcctctcggaagcggcaatggcatggcaagcctgctgctttttacctcagctgtatgctgcggagtggtataaatatgataaatgtaaatagctaaagaaattctctttttttacccgaatatatgagctggtgtctaatggactgatcttaagggtttgaaccacaaaccaagttgaattaataaaaatggaggctttgttcacataagtggtatccttatgggtttattgaaacataatctattttcttctttttccagtagttttcttttctttacaagttaaattggtcactttcagcacatgcttccatggctttgctttctattcactggatgttaatttagtttaaaaatatattcaatagataactaaataaaacttctgtggcagtatgattttaattgtttttataaatattagtttgtgtaatttatctgtcaccaggcctcagtgagataagaactcctgttatcctcattttgcagatgtggaaactgaggcacggagcggttatataacatattagctcacggtcaacagcggataagtggaataggtaggattgagacctacgtggttttgttgaagggtttgtgctctcaaccagctttgctatgtgatttataatcgttttacttgggggcaggtggggatcatggagatgagagagctaagtctccacaggcttcctcctctccccgctttgtaccatcgccaactccaatgatgtggctacttctgaagaataaactgtgttagggctggaggcgggagggtgagtggggcacacacttgcttttgatttatttatgctatactgtttgcagtacttttatacaatgaacttgtctgacatttgtagttatagttttaaaaataaggttctttgaaaaaaaattttttgacatatgcttagcttcaaattttagaaaggcatgttctaaatataaagaggcctaaaaaaattaaaagtttaccagagagcgttttttttttttttttttttttttttactcccagcattagagtattctgtaatataatttaccatttcttccatcctcaagggctttcagcaagtctcagttcatgtgatgatttgatgttacagttgaaattgagacagttttgttcccattatatctaacctgtgaactgaaatatttgagatatgttttattaaaatatatatgttttgggctaggtgtggtggctcatgcctgtaatcccagtactttgggaggcctaggtgggtggatcgcctgaggccagaagttcaagaccagcctgtgcaacatggtgaaatcccatctctactaaaaacacaaaaattatccaggtgtgatggtgtatgcctgtgatcccagctgcctgggaggctgaggcaggagaatcgcttgaacctgggaggtggaggttgcagtgagccgagattgtgccactgtattccagcctgggcaacagagtgtgactccatctcaaaaaatttttttaaataataaagtatatgtattttggagtctaaaaacatgtgcctttactcagtagagaagttagagatgagggaaaaccccagcgactgaactgttgccatgaaagaaacactaggtaggggagaaggttatttaatttatcattctttcggttgtgttagttctaagtggtgtatgctcagtatgttgctaagagttgagttgcatcatatatagagtcagtgcataagtctcattaagttaatattaaccttgaaaacccaatatataaccaactggtgggcccttagcagctcagaagtcaacaattaacttctttgggttaatacacctttgaggcagtgttgtgcagtggttaacgttcctgagtttgaatcccagctctgcctcttattaaccttggatatgttatttaaacacaccgccttagttcctaaatctgtaaaatggcaatatttacctcatcatggtcctgctttgactaaatgagtcaatacagtataaacaaaatgctgactactttttacatagcacatgctgatgaaatattagtgattcttattagtattagctttgtctttttattttgacttcatctcatttcttttgggggggtaaaggccaagtctggtttcagggggctggggaatagagaggaaggaataaataaaaaagaaatggggttgtgtgcggtgactcacacctgtaatctcagcaccttggaaggccaaggcaggaggagtgtctgagctcaggagtttgagaccagcctgggcaacatggtgaaaccccatctctaccaaaaatacaacaattagctgggtgtggtggctcacacctatagtacttgggaggctgaggcaggaggattgcttgagtcctgacggttgaggttgcatcaagccgtgagagtgccactgcactccagcctgggtgacggtacaagaccctgtcttaaaataaaaacaaaaacaaaaacagttgaggaagggggacaggaaatacgttgaattatgctagactgttatgaggctgtttgggagaaaaataaccaacatataaacttacgctatttgtgtgtgtgtgtatttgtgtatgtgtgtgtttagttttaaactagagctggatcttgcattcaacctccattcatagggccaactttttaaaacacccacattaatggtgatgatcagtggtttacaataatctgccagtcacccacattttcaaaggtatatttaaacttgggggtgttgtccatgctggaattcctgtctatctttgagacaaagaatgaggccccattgagaggccccagccaaagaggaactgcagattgcctcatcctctctctctgttcacttcttttccaaagccctttgtcctcttatgaaattgactgtttgtactgacctggggctggctaagtcagtttggtttaagaggacttctctgagttgggaaagaaaccttagaccttttcttccaactaataaagatgtacacaacaagagctcagaccattgtggccaaaaggcctcataaatatgggaggtgatgatgaccaccaaaggattgaatagtcacagctgtcctctcttctctctggaccttgctggaatgggttgcttatagggttgctactgataagtagccaaccaggtgtttggttgaagaggccattaggtaattgtgccaggactaattctctacaagaactttgtgtgttcacattcttctctgccttgggccccaagaacagcaagttgccttctaatgtcatagaaggaagaaaatacatgcattgccccttaagtgtggctctgagtggcccttgctgggtgacattggttccctagtggtattcagagccctttaaaaagaggtcaaacggggcccaaaggagcacagcaatccgtggagaccatctgggcctcgccctagaggccccacctctaccttctttttggataaggcctgatatggttgtttacctgccaagccctcctttcctcaaagaagagcgttcttgctgggtttccacaaacctgctgtctagtcctgcactgtttgttccttgatctggtggttggggctgcactggttgcattttggtaggcaggcagacccctcacagtgttaaaatgaaggggaggaaagggtaacctttcctaaactacctaagaagaatgctaatcccaactgtttcagaaacctgtaatttttagtttatgtaaaactcagatagattgaattcccccttgaacctttttgtatttcataagagttttatttcctaaaactgacagcagtgacagttgtgttagaattcagccctgagtatttatttctagatttcacaatttgttttgtcttcgtagcaagcaattgccttccttcctttctctcttcctctctgtgtctctgtctctctccccttcctttctttgcaatttccttcttttctcaagctcatgatgaaaattgacccttcagttttattttcagatgaaagctcaagcaacaagccagcgcttgcctccattagtggctctgggtagtccttgcaggagaaatcaccatcagcaaatcatcgtccgtttagagtgggctgcagaggctaggcagctccctgacttcactgtccaggagcctcttagaaatgagcaaggagtggcactggtgctagtgccattcagcaaggctttggaggtgtgcttcgctgcattggggtacctgatgaacagcatctcggtggttgggtatcttgcacccaggctagaaggttaacttccattaagctttattcaaccctgcatcatagaagtggtgggtaggtgtttgtgcatctctgtgtgtatatgaatgacatggccagaggctccactgttccatcatcgaaaagtttcttaaagggaccttatgaagaaccacatggaatttgtaacttgatcacgaaatttggaccattaaggacctgaaaatagctcttcggttttgtgggtcacacctttctctaagctcagttaatgagcaaatctttattctttacaagattagccaggtgtatttcgtgaatgttaactttagccttggctgcttggccctgctgctaatgaggccaaagtgggaattcctgcctcttgtggaccagttaccttcactctcttacctggccaccgaccactaaccctcgccagctggcttgtgaatgtctgcagttggatgttggagtgtggggaggtgggtgggggaaggtgttgtatggattaatgcaaatccatgacccctcctggggaaaagccacacacacatactccatggaacaagggtcaagtgcattgtctccacttttgaaaggcaatagagttgattaaggttaactcgaaaatactgatgttggctagaattttggacttttgccaggatatatgcaacatttaaagtgatttctggaaacctgtgcccatggttcactggtagaggagcttaagatgaataaaacagtgaaaaccagggagagtgtgattacttttaaatatgcagcaacaaaagggacatggcaatagcttaaaaatctgttttctaggaatgtaatattttccaaaatcttaagctggcttacatcatatttgggttgtaggttcttcagacttttacttttggttcctacctattgcgaaaacgatatatataggttaaatttatattatagctatttattatggaattgcatattaaatagaaatcttgcagttactgaaaacttttaggattttaaacaaacattaaggagcatataatgttctagaagataaatatttgcataaggcagttcagtccttcagcatgtgtatttttaaaaacaaacaaaaccccatcaatatttaccctaagtgtaatttgcaaagtaaaatgagagtaattttgaaatcttgtgtaactctgattcatttattttcataggatggatttacattttggaatgataaatgtgcaataaagagctattaggaaaaccattatttctctcagatttgggaaattctaacactgctttgttacatatcactatttcccaaagaaaagaaaattaggcccagacaaactgtgacttacccaaggtcacttactcaactagaaagtggctgagctttggtgaaaaccagtccttctctccctcagaccagtggtatttccatgacagcatgctgatttttttcagggagcatatgcgcgcatgtacatgtgtaaataaaatggttatttttaataaaaaaaaaattgttttaccacccatggtcctggttaaaatcgctattttgcttccttttaacagactgcaagcgtggtgacttggaaatatcattttctttctcatcctttcaagaagcaaattcagcgtattgctttacagtcttaacatttttttatgtctctagatacagaattgactttgtcttttctttgccttctaagctgtttagagcaaggtgagattacaatcataagctgaatctggaaaaaaaaaagccctattatctttcttgactaccctcattgcctggaaaagaactattatccaagtttcacttaatcatatggtaacttacaacagttgtgatttgtaaaatacatgacgatttggtcttgtctcctttgtctctcttacctctttgtgatcatattctgcttattttaatgcatgaccagccaactgtgttatttttcagaaagaccaccccacatataaaatggagtggtctttaaatgtcttgggctttgaaagattgtttagccattccttcccaagtgcttcaggtttggattttggaaacgtatgtttttgccattggtgtcactgcaaatgttctcatcttccttttttctttgaatttgatcaaactttgttcacttgtagtacttccacgatcagcagagtctgtctagtctttcctgctttttccttttttttgttccaaattttcctttttttttttttccatttctttactttcctttgatacatctttttaaaaagtcaaagtggaaatatatgtaattgaccaatgctatagcagtttatagatgatataaattattaaaagaaataaatacatattttataactggatttatatcataaaatatttctaacctttatagaaggatttatatatttttatttatatcttttaagtacttatatctttttaatactgctacggcattggtcacttgtatgtattcggctctgattttcctaaaagacatagtaaaggaaagtaatagaaatacacacatatatgtgtgtatatgtatgtgtatacacacatatatgtgtgtatatgtgtgtatatgtgtgtatacacacatacatgtgtgtatatgtgtatatatagtgtgtaaacacacacaggcacagcatatagtaaataagagaatttcatatctttacaaatatattcaaaagagaaccacttcaaacacatgggttttactgaatgaagatcacttctacctttatgtggtggtctaaggtttctgtcactttctttgttagttgtatttgaaagcaggtgagtaaaccagaaagaaatgattcagtctgcctgctccaggcacagaagtagagggatataggcctgcagctctcaggctttctgtggacctgcttccccactctgttttgaggcagaaactgggggatgtcagctcaagctttgcttggccacatgtgcctccacggctagctgagagtcacgtagatgccacttgtcacatacacccttggatctgagctgcttgagggtgttaccacacatcacagcttggtgctggggctcagcatggccaggtggctaaccagggcttggtgtcaactacatttgggatgatgacacttggaggacacagagccactgtgcagcaggagtcgccactgctaacagccagaggttggtgcccattttgccccaatcctcctcagtcccttctcaagtggaaattttgcaagtcgacttctgcagcgtgcgtagtacaatttggctgacagcagtttctggcaaaagaaataaccaaattattattcagtcatggttttttaacagccgcaaagcaagtggatgttaactaaatgatgcaatttattcccttccctcttattgccagcttgcctattacagagcgactgccagttttcaataagtggtacccagatggtattcgcatgccgcccacttggttacagagccgaagcggggaataactcggcagacactacaagctgtgggtcaattgagggggaatgcctgttgcttcacagttttgcatatgtaaatctgttaatgttatgtcagtattgtgcgggctaaacacaagcattgcctttctctgggggcccagctgaacttggaccacagcccagttataccgaggctcggagagcgaagctgcagtttgaggatgctacaccgcctgctcccctccactcttgcctccatgcttttgtgttatctgcagcccaagctggatgcaggaagtgtctgccataggctgactccataataggacaggcaggccgggttttatgagctggctgcggagggaggagtgtgagtatgtgtctatttttaggccagccttcaagacagttcctttggcccagcctgcgcctgcctgcctcgctcacactctcctctgtgtgtctgccacacttctgctctccatttcatcaactgcagatgtggcacacagccgtcttagaaaagtcatgaactgtgtcgtctgtgcggcttaacagccaacatctgctgcagcaggctgaaggaagaggcagggaaatcattttcgggaatgcactcaagtgcctcaacttagcctctactttggcctgtgcagacaattattttacactaattgcatcaagatagcagctataaaaacgagatttcgatcgctctgctcccccacccctcttgtgaaagttgcagttacaaaggggtagttcttttttctttttattgtggtttgtttcttgttctcaaaagcttattacattgggtgcaaacaacaacaaaaatgccataaaaaggcaagaatcgtaatatgcttaagagctaaaaagacctatggtgttggtttaaccaatgaaaatattcctgcaggtattgtaaaatttatgtgccatatgaaaaacattaagggtgttgtttttttcacagaggaaaatgttcattgttgagccattttgtaaattattttaatgctgcatttctgcttaaacctcatgattttgatatataagccagtttaatgttttctatacagaccctggcttttcttaaattttatatattggaaagcccatgtttgtattggaaactgctggtttctttcatactgaaaatctgtctcgcgcggcgtgatgccatgtggcaaaggagtagtttgaccagagtcaaacctcgagtgttgacttttgagtcctaaaaactaggcaagaccgtctgaataaataatctagaaggtgtttttttgtttgttttaaaaccaggagtcttttgacagcaataagaatagcatctctgcagtacagtatggactttctaatgcattggtctgtttcaacttttcatcttcttgtaacagaggcaacattgtgttcagtatctgagccttaactttttttttttaatgctctcggagtaaattctggtgaaatacgcattccagcatctcggattctcttgaaagatttgtttctgtgacattttgctgtatctgttgtgcagctagagtagcatgcttctctcctcacatttcaagtctctagactttgttctgaagagccagatggaagtatgcagattgtttttatcttttgtccttcacactgtaacctgatctccagcatatctagacatctagcagaaaatttactatgtgaaagcaaggaaatgatttagaaatatggaccagccaggaaagaaagggctcaagatgtactttatcagagtaaatctctccacccaactcccatacccttctttttttattttcattaaaaaatgcttttctcttctagggtatgtctacatatgcccaaatattattcttctcttttaacagggactgagaattataattgaccagtgagtttggtaaaggtgtaaataggtgtgcaatgaaagttgattacctaataattgaaagcttggaaaaagcatgaattggtagaatcctagacttggcaatggccttataaattagggcagtgcagtttgctaaaagaagggacttgtccaaagttacataccacggttgagacagattcaggactcaaagccagcattgcctcagtggctgcaggaaacaatggaatctcaggcttcatggtttgtggggttttaatggcaagatatttgtaacctttttgttaatgttctcctacctctttaacttgtggtcctaaaaaccttgtttccttctaatctttcattggtgtttggattcacattagtaactaaacatattcaccaccatattagggcactggatatttgctacacttgtaagtgtacacaatatgcgtgtatgtctgtattcatacatattcagcatagtgcacacatttggagtcaggagacctgggtttaaatgccaacggtggcagtttggagaagcgaggccttaggtgaattaccctgacatctccaggtctctgttgtccctgctctagaatcgtgatgataataatacttgccttaaggttgtcccaagaagttaatgagattatgtacatgagacacttagcatggtgcccctgcagcacatacagtattcttgtccttaacgaaagtttattattttaattgattatctgttacccttgacaacaaaggaaagtagtgataaatgccatatttagccttgagtttcaacatttttctcctgtagattggtttgtgtttctcacccttcttgtccccccttcactctttcttttctagcaccttctgcagcatttcttgttttacctttgggtgtcattagacgttgtttacatcattgtctggcggaccagtgctgtttgcaaaaagctcaggtgcttcctctcctgcttactcttattctcttccttgtctagtgacattgtcttgaactttctagctgggaaagactaaaggggatttgtcacctggcaggggccctcaccaaacttgtgtcatgcttgagaatattttgcctcattatcgtcagtaatatcttcaatgcacaccattaagaccaacctagggcttgaagaaatgaatatttaagggcatatttattgcctagattagaaaatacagattttaagtgttttctgctactgataaactttgttcattcaacaggtgtttatttagatgtctactatgtgctaggtgtgcaggataagcaagacagacactatttgtgctctcatgaagcttaaaaagcctgacatgaatcttgacatatagtatctccctgaaatccagctttagttttaccttcgatttctgttaggctttggtccttgtttcttgtacatctactgattgactttctacaattccaacttaaaatttatgctaataaaaaagatttcaagctattgtatttacaatagcatcaaaaatacttaggaatagatataataaaagaagtataaaactcatacactgaaaactacaaaatattcttgaaagaagttaaagacctaagtaaatggaaagatatcatatgttcatagactggaagacttattgttatcaaggtggcactctccatgttgatctacagatttaattgcagtccctaccaaaatcccaggtatttttttttttttggcagaaatcgatagattgatgctaaaagtcatatggaaatgccaggaagccagaatagccaaaacacttgaaaaagaacagagatgaccgagcgcggcggctcacgcctgtaatcccagcactttggaaggctgaggcaggtggatcacgaggtcaggagatcgagaccatcctggctaacacggtgaaaccccatctctactaacatacaaaaaaaaaaaaaaaaattagctgggcatggtggcaggtgcctgtagtcccagctactagggaggctgaggcaggagaatggcgtgaacccgggaggcggagcttgcagtgagccaagattgcgccactgcaccccagcctgggcgacagagcgagaccccatctcaaacaaaaaaaaaataaaaacaaaaaaataaaaaataaaaaaacctaaaacaaagctacaataatcaagaaagtatggtacgagaataagtatggagatacagatcaatggaatagaattgagagtcaagaaataaacccttacatttatggtcagctgattgtcaacaagggtgccaagccaattcagtggagaaagaatagtcttcttaacagatgatgctgagaaaaacagtatattcacgtgcaaaagaatgtagttggacctctactttacaacatacacatcgaagacccgaaagtattaagacctaaatatagaaaactcttagaagaaattataggaataaatcttcttcatgaccatggataaggcagtggtttcttagatgtgaaaccaaaccacacgcaacaaagaacaaatagataaactgggacctagcatttctactcctgcatatgaacccaagaggaatgaaattgtctatctacagaaaagcttgtacataaatgttcataggagaatgatttataatagccaaagagtggagacaactcagatgtctatcaactggtggatcaacaaaatgtgatgaatgtttgcaatgcagtgtttttcagccacaaaaaggaatgaagtactcctgctgcaccattgatgaactttgcaaacattgtgctaactaaaagaagccagacaccaagggaccgcatattcaattccatttataagaaagatccagaactggcaaatccattaagacacaaagtagatttgtagttgcagggagctggagagagaggaatggggagagactgctaatgggtataggatctcttttgggggtggtgatcttctaacttatattgtggtgatggtttcacaaccgttgaatatactaaaatccattcagttctattgtttaaaagggtgaattttatggcatgtgaattgtatcttaataaaaagatttcacgatctgtctgcatttctttacttgtagaatgaggcactgctgattgtgctctcttttggctaatgcaggggtcagcaaatttctgtaaagggccagatagtaaatccattaggctttgcaggccatacagtctctcagctctcttagttttgccattgtagtgcaaaagcagccatagacaatctgtaagtgactgggtgtggttgtgttccaataaaactttatttatgaataccgaaatttcaatttcacatcgtgttcatgtgtcaccaaatagtattttcattgtcttcttcaaccatataaaaatgtaaaaatcactctcagctcatggcctgtaaaaagcaggtggtcagaaagatttggcctacaggctagtagtttgccaacctctgtgctgttgctacaaaaagctttaaatacatgttagcagcttcattagaggaggtattattcttgtccctatttcaaagatgaagcagttgagaattccagaggctgaggcaagtcacccagatattggctgccagggctggtccttgactctgttgagttccagaacctgtgccaaaaaaacaccgtctttctgtctgacccatctgggtcagtcaaggcagcccagccccttctagctgtgcaggtcactgcatgcttctccgacttggcctctgcgcctgcctggtgccattcattatcctgcatcttccattcattctggaatgcacacttccttcactcccttctagtacacttttccatactgctgagccaatacccacactgagctgggggaaaaacaaatccaccaccttgcctcgctttcagtctttcctcgtgactcactccttctgggaaggcaatgcctcggccaccttttgaccctaaatccagctggaactgagttcgccttgctggctgctgggctctgccttgatcatctgtctttcgggaggcagattggctgtgcatcatttcaaccgtctgcagtgacaagttttttagagcctctttgtttcatttagtacccaggccttggttaggaccttaaaggaagttaaaaccccagtggcaccttttatttagggatcgctggctcgcttggcctcagtcttctactcgcctttcccacgtccacctgacatcctgggacagttggcagaccttccctccatggctcaggtgggcaggaggcagagtcagcaggggtgttaagtcacttctacatctctgcgtggccgtcatcgctgctattctgcacatgtgttgccactggggaaaatgggacactatatagagggtgtcttctcccaccacactctgtgggggtgggagaacccacaccaaacgatcatcatgttggatttgcatcatggcacattgagaatgtgttcagtgggactgtggatactatggaacctttcccacagagtcctttgtaatgcctctgctaggatccagttcattgctcaaacacccatacatttttgccctttatatgcgaggattttattctgaaagctgtgttatctgtgctgcttttccaagacagagcaacaactaccaaaaaaaaaaaaaaaaaagagacatggtttagaagtgtttaagtgataaatgcaagctctttatttatgactcataatgtggttaagagtccttcgactttagtacagtctccattcctagtagtttggactgtgtgaagtgctaaaattccgattctgtgcaaaaatgatcctgccagttgctgactagggtgactggggtgtggaggtgaagacatagaccctctgagcatttgggtaggggatgcgtagggtaagcgaattgcattgttctgcaattcgtgggtcacaagtaaattattgagagttcagaaacttcttctttggcctaaaatatttaaaaagtactccttgtagggtgtctttggttataagtaacagagggaatttttagggatgatttagagtgggatcatggaacccatggtgaaattgaaaactggaatccttcaggacatgaggcaccttctctctgtgtcactcttcttgtgtctcgttgtgttttgactgtgctttattttgctctccctccctgcagactacctcaaggcaactgttagtctgcaaatggcctctcaggactgcccccaagggtcacccttgatctctaaggctttcagaattctgtcatattattctgtctgaatacttagtgttcttgttaggagccttggtgttgtaggtagctaacaggcaagccagggtggagggcacggggaggcgttgtgtgtattagaaggatcttgggatatctttaggactctgggatgccgccatatctcagagtggggcagaaccaggaatgggaatcaccaggagcctgaacagagttctctaatttctcatccctgtttctttctcttcttttgagacagagtctccctctgtcacccagtctggagtgtagtggtgcgactgcagcttactgcagccttcacctcccaggctcaaagatcctacctcagcctcccaagtagctgggaccacaggtgcacgccaccacgtccaagctaacattttgtgtttttgttgttgttgttgttgttgttgttagagatgggtttttgtcatattgctcaggctggtctcgaactcctggcctcaagtgatccacctgccttggcctcccaaagtgctaggattccaggcatgagccactgtgcctggcctcatccctgtttctcgctgcatatctctgctttgccactggctctcagcagactcgcccctctgcttctcaggccatgacctgcttgccatgaattctgagtggacctattaagttctcctccagtgaaataacatcttacctgaaggtcaggttctgaagttagcatatgagatgaaaattgcttatggttaaaatatcctttcagagccttggaagtcaccagtaagcagggccagatgcacctggtttgtggggcatgtgggatcaaagacccactaaaggaacacaggattttcagctccttttgctcccgggcatttgctcatcatttgcactattactaaatgctcttcccttccctgctccttctccaagcattggtacatgtctttgtgctagttaagcttgagtacattgtgatttcactagatcacactcccaatttcaagttcagtgtgaagaatatagaggttctggttggtctagccttggccacgtatgtgtccctcataggtcagctctggcttagagtggctggttacattcaggaaatgctcatacttttaaattaaatttgcaaaaataagagagagtcttggaacaaataatgagaatgagacctagaaaagtgacagttggaatatggtccctggctgtggtgagcccttaaatagagtgttttccagggtctgcatagagtcacctgtggactactgttgaaatgcagatttctcaaccccatccaaccccactctggctctgtcccatcttctagaggttgagccaaagatctgcattttcaagtaagcaaaccagatgaatcttatccacactaaagtttaattactgcttataagaggaagatattgggctgttttaactacatttggagtaaagctttttaattctagtgagaagtggagttgacctttgaactgggggtgtctactcatacgtggattttttttcgaccacatgcagagtgaaaactcagtgttggtgaatgggaaaccagtgtatagggagagccttagggttttttgttgttgttgttgttgttgtttttgacagagtttttgcctaggctggagtgcaatggcgtgatctccactcactgcaacctccacccccccaggtccaagcgattctcctgccttggcctcctgagtagctgggattacaggcgtacgccaccacacctggctaattttgtatttttagtagagacagggtttcactgtgttggccaggctggtctcgaactcctgacctcaggtcatccgcctgccttggcctcccaaattgctgagattacaggcgtttgccaccgcgcacagctgcctttgagggttttgcagggctgactgcaggacttgagtatgcacggattttggtctacttacgggttctgaaccagtcccccaatatacagacggacaactgtgattatgctccttctcttttttgaacaattgggcttcccgtgacaccaaggcttagggctttttctgtattcattttgggttacaatcaccttaaacccatttttgaggaaggtggattccaaagaaatgttgagttctgttatttttccttgtatttcttgtagctctctggaggattgcatcataatggctgaagactttaattattcattcaacaaaagaataagatggagactaaaatttgtctggaggatgttttgcatgtcatcccaatctttgctattgccccctttaaaacacccgaaaaataattctgcagaattaaagagtgaggggaaggatttgaaattgttcacagaacaataatggggttggggacgccaattttccacacagtcgaaaatctgggtgtaacttatgattccccaaaacataactaccagagcttactgtagaacagaagctttcctggtaacataaacagtcaattaacacatattttgtatgttccatatatattatattgctgtattctgacaataaagtaagctagaggaaatgaaatgttattaagaatatcataaggaagacaaaatatatttactcttcattaagtggaaatgactcatcatcgttctttacattgagtaggctgagaaggtggaggaaagggaggggttggtcttgcttgtgcagggctggcaggggtggaagaaaatcctctcataagtgggcctgtgcacttccaacccaggttgttcaaggctcaactgtacataccatgataatgcatcttgcctaattaacagttgtgaaatgttggagttatgtggtatttttatttcatattaagaaagtcaaaaatatttttgtagcagttgagttctcactggccgctgcagaagtatttgttaaaacttgtatggtaactttaccttctggtagattctaaactctttctttctgattgcaggagcaagatgtatcaaccagggtcctatgctttgatttggaatgtttgaatatgactcatgtttatttccttcaaggatgaagtgtgtatacctcagtagatcctgtcccccgcctcgcctcctgaaaatgtatgcttaaaaacaaattatgaagttattgctagatatgtggttggagtggccagtgtaaacttagttgttgcttacggcactttctgttctctgtggaacagaagggcggggcaggtggggaactggaagaagcagcttccctttgcttttcctgccaaatttagtaaaaaaagaaaaaaaagagggaggccccaccttgtcttcatctcctgtctgcacagttgggcatggattgggaggagatcttgccaacactgtgagttttaataagttattttaaaaatttcctaccttaaggaaactcacactgacaccaaattaatttttttaaaaaatcattccactaggacctgtcttgccaacagttttgggtaaaacactgaaggtaagatgacagccatccagggagtgtatttggtttgtgggaccatccacttttgggtgtttgagtaacttcattaatagtttctttgtgccggccgtggtggctcatgcctgtaatctcagcactttgggaggccgaagtaggcagatcgcttgagctcaggagttggagaccagcctgggcaatacggcaaaaccccgtctctacaaaaaatacaaaaatttgggtgtggtggcacacatctgtagttccagctactcaggaggctgaggcgggaggattgcttgagcccaggaggtggaggttgcagttagccaagatcacgccactgcacaccagtctgggcaacacagtgagaccctgtctcaaaacaaaagaattttttttctttgctgtgccaggtgatggaggaacttttgcaagagagataaaaaagaagactgcctattaagtcaatggaagcctgtaggacttgagatttcattgaaataagtaaaaggaattgtagaattgagcatgtggaagtcgcataaatgacattcggttttttcagagtattctgaaatggtggggtacacaacacatatagttgggctataaatttcatgcgtcctccacttacctacatagtaaggtaggaagatacaaaatcttgggtctagaacgctgtagttgaaggatctgtctacctgaacacacaaacgttcccagttaagccttttccatgtaggtttcaacttgttggcccatcccaaacatctttggcttgaagatggttacctttacctagtcagaaatgataaatcattcctctcctaaatgatcacactggagataactgtgcagtcagggaagcaaaacaaaaaaaagatggtcatgagaacattggctgttgtgtattttcttcttactcctaacaaggcagtgtgctttctttgtttcctcacttatttgtttgtttccttccttctttttttttgtccaatttgttcctcaagtagagctcctctatttaaaccagggtggactggcaatatagtgctctgaggtcttttcctgttgagggccccagtttcttcccgtagaatagcagtagtttacagctgtaactggagccaggccgatagctgagtggcttcttgctgtgagctgctgccgggcagctgcctgtgctagtggaaatggcaggccccttctgagtgaccttgggcagcgttacctttgtaaatcccatctcatcagggtccagggattgaatcctaagcccggatttgaaccgatatctcctactttgcctgagcattgcactgagccctgggcccggaagaaattatatttatttatgtgcgtccctcctcagaggtggagatagtggaaataaggaacaaaggttttattcacacctgaacgcagatttaaacataaggaagtgagaaacaagttttattaatagctgtgctatttagatggtgctgtaggaagaatcttgatttataaaattatgatctacttccatttccatggtgggggcccatttgggggcagaatgggaaagttagtacaaattagctcagtctttttccttcgccattcctggatggggttggggggtagttttcttcaggttttcattgacccctccatacaggctgtagtcacatggccctgggttcaaatcctaattttgttagtgtacggcacatctcagctaaattgcccactcttcgttttctggttgtaaaactggaacaatcacacctaccttgttgtcatgaacgttaaatgagacagtgcttagaaagggcttaacacagtatgtgcaacataattactgattttgtgagaaatgacctttgagattacctctgatatgtcagttccccttcagatagggagtgaacaatagaaaaactccttcctcctgctatactctccatacagaacacttacggtcaccacaatgtgtagggggtttctttcacaccaactgtcttggtccactttgtgttgctataacagaatccacagactggatcattaataaaggaaagaaatttattattattagttatttcagttctggaggctgggaagttcaagattgaggggctgcacctgtcgagggccttttgggttatcacgtggcgggagggtgtgcatgagagcaaaagagggctgagcttgcttctgtagcaatcccactctcagtaatgaacccactcccgaggtgacaacattaatccattcatgggggcagaggcctgatgacctaatcacctcttaaaaggtcccatctctcaacactgttgcactggggattaagattctacgcataaacttagggagatgcattcaaaccatagcactaaccagttctccaacaccagctgggtgtcctgtcattcaattcagttctgacaccatctacctggagatggcatcagatcccacaggttaagggctcggccccactagactgcccctgctttggacacaggtgccatgttgtcacctatgcttctgacccaccggctagaaattagaagtttccttgacccctccttgggttcagtcactaattagaatagcttacacaactctaggaaacacttaggtttactggtttattggaaacagtattgtggtattacatcaaggatactgatgaacagccaaatggaagacagtcgcaggacaaggtatgtaggaaggggcaaggagatgccatgccttctctggaggtggcaaccccaggaacctcgacatgttcagcattcagaagctctccaaatcccatccttctgagtttctatggaggcttcgttatgtaggcatgattgatgaaatcattggctattggtgatcaacttaaccttcagtccctctcccctctctggaagtcagaacttggaggtcagaggctggagctgaaagttcccactctgcaatcatgtggctggtttccctggcaactggctcccccatcctgaggccttgctgcagtgcccagccatggcatacaaaaagacaattatcactttggggtttccaaagtttttaaggactatgtgccaagaaacaagggcagagaccaaatatttatttcttattatgtcataaggagtttgatgcaattttccaaagagggcaaagagacttgggtaagataacacactagtactttctttcaaattttgactcaaattgaactatcaacatgaagagaatattgttgtggctaatatgcatgtgaagtattgagacatactaacaaactgaaaactttttgtcaagtcacatcagcaggaaaactaaatcattagatcaatgggcaggagtgtgctttttcatcctagctgagttacagagtcggatgtcaggaggtttgacttttggttttctttttattcatcacagaaaagcctcctgtattgaattctaaggtgagccttatagatagagtacaccagttagctggtgcaaagttttgccttatatggcaatctctttcaaaaccagagatgcttcttagtttagcattactaagttaaacattcatgatcgctattccttgaagatacttcatacttcaagactgtcttacaaatcagctagtaaagaatacccctttgttttccttctttcatacctaacccccaccttcaggccaaagctgtgtctttgaagttctgagtgacattatccattcttacttgtttggggtaaactatcttaaatgtcacatgttttgtatgccttcttcccatattcctctctttttcttgttcaagtagtccagcccccttattaattttgtttatccaagtcaagtgtttcttcagaatgtaccctctacataaatcagggtaaatgactccgcatcactaacttcaaattgatctgtgacctctgtgttccatgacaatacaggagtggaacgccagcagtccatatcctttgatactgtgagtaagttttgaggacattagaaggtcaaacattatttattatttctttgagtttgcttgatggcaatcacagctctgtggaagtcaatcaagtctcttgataattctgtttaggcggtatataattaggcgtttaaaattagttaagtgcctgttttgctatgcatttcacattctctttggaaggcatgtttaccagatgactttggggacatcttttacttcagcttttccccgagctgagagtttgaaagttagggaattctttctacttgtattacctgtttgtcagcaatttactagagttgtttttgtttaacactgaacaaatgccgggaggtgtaagcacaaacatgttttcataaagagaaccaagaagaaaccacaatagtgactgcattgttggggatctgcatttttaggtgtgtgagtatttcttaaaaaaacaataaaccatctatacacaaagtctctttgcttttttcctggcatcttgatgtcctgtagacaccgtggtctttctctttgaatgacccaaagtctgtatcattactgcagaattgctgtctgaaaattaaaacatgggatagtgagcaaataaatatggcaaagtgtaatttaaaaggaaaccagtttatttgaaatcaaagtatatgtagacaggacaggatgaactgtttaaaagggcaatttttgattcttaaacaacaggcttccctttggcgtcccattttgaaacctttgtaaagcatggcccagcatcacacaaacatatattttttttctctttgttttttcccccctattgtacagattgtcgggggaaacacagatgaaaaattctaatacttaattacactgtaaggagcaggtgaccagatgctggttacactctgcacctctccttttagtcatggatggtagtggatggagttggacttgaagctaggtctatgtagaccttgagcatttgtgctgtgtttatagcttttagcataatctgagctttttgggtgagagatcgtctcatcaaacctccagcttggatgtggacattgaagtagtgatcagttaaggactttgtgagggtcacttagcttgggagcagatctcatcacaggaccccttccagtctactgggtgagagagtgagcatctggaaggcagggctctgtctgtcttgattttgaactccttgatcttgctgttgatgcttgagagaatcattaggcattgttaacttaattattctttgctgctccttgctctggagttgcctgacagtcacagatcacctgttactgttttgactggctgctctggtgtgaaattgggattgttcactgtacaagcttgcctggctgagggggcaagtaggagctgataccttgcctgtgttcttcttcttaggctctgggccttgtctgcatcagcctagaggaagaagagtctttacaattttgtcttgcatatacagtagtgccctctgctcaccaagccatgtagggctacctccctgcagaggggaactttttttttttttttttttgagttggagttatactcttgttgcccaggctggagtgcaatggcgtgatcttggctcaccgcgacctctgcctcccaggtttaagcaattctcctgccccagcctcccaagtagctgggattacaggcatgcgccaccacgcccgactaattttgtatttttagtagagatggggtttctccatgttggtcaggcaggtctctaactcccgaccttgggtgatccgcccacctcggcctcccaaagtgctgggattataggcgtgagccaccgtgcctggctgggaatgtttttctagttcacacaaatgcatgggtgggatggctgaggcttggcagtgatgcagtacactcccacagtgctacattcaaagaagatttttaataaacactgattaaaatgtaagaccctaaaatgactcatttgcttcttagagccccgtttctgctttggatggaattcccttactatattaatgtttgtcccagtttttattccttgcaggtttctatatgatgtgtagtttgtgtttagactattactgactgtacctttcagcagggattgtttgtatctgttaaggtagttttaaagatttccctggcagagaaggtccactttgtcggctgaggcacagatttgggcctgaactctggattcttactgcatgtgcatattcctgggatctgaaggtgaggcagaaggaaggggctggccctggagtttttagctcatcatgtatcagtgtggccataattttggtcattgtgttcaccgacatcatagtaccaccggtactcttgtttgtttgtttgtttgtttgtttgtttatttatatatttagagacagagtctccctctgtcatccagtctggagtgcagtggtgcgatcttggctcactgcaaattctgtctcctggattcaagcagttgtcctgccttagcctcccaagtagttgggattacaggcgcccaccaccatgcctggctcattttgtttttgtatttttagtagagatggggttttaccatgttggccaggctggtctcgaactcctgacgtcaagtgatctgcctgtctcagcctcccaaagtgttaggattacaagcgtgagccactgcacccggccagtactcctatatttaaatgaataaattttttatattacctgattttttaaaaaaaaacgtgaatcatcttacaccaaaaagaaactttctatggattattgtaattagaaaatcacttgccagtagaagaaggtgatgataaaaataaataaatataaaggcctcagcaagattatgaaataagggaaggctaaagaagaaggaagatggtgaggtctttcttattctccctgtggtttcacaaccctgtgcagaccttcgttcagggtgtagaccagagctctcaaaggtggtgatctatgagaatcacttgagagttttaaaacaatttgacttcctagggccacaaatccagttgattctgaaaaaggacttgaaatctgtgtatgttttttaaagttctctcagcgattgcccagccagtgaaaccactgcctttttttcgtctgaaattagtgaaaattagggaatttcttaaaaatagattcacatattttgtagcagcccataattttcgttgctgtctttagacctggaggaataggcgtttcattcaacactgtgtttccttttattcctaaagctaatttttttatccaccctagttttggtgaaattatgtatcacttgtgataattcattttaaaaattcctgagctgtgtggcgcactttcatgaaaattcatttagataaaattagatattattgtttaatgaggtggcatttcaatttggaccctgcatcaggcatataccaagagttttttatggaagagttaggttcatttgagtaataaagcctgaatcatgggggctttaattcttaatcgctgtgaggattgttatccgtgggatgtgagctgtcttagtggtattcaatcaagtgtccacttagccatgactggaagtaattgctcccaagtgggccgcacggtgacctgttaatactccctttgaccctgtgaccttgtctgccccattgtttaggattttatagcaggcaagtctgcatttctgtggggtcaagtagatatcttgaggtcaaacattttctgattactgcctagtccacactgtaagtcgaccagaagctgttgcattgttaatagtcgttgctttgtagcggaacatgaacaatttgaaaattgtcttcctagcctgcatgtaaacagtttaatattttacagaaagaagttcatcttgtaaattaggtatgaataatacatttgtaattactccttgtgtctttaaacacttgtgtcttaattggcttgcttttttttttttttttttaagatttatttgcatttgctagcaagttaaaattaactcctgtagaaacccagcaacaaagtgaggacagagcattccaggcccctctggttctgctagacttaaaacttgattgagtttttggaaggtgcattcattctttatttttattcatttattttttctttgtttgtttttttgagacagtctcactatggcacccacgttggagtgcagtagcttgatcttggctcactgcaacctctgcttcctgattcaagtgattctcctgcctcagcctccctagtagctgggattataggcgtacaccaccatgcccggctgaattttgtatttttactagagacgggttttgccatgttggccaggctcattcattctttcttttaaacatttgttggggccattcagcaagaaacaaatgtgtttgctgtgccttctggaaaagtgtctgtcccgtcactcactgaattgaggttgtttcttgttttttacccttttttatttcatggcatggtgttattttgggtttctgtctgtcggctggtaacatacattgttttttccagtagttacatggacacattccctcatctccgtgatgagtcaagtaatccaagcctgctacacatctctttgctttgtgggtgatcccggctgctctgccctccctcgagtttagcagaattataaaatgggggtgagagaaggagttaaacttgaaaggtgaattcagtcacatctgaattcattttagggccctgtgagtcatgttagggcctcctaaaactgtatccatgccttatctcacttttacccattcacacaatggattttctacaaatgcatatgtggaaaagtacagctagaaaaaaaacaaaggaaaatacacaattaggaaaggaggcaaacagtgaatttagaatgccccctaaggtgactcgggatgtcaccgcaaaataaaatactcatgaagaaaaattaagtggctcttgctactgttttgaatgtattattcaaaacaatatattggcatcttggctgctccttctttatctaagtctgaaatacgtacaatttgtcttaagagagaaagccttaatagcttaaaaataaagggttactgtttattacaacttcagcagtggggcccatccccactgaggaaacacatagcttactacgtaaattattgtccccctgcctctggctttaacaccagaaatttgtcatcttttgcttctagagccaagaagtccaagacaaaggtgtcagcagagtggactctttcagaaagctgtgagggagaatgtttcaggcccttctcctacctcctggcaggggctggcaatgtttgccattccttgacttgtaggagcgttgcctcgatctctgccttcatctccctgtggtggtctttctatgtgtttgtctatgtcccaatttcccctttttacagacaccagtcatattggattagggtcccaccccacttcagtatgacctcatcttaactaattacatctgcagcaatcatattccaagtaaggtcacattcggatccaccttctcttttcgctcagttcatatagttgaattcaggaaagttaaatgtgtaagtactgcggctcctgagaatattatggagtagaatgcaaaatctgtgggaatttgaaaggaaaaccatgggaaagagacatggcagtgtctctcttgactttacggtaggcccatcccagcttgagaccactgcattctctgtgtgcaaacatcagacacagatgtgcagtaggtgggcccaagtcatgggtcatatttctttttttcaatatgacatcagtgcatgattggcagaggctggcattggcccagaacggtctgagttatggtctcagtcttgaagctctctagtgccacctgctatatttgaatcactttatatgaattttatttgtccctcacaatgaacctgggaggtggccagtaccttttctgtcttttaagaaagaagacgctgagaatcaggaaagtcaattccctggcttaggtcacatagctaattcaagattgaaactcaagcctttctgaatccagagcctgttttccttctgtctctctggctctgacttattaagtgccccaatttcctatcttctcttggaaaacaccatcacaggaaaaggaatctggtggtatttcctgtctttgggtctgtctgtctgtctctttttaagcagagtagagtttaccctgagaaataggaatattatgaaaaaataagtttctctagattggatgtcccagcgtggacagatgagcccagggacccttgcctctgtcattgggcagctgcccacagggagctcagtgtttttggtgccagtgtctctctcggaactcttggcaggcccaagggtgtacttgcaattgctggtgcgtggtatttgggatgtttgtatgtggctgttttttattttggttttgttatctaccctttgtaatagtaactggcaccatttcttgctgttcagatgttctgttgctttcaaacaaagagatctgaaaatgtaccaaatcagcgggcttcataaaaagtttggtgcattggagccaaggccgaggtttcttgggccatcagtgatgtgcttaaaagtccaatgcgcctttccatgagcagttccccctgcctaggaggatacagatgccagagccgacaggagcaagcagatggcctcaccctgttgttgctgtgggagaaacattagtttcatgtggccagatctcctctcctcatatcttccaaagaaaccagaaaactcaaattaacaaatgcttaatcttgattattaagtgttggaaatagaataaaaataaagtctgtctagtctggcccaagcgaaacaaatctttggaccacatttggctctcaggtcattgatttacaattttaggcttagaacagagcccctgtccttcacccaggtcccccccctccccctgcccttttttttttgagacagggtctcactctgttggccaaactggagtgcagtggtgtgatcttggctcaccacaatctccacctcccaggctcaagcgattctcctgcctcagcctcccaagtagctgagattacaggcgcttgccaccacacctggctaatttttgtatttttagtagagacgaggtttcaccatattggccaggctggtctcaaactcctgacctcaggcgattcactcggcctcccaaagtactgggattacaggcctgagccaccacgcccggcctcctggccccttcttatatttacttcagattacagtgtagataccacatatctcagtggccttccctgtgactctctgtccatccctttcaggagctttccttgctgctatcatgtccctgacaccccctcccccacaccacctagccttgactttcctgcattttaattgtatttctctgtcatcttcatggatcatggctttttccccattatgtccatggtcttggcacctggtagatgcacactgtgtgattgctgagtggatattgggtgcaagtcggtgggaggggaaaatgtcctcatttctcccttggtatatttttctttctatattcatttgcatatgtgctgctcagcgtgggtgtcagggagttaggtcatccttttgttctcagatggcaactgtcgttgctgattatactttgtgacttacctgagttactttggagaaaaaaataaatgtcacgaaaatttcaattgacttgtcaatgccaacctgttttggctcctagaggctaagtggagacacaagaccgacaggtttctgatacacactgttctcagcattttgggtatgcctgacttactcattcttttgctagaacattttagatctgaagctgttttctcgagggcagtctcacgctgacatttttagggcaactggaatagtgttttgttgctgttctgggaaatgtgggggaaaggcccccttatatccttgtaaagatgtcctcaaatctaaccttagtgacagacggggactatttctaatgagccgccaagtggttctcatctgatataattctgcaaggattcctgtggagttgcacaagatgggctttcccttgtatttggaatgagaacatttaaaggggtcagccagtttcatgctgggaagtcattctgcacatatgctaagaaatggatatatgttttttaaaaatgtgaactccttcccgtcattgaaaaggaatgtaaaatgatctatttttcaaaaaggtgtagaaattgatgaggcaaacagaagtctatgagtggttcatttataggttagaagagagcatgttctgtgtttcagacactcataataagatgaagaaatgtcccaagataattggggagatgcatggagttaatagggaatggtatgtgtatgctcatgcactttcttttcttctttcttcctttctgtctgtctgcctgtctctttttcatctaattttatttcttaatccaaagattgtctggtcacctacttgattcttacttggaaaactgtgtcccaagaatatcttgacatgtgtttgcctcacttaacatggcccctttatgggagggactgcattcagcagggactggcccccacatttatgggaaagcatttcagactctggagagaacaaagcatttgcttacatcccagtgcagctggttagcacctttatagagatttagcagcaagcagacaacagtttgtcatttaaagtacttacaccacaatatcattcttgtataaacacactgggggaagaattgggtttttagtttgtttctttgaggcatgccaaagactgagttttgaatttggcatgggggcaaggaatagaaataaagtgaccccaacttaggtaaatataaagatctgttgcgtggaaccagagaagtgatgggaagacaatgcccaggaaagtggggtgagtagagatggggccttagaaaatggtctgtgccttcctgagagaatcctaatatacttatcagagagttaggaggctctgtgctttggcatttgagataggaagagacaggttagaggtggctgatcttcatggcagagaataggacttaacatgaaatctaatgtctagtacttttctgtgatgatgtactatgtaaagtctccgcagttttacctttcatggtatccccagccttctaggcagctcacgcaattgcctgctcacacattattttattatttatttagttagttagttttgagatgcagtctccctctaccacccaggctggagtgcagtggcacaatctcggctcactgcaacctctgcctcctgggttccagtgattctcctgcctcggccttctgagtagctggcaatagaggcatgtgccaccacatctggctaatttttgtatttttagtagagatggggtttcaccgtgttggccaggctggtctcaaattcccgatctcaggcgatccgcccgtctcggcctcccaaagtgctgggattacaggcgtgagccaccgcacctggcctcacacattattttatcccctgctatgtaaccactttcatctattcgggagccttgccagttctttctcctcattgtgtcctctgatgctttgcatagtgtctggcatctcgttagaagttcatcaaatgtatatagaattgcttataaggtcacagagtaatggagggtgtattagctaaggaaatgctagctgctgtaacaaataaacatacaaatgtttaatgactcaaacccaataggtatttttctccaaattgacaaggcctctcttgcaagcattgtttcagacaccctttgttcttacattttatggcgccaccatcttctgcatgtgttttccaagtctgccaacttgagaaaagagcaagggtcatgtaagtaaaattgtatggacctgtcctggaagtagtatatatcacttacacaaacactccattgaaacaggtgaacatgttcacaaaagagggagaaaagggcccaaaagttatttatgaatttatgctgtcttttggaattagatgataattccctagagggcaaggatagtgctttctatatattcttttatctttcttggtgtttctcacatttttaagcaaataagcatggggaggtttttggttgactgaccttgagcttgcattttctcatctgtagaattctgtttgcctaacaagggtaggaatttggagtcagggaatctttttgctgctggtgatctgatgagatcatttggtccagctggggctgtttgtattaattaagtttcttagagttcttagagatgcatgtgcttagataaaatgcaagaaaaacaaaaaacaaaaaacaaaaaaaaacactgtcaaatgtccagcaagattttctatggtttccccaagcagttgttcattaagaggaaaggcagagagtttttcactggggagggcttattactctaatgttccattggaccatttcttgaataccttgttactgagttgacttaacatttgagatagcatccagtgcacctgatgtatttcgaggggagagctaataatgacacttatatgccagcggaatatgacttaggtaagatgaacaatcattctatgcaggcaacattagatgtagacattacctagttagttgtatctttgcagtagtccagcgagtttgttttcccatcttaagttgaggagactgaggtcttgagagcgtgagtagcttgtctaagaatgtaactaatgaaatgaaggagctggaatttgaaccaggtagcttgctgagccagtattcaataaaagagagtgttttctcttctctctggtatgaatattatactgaagataaaggagaaagaagtgataccagttcagtgttcctggaatgctggccatttctgggaaggattggatgaaaaatctcgagttgattggtcaagttgctgtgttggtagtaaaataaacatcattccactgacaattattataatagacatttccctgacagttaataaagtggtatagaatactactgataatataatccctgttgccagtttggctgctaaatccaagaaacccctgggcaatggttagacaaatacattcttgcattgttacttatttaagtcatgtcacacatgactagacagcatttccatcatttgaaagcctttcgttattgccttctcttcaatgctgtgaatctgtatggacttggacttgcagatgtgttgtcattatcatctgtgttttgcatagccacatgtatttttttttttgatagatcaccttcagtgtaggttaatatttttagcaaaagtaagacataatattttgatcctcttttctgactatttgaaactttgtattaaagtatgggttgttttctcaggaccaactaatgtggctgacatcatttccaaattggaaagccatgtttttctcctaccaatgatgtagctatttaaaattcacagggggtgaaagagaaagcacacacacagtcagctctgacaggcgagacacacacgtggccctggatgggtgcttcatatatggcgtatgtgtcgattggctaagtgaatgaatgaacagaagaatgagtcttttcttttcttttcttttttgagacagagtcttgctctgtcacccaggctagagtgcagtgatgtgatctcagctcactgcaacctctgcctcccgagttcaagcgattctcctgcctcagcctcccaagtagctgggattgcaggtgcccgccacaacacccagctgatttttgtatttttagtagagatggggtttcaccatgttggccaggtgggtcttgaactcctgacctcaggagatccacccgccttggcctcccaaagtgctaggattacaggcatgagccaccacacccggcctacagcagaatgagtcttattctggttagtatatttcattttctagaaaataaccaagataatatattttaggaatgagattaggatacaaagtatgagctcatttttcttttggtataattgcaaacttaacacagatagttgcaagaataatgcaagaattccctatgccttttagcgagatttaccaattgattatacttggttccatttgtttttcattctttttctatccctccttctcatactctcagatacacacacgtgtgcacacacacacgtttgcattgtgcttttcctaaatcctttgacagtaagtttgaaatctcaagcacccttaccataaaatgcttcagcatgtatttccttacaaggccgttattttacgtaactgcagtacattaatcaagcgggaggtttagcattgataaaagactgtggcacgatgttgtcagtgtctctgatctcttctgtagctgttgttttgcctagtccagaatccaatccaggatcatgtactgtatttagttgtcactctcttttataagtttgtatttaatgagcgtttgattaaacaaaatgtgttacggaatctcagatgaacgacactggccattcttctaacccattctcctggctgcaaacaaaatcattttgaaacatcagagacagagcgtattctgacccttgttccttccttaaaaagatgacgttttttgtttccttttgttttagcaactttccttagtaatctcttcctggtctcactaccctggtagcagcagtgtttttgcttatgttgaaccagtaaaggtgagctagatataacttatgttaagtgctgttttcttcacaatgttacattcttgagttactttttttctcttctgtagccacacagcacaaaagtctccctttctcctccccctccctccctagactttatttcactatgggactttgcagtaatgttagattggctctggcaaaggcattttgatgacccctgtctccgatcattatagtaactaataaaagcttgaaaatgactgttaccctgcaagcgtgattccaatgacttgcggcgagctcagctgtataaatgtgcagtttttttttttttttttttttgctgtgtaaattttgatcaaagggaaatgcgtataccatttagttgaacgtttcttttaaatttaatcacatcttagtgtaaaacaacaagcagaaataaaatggcattggaaatgtgagcttaagattcagaaagaatggagatactggtccacatagcagctttccataccgcgttgtgtgaagcattttggttcgatgcagagggtatgggatagatggcatgaatactatagccatggttatatattcaacagaaaggcctgttttggttatgagagggtctagaaatgccagtttgtaacgaagagaatggaggtctgtcgtaaaattcacaaactaaactttttgagttaaacttgaaagcagatagcctggctatctttatgctgtttaattaaaattttgacttctataaaaaatggtagttttagtatttttcttttgaagttgcctgctgtgagtctaattaatttttatttaataataggtttgcatctttgaactgtttttcttgtcttagggctgggtatcttgttagtgagtggaaaggaatgttggaagaggagcgataaaggatgtttcagtcccttactgggcgtggtgtgagatgaattctgaggttgtgactgggcccagtgggcgagagcattgagctgctcacctgggtcggctccacatgcaggtcacagaactgtggtgtacgtgctgggtatttgctgagcttagacaggtctgttttttcaacttgtatgaaggagaaaaaaggaggtgaagagaacatacccttcccaacaggggggagagccttcacagaatgtccactcctggattcattcatctattcaattgttcagtcaacagatatttaccaagtgcctgttttgtacatgacactgttccaggcatgtgggataaatcaatgaacaaaacagacaaagatcctggccttgtgggcactcattctggggagagaaaggatgcagacagacagacataataagtagattagttaggaggttagaaggggtgtgcaggagaagaaaaaccagggaatgaggttggcagttctgtggagtgagagtgggctgtgcttttgattgtgacgccaagtagttctttttaaaggtgctgtttgagtaaggacttgaaggaggtgaatgagttagacttgtagaacattccaggcagagggaacagttaatcaaagaccctatggttgggggcaagtcatgcataatcaaagggcagtcaggaggctgctgtggccaagaggagtggactgggggagtgtggtgagagatggggcctgagagccagttggggccataccattaaaggacttgcctttgtcaaagtcaaaatatagagacaagtgtctaaattcagtgttttatttgggaatcacagaattgcagttcaaggcatatgcacagactcattggagcaaagtttgaggattttattagacatagttttattagaaatggaaagaaagctcactggcaagagaagcagcttaggggagctggcaagctctgaacagcgagtgacggtgataggtagagctagccttaagagttgtggcaggtcatttcagcagctattaggtaaacccggtcttatggttgcagcaggcagtttcagcagctgggcttgcagagaattacattcttggagccatgctatgtgccctgagtgcctttatcctccaggccctcagagtgattcagtttggggtatgacaaagaatgacccattccacatcatgaactttcacaccttgcgctacaccctgacccattttgtataatcaactttcacacagttctggtgcgagaggtggaggtgttgatctgctataagttttaagaagttctcttttgctaccgtgttgagaatagaccacgggtggggtaagagaaggagcagggagtcctgttaggaagcttggcggggagatgatggtggctgtgaccaggaagttggtagcgaaggaggggagtactggctttttatatctgttttgaaggcagactctatgggatttcctaatggaatagatgtagaatttaagagaaagacacgagtcagtattgactcaaagatgattggcctgagtgtgatgagaaggatatagttgccgtggactatgattgggaaggacaagttgtgttggggaaggatgtggtcagagcctgcttgagattgaaaatcacgtggatagagcctgcttgagagggtaaatcaagttctggacgtgttgagtctgagatgtctagacattccagaggacaggctgtagaggcagataggtacacacatctggagttaaggaaagaggtatgggccaggttgggagcccagggagttaggaatgcctggtaaatgctactggagcaggctgttttcatgttcccctaaaactgaccttactagtatctcagggatccttctgtgtgtttgccgtgtaaggagatgctcagtttaactcttgagggtgacgtttccttggtgttaggcattggtgcttgagccgtagggctggcgtgctggttctgtgtacctaaaggaagctctcagagtcacagaaagtctgaaataaacacaggggtggagatggtctttcctccctcattactgtgtgtgggaagagatgacggcaccaggatgtgggacagaatggaactgagaatccaagttggttgactccctttctgttctctttctactctactgggtagtgaccagctgttgtatgaagtggcattcacaaatgaataatccaacacctttgcttctctcatccctttattcatcttttgtcacccaggaaaagttggattgcattgtagaaagaagaggactactattgcttttctgtcttaaatatgtactacttaagtgtgttgtgatgggggaaaaatagactcttcaggaacatgcatatggtgcttttggtaacaaggcaataaggtaataggtggaggaaggttaggagttcatttttgggtggggatttcttcctttgtgtctgcaagagaggtgggatatggctctggctttttaccttgcttacagggtgtgtctgctcttaaatcttctcctgagatggggcctaggctatgctgcctgtccttagccaagataagaggtcatttaggggccaggtatattaccctacccttcgccaggccctatatcctgtctctaaggcaccactgggaggcaatatagcacaatgtgaactaggttcaacccctggttcccctccacttaattactatgtgaccttgagcaggtgacttcccatctctgagccgtggttttctcacgtataaagatgcattcctacatcagagctttgttgtgaggaaccaaatgggaaaatctatgtcaagggctgagcactgcacttggcacaaagtaaatgttgactaaatggcagctattattgttgtcgtcatcaccagcagttccgtcaactcctacctgagccttaggccagttttgttaagattaatttagtttccaaaaaagatgtgctaattggattattacattttcatgtgtttacatctatatatacatgcatggctttgaaatctacacatgaatatatttatccattcaagtttctcttttaaaaatctgtaaggattatatttttaagtcattgaaccatgatgagattctttttcaaaaaaaggattgctataagtgatcattatgtaggccatcaaaatggagaataatgtagacatggagctaaaagaaaaccaaaaaaaaggaagtcagtgttcatacagggccaccaattgagtgcatatttttatggcctggttatttaaaaatattggcacttgcctacattgtttaggattggatgacacagacagagatgttttggggttggggtaattttttttttttttttattaattctacaacttgtagacttgtaatcaggagtggcttatcagcagcttttcaaaatctgacattccacatggaatgccccaatggaggaaatttagcactctgtgaatgcttttacagttgaattccacacatatgaattatgacaagtgaggctgactacactgtggtttgttgtgtctggtctggttcctacttttaaagttgcagttgcgtttggtcatttgaagcttattttcacagtctggccaagccagcagggtcccggggctctgcaggggacataaaccaccagcctttaagccagagtgctcagtagataagcatttcaagacttcattgcatcatacaaaaggacttatgggcttatttaacatacactatttgacttaatttagatatttaatggaaagaaaagccttttattatcaccgaaggaaagaactgccaaacattgtgaggctcagttgaaatattataacggatatacagagtgcaaatatatttcactgccttacataatggggtgtttaataatagttgtttctttaaatttagcacacgtatctcagacatttgcactttgtaaattataggccgtggttcaagaaactcagttttaaaaaaattgttttaatgaggcatgtactgattttttaaaaatgaccttcagctttgatttatgtttatgagcccagattggggagttcatgccaggaatgaacactttccgtcctgactttttacaaatgtaaatatgagcaatggctgggtctgctgactcgattggacagagcttagttgaacattgcagttggtaggcatcagccccctctgcaggtctggtggctgggaagagcaaggagctcactacagcactgggaggacactacacataagtgtctagggggaagcctttccattgtgctgcacctgtgtgctttcattttctgaagtacctggactggctcagattgccaaagcccaaggcccaagatcaactgattttttttttttagagacagagtctcactctgttgcccaggctggagtgcagtggtgggatctcagctcactacatcctctgcctcctgggttcaagcgattctcctgcctcagcctcccaagtagctgggattacaggcaagtaccaccacacctggctaattttttgtatttttagttgagacggggtttcactgtgtgggccaggctggtcctcaagtgatacacccgccttggactcccaaagtgctgggattacaggaatgagctaccgcacatggcctgactcttcttatttatttattttttgagacagagtcttgctgtgttgtccgggctggagtgcaatggcgcaatctcggctcactacaacctccgcctccggggttcaagcgattctcctgcctcagcctccctggtagctgggattacaggtgcctgccaccacacgcctggctaatttttgtatttttagtagagatggggtttcaccatgttggccaggctggtctccaactcctgacctcaggtgatctgctcgccttggcctcccaaagtgctgggattacaggcgtgagccaccgtgcctggcctgattccttctttttagagacagagtcttgctctcttggccatcctggagtgcagtggcctaatcatagctcattgcaatctgaaactcctgtgctcaagtgatcttcttgcctcaacctcctgagtagctaagaatcaggtgcatgtcactgagcccggctaatttttaattttttgtagagacagaggcttctttatgttgcccaggctggtcttgaactcctagcctcaagcaattctcccatctgagcctcctagagcataactgattcttaatttggggcctagcttgtcctttcaggaggtgaggagctgttgtgggttgaattatgtcctccccccatgatgtatacactgaagccctcacccccagtacctcactcggaatgtgactgtatttggagatagggactttaaagagataattaaattaaaaatgagatcattaggatgggcccaaatccagtgtgactggtatcctaataggaagaggagattctaacaaaaacccacacgggaagaccgtgtgatgacacagagggaagatggccaaaaagaggggcctcaggagaaacccaccctgtggataccttgatcttcgactttcagcttctagagtcatgagcaaatattaatgaatgcctgtggttcaagccacccagtctcttgtactgggttacagcagccctggctgactaataagggagcatacagtatcagaatctgcacaagggcatgcttcatctctattctctattataatacaatgcttaaatatgaaaaaatgatggcaagaaaaccattacaaggaagaaacccataatgactggcgaaatccatacggagagtggagctgtatcagaaaatgccaaagtagtcatgatgggtcaggtttattgagaagtcccagtgggctgaatgcagagctcagtgtctcacatacattttccccttttgtcctcaccacaatcctgtgagctatgagctgttgccctcttcatcttgtaagcaaggaaactgaggcaaggaagttaagtgacatccacgagatttcagagccagccagggtcagagctggaattccaaggcaggtatcactctgcagacctaagttgtttctttgacagccctaagcccttgggaggttgggggccagagaggggtggttgtaggatctattacgataattggttaaaagatattgggacacattgccttaacgatgttttggttccatctgcagaaagaggctataaaacgtattgagtagagtgaagatgtcactcgtaaaacaatgagtatcactcatattacagagccctcaggatctgtgagccctgatccaagccctgtacatacctgcctatttctaactcacagaggcctgagcagcttccccagagcttctgggagttctgcacccaggccgtctgactccagcacctggacctctaaccactgggtaggcactgccttccctcacgagcccagcgcctgcctagcatctgcttctgtcacagtgagggaaagatggtggctgccatttgagcttttaaaacagaaaaatactttgtcccccaaatttcctccctttattacaaacatgatttatgataaatgtaaagaatctaaaaaccaaatcaaagctagaataaacattatctgtagtgccaccccctaaaaagaattacttctagtatttttgtcagcttttctagtcctttttccccctatagaaatatacttaatgcagccataaatatactaataagtttataggcagcagcactcattagaaaagagcaagagctttggaataagacttgggtttaaatccatttactagttgtgtgtatttggacaagttattttatttccctgtgtctccatttgctgtctgtaaaatggggataataacacttcattggattttgcagtagcctagcatatgtaatgtgcttattcctgtcagctggcacacagtaagtactcaaataactttaaaaagtagcagttttgggctgggtattgtggctcatgcctgtaatcccagcactttgggaggccaaggtgggtggatcacgaggtcaggagatcgagaccatcctggctaacatggtgaaaccccatctctactaaaaatagaaaaaattagccgggcatggtggcaggtgcctgtagtcccagctactctggaggctgaggcaggagaatggcgtgaacccgggaggcaaagcttgcagtgagccgaggttgtgccactgcactccagcctcggtgacagagcgagactccatctcaaaaaaaaaaaaagcagttttgcaacatatcattcaatagacatttggtaagcaggtatgatttggggctcacgtttccttctatgcccttgtttgtttttacaatactttttaatggttgcataatatttcattatcatatgaatcagaaatagtttttaactgacatttatttttctgttttcatatactagataatgctgtgatgtattcctttgtgaccttgtagttgaattctccccagtgattactattttgttaaaagcatgcattcctgttcactccttactctttggaagggattctaagtcttgttgaagcatatcaccacccaactggaaaggcggtgtcagtttaccctggccctggctgtgcatgagagtacctgtttctatttgtgaaactttaatgtaaaattagatcaatgggcatgaaagaaaactggggcataattaagttctgtggttcgctgacccaaatctggtaccatgaaggactggcagcagctcacacatttgagagaggagagagcagccggggacactgttgttcacttagttgtgtggtccaagcaaagatgagaacagcagctctcaggtgtggagccgttgctggttgactaggcattgagcacagtgctctccaattggataatttaatctcagcaatgcttggaggtagggactttcattagccccattttatagaagcagaaatggaggtttagagaaactgtaaagtgtgcagaattacaaggctactctatggcaacgttgggagctgaacccaggtgccctgatgttcagcttcctgctcttgtcttaggatattagtaatggaggtggaaatctggatgcaagagccagcactgagcctaagtcaagggcaaacgtggtagctggctggtactgaggggaaggaccagcttcccccagttgttcagcttcctgctcttgtcctaggatattagaaatggaggtggaaatctggatgcaagagctagcagcgagcctaagtcaagggcagacgtagtagctgcctggtactgggggaaggataccgtggaaccccttagttggaaaagttatcagctagttggaaaagaaaacctggggatttggcaaacacagggaggtgaggagggggagccagtgtagggagcgtgtgcggattcgaatagcagatacgccgccgtggagacaggagatgtaaaactaccacttgccctgtttcaaggtttacatgcattatcccacttaatcttcaaaccactccatgatgtaggaagtatcattacctctgttttgcagctgatgaaacagaggcccagaaaacttaaatagggttggaccacgagtatcacagccaggatcggaccccaggcagccaactcccaacactgccgaagccaactgcgaactaaggctcagtggagaatttgcaacctgggatatatttgttggaagtgattgctccctccttttgaactttgcagcaattattgtctgtagaattcatctggcaattaatcatgtactcccggtgacaaggctcttattgttgtcttgaaatgttatttaaatcgcacattgttatttaacttcttgcccagagaggcagactgtgcctgggtatcccccacctcacccagtgcatgtggtaccacagtgcaataaatgtttgatttaatttcatttgagaggcttccgggcggaagtgataatctcatcctttagactttagtgacaggtgacattcgtggaggggaagaagtaggagaggaagggggacgatgcccacagttgtgattcagaagaaaatgggagaattgaagggagaccgagagaagaatagaaagcatccctcttcagggctgggcgcagtggctcacgcctgtaatcccagcattttgggaggccgaggcaggcaaatcatgaggtcaggagatcgagactatcctggctaacacggtgaaaccctgtctctactaaaaatacaaaaatttagccgggcgtggcggcaagcgcctgtaatcccagctactctggaggctgaggcaggagaatcgcttgaacctgggaggggaggcggagattgcagtgagcctagattgcaccactgcactccagcctgggcgacggagtgagactccatctcaaaaaaaaaaaaaaaaaaaaaagcatccctcttctacagtccaataggaggactgagtgcatgcctcatatgccgtcataaactccctccttgtctcctgtcttgggggagatgtcctgtctcatttccaagctgcactaccaggggtgacttgggtccttgcttttctgcttcccgggtttgcctgacttcacgcaagaagccaagggttttagacagtgggaggcaacgtagaggtctgaacagaattataactctatgttgccaggttgtctttattttgggaacccttccaaacgttcctacttttcctgtttgagctgttggaaaaatggtactcagtagtattcactggtggttaagggacgaggcttgggtttcagaaagatgtggctctgtcactgactgtggtcttgggtaaaggacttcccttcaccagccttggttcgttcatctgtaagataatagcatttactcttgccaccgttataaggcttaataagagggtggatgaaaatgctatggacagagtacctcatgtgcagtgcagcacaggctttgcacatgttagttggtgttagaactggaagtacccaggagaatatccaaaagtcctacgaccgcattgaacaccagggtgaaggaccagcgtgttcctttcctttctcatatttgcaacagaaatgtcaccacttgggctccgtgacacttttcttgatgacattgtcctgatcatcagctcttcccttggcgcctcgagacatttccaaaccacatcattccacacaccctggaatgtgcacgtttcctttgtcagaaggaactgtggccatcagacgttggacagctctgagccgggttgttttcttctcatctacttactgttgtgctgaagtttggttttattttttaatgtaagaattgtctggaagttattcttcagtcatttcattagtcatttactttcttggttttgaaaattgaggaaaaattactttgaggcagtgggtcagatgagcgtggctggctgggtaacccatttcccgctgagtcacctgtctgctcagacaactaaatgctgaagtatgcttgatgactagtcactggccaacgtcatattaatctgaaatttcgtttctgctccttttaagttatggtagctttggttccttggtgggttttttgaaagtgctccaagtattgtattgattggatgatgtagcctggaattctcggttatcccccaaagtgtttttttcgatttgaggcataaaattatgacatagtattgttcaaaaagatgggattcaaatgccttcattttataagaagggaaactcaggttccgagaagctcactgacttgcgaaacatctcaaacagttgttggcaaagctgggatggcgttgatcttcctgggaatttgtgatgtgtactcaccccctgggtcttgctgcacttctgctaaaactacctggaaattatttattttggtcttcttccttgatagaagagaatctgaaagtcaggaatagtggctgcctccaaatgcccttggctccttctcctgaccccctaatgagcatgtccccagagcatgttataaccttggaaaacaaggctacttagtatgtttgtactctgatgcctgtatgttctgtacatgatctggcctgaatgatggatgaggctccatacaggcttcctgtgtcttctgccattctcccctccctacagtaccatacctgacgaaataataacatcgagtcactgaggaggtttaccatagtgtggtgctacaaccttaattcgtggtgttttttttttttttttttttcgagacagagtctcgttctgttgcccaggctggagtgcaatggcactatcttggctcactgcaacctccacctcctgggttcaagtgattctcctgtctcaacctcccgggtatctgagattacaggtgtgtgccaccacatccagctaatttttgtatttttagtagagatggggtttcatcatgttgaaattctgtttgctttttaacttaacttgagcataagcttagaagatgatttgggggctgggggctttatttattttagcaagtaatttggcctgtatttttattcctttaagtaatttgtaactaactacaaaggcctctggtaagatggcttttgtttctagttggaacatggagaccaagagaactctctagaaaacagatttggctccactgctatgggacttcacacttacctccacagaggggctcttctgatgcctctatgtaaacagcacttttaaatcctacttcagggaccattggttttctctcaagagatatgttccttttttttcttctcttaactcttttgttattttactccttttccaataatggaaggcttttcagttttacattagaggctactacttgttttttttttttttttctaattgtaaagcaggcaaaaatcatcacagaaaacagatctcaaaagaattgcacttagtgttgtgacctagttggtttcttcattctttgaaacattatttgatttttcctcccgtattagctgttatgtatgccggttacataaccttaatttttcatggaaaatatggatgtcatcaattaataggactacccctgctgttgttatggctggcttcttctagaatgttcccactggggaaactgaggcttaggtttgatactgcaggatttgccattgtaatgttttccttttagtaacatcatcattatgaatataattcttgttctcatccagtagagagccttggttaccggcaacccagttcaagcctttgaatagatacatagggatcacctctctagtgtgaagatgaaaataatataatttgtttaccaccttgagttgtttaccacaggctgtgaaaaatatgttttgaatttaaaagtgtgaaaaacaagtgtgctagctatcaaaaaagctctcccctcaaagtaaacatgtttatagagcaagactcaaaacaaaatacttgataagcctagccaatcaaaagaaagtaaacatgtttaccacaaaagccttataaagaacccagatggcagccagctctctgttcacttgaccgtccttccagggagctgcagaggctcccctgggccttggggaccgggccgccacttgccctgctagcagggggcctgccttgtgctagctgtgctcagttagctagacccagtttgccagtgggaacggaaggtttgtgttttctgccatttaattgaatcatgagtggaaggtatttgtgaaaatgattctggagttcccatgattcttaaagagcaacttgttatagatagggtgccaagtgggcttctgggggactcttcctggctccccaaaagagccttcctgatgagcgtcacgcctcccaaccttctgtgttccaggcgctgtcgtgccaccatccaggatataacctgcaaatcccagaccctgccttgctgatctcactctgcgaaagaaaccaaagagcttgaacaggaagtcagtagaaaagacaaggccatcttgagggataccagggttttcagggcactgggtaccacaatatgagtcttagatgatgtaaaagacaccgagttcagaaacgtgaaggtggattgtgtgcactgggaggagcaatggattcaaggtggttagtggcattaaattattttgactatagtcaccttgctgtactatcaactaccaggtcttattcattctttctatttttttgtacccatgcaatgaacattttcttcgaaaggtcatgttgttgttcaaaagtgttttcaccttttgggctgggcacggtggctcacgcctataatcccagcaatttggaggccaaggtgggtggatcatgaggtcaggagattgagaccatcctggccaacatggtgaaaccctctttctactaaaaatacaaaaattaggtgggtgtggtggtgcgtgcctgtaatcccagctactcgggacgctgaggcaggagaatcgcttgaaccagggagtcggaggtggtggtgagccgagatggcaccactgcactccagcctggcaacacagcgagactccgtctcaaaaaaaaaaaaaaaaaaaagaaaagcatttcagagtttggatttttttgattagtgatgctcactctgtagtaaaatacctgagaaaggtgttgaagagcatttttgccatttatttatttatttagagacggagtctcactctgtcacccaggctgcagagacttgatctgggctcactacaacctctgcctcccggattcaagcaattctcccacctcagcctcccgaatagctgggattacaggcacccgccaccccacctggctaatttttatatttttggtagagacagggtttcaccatgttggccaggctggtcttgaattcctgacctcagataatctgcccatctcagcctcccaaagtgctgaaattaacgatgtgagccactgtgcctagccatccttgacatttagaagtaactgccagttggctgggcaggaagcggtggttcccttacatgtgactatgaatagaaaggtttccatggatcttggaatcacggtggaggaaggtgatggtactttccttgagggtaggtgacaggtgaggtgggctgttggcagaggaacgacttggctgtaacaggaattgaagagagaccaactctttcttttttagttgcttgaagttgaaagatgtagaatgagtggcttctggaaaaggagagaggggacatctttaagggtaaaaggcaagtctctccattcatccagatgatggtagtggaagatggtggagagaggtgagcactaaggcccaggggaaggaggagtggagtttcttcagcacagaagggagattctggagtgttctgaagccagcaggatgatggtctatctcatccccaaagaggggaagtgatcagttaggtcagttgttctctagagcagggtttggacatagatgggggaatggagcagacagatgccacaggaaaaatctcactagcctgcgagtttcacatggaatattcaggagattgttagtgaaaaagagagcaataaacaaacaaaccgaaaaggtttcaggttgagcctcagagctagaaaagtaattacgtaattccccatgtgttctaattagtctagtgggtttacttaaaaatttgtttttgagcatagataccaataagtcctctggtgagttgaaagaaaccttactagtggaagattaataaaaggaatagtgattggttagttttagggaacttcactgaaacaaagttagttaaatgggcttgcccaaaccatggaggttggtgtagtgacccatttggttaaatctggtgaccgttttttaccagaactttattagaacttagcgctaaagacagatgcttatttagggcacgtttgagttattattattattattttaaaaacagaagtattatttgttcttcttttcctagcctatgaattgaggtggattggcatcttatttatgagctgacaaacacatacctttttttgcagctgatgtgcttttttgaactgggttcagcattgtcaaaaagttattcacaggagttggtgatggagcccgctccacccacttctgttccctttctattttggtgccatttgcaacaaaggaaactaagtttgtaaattagagaaggattgaagctctcacaaatgcacttcttatcaggttgtgtaacagattagacagagcaggctcactcttgctgtggcacgtgggacccgaggaaacatccatgcaaactccatgaggtggccttggccaggggactcccaagttttctggccaatctgatttagttgcatttaaaaacgaacaattatgaagatgtatatatctgcatgtctgtatgtttatatgcacatatgtatacttgtgcgtgtttatatgtgtgtgtatatacatacgtatattatgtgtgtgtataaaattgccatttagcattctcaaaccaagggagatccagtgggcaacacattgaatttgacttttgcataagggtccctgatggaaatagatggcttttagttctcctaggccttaagtggactaggggaggcagaggagggctgaaagaacccagagagaggagttgtgtggagagagctgcctggcagggttgccactggtcaaagagggactcagaactagagaaatgaataccccatcttctgtggcgtcctgagatgagagctcccattggttggacagagagcggccctctaggacacagagctgggtgggggatagtgagtggagcctctggagaagcagatggaaaccatccaatgcattttgttctggaaacagctatgcaaggtaactgccataactcaaccaggtaacccatgggagaggtcaaggtgggaaatgaactccttcctagatcttcagggtggggatagagcctctagctttagagcactggttctcaaaggatggtgcccggatcagtagcatcagtatcacctgggaacttgctagaaattctcaggccccgtcttggacctatggaatgcaaaactgcaggagaggcccagcaatctgtgttttacaaacccccctggagatcctggtgcttggtcaagatgtctgtgagttgctggaggctcagcatatgatgtcagtttgctgagagggcctttgttggcatgctcagaaatgcccgtgatgagcatgttgtctgttatcaatccactgcttgaaattctgcagttcctcaatcctctttttttaggatagacattcttcaatagaaatggaatacttgattacatttaggccatggaggccaatacccagtgcagttcattcctttaatttttaagctcttctctcagctgtgcaggcaagttccagggcagacttttggaggttgaaaaatagatgcaaatgctgtctgtgctgttgttgttttcctggtgcctggcagtgtttggtaaacaacttgattgctaggtcccggcctcagggaaccacagctgctctttctagctccctgcagacttttgtactgagcagggattgcttcagggaaaaataaacaggggagaacaaaacaagaaaacatcacttgttgttttgtttctgcctctacctgtttttctggagctgttttgcaaccacaggccctgggatttgggttcctttgctttacagaaacaaggcaggccccggtggcattccacgcttctctctccatggctagactgtggcatttggagtagccacaggacttggaaagcgttggaaaggacttagtagccactgccagaacgcatgcatttttaaatatgtaaattgaaaagggagaaagcttcattctttctaatgacccccaagatggtaatctggcttttcaaatctctaggaaaacagattgaatatggcacaattaatgtttcagcacttctcggcttttctctaaaatatttcaatgggcttttaatttattgcagctcttgattagcagggttgaggcagggttactgctgacctcctgggccaaggtacttctggggctgtagtgaagtggaaaagaacaaaggtttgatagtgttctcagctggagcctcccagggatgagcccctgggggttcactgaataattccttcccctaaagtagtcagagagcaatgcagtgttcttcagatctttatcagagttacctggggtatctgttgggtagaacagcagattcctggaacttgtttaagaatctctggactatggagggtgggaacttgggcttcaagctggtgcctccctgcacactcacatttgcagtccatggccttggtgattgatattgctacagtgtaaataccgtgagctggggtagaaagcaagtgggggtactgctacattttaaaaaaatgtttgagacttgcacattgtttgttagtgcatttacttttcacttactctacttcacaagttggctgttccctaccttcttaaatcaaaaaactttctcctggaaattgtttctttttggtctgaagtaagtcttttagaatgtccttatagagaggtgataaacttctgtttgtttgaaaaagcttctatttcaccctcagctttaagagatagtttttctagttatacaattctacgtaggcgggtgggggtttctgtcatttttttcttttcttttttgtttttgcctctgtactgtggaaaggataatttatttgggtatctatcttctggtatttttaaaaatttcagttgctgtatttttttatgtctagagttcagaacagttaagtattttagttagctatggggttccatgaagatggaattcagtcctgtgactgttgaattcttaacaacacacacacacacacacacacacttccacacaccacagtggtgattcaccctttatttttagatatgcctggttactttaaaatattagaagtcaaataagacagcactaatgaccatacacatagagcattgtttttttttgtctttttgttgttgttgtttgtttcttttgtttttttagacagagtcttgctctgtcgccaggctggagtgcattggcgcaatctcagctcactgcaacttccgactccctggatcaagcgattcttctgcctcagcctccctagtagctggcgtcaccatacccagctaatttttgtatttttagtagagagggattttcaccatgttggccagtgtggtcttgatctcctgacctcgtgatccgcccgcctcggcctcccaaagtgctgggattacaggcgtgagccactgtggccggccacatagagtattgtttaaccgatttatgtcttagctagaaagctgctactcactccagtccgaatgaaaacgaaactcccacaggaaacctccaccagccctctcctcatggctgatctttgctgttgacttgcctactcctcacccccaagccttcgagtatgatattctgacctgtgaaatgcgttttccacccaatcttccaattcctcccaaaacctcaagataatgaattcttctagaaagctcttatctgcccagacacctactgtgcttttctgtgtcacccgtactgcttctctgtgcttctgaatcactctggaatcataaaactggagacagtgcatgacctcatccatcctttgctacagggattgcaacatgtttgttttgtttaaatataacttatttaaaaagttagctgccatctttgaaaaattctggaattttactaaatagaaatctagattactgcctttatttgtagaattgaaagctcttgaggttcttgagggtatgtgcccatgtggcagtaattggagggggaagtacaatggcttcccccttgaagctgataaagtgaggatttctcagcttgccacattccttccctctccctgttaccttacacctggccttcctcgctcatttgcattacctgcctgttacaaaatgtggcccatgattgttagtaccagcatggtcaggtagtgccaaaattcacttgagcaagcctgagtcagaagggtatatcacaaaaactcaggacttttatattagggtattggctggaaaatatagagttcccatgggcacaagctttatagagttgagtcaggctgctaaaactccctgtgcctcagttttcttatccacatattgagtttaaaataataatatctgctaagaactttgttgtaagaatagaatgaaataatgattataaaagacttaaaacaatacccagtacataatgagttttcaacaaatggcaattatatttttagagagtaccgaaaagttacttctttcagttgttgattcatttattcactcaaaagatacatattgagtacttgctatgagctgggcatttttctgaaattttggagcattgcgatgaaaagaaatagttcttttatctaattgagcttatattctagtggggaagacaaatgagcaaatagatcagggcgaaagctctgaagtaagcacataggatgatataattgagactaacttggaacctaacttaagtaggtgggcaggacaagctttttgaagtggcctttgtccctaagtcccagtactgagaagggaccagttgtgtaaagaatgggctcatggcatcttgggaagctgagatagcaagtgcaccagccctgagatgggaagacacttgccttgcttgaaacaaaaggaggaccactgtatctacattgattatagtttgggattgggttggtagttaaggcagcgtcagagaagtagaaagtggccagattatgtagggccctcaggccatggaaagaaattcaaattttatcctaaagatggtaaacaacttcagcccatttcttcatttcttttctttttcttttttcttttctttttttttttttctatgtgacatagacttcatggctttagggagcatgtctgagccttggaagtacttcttggatctcaaagctgcttggaggcttggagaataggactttgccatttgactcgaagtgtggtccatgattggtagtatcagcatctcctggtagttttctagaaatgcagaatctcaggcccactccagatctagtgaatcagagtcttcggggatgggtcccaggaatctgtattttgaaatgctctccaaaagatgcttatgcacagaagtttgagaagcatcaatctagaatacatctggacagatttctgcaggacatggagctatgctcattggagaggaatggaagcctttcctgggcacccaggggatgctgccagccgccgggatgctggctcaatagggttaggtactggtgccaggcttagcattctaagcgcttgaaaaactctctggtcacagcacatcttcagtgttgatggcaggtcagcatgagagtgaatcatggtaaaaacaaaacaaaaaccaaaaatctctttttaatcaggaagcttaaaggagaagttaattagtttaaagtatttagaagaaatatgcttctttcaaaaagacagaagcttagaggtagaaggaacttgaagagcatcggttaatgccctgaccctacaggtgaagagactggaatcgagatgataaatggctctcctggggccacactagtgactgaagaccataccgggtccagaactcaggcttctcagcttttgagccctgaccatcgcaccgtatgtgctttcttgatggaaacatctccatgagtattgctccttatgtaatccataatcatttttagaataaaatagaattattttggagaaaaaaatgatgattacctttcctactagttttaatgttcgttattagtactagtatttctaaaataatttaaaattatttaaattttttactttttttgttcttcgaaaaagatcataacttaatagggaatggtacatttatctgtgtaatattttagttaaaacagtttattgttacctgaagacttgataatgggaagtggtattttcatatgctaaaatatttaaaatatttggtacaaagcccataataaataacaactttacagtgtacgtgttgaagtgattagtaaatgtatctttcaaaacagtatttccggttcatatttaacagcatcacacttgatgtattgacataccctggcttgaacggtgttttcccctacctcaagaatctatgtcttgctgttttcaagtgtaaggaagtggtggttttagaagttacatcttagttatgtgtaaaaaatatttttgtgttgcagtgtcccagaagcttttgttgacaattccagtttccgaacaaaacatttcggcaatggtgagggcttcgatcccttctctgatttgctgtcagccatgaacggatggatgtgatgcctgctagccaaaagggtgagtgaatgaatgtttgtgattattcatctgaaaattcacaagacaaaaagtccttcaagacagttgcccacccaggatgagagattcttatcttgaaagaagggacaaactctgtcattgttttctggtgtaatcttttcagataattcctgcggtgatctgaggatttataaaaggcataataggacataggataacttcctctgttggcttgtttgttttaatcatactctgaaggatggactatctcagttttggtccatgtgcaacgttgaatgagtaattgtttttttggtcccattacaacttggtgataacatgagccaccaagaaataagacaacaattttttcatcttgagttttaggggaaatttgagtctaatttgttccttgagagagtcctatcccaaactttttgtatgatcaggacttatgagaaagccaaaggattggaaacttgggattttcaaagattttttgaaagacttctggaaatttttttgtatcataatttacctcattaggttattcattgactttttagggggaggttagaaaggacatgatgatatttttctctaagtgtgttttccatccatcctgttcctcagcaatcaatgactcccctgtagtaatgaacactgtgacttgtcattagcagagacaatgattggttgaggccaggcattttgggtgacaactctgacatcatttgtggtagccttgccattggatgaggtcagtttcatggagaaccttatcatttcagggtttgtattgaatagcatttaattggtaagaccctcatctttttctgtcttagtgcagtagtattggaagcaaattctaaataatggagagaagtgtagtgaagcagaaagggcactgtattgggagttgggaggcttaatagtaacctggcatggggcaaattaggctctctctttgattttttttcttttttttttttggagacggagtttcccaattgttccaggctggagtgcagtggcgcgatctcggctcactgcaacctccgcctcccaggttcaagcaatttttctgcctcggcctcccaagtagctgagattacaggcgcccgccaccatgcctggctaatttttgtacttttaggagagacagggtttcaccacattggccaggctggtctcaaactcctgacctcaggtgatccgcccgtctcagcctcctaaagtgctgggattacaggtgtgagccactgtgcctggcttgattttctatatctaaaacaaagcatgtaggttagaggatcctatcctatcagtgttattgaggccctggaaattatctatttaaatacctcagtttacaaatgggacagcttaagtcatgagtctaggtgggatggctaagtccctggggttggtctgggctggaccatagctatttggtcatcattcagtggttctttctagcttatttcaattacagagattaagacatcctgcccatttagctttttaagcctcctctgatgatatgtctaagacagtgttatgcattcaattacttgggccagatttgtgaagattttatagctagaggtcattttgacaaatccttccccttgtatacattaaaaaatactttagttttattgtccagagaaactgtgttcatagtgaagcaaccggctcaaatattagagaccagatgattttcaaagagctattggctcgaaaaggcacttcctgccacagtttgttaactgataacttgtactttgcatttggttctgctggagctagagagagagaaaaaaaaaatccagcctcctgtcttccctacagtattacttctgtcagtggcaagaaataaggcaaatagtaaacagtaacacacgggcaaggatgtccacaatgaaaagaaatggttaatggagtcatgaaattttagagctgttagtgatctttgatctttttactgggtggccttgggcaagttgttcggttctctcacccgtgaactcctgaggttttccattgctatgcatgtatgatagacttttgtggatggtctgtagattagtgaacaggcagcacatgctaagaaaagtcgtatcttggctgggcatggtggctcacgcctgtcatcacagcactttgggaggccgaggtgggtaggtcacctaaggtcaggagttcaagaccagcctgaccaatatggtgcaacctcatccctcccaaaaatacaaaagttagctgggcgtggtggtgggtgcctgtactcccagctacttgagaggctgagacaggagaattccttgaacccaggaggtggaggttgcagtgagctgagatcgtgccactgcactccagcctggttgagaaagtgagactccgtctcaaaataataataataataaaaaaagtcatatctttaggaattcaggtagagttgagaacaaagcctcggtctgtttcatatacacatgagaattcatcaaaggggttagaattctgaaggtattgaaataacaacaaactcaggtttttggttacctgtcatctctgtctttggtattgagagagtctgactcaatctcactattacaaaattgatatatgaaatttaacaaaaccacatgaatggatttgttgaagatgaggctcattttattcattaatttcaattggatttggcccattatttgaaaaatccatctgaagaactataatgaaaatgatatctgttttgaaaaaaatgttcttttaggcctagtggaatactagaatttttgtaaataaggcagttcttagtatttatcagactttaaaaaacttcccttctcagtatttttagtagaaggtagaggtgcctgaaatcctgtgagctggaccatatgttctgattttctattctcctcccattttttttttttaagacagagttttgctcttgtcacccaggctggaatgcaatggcacaatctcagctcactgcaacctccacttcctgggttcaagtgattctcctccctcagcctcccaattagctgggattgcaggtgcccaccaccacacccagctaatttttgtatcttttagtagagacagggtttaattatgttggccaggctggtctcgaactcctgacctcaggtgatctgtccacctgagcctcccaaagttctaggattacaggtgtgaggcactgtgcctggccccatttttttctcaaggtgcatttccaaggcttgctcaaaggactcactctcttcctctgtgctgcagtgactggccttccgtgcattatgcatctgatagttagtcattccattgtcaaacatttattcacagtcctgtgccttttagaactttacagtttattgaacaaccaaaagaagcaccaattaattgttacagctgacaatttggagtctttaggcttgaaataaactctaattctgagtgaagtgtttcatggtaagtgtcctcctggtagaccagggtcagagttacagaggtaggcatccagaacaacagattgcttcactcaaacacaaggaaacgaaaccatgaaataaaaggtttgcacagatagatcattatggccaactttttaaggtcagaagacgggtaatgtactcgattgatgccggcggtaaccatgcttgcataataaattaacttagaggcaggagacagcgaaagaagggctgagcacttcgtatctctctttgtgctgtggttatttaatgccaccgttcaccaggaaggagtcagagttggctcctgtttcctggtgtgaagctttagttgacactggtacctataggatgcacatcacaggacttccagagtgaaggctggcaatgcctgctgcatatttaatcggcagttagccacagtgttattaataaatgtgatcatagcaatttgcatttgcatagagttgttttgagaagggctgactagagatggcgaatgtgttggtttgttcgtctgtctctgctctgtcattgcatcgtctctaccactaggttgtcccttgctggtagatctggtgaaaagacataagcgtcacgcaacattcattgttatgtgttatttgcttacaactgttttcccttatttgcccagccttcctcttttgatgtctctcataatcaaattgctaccttttgacttactaggaagagacaaaaacaagggaaatgcatccttctcaccgaagacttggtgaagggctacttttttggctgggagttcctttctttttaaaataaaactcgagaatatggactttccgtgaccggttttggggtggggcggtggtggcgcagcttccagaaggtatgtgcagctggcaggtaccttgggccaggagagccagccgacagggttcctttctggtctgccatgtgctgcagcctgtcaggggccagcccacggtgttgtgcttaaacttccagtctctggaattttgactttgaaaagtaattttaacaatttaataaactacataatatgttttataagctggagcgaatgatcttaagtattttggtctctttcataacacaatgaacctaatattggtaaaaatacagatcttcactcacaccataaagagaggctagatttaataagcagttatgagtgctggcagctgcctatcagattgtatcactcgggctcccgcatgcgaagacagtgtcaacttacattttatctgtgaagtattttcgatgcgtttattttgcctttctctccagttcctaacccaatacaagtaatgtaattggctaaatattttccacatagctaactggctaggggccaaggtggaaaccattgtctggcttgatgaagatcagaaattaacatgacatttacgtggaggtaatggaatatattagtaatgtagtaattcaggatggtgagagacagtgtccatcccttcctgcccataagcagcaggaggtgttcagcagctgatgaaagaacctccacacccccaccccagttccctagtaccacacagcagtagccagcccatccctgtgtcaaatttacttttaagttcttcagacagaactgtaagacaaactaatgaattattccatttgtcaattaaaaaataaaccccccaactcctattttaagattaaattccaattagaagattgcatttaattcagaagctgtaacattgttttaatgaattctattggaggtgacagtttatgtgagataaatttatatagtgtagatagatataaattcattggataatgttaaacatgttacttcatatatattagctgtgaaatttatttcttctctggttaggtccctaaggaggtagagtcaaagggaaaaacatatcttcaaagaaagaaccctttctgtcctttcagatatttgctctaaaacagccttttctcacttttattaaaaaaaaatctgttaaatttctgcattaactgaatttatgattcttggtgtatgctatttataaaattgaatataggttttatgatataggaaattagtctaggaatgagaatatgatccaactttgtaataaaggtaatctgcatttatattgcatgtattttccattcctctctaagccccttacgggattatacacacatttttctggacatacaaattcaccataaacttttaatgtattgggcagactttcgttcacatgatacctacacaaaacatcaaaccttttggctaaattagaggtggcaaacattcttgacacactttcgattttatagttccccttttctgtgcccatcctgtgccttggcagacatcattgaattggtcatattctttcctttactgagtgtagatgtggcctcagaattattccacctaaattcttgtaggcaggcttacagagtcaccatttacatttacaatgcagtgtataaggtataaggccggggcttttgagcgatctttgcagtttgcctttgtatacccagtacttaccctaatatctggcagacagtttttaaacagtccatatttcacatattaatgaaagaatctgggctgggtgctgtggctcatgcccgtaatcccaacactgggaagccaaggtgggaggattgcttgaggccgggagtttgagaccagcctgggcaatatgtgtgcaccacattgacttgttaggtagtttattttctacccttcaactggtttttgtgttatgtctgtgaaatattatagttttgtagtgttttttttttcaatttgcgtaactttggaaaagacgagaatgagtctatgtcgctctctttttacctgtgtatcaactgaggctctaacatagcaaggaagtggtgatgtgagagccaaacccagactttcactctctgggtgcagttgctttctcatagggagaggcacatacatgccgggtgctgaccggtgcagggcaagtttcttacattttccttttgcatattaatcttacttcttatcaatacaccaaagcaagctgtaccagggaggaaggcatttagctattatatttcaaatgatatcttccgtgatgtaaaattctaggaacttaaactccattgcatgttgtttttgaaaatattctgttttctgttaagttggttcaagtaatgcacagaagcaaagagaaggaaatttccattcagtttatatgcaggctgctgagctgcctgttgagaattgccgtcattttattctgtcttcaagaaaagtaagcaattagtacatataagctatcatttagctaatgtacattttaattttatttcaatatgttgcatattattatttcttttggtcatgaaaagcagagtgcggaagagtgactgtggtgaacacgtgaattgttaccctcttggcccgtaataataggatgatacggttgactttgattaagggtgacaaaatcagcaggcccccgaaacagcaggcctgttctgatggtggcttttggatttttccctacagatattctatgtagcaccatccaatggattggaataggctcatgagataaaatctttttattccttctgtattcgatcagattttagtaatatttataacaaataattagagagctattcatcaggcacttacttttcctatgttggttcaagtatcaccttgcttatcttattgaaccttaacaacatctctgtgttctaggtattattctggttttaatgttgagaagagagaaggttagtgcataagtcacctgctcagaattgcatagcaagagtgagaagtgggttttattccaagttgggccaatttcaaaacctttgtcttaaccatgaggacatgctacttcctcatctttgaatagattccgtggttctttaaggtctttttgatttaggcagagaagattttgtagtttatacttgtctttgtgaaagaggtggaatctgacttatttaaaacagcagcttcatctgcaagatttttatagaggcagcaatgtaaaagggaatggcttcctccaaaaattttctccaaaatattcctcacctcctggctttttcctcagttgaaaaaaatctccccagagtcatgccactggattcaacactgcattatttctgtggttcttttttttttttttttgatggagtctctttgttgtctaagctggagtggagtggtatgtggtatgatcttggctcactgcaacctctgcctcccaggttcaagcgattctcctgcctcagcctccctagtagctgggattaaaggtacacgccatcacacctggctaatttttgtatttttagtagagatggggtttcaccatgttggccaggctggtcttgaactcctgacctcaggtgatctgcccgccttggcctcccaaagtgctgggattacaggcgtgagccatcgcttccagcctcagttattattcagggaacttttttctccctgttttaaaaagttgcatattgaattatctaagagtgaaatgacatgtcagttgcaagttcctttatgaatcttcagaaaataagaaaaaatgttggggcagaagcttgataaatctagaatctaggtgatggatataagggggtttactattttctctacttttaaatatttttgaccacttttattgtataaaagggatattggggagatgagaggcttatctagctcactgtctaatctagtcgttgataaaccaatcacaggcaggatagaaccaggcctctgcacccctgtcctctacccaacacctgctggccctcagctgccagtataatttaattgatatggggtcttagggcaaggagatgctgacctcatcagcccattttgtccaggagtaatttactggacaatacagatacaatgtctttaacctgacataccagcagtccccaagtaacttataaaatgatggcagttgtcatagttgagtatgtatgacatgccaagggctataatacgtgtgttatagatttttatctgtaatcttcctacgggcagtgtttggagggctgtagaggagacctgaatttagggcccatcagattttcttctttacctccacgttttgtgtttttcaaagtgtcatctcagcactgcctgggaagcgcattaaatacagactttcgggcccacactgagacacaggcccttagactggttagggagggtgtggtctctgaagttgagtggatagcctcaggtcctggccccaggactcaataataccgtaaccccgaccatgtcacaactccttccaagcctcagttttctcttctgccaaatggggacagtggtgtcatccacactattggctgtgaaaagtccttaatacagtgcttgacaccttgcaaatgttagatatatgctgcttgtaactgtatttgaacctttttgagactttgccaatttcctgataaaaccaagaatattgaggatgtagcaatgaatgctccaggtggcactatttggtgggtgaaatttaaaccttacatatccttgaagtatgctttttgtgattattaaaagcattttaaaaataagtattagagtttttacttagatgtttgaaaaagaattctgtcatcaaagtgtatgagagttgacaagtgtaaatatgcagttagacagtttcaagggacgtgtattatttactgatcaatgtactgtctcctttggagccattacactcagtcatttcctgtcaatctctccacgctgttataatcagactatggatatgcatattaaaatataagaaagttattgtgtatgtgtggtggcagctttttaattgttaataatgttgctgctttaaaaaggtatcagggtagtttactcttaggatggttaatattctgcagaattgcatgagaaattaggggaaccaaaattcgagctggtggataatgaggccaataggtgggtgtctgtgcttctagtcgttgccccggttacaaaaaaatgagcttttaatggtggtcctaatatggaggtaggttccttctgttcttttttcaaatttttatttatttttatttttttttactactgtgtttttaggaaaacttttgtaattaaaaaaaagttcgtgtatgtgtgtgatggtgggaggctcagtctaatttctgcctgtaacagggatcagcgaatcttttctgtaaagagccagatagtaaacattttaggctttgcaagccacctggtctgttacaactatttacctttgtcccctctaagcagccatggatggtatgtaaatgaaggggtgtggctgtgttccagtacaatttatttacagacgccgaaattagaatttcacatgattttcatgtgtcactaagtagtagtaggattttcattttcccccagccctttaagagtaaaaactagctcactggtggcaggttggatgtggcccacgcgcctatagtttgccaagccccagtctggaagaagattgggaagtagtggcgaggaccggccctttgttcccgctctctggtgtttctgctcgctcacttgctcttcggtttctgatgaaataataatgtcatcagtttttatttaatgcttatcttgagacaggctgttctgcataattattgatttagagtacaatttagtgaggtccttcctttacttaataaaagacaaaaatatatctagatgtaaaaatgaggttcaaggtgaagagtgaaatgaaaagggaagacaagtcaaagaagaaaagtagactttgaaaagtgacgtaaggctgggcgtggtggctcacacctgtaatcccagcactttgggagaccagatgggtggattgcttgagctcaggagttcgagatcagcctgggcaacatagtgagaccccatctctacaaaaaataagaaaaaaaattagccggatgtggtagcttgcacctgtagtcccagctacatgggaggctgaggtgggggggatagtttgaatcctggaggtggaggttgccatgagctgagatcatgccactacactgcatcaagcctgggtgacagagccagacgttggtctaaaaaaaaaaaaaagtgacataagaactatagtctcttcctaaccagtgttattaaaatgtgttgtatatctcactagtggaggaatttaaggtgaattttctgcaagacagaaaatttaaaaaaaaattttaaagttatgtattattaggccaggtgtggtggcagacgcctgtaatcccagcactttggtaggccaaggtggttggatcacctgaggtcaggagttccagaccagcctggtcaacatggtgaaaccccgtctctactaaaaataaaaaatcagctgggcatggtggcgcacagctgtaatcccagttacttggtaatcccagttaccctaactgtaatccctgttactgctgaggccggagaattgcttgaacccaggaggccgaggttgcagtgagctgagacctcaccattgtactccagcctgggcgactgagcaagactccgtctcaaaaaaaaaaaaaaaaaaaaggttatgtattatttttaatagtgttatatattaatttgtagcaaaaaataaacttagcacttcaagtctggcttctcagatgatattgctaattatgacattaataaaaatgtgagaagcttaaggaaaactataaagattactgtgcaagtggtacctgggtgcagcaaagcccttagaggtggtattgaaggattagaagtaggaacttttcttctaaatgttccttaatttatcatgagggaagacagcaggcgacatgtgcgtgtcagctgattgcgtctgaagaaatctctggaggacaagagtgatcagatgtgcatgtgaacactctggagagaagatgctgcaaatcctccctcctctctttgctggagatttaaatcttttgtgtcgtaaacaggtggaggaagtcagggcaggggaaacatggggaagagtgaatttgtggagtggggcgttttcataaaacggaggcctaggtagaaaatagcatcgagtgagaaaaggtgtgcgaagaaggtttgtgggcattattctcaaggcgcctttagagtaagggatggtggaagccccaccaagaagtagaaatgaaatgggtgtttctcaagaaaggtaagaataatctagaggaatatttctttatcaagtatcatgataaaactgacttgaatatgaaagagaaaaagtttctgattgtcaccaagtcagaatttatgaaccaaagtattgtttttggggttggggaataaacattcagaaaagacgactgactaagatgcaaatatcatgatttcacataaatgtcctttgtaataaaaaaggtaggaagtgggagagaggagacaacaaagataggcttgtgctgaaagctttgtaaattatcttttttgttaagtgaaaaataaatgcattccaggatccaagttaagatgtagaacctttgatatgtagtgaacatctacatgtggtaataagcatacaggatgttggccagacaatttgggctttaatcctggttctgccacctaccaacagtataatcttgggtaggtcatatctctctgtgcctcagtttcctcacctttaaaataatagtacctaactcataggtgatcgtgggatttaaatgagttaacacacataaagcattagaaaagagttagcacatggtaaatttttgtaaattacagccagctgttagccccaaagtttgtcctaagcaaaatatttggtttgtgatcattacagcaaagttgccctcatttctctaggatgtgaacttttttgtatatatatgtatgtgtatctatcaatgtattgtagtgatatatgtcatgcacattcaaagacagacattctgtgctcaaaaaaagaatgaaggatattgcctgcccttccttataccttgtgcctcagtgtttgaggcctaattaccactacatgaacatccacactgcatttgaacaacctgagagatggtgaatttctatccttgggaaagaccgatatatgtgtggccagctgttagggctaggaagttctttcttacactggactcaaatctaccatgcatgggcttcccactctggtttggtaccttgggattctagaaaacccatctcttctacttgacaagctatgaaagatttgaggagagttagcagatcttcttgagcccactccaggctaaaaatctcttgctccttcagctgttcgtcttttgcttcaattttgagtgccctgtgaccatgtgcattgtttcccacagcaccaatagtcatagagatatgttttattgatgtgtccacatttagatataattcacttaagggcacttctttttgacaaaactatctccatcatttgggaacgaaacattgtgactgttcttaacctacttcctaaattcgaaatctgagaagctggcacataaagaattataaattgtctcttgaaactttagtatgctggaataggcttttcttcatttcaagccaggtaactgtgtagaagtaaaggtggtaattccagttctagtacctgcagtagcagcatactgtgtgccagacactcggctcagtcctttggttgcagtagatcatttaagcttcatgatcacgagtctgttcctgtttagttttggggttttttgtttgtttgtttgtttgttttcttgagacagagtcttgctttgtcacccaggctagagtgcagtggcgcgatcttctcttactctgcctcccggggtcaaccaattcttctgcgttagcctcctgagtagctgggattacaggtgcgtggcaccacgcccagctaatttttgtatttttagtagagacagggtttccccatgttggtcaggctggtgtcgaactcctgacctcgtgatctgcctgcctaatcctcccaaagtgctgggattacaggcgtgagccaccgtacccagcctgtttctgtttttatttctatttccagatgatgaaagcagtggtagggtaaagttggagacttcggttagaaaagctcaagaggaggattttttggtaaacataaccaagattagttgttcatgtgtccttaatccttataatttttctgttctgtctacccaagaaatgatgtagtttatggtcttttgctttatctttttttttcttttcttttcttttcttttttttttttttgagatgatgttttgctcttgtttccgaggctggagcacaatggtgtgatctcagctcattgcagcctccacctcctgggttcaagtgattctcctgcctcagcctcctgagtagctgggattacaggcgtccgccaccacgcctggctaatttttgtatttttagtagagacggagtttcaacatgttggtcaggatggtcttgaactcctgacctcaggtgatccacctgccccaatagtcatagagatatattttattgatgtgtccacatttagatataattcacttaagggtacttctttttgacaaacctatctccatcatttggaaacgaaacagtgactgttcttaacctacttcctaaattctaaatctgagaagctggcacataaagaattataaattgtctcttgaaactttagtatgctggaataggcttttcttcattttaagccaggtaactgtgtagaagtaaaggtggtaactccccagtcccagagtgctgggattacaggtgtgaccaccacgcccagccctatcctttgttttaatgcatataaattgtgcaagtgacgtaaaagttaccccctcccccttttgggatagtctgcttttattccattgaaactattcaagctaattttgagttaaagatactgctattctcaatgtgccagagcccacacacacaacactggggatggtgtacttcattttctttcagctttctccaagtgactttccctccccccctcctttcaacaagattctcagagaggaagccaatcacaatgttactgggcatgggtatcttgagggatggctgggtgccttctatgagacttaacacatttcctgaacatggtgcctcaccatggcaacagccatgtcacacgacacattggtgacacatgtaaggtgctgccacaactcatcccaggttgaatgtctgtgattcattgtttccactgacacagtgactactgtaacttgcagttggaaggttctctggttttcagtgccattaatgcatactgactcccatggcgcatggagggctcagggaagagaagcataaataaataagtgcaggctgtaaacattgccttcattagctttgcagagaaatacttgttcatcagtcaacctccttgccactctcattcttctttttttaagcatattttgttggtaacaccttggaagcttgaaaatgatttttatttttactcatagttgtacccatttctacttggcaaacttcacaagagagagttcatggtggcccctttttagtatttattcatattcttcacatgtagcagatttattgatgcaggcatgatcctgggaatatttttttctcattgtgaaatataatgaatactttacataaatcagatggtggtattacggatccatggcttatgtagggggctgaaggttgtattctatcagaggacttttctagaggtccaagataggtggtattttaacatattttaatttttgagtgattcagcgagtgattaaaaaagaagatgtggaatctggaagacattaaagagatgtcaaggacagacgggttttgatttgtagcctaatgaatgttttgccaacttttaaagatttttttgagagtagaactttaaccatttgcttgtgtttctggcatggtaaggttattcctgtttctgttataatgaatccaaagtgaaaatgggataatttttaattagcaaaattataaaacgatttgcagccaaatgtttcttgtcttgtataaactgtgaggtttcacattttactttaatcattttaggaaatttcattctgaagatctatttcagttggtacttcatgtatgcatacaaatcttcaatattagaaattaccttgtaatattcttttccattgtcacttgaataatctgacaggatttcagtcatgtgcattgcttgtgtgtattttgtaggtgtcatggttaccttagttggatgtagcactaatattcaatctagcattatgaatgcaaggctcaacatcataagagaaatagaaatcaagggttagaaatgtttgctaactctatgttgtatggttttatacagttcagaattgcttttgtcgagcttacctatgtaattatttgaatcaaaaattttatatttttactttttgctataaataatagagagctatttaaaaatatattttattaaggaaatgagaacaatgagttaagtcatggcaacctacacataattcccagacttttcattttatgatgcttcaattgcatttgattacgagagttttacagtttctggaggctcattggagccctacatggagatgaaagaattctatggaaatgcaaagggatttaagtgttcagaatttgagcatctgcctagaatgggacacttccagcaccttgaacttttctacttgctaggtggttgggaggcctgcagcattgtgtgctgcttttggtggatcttctggggggcgctgtgtcacacctcattgtgcacctgttgctacagaaagaaagatggcggaaaccagccaggcaggaagaaagctgtatctgcaacactagctcaaggctctggtgatacataaaggccctcaccttttcttatttgtctctgaaaaccaaaggtgtctcttaacaagagcaagagggagaatgagataaatgtcaataagtttccttcagatgagtaatttcttaatgaaacagattattaaagcttaaggttcttggggaatgtcatagacctaatcagttattattaagctgcaaataagaccaaaggacaggaaacataatttaagaacaaacacattaaagaaaaccatcaatgcggcccggcgcagtggctcacacctgtaatcccagcactttgggaggccaaggtgggcagatcacgtgacgccaggagtttgagaccagcctggccaacaaggtgaaaccccatctgtacaaaaatacaaaaaaaaaaaaaaaaaaattagctgggcatgatggcgggtgcctgtaatcccagctcctcaggaggctgaggccggagaatcgcttgaacctgggaggtggaggttgcagtgagctgagatcgcgccattgcaataacaaaatggcatgaaattttacccataacccgaggactcattctgcaatgaaatggcagtcgtagacataactgatgtgtaactgcacaccacctctccatccaccatcaaatgaaagaaagaaagagaatgaaaggaaaccagaagaaatatccaacagaaggaaaatagttaaccaaattatggctcagactagtttggtttaaccattgctcaaaaacaaaacaaaaaaaaaaaaaagaacttgatgaatttatatttaaaaaagaaaatatgagatagatttctttctaaattaattcctttcatccactataaacacaacacatccataaagattccctcatggattataacctgattgggagaaaaccactttcagtcatttccattgtgtggaccatttactgacatatctagttgaagagtcacttaacacactagtgatgtttcactttgaatgctatcggataatctgctttcttgaggttgtgttctactttgtcatgtagacttgtgcatttcataccagaatgtgtataccattagcaccccattgacgtggtaaaggtatccccaaatcatagaataatttattctggtggatctccatgaagaggttttttttttttttttcccttgaagagtttagtaggaaaatacatcatttttatattttatttttatttttattttttgaggtggagtcttgttctttctcccaggctagagtgcagtggcacaatctcagctcactgcaacctccgcctcccgggttcaatcgattctcctacttcagcctcctgagtagctgggattacaggtgcacagcaccacaccagctaatttttgtattattagtagagatggagtttcaccatgttggccaggctggtctcgaactcctgacctcaagtgatctgcccacctcaccctcccaaagtgctgggattacaggcgtgagtcactgcgcctggcccatttttacattttaaatggccaaattaatgctgttgtataatgcaagattttgaaggttttcagtgatacttcctgcctacttaggtcccctttgatttgtgcctccagacccttcctttctcatgggttgacatttaccaccctctccctttccccgattgccatggaggtatattttggtgggaatatttgagaccaaacgtattttctgtgctaatcattacttcttaaaaaattatagttgctccttcttccactgagcattttaatcgtggagtttgagcatcttagcctgcttaataaaaatgcttgggtgttccttgcacatgataggaaattataggacggcatggggttagcatccaggagagagggagggtcttgggttgggggatggcattggaaatagaagcaggggggaaggtgagatggaataggaattgtagtgagggctgagaggatgtgagggctgcctgcaggtgggagccataggatggagaagagaaaatcatgacttcagacttgagcttgcctgacacagcggatggcagtgtgcataacagagatgggaaactccatgaggaaggcttcagtgggcagggcctgtaaactacagcagttctccagccttgttggcaccagggaccagaatcatgggagacggtttttccatggaccagaggaggggatggtttcaggatgattcaagcacataacatttattctgcactttattttcattattattaccttgtattatataatgaagtaattatacaactcaccataatatagaatcagtgggagccctgagcttgttttcctacaactagatggtcccatctggggttgatgggagacagtgacagatcatcaggcattagattctcataaggagtgcacaactttgatccctcacatgtgcagttcacaatagggtttacgcttctatgagaagctaatgccactgcttatgtgacaggaggcagagctcaggtggtgatgtgagctgtgggcagcggctgtaaacacagatgaagcttcacttgcttgcctgacgctgacctcctgctgtgcagcctggcttctaacaggccacggaaaccagtctgtggcccggggactggggacccctgaactagggtactcagaatttggagatgagggtcagaaatctgtctagaaatacccaggtgacagtcataatttatctttcttcaaaaaccttcttgttcttttctcttgatcacatttattcaggagtggttgcactctactcttcttttctagtcctcttttggccagttaaatgtggtttaggttttttactgtttcatgatcaattatactatgcttaagccacagagagaaaagccactaattctcgtgctattgtgaaacaataaaacatctaagtgtatttccttctagtcttttttggaatttaaataaatatatagttgcaattatcttgtgcttataactttttatcctactttcttttcctaacgtaactattttcatattgccatattatcttttatgaacggtgtaatagatcatccagtcattacacagatattattaggtgcctactctgtgccagggcatgttcagtatctttcaggtgacatgtcccacccatgtagggcttcataattaattactgtctttctccatgaggacgtcatcactattagagatgtaacagttctttttgtgtgtgtcatagcttgcagggtatttattttgcaggatgcctcccaggtcgttgtgacaaccaaaaatgctcccacacagctcctaatatcaacccccttctaactcccaattgaggatcaccagtttaaaccataatttggttaactatgttccttctgttggacatttgatttggtttccttttgttctctttctttcatttgcgggtggtggcggggaggtggcgggcagttatacatcagttgtatctatgactctgccatttcattgtagaacaggtccttgggttataggtggtttttcctgccactttgttacttgtgagaaggctatacacaaaattttgggacaatattttgacaatgcttagaggaaggacatatgacatgaggggagccacttctgaataagatctaatgttggaaatttttgtttcttcctctcagttccttcattttttttcacatcgatcctatctaccagcccaaaggtggagtgtatttcaggggagcatattgggccatagtactggagaatgtttgctgacccacaatttagggtctcacttaaaatcctagttctgccatttcctagctgtatgtacctaggtaaattattccatccagttgcatctctttttatcttcctctgttaaataatagtatactccacagagagctcctgtgagattaaatgagctatgcacgtgatgttattctgttacctaaaatggagaccagtgtttgtctaatggagtgtagtggttacagacacaggctctagtgctaggctatgtgttcaaatcttagttcagttattttttagctgtctggccctttcataagttattttgccatactgagccttggttccccatctgagaagttgaaatttaaaaaaatccctcttactgtgtcatcataaggactaactaattgaaggtgccctggagtgcaatgcctgcatgtggttggagcacaccataaatggcagctgcagagctagacatatcttggggagtttgaataagtggggttaatatgtagactagttttctctgttctcactttgggggaaaaaccaactagcgtttccattattctaatctacttctcttatggactagaatagttaaaattaacaaaatgccttgttaggagtaaaatgggagcttggattctctttattatttgttttctggactggggtttcctgttggagttctgggctggtttcaaagtcccagatgctgggcagaataagaagaggtcttccctcagggttggcatcatttacttcattgaagtgaaatagcgtgtatcagagcaagtggaaccgacacccaaaatatgacttgaagaatgtaatttaaaatgtagcatagaaaaaaaaaaaggaaaagtatgattttacatattttcagaacttctactgaatcctctcggacccataagatttttcattttttggtcaatcatttttgtatggtttgtgtcgagtgtttattgggtatgaacagttctgtaccttctgtcttgaaagtctaaatctttattccttaccaagaatgatggaacacagttaaataggggaattcacataatccagggtgagagtggtcctgaggaggtaaaaacaaacaccctgacaaaaaggtatgtcctctgcaaaataagaattccttacttataactcctcccccaacaaaaatatgaccctaaaggcaatgaagcacacaaaacataatgaaaaactataaaacgtaccttctagcatcgacttttagtgactcactgacttcataataaaatgtaaatgtaattacatttggccatcttctaccattaggcaaactggaggaagaagtacagggaacctctcccagtagggctgtagaacaaattcagataaatctttaaacctgggagtcacctggtgttatgctgccgggtctttcttggtctgctcagatggaaccactttgaatcatcagaacatggagttatcattttattcacctgggaacgtggtaaagctgccgctgtattccaggattatatgattcttaagatattggtgattcataaagtgacacagtaacaaaacatgtggggtccttgaaggtatggctttcagggtggactgtctcatttctacctttttttttcttttctatcacttgagtattcaatttgcatgtccgctataaacgtaaacttagcctgtgttccatctgagttgaaaagaatggaacattgttatagttttgcctaaaaggaaggccctgcagttgttttgaatcctttgtggaatgactagaaggtgtatactcaaaacattcgtttgtactctgggtgattattggtgggatataccatttttgtgttatattgggtacagtagaaaaatctgaaaagtgtgacctaatattcccattgacaaacctcagttatttcgccctgttcttttcctttataacacttgtcaaagtttataattatatacatataattaatttttggtgtatgtttactataacatataataaacataaaagtgtacttattatactatataatttatatatataattaaatatgtgtatttgtgtatgtttattcaatgtaaacttttcccctttggggtgtaaacctcataagagcacagaccatgtcaatttttgtaaccatctagcacacagtaggatgcagtaaatagttgttgaatcaatgttttgtccaagcaaggaaacagaataataatggtgaacatgtatttaatatttaatgtagcagattctttgtgaaatgctatacagggattatcccacttacccttgccacaagtctttaggtggtcactctctaactgctcccattgtagaggtaggaagctgaggcttaggaaggttaaggcacagactcatggtcacgtgggtgcaagtaccattcaaatccagttctgtctgtctcagaagcttatgccattcaagactagttgatacactgaatagttgaagtttatgagatctcctagttcagcagtatttctctctgcaatattcagtgttttcttttcttttcttttctttttttctggagacagaagtgttgctctgttgcccaggctggagggcagtggtgtgatatctgctcattgcaacctctgcctccgggttcaagcaattctcgtgcctcagcctcccaaatagctgggactacaggagcgcacaccacgtctggctaattttttgtatttttggtggagacgcggttcaccatgttgcccagactggtcttgaactcctgagctcaggcaatctgccctcctcagcctcccaaagtgctgggattaaaggcgtgagccaccgcaccggcctcaaacgttgttttttaaggaaagccattaggatttgactcaagtcattaagaaagaagaattacttatgaataacaacaataatagtaacacacattctcttagctgtgtattaggtattccactaagctctttgtacaaattaactgattttatctgtataacaactctatgtggtagatactgttattattcctgttttacagatgaagaaacaggctcaggaaggttaaggagatgttaaataacttacccacggtcacacagctagaatgtaggagagaacacattaataaattactttagaacttctttccaaaggacagtaggagctagagactcaaaattccttttttatgttttatgaatattttatttttattaattttattttattaatattttattttattttatctgcaatattttgaaatcaggaggcagttggaaagcgagaggagagagagatcaccagggctgtgagtttttagagttcatagattaccccacatgaggccatttctgtcctacagacaggatgctgcctataggtgttgctttgaattttatctataggcataagaccaaagaacttgcagggatgtggagagctactgcacatcatctgtgtgcaaaattcactgggggggaactgatatttgagaaagttccagtgaaaaatcgggctttcagttgagggtggtctgcagcttttacggtttttagctccctggctttccattttggcttttgcttcttttcctccctcattacattcagcaaggaaatggacactctaatatgatcatcaaagcccagctaagatttcataattaccagttggtaatcaatgtgaatttctgtgtgggctaagtcacttagtagatgttattttcttcatcatactcccatttggatcccaggaatgactcaagaaatttgcttctttcctcaattaaaatggaaacaattttgcaactgtttgtttgagggaagactggctttacaagaaggtgacttagaaggggtggttttctgggaaagagattaaactatagaatggtcctgtgtgttttaaataatgctgacatattttgttgatgctggctattttatttgattgctatccgttctgaagtcttcccctcctttttccttctttgaaatctgttggttactatggaaacagtgttgttttgggtttgggtggagctgtatccacaaatgcagtataaagtcatttataaaatgggttaatatttattctggctgggcatatatggaacttgatgtaatgataatcatgatcacacatgcagaataaatttgcacttttattgttattttcttagtcagtctaaatgtgtgccattttgcttggaatgcactgtcatttcctctctgatttggatattgccatttacaaggcaacacccagcgccggtggaattgctctgagttggaagtattcgacaggcctcaaacatccctgggtccaaattctcattcaggagagtgactcctgagatatcttttgtgtcttgctcaagcacccacatgccaacgtggtcctgctcgtttttctctttcagatcttcagtcaagtggagttgtctggtgcttctcctttcacactgatgcttgtgtcagcagtgaagtgctgttcttaaaagcctcacatgattcaggatgtattaatgagagtccatgaaagagtcacggccagtgacttgtccaggccccagggggaaaacaaggaaagggtagggatttgggaaaggctgtagaggtgatccatggcaatgatgaaagggtggtgaatgggatctttttagaacggttaaaggaatggaaactacttaacatatagaggagaagcctggtttgggggtgggtgggagttttaatgtctttatacataacaaaaggaattgtaagcaaggggctgttcaccccgctgttctccagagacctaacattagaaaggtatcacgtgtcgaagagcaggtgagatccctgtgtgatgtgagaacatggcaagagtctttcaaggtagcccgactctggaacaggacagtcacaccaaggagaaatgttggggtccttcaccttcacgtcaatcaggcatacttattgacatttggtggctgatttgcaaatcctttttgaagccaagcaatgacttagatgaccctttggaaatttcttacagactcctgagttcaatttatgtcatcatatcgtgattgaatttttgaaattcattttttcaaatgtttggacaggtatttttatctcaccaaaaatgaatacaggaatgtgaaagaaaaaaaaaaacattgcttctccaaggattaaaaatcccacctaatgaggactgttggaatgatcaggtatcttgatcttatatttaacaatgctgtgaccctttatggtaccttaaataagggtggatctacttttccaagtccattcagctaagaagagttttggtagatcatgaatagacttgtaacatattggaatctgtggaaccttgtagattgtcaggattggtggctcacaaagcatggtccctgtactgcagcatcagcatcatctggaaatttggtagaagtgcgttcatgggtcctattccagacctcctgaatcagaaactcaaagagggagatccaacgatctttgttttaacaagtctttcagtatgagaattactgggctccaccatccctcatttacttagaagattagcatagtaatataaagttttgggctaattggcagtctttgtcattgttgccatggtgaccaattaacctggctcaggaaaaggaaagtttttttagccacaggctacccccaactatcttataaagacgttttcttcctttaatacaagagctgtcgtggcatggctgaggacacaccttgaacaatagtaaggaggaagtccctggataaagggccgccgtgtcttagaataatgtattaaaatcattttcatcagtcatttctttttggggagattccatttgtccaccacccacccacctacccatgtatccttctattaacttgtcttttcatccatctacccatccaatcatccaacaattctttgctgaaatcctacttcgttccaggtactgtgtggtgaatgaagcagaaggaagaaatttatcatcctctgaacgttactggtatataggtatatatgtgtgtgtatgtatatatgtatgtgtatatatatgtatgtgcataggcataagtatgtatgcatgtacgtgtatgtatatatacgtgtatgtttgttatatacacatacatacacacacacgtacacacacatataataatgtttcctttttctcaagctcgcaacatctgtggtgcccaaagcccaagtacccagtcacctccttcagcatttttttctttttgtttttctggccttgggctggctccccaacccactaaattctcctgcagtaacatgagttttcccattgaagctaagtgttcattaaattgtaaagacaaacaaaacgtatccaaggataagtatcacttgagaaacacagatgtcatcattcctggcatgtgtctgtgtttagagcttgtacctgcgtctctcatgtagaactatatggtaaggagagggaagatgcaaccccctgccctaggcagtgctctttgtgaccttcccgatggtcggatatatctttctactttctccctgtaaactctggggtggggctcacgtccctgcactcagcgctgagtcagcatcagactccgcctccattgtccagtgttgttttctgcacccaccccctaagctattttctcaatggaagaggaaggaaaaaaaaattccgctgaaaacaatccaatcccgatcagattcgcatagcataataaacgcttgtttggacattgcttggactgtcattttagcaagaatcttctgtttgattaaatagcttctctgttatgtattgaacaaaatgaaatgtatgtcataacagatataactagatgatgacaactttccttgactgtgaatttcattaaagatatacatttgtgttgtatccctttgaatgacagaagttgacaaatagctggggaaagttgttttctggagaaaagttagcagctcgcctgttcagattttttccaggcccaagacaaaaataagggcaggccaggaaagcagagaggttgggtactgtcgagcagcagtcagtggtggagagaaggcagaggaagcgtccttgaaaggtctggggcaggcttaggatgggctggcatctgtttccaaggggtctgtacgcacttgtgcctggttgccagctttataagtgtttcgttttatctgtccagcatgttgcttagatcaatggtccccaacctttttggcaccggggacttgtttcatggaagacagtttttccatggatgcgaggggttgggggtagtggtttccagatgaaactgttccacctcagatcatcaggcattagttaggttctcataaggagtgcacaacctagatccctcacatgcacagttcacaatagggttcgccctcctgtgagaatccaatgccgctgctgatgtgacaggaggcggagctcaggctgtaatgcttgcttgccctctgctcacttcttgtgcatccggtttcctaacgggccatgggctggtacgtgtctgtggcctgggggttaaggacccctagcttagatggatggaaagatggatttgctctttttttaaactcttagagcacctccactgtgctaagacaacaatgagtgaaaccaagcacggaccctgcccttgtggagcattgcatgaataaacgtgaggtttcagtgccatcttcagtgatgtaaaacagaggctgtgggacgtgcacaaggttagatttcacagagcagggagttagacggcttaggttagaccacgtcctggctgttccatcttaagcaaattccttaagcacccagtgcctcagttttcccatctgctgagtggagatcatattagtctccacttcatagcattgttatgaagaagatgacaattctagcctggccctcttcttcttcttcttcttctttttttttttttttttctgagacagagtttcactcttgttgcccaggctggagtgcaatggtgtgatctcggctcaccacaatctctgcctcccaggttcaagcaattctcctgtctcagcctcccaagtagccgggattacagacatgtgccaccacgcccagctaattttgtattttcaatagagacggggtttctccttgttggtcaggctggtcttgaactcctgacctcaggtgatccgcctacctcggactcccaaagtgctgggattacaggcttaagccactgtgcccagccttagcctggccatcttctaagtgcttacaatagctcactggatccacacatggtagaaaaccctatgaggcaggtgctacagtctccattttacagatgaggaaactaagggttagatgtcaagtagctcctatgaggttatgtaaggggaaggggggcagtttggagactagacttggggcagtctggtttcccacttctgcttagtcccctgcttgccacaaagtcagtcctctgtgtgtgccacctttgtaatggctagtcaagggcctcggcttccctgaggaagtgactgttgagcggaaatcagagaggccacttgtcttcagtcatcccctcaccttgggggtgaaaagggtagagcagaggccagcttgcttcttggcagtgcctatggagaagggctgttttttgaaagtgccaggtcggggggagggcatcttgctatttggcttcttgacttcccaactcccaggagccagaggaaccctggctccagtcaactcccaaagaggctgagcatggaacagtagtaacttggcctctgattcaccttccccctctcaggagagcactccaacttgtgtggggcctttaaggagacatctctggggccctctttggaggtcgctgactttggcagtgagccgagagccccgcactgtggggagcagggcattctctggggatgctggtcacctgctcccgacttgcagacctgtaggcagttaccttgttttccttctttttgagacaggatctcgttctgtcgcccaggctggagtgcagtgatacgattatggctcactgcaacctccgtctcccgggctcagttgatccgcccacttcaactcccaagtagctgggaccacagcatgtgccatcacgcccagctaatttttaaatttcttgtagagatggcgtctccctatgttgcccaggttggtcttgaactcctgagcttaagcagtcctcctgccttggcctcccaaagtgctgggatagaagcgtgagccaccatgtgtagcctgttttcttaattagtgtacctcatttacagattggtaaactggacactcagcctttgcagaaatgtatatttgatgccacctctcaatcctgttcaggctggatcccctcttgccagtgtcttcctcttggccagcatccatacttccgttattacaaaatatatgcctctgcaggtgctgttcttggtcctagccaagaaccaagagtagccagacaaaacctccaggacatgattaattgaactgtgctgtgtttggggtcaagacgcagtcatgatagttaccctggtagctgctttcttgctttcattaaacagtgcctttaattcagggaccacaaagcatggtacaggcattaattgaaagtacaacaccccgtgaggtagaagttgttatagttatcttcgtatctcctggggagagaccccagcccagagaatctcagcatcaccattcatgtcaggcaattgggagagcctgttgcatacagctccttagtgtgggatgtcttccctgccagcagggccctgaattttcctgaacccatagccatgtggtaggtgtgagctgttttccaaaggtgacctgtggtgggtatattcccccttggtgagttttttttttttttttttgagacagtgtcttactgtgtcacccagcagtggtgtgatctcagctcactgcaacctccgcctcccgggttcaagcaattctcgtgcctcagcctcctgagtagctgggattataggcctatgccaccatgcccagctaactttttgtatttttagtagagtcggggtttcaccatgttgctgaggctagtctcgaactcctgaccttaagcaatctgcctgcctcagcctcccaaagtgctggaattacaggtgtgagccaccatgcttggcctccttgacaagttcggaggtctgagaatgacaatcacagagaggagaggctttcctgccaaggtttaagtcatttgctggccttgcaggcaggcaccttccatgtgaaaatgcacatttggttgattgatggggcgtaggaggtggttttatacatggtgctgtctttggcatagcattggttttcgagagaagacctggggtgaccagcctgctaggccaagttcagcagtaaactcaagtcagcaatatatatgtggcggtccttaatctggaccagatgaagctacatcacacacaaataaaaaacatgttgaaggcggtggctggtttgaattttccttcatcggatgactagaatacaatggagttacacggaatttcttctgagtcaagtccagatttctaacatagatgcaatgatttccctctcacatcttcactgatttttaaattctacggaggttttggctgaagacacctggtgaaatttcagctttacacgaatgggttctcacttattttattctgtcttagaaagttgaacggcgactggagcttaccaagaaggagaactttatctgtgtagttggcccatcatggatacgtgattctgtgaggctgagtgtacctctgaaaagcctagtgcactccagaaggcaggtggaaggtgttgtttgaagtgaaccctattttatttttctcaagaaattcttgagctgattctgtgacatgaacatctaaacagagtaaccagattccaactgcatgactcgaataggtttacacatttttcttctgtcccgcctttcaaacaaaatggtaaataacttcatttccaggccagtttagcattcccattttttaccctgatgagtctcattttaatgagcaatttgctttatccagtagtgcattagtgaagtgtttcctgattttatgcggcaagtgtttatgtgcagtcctgtaaggccttcctcttggtgaattcctttctctactagtgaactatttaaggcagacaatatcaacaccaggtagtgatagttccagttttatgggacgtccttgttagcattcaggtatccttgattctcccctctgcctaaagggagtgtcagttcttctggggagggttaagttctctcagtgttaatcactctttcttagaatgccaagccctgccaatcttctcttgatggggtaactttacactgtgataccagagacctgtggtccctgtaagcagttaccttgttttccttcttttttttttttcttcgatacagagtctcgctctttttcccaggctggagtgcagtggcgcgatcttggctcactgcaccctttgcctcccaggttcaagcagttctctgcctcagcctcctgagtagctgggattacaggcgcctgtcaccacgccctgctaatttttgtttttttagtagagacggggtttcatcatcttggccaggctggtcttgaactcctgaccttgtgatccacccgcttcggcctcccaaagtgctgggattacaggcacgagccaccacgcccggcctcttgtttttcttctttttgattttttgagacagggtctcattctgtcgcccaggctggaacacagtgatacgatcatggctcatttaaaactgatgtcataaccctgcagaatctaccgtacacttactatgttgcatgagatctccttgaacactcgtttctgggtaattcgtcgatctgtgtttttagacgtgatgttagtttgactttttacacggaatgagaataagatcatcaacccactttattctaatatgaaacaaaagccattgtgactgaaatggagagttctgtgtgactcacaccaccatataatatgctttgtacacagagttccaaagagatttataacttttaggcaccattttattatagctcgtactgatgaaactcaagaatggacaaagtctttttaacttccccaagataaaactcaaacctctctctacaaccaaacaaacaaaaacgtctaagaatttaggtttcagtcacaaattcctagatgatattgcccatctctttattgtaaaactgtaccggttgtttttttcccttcagcttgtcagagctattcccgacagtcaaaggcaccaccatcagacagttctaagaagggaatttggcttaattctccacattgttctttcagctagatacggtgtacaatcaaattttgctaagcttacatggttgccactcagaatgatgaattctctcagctaccagtgtataatgtaagactcttattttccctttctttgttttaggttagaaaaattaggccaggcgcggtacgtcacgcttgtaatcccagcactttgggaggccaaggcaggcagattgcctgagctcaggagtttatgaccagcctgggcaacacggtaaaaccccgtgtatactaaaatacaaaaaaagttagccaagcctggcggtgtgcacctgtagtcccagctacttgggaggctgaggcaagagaattccttgaactcgggaggcggagattgcagtgagctgagattgtgccactgcactccagcctgggcgacagagtgagactctgtctcaaaaacaacaacaacaaaaaaaaacgaaaaaaaccaaaaaatcaaaaattagcggggcatggtggtaggtggctgtgtcaccagctactcgagaggctgaggcaggagaatcgcttgaatccaggaggtggaggttgcagtgagctgagatcacgccactgcattccagcttgggtgatagagtgagactgtcacaaaaaacaaacaaacaaacaaacaaacaaagcctttactcctctagaccagctaaatggtttgctaatatcaagaagatggacgaatcacgaggtcaggagattgagaccatcctggctaacacagtgaaaccccgtctctactaaaaaatagaaaaaattagccgtgcatggtggtgggcgcctgtagtcccagctacttgggaggctcaggcaggaaaatggcgtgaacccgggaggcagagcttgcagtgagccgagatcgcgccactgcactccagcctgggtgacagagtgagactccatcttaaaaaaagaaaaaaaaaaaagaagatggggcctgatatattattttaggatccaatggcacgtaatctttcttcttaagttctaatggccaagaatactataaaaaaagaaacaaatcagcattcatttcctatgaaaattgaaatcagcttaacacactgattaattatctcattcttctgaaatcatgatatatagtctttttcatgtgtgtttgcctttcttaaacacattgggaagcaaatgttttattttagctgtatttgaatttggaggctaaaataatatgattttgaatggaatatttatttgtgatgaagggattttaaaaaacaacagccccatatctattacatgagggacacaagacgaagagggagattgccttttggcattctttttgtgacaatttcacaaatctttattaactgaatagaaaaaaagctgcgttaggaagggaactagagagactccatcatctgttcccctgtaggtaatttttacacctttttcagtatttaaatacttcttaactgctagatgtccatctgtatccccttcttgggtctcagaactagtgtatgaagcatgaccttgtaacttgctttgtttatacatctgtcaggacaatatgttatctttccttaaaaatgcaaatgtgcttcttgcaatccagagctcttcagtcaataaataaattgaggtaaagactgtacctaatacccatttaatttaaattcattttataaacataaagacgccttttaagagaagctttaattcctactagcaccttgatttgtggttaccatggagaatcaaatctgtcatttgacaagaaaagtcacccatttatgacagcactttatcttgtctctccaggggaagaaaatgtcaaaagtgagagcagaaaaaaaataaagccttgaaacaccagaatttcttgatttcatttttattattcagctatcatatcctttctgataatagcaacttggtgaaaataaataatgttcctacagtaaaatcaaatatttcctattggaatggacaaggttctttgtgactgtcagtgctgtgaagtctggcaagaaatagtgttattagataaacctacggtgcccaaatcccattttcttttcattatagtgtcaaaataattatacctgtgtaatttgggtaagaaattgcagaataagtaaaatggtccattgcaagagattgctttacgcttgtgttccttacagggtggggtttctaccagctaaagaaataaatgctggggaaagtattttcatttgaataaagatgtagagtaggtcttccatattatttgctaaatggataggtaaatgctatattctgttattttgctcacatacctattttgcaaatcagagtaaaaaggcagaatatttcaccttgtcaagcacagggatattacactttcccaaaattaaaaaaatgtatatttcgtttgatctgatgcttgtttggggtttttgaaaatggggttgcaccttgagaaattgacagtatgtaaagttctgatcctgggtgatttctttatagcttgacatgtgtctatgtaatgtgtgtatgtggacatgtatacattggaaggatttttgcctgcatgctgctttcatggttaaactcttttttgagatttgcattgcattaaacaaaaatgttggcattctgctcacataagcacatgaaaataatctgggctgcatctttcttgaggggcaatgtttttgattgttggagtattatatagcttgatgtggtccagaagtgaagtaatcttgtatcaatgagatagcattgtaatagcaagccctttagtaaaggtttagtgtaaatatctgactggtaggggagctggtttctggaacagttgtgcctctgtgagattacgaaaatggagagaaagaaagggctgaactctaattttcctgaaattggtgcgtggtgctggagttgtagccaatactggttgagatgtgctgcaaggaagcctggagcacaatagtccctgtcctgtgcccccatgttgggcactgggaagcggagtgtgttttgctaaaaggaagaaagtaaagagaagaaatggctaaggcttgtagtaaacaaacttacccataaatatcaataaaatcctatttcccaggcatatctcttcgagtgctttgattgtgcatgtcagagcaactgcaaattttgacccagtggttaagccctttcccctagtatttttgtgtacaggagttctcagttgctgcagtgtgagacatagtatactaaaatatgctttagagggatttgcactaaatgcgaatctgcaaaagcactgtaattcataattaatgctttcttgtttcacactcctgagtccttttggtcttctactttgataaagttgttgctttaatttcatgggggtagagatggagaggtggatcaacccctcaaggacttggatctcttttgtgattaccgaggatattttaggtatgtacctggcagaaagagaggatttgtttgatttttgatgaaaaatggtccatgctaattgatagtaaaattgcaatatagcacagtaattgtaatttacctagaagttctaggatcatgtgggtacagtactactgcatattttcttaaatccagtgtgcataaattcattaggtttgcttttctgactttgattttattggattgctaattttgaaaatggtattaatccacaagtatattatgatataaatatgttattactgtcactttcaccctgatttctgtggatttcagatgctttttttttttaagtttcatagtgaggattagcagagacatttaagaacatggcagagatgtgtgaatgagtaaactctgtcttcagtagcccagcattctgtcagcactctccaatacccatctttatatcctagcatgagaactcgtgtttgtgtattctgctgtctttaagggtaaatgacacatctctcagataagttaccagggcagtctttttcatatggggcattttctatagcaataacctgctaacactctttctttaaaaataaagccactgatatgagttgacatagatatatcacagaaaaaaaaaaaaactaccaataactgactttctgatattccatgggttgcttttgatagtagaattaccacgttgttagtaataaaaatacctagcatatttggcacttactagatttcagtcactgtgtgatttgggtatctcacgacgtttctgtggagtaggaactgctcttatcctcctcttccagacaagaaagtgatgttgaagaagacaaatacattgtcctgagtccccaagctagtgtgtaggggagttgggaacaggcttcttccatagtctctaggagagaaaaggaagggctgaccctcaaggggaacatgtaaaacaaatttcggttcttattctgatgttgacaatatgtatatgaaatatcagctccatacattgtgaatcaggtctcacgtgctgaaaaatgagatgtacaagaaaacccggcaccttccatctagtggagcttctttgcttctgcaatattgaaagtaacagaaacccttatttacatttcagaaatagtttcctcaaatttcctgttttgcctgacttttgtgtgtcccctctctctctctttctctgttgtgcctgctgccctgtgctttgcaatacagcaagggcgacttgtttgttgatttcaaaaagtatgccccatatatctttgctagggaagggctgttgctacctccctcaaatacttgaatcatctgagcaagggcaactgttattctttccacagacattacctcctttccctcggtttggcatgactttttggctgtgattttttggaaaccctttgtccatccaagttactttacctgaaggcttgcttcattgtgttattaatgtagtcaaattatagtcgtgttttaataacttaattgcacaaaaaaagaacactttaaactgaaaagtggaatgatggtgtttattaaaccattcttgcatattcccgcagatctgcaatgggagataaagcaagcatcagtttgcatgtggctgtcaccccatacccacccgtaactatcactaatagctcttttctttcttaggtaacttgcaaaagggaaattgcaactgttggaagtgtgatcctttaaaatattttgactcttcgtattaacaaaaaacatttgggcttcttctcccaaattgaaacttgggcctttaagagcatgacgtgggagaggtacccagaagcaaatgtgtcttgtttctctcgcaggttgcaattagttaattctttgaaatcccaccccatccaacatttaagagttttcattatttgttttatgcagtttgtatcaaaagcagtcttttcttaaacatttaaatttaggacccctttgagagctagtttccaagttttctttaattaaaagggaagggtgtttaatgactaaaagctaacatataatgggttatttattgctgcttgttaaattagttggagttggtttggtcctagacaaagtgaatattagatttaaggagggtgctttccgtctttagctggtctgtttttgtttgaagttgtctatacgtagggatgtactctcagatgtatgcctctgtatttcagacggcgggggggatgtgtgctcgtgtggctatttccacgtccgcctgtcattttctatgaagagtttagcactgaaagcatgtgtgaatgcatgtgttaccgagaatgcacacatttccttttaaaaaactgactatttgtaaagagatgtatatcattcataagaattccagaacactgcccccgcctcattcactttagggcatatacaaagctatgacatggtttttgaagtttttgcagattattcagttaccaaatgtcgatcagtttaacagtatattgaaaccagctccagaagcagcacagaggagatgcacatttgaagttgctcagtggttttcagactggtgtgggccctaggactacctgagtgccagtgattctaattcagtgggtctgagagagatggcgctcagaaagcagttttttttttgtttttttttttaaagaaaacaagttgctttgatgattcgaatccacgtattccacagacttttacatatgttctgaaagttagggaactttcgctaccatctccccatcaagagcagctgcatcatagttcttctagagcacagtcctcctcataccttgaggtgcatggaggtcaagctgcagatcttgtcaaaatgcagattcttgttcagtatgtctaaggtagaggctgggaccctgcatctttgataatgttcaggctgctggtcgaggccacacttggaacctcaaggttcagtcatttatattgtggagtttttgaaaatcaaataaaaattataaagcgactctttgggtgctttttgtctctgtggttttctatcgaacacctgtctctctctgtgccttagctcctgcttcagtgggtaaccacgtctgtgaacattaaggagcattttcacaaaacgtgaaaatacagatgatgtgcctcgtgtatgtggaggcacagtgattctagattagccccggcgaccctagctctgatcacgctgtaggagtatagttctcccagctggacggagggttctttaggattctttagagacactttctcttacctcttctattgctgctgttatgcaacaaaatagagcaaatgtagttctaaactccagggtcactggagaagggacatcttacaaaggggtgcagagggtggtaagagaagtaacaatctagctcaggattttcctgctaaagtataaatatttgcttagtaaaggattagacagcagaagaggtggtttggtggaaatacctgccaggcctgtttcagagttacagccccttaaaacttgatgtgttcattgtcttaagacacagatgtctggttcataatgcgtttgtaagatactctttgcataaaaagggatgaggagagtctttccataaatactttatatttttatctctagaaggcagaagctattaggatgttggtgtctgactttagtacatatttgtaaattccctttactcttgggctctttgaaagagcagtgtgatcagagggcttaactctaaatgtcatcagcattttggggatggtgtttatttcttcaacgagaataagattccagatcccaaaaatgatattgataatctcagtgagtttggtcaggctctccaggttggggaggggcttggttttatttgttaagaagtaggagttaaacttcagtgagttttatgtgtccatcagtaccagacattgtttgctcctgtgttgaaatcctattacagcctatcctttgatgcggccagtagggctgccgggatcacactgcaaatctgctttggctgttaggatagccaaggtaaccaggtctcaaaatattcatgtgcatatatcattcagcttgaatattgcatctgataattggaccaagtactcctttgcctagtagacattatgaaatgacattggtaggatggagtttggggaagggatcttgctttattcttggtgtctgtttagttggctggtcttggcatttatcatgaagctgtgtatatatgtatttcattttcttaggaaattaggaagtgtggggacataccctgatactggcccaaacatcaccaagtgtgaataggattgtgggatttgtgtcctggaagtaatgcgaggtaagctgtattacagggggctgaaactcaaattgttatggcagccacacagttaatttaaaagaattaagcagatggggtgagaagagtaaagaactaggcagcacaggctttatttaaagggagctgttgttgctgcctcactccagccagttgttgtcaggactttgggccatattgttggattttctgatttttctacagatgccagaaagcactcttgtaagtagtaagagtggtcttcaaattccttggagatttgttcatttcatccattgggactccactgagtgaaaggggaaggaagggagggaggccagtgtgtggaattcatttcattttctgggaacaccagctgattttgtcagcaactgaaaagctatcaaacaataacatttcactgcagttgacttgggagggaggcaggcactcctgctctgtgaccatcaaaggatgacaggtcttgaccaaagcagcatcctcggtaaaaaaatgtatgccttgtccctccaagttcaaccctctcaaatattaaaatacaacaagagcctcctttgggggtcagtaagcctgaatctcatcatttatcccagagaaaataaaattatgtctagaaactcattcattattttgccagttccaaattgtccctatcttgccttgctggctctttgagttgccacgtcattagaaaataaggtatcattgtacgtgaatcacctggttttctaggttgttacctataaacatagctgcaacagaataaatacctttccatttccccctcttggcatgggggctgacttaataattaaactcctgagtatttagtcttgagactaatttctgtagtctgaaagaggtttctgtatgttagagcttttcatgatccctttaaagttccttttgatgatattgtttccaaagatgcagagtggtaggtattagaaatggatatacattcaccttttgggggctccgagagtgattaattttagagacgtcgccagtaaatatttggcaatgacatgtacgtctttaccctcctggcgctgacttttgtcacagagaagtgtggggccacctgcacaggagatgcatgtcttcataaatgagagaggcaggtttctttttcttgaaacactgcactctaggaagttattgttttacctgtagaattactagcccagaggtagcctggagttagcacacacatttttatttggggctttaacagttcttctagcaagacctttttcctgtttaataactaagtaatttaacacctacacaaatgagacccagtttgctttcctttttggttctagtattttctacacatttttcatttcgcttaaaaataggggatggccacttgatgtgtttgtcccagtgttgaaaatatggtgtatccctaaagctattttcactgtcactctgcctgatgttagcctatcgaagcatttgactactggtactttaattactgtattgttcatcaggttaaattgtatttaattggctttgtattttgtctttttgtttcaatgaaaggattactgggggtgttaaaaaaaaaactcatttaaatgaagcttcatcatctaaaacacatacgaaaattctttaagatgtcttttattccagatctctttatcttccttcacaagctttctgagaataagtagtgcatgttgaggtttatcttcgcttttatgtgctctagccacttgcttaacattgagcacatttgagttgcatttcatcgggctttcacaatccttttataaagggactgatctgttaacatcaccctctttagatctagcagacaggatgttcttccatacaaagaagtgctcacagtctttctggccggccagtaagtgaatgatttcaggcctggtgggcaatacttgtgtccatgcgtaacacagcccaaccacagtagtaggcagctgcatgtaattttgaactccactcattgaactgtaataaaacaatataagcactgcttggggggaagattggatgcagttatccttacacaaggctcaggcatatgaaagcagtgctggctgacaagaggattttgagatttgattttgattgaattgcagaattgaacaggccaggaatgtcagtggaaggctaaacgcctgtagtgccataaagttttattcatgtgaggctttccaatatcaagtagatggattattggaaaaggtgtcaagggacatgaaatggaagtgcccaaaacataaaatgtaggcaggagggagaaattacttcttgcttagtatatataattaggtcttcaaaaaaaaaaagaatattccataaaattgtttattcttccctctttaaattaaaaaaatgaccaactcatcttatcacttactacttattttatgccatcacaagaaacagtatttagacaggagcttgtcctatgccattcttcagttttgttcgaaattaacataggctttctttaagagaaagggcagggtgaaccaagaatatcacagtacactagacattaggaactattatgttcagaaacaagagcaagccatgtgttcacacatcctaacacactgacttatttcgtagcttggtaatgcatacaaaatcgtacacaaatttgcatcggacagctgagatcaaaatttctgtggcattagagagtggcattcactggcaacgagcttgtcattctgcagtgaagttatgaagaaggttgagctggggagggcgaagttcattgtcgtcccattccttatcagtatgtagagtttctgttctgatagcaggtgaagtacatctaaaaattgccagcatggaggtacagaaacacctgtagttttttagttgtgaatctatttgtttagcatttctaaccaaagtagtttcagttaaatcattgaaattaggaacataaacacattgactctaatacgcaggtgtgatttttctttgtcttccacctacctcttctaatgtcttatgtatttagaaacctgtttatttgtaaatgaggctttgtgaggttaaagtggaaaacttcagaaggaaattttaaaggacttatgtttataaagccccttttcctttttaatgctcaattcgtagacatgttgggaaagaaatttcatgccttatgactgaagtcacctctctgagattttttaaacttttatttacctcgtatttcatagacctatgtgagattgtatttagttatactttgttatggtttagcttttctaaaaataaactttgtgaatatttatctaatgaaacaatgattcatttataaacagccccttaaaaaagaattcctcaattcgagtggtcagattgcatgatcagtaagtgacccctattcattttacattgcacccctttcttccatagggtttacatgggcaaaaattatatctgagaataggattttctgctgcttgtagaattaatccctgtttgtatgggagaggacaagaaaaggttgttgagggctgatgaaaggaaaccctcacaaagttgcaaagagctgcctttgaacttggtaaggttctaggaaatagtcctttgcctgggctgctcccagccatgaaattctgggttttaaaggaaagatgtgttgtaatgttgcccatcagtgtacatcttggagcctccttgcaggttactgccacacacacacaaatgcatgaaaattacatttcacttcttttaacaccggattaaggggagccacagagggtgtttagggtggaaaatttaaggaggcatttgctgtcaatgctgatcttgaacttggacgatcctgagagctagtgcctccctaaattttgcaccctaggcaccttgcttgcctcctataatttgggccctgctctatttttgcaattaagaaaaaccttgacccaagtaaaacacatcaattttttgctctttctatatttctaccctgtttttattaccaaaatttaataatgacaatgaatatgatcatataatattgtttgattactgtttctatgtagtttccccgaattggcaggcattctgtttctgaaccaaaaaccagtttggggttaggtctggtcataacacgcattttgttctttgatttcattggagctagggtttgacattagctaataaactttgcatgcccacgccttactaagttgtacagttgcaagtgtcctccatgaaaaagacgtgtgccggcattcccaggtcaaagtttgctaagcaggtttctaaggattcttacttgccagtgatttggttctgaaattgtggcaatggtaatttggtattcaaaacagagaagtttggaataggcatcttagctggggacagtaaagcagccgacaggaattatctttgttgtagacactaccaccattacctactagttaaggtattttgcaaagtgttcttgaatgcgtcccattttattcttaaggaaaactcctttttgcgggtaccattattacctactagtttacatatgaggacattgctgcttggagaaattaaatcatttacccaagttcacaggtcaataacaacagaccctaacccatgagccagtgctcttaataccagtgatcttaaccactgtgtagtctttgctatgttccattaattgtccagggatattattataggtacagtttgtcttttgggagaggtaccagaatttctttcttaagtattgcttaaaccttaccagtcaacagcctttctttgcagaatgaggaaagcatttagtgcccatactgttttcgcagacttaatggagcaggattttgtacatttctttgtggaagctgttcagagaggtgtgtgtaaggggaaaggaagcagtgggaatccttcaccctggtcaggggataaagatctcctgatagactaggaggtgtctgtcagtcactaagattgaaatcttagaaggagtctatttctgtgctggggttccgtccccaaggctggcaacattcacattcctcggcagggaagcgttgtttagaggcatcaacccgtgaagggttccatgaggcctggcactatctgatgtgtggtgtgtatgaatgaagcctctttcctcaaagctgaaatcagtttgagaaaactggaagaatgagtcatttgaggttcttctctctgaacgtgtctacacttgtctctggctgattctatacttgcatagttgtaagtatactgtatagattctatacttgcaaatgttgaaatttcactatgatcttgagtagggtgaaagagaaagacatgatatccaaacccctctccccctgccccattctggtgagtattcaagtttaataaaaatatatgaaaaaggccagattcttttagaagggctttgcttctatctgttgcaacctgtgtctgaacaggtagggcacgctggacgtggatgagcttcctttaaagaaccatgctgctagcgtgaacctcatccacacgctcccttagtgggtcctctcagtttctgtctggtaactggacataggcctcgatggtttcatctgtccagaagggaaaagtacaatggaatgggagcaggttggtatgcagacctgtggaactaggccactgacctacttccttccagctggagtgatgccctttcagatctgactccagccatgtggcacctggttgccaatcactgcccagattggcaggttcctccctgactcaggccattcatctaagtggatgtgactgtttgtaagctcgttggggtgcctcataaactagcttgagaatgtgtaaggcagaggggcctggaaacatagtggctaaatttaaacagtcattcttgctgtatgtgtagacataggtgtagacagaggtattcaggccacaactacatgctaacttgtatggtattctaaataaggtatttggatgatcactggcatttatttactgaggtttcctatgcagagcccagattcctgacttcttgtaacaaaccaaaagatgtagtaacaccagcccctctcccatgctggggtcaagtgcccatttagatggggcttgtcaaagctgtctgttagggatgcattcccacccactccctagtgtttgagtccctgcctgcttcatccattgaatccattgaagcaactgcctggcccctatgggcatttgagtttgcaaccctgatggaaagcgtgtcctgaaatagatgtactggtatacacaagtatgtagacataatctgtattgacacttactcctgctgaggaatgtgcagccagatttctggaaagtgccagtttttaaaatcccttcaatgatttaaacctgctggaagctgtgcatcccatctaaacaatgggatccatagagaaacatactcattggagaattacgaggcatataattttgtctttaaattcttatgagtgaattgtaagaacatgacttcataggaacctctgagacattacagtgttttaataacactttgctgctacatgcagtggttcatttttacttttattaattttttttttcagtgtgtggcagcaggtgccctgggcacctcagccctatctctagcttcatcctcctctgcctctgggaagccgcctggctccctccctccttagggcagaggctccagggggcatgtcttgtctgcgaagagtttacgaggtttcacccactccttcattcttgaacatgctttttctctgcttattaccctccctgtttcctcctgggctgccaacaacatattatattacctccatctgcaaccagagctgctaccaccactgtgcccgagcctgaattttcatagttatattaaaaaaaatcaagggtgcccacaagtgacagcagcttttatggaagccagtcttagcaagatggcagagcacccatttctccatgaggcccaggcttctcagagaagggcaagaactgtcttctgctttggccatcgtgatgacacattgaatgcctgaattcattcactcactcactcactcactcactcactcactcactcactcactcacctatgagttgttttcaatagatacttgtatgtgttaaaagacacacataggccgggcacggtggctcacacctgtaattcccagcactttgggaggccaaggtgggcggatcacctgacggcaggagtttgagaccagactggccaatatggtgaaaccccatctctactaaaaatacaaaattagctggggttgggtcacgtgcctgtaatccgcagctacttgggaggccgaggcaggagaatcacttgaacccaggaggcgggggttgcagtgagctgagattgcgccactgcactccagcctgggcaacaagagtgaaactccatctcaaaaaaaaaaaaaaaggtataaatatctattgatagatatttatatctattattaatatgccaggcattgttaatttcaatactgtgtaaaaacagacttggggcatacataacacagaaacaaatgggaaatttgaattatagggaattcaacaaagaaaggccctttatatagggcaaattgacttggttgaaagccatggagttcatactaccttagaatcttagaacttcttgagaagctctggacagagctcatttttattttccagaacctttgggaggcagtatattccatggttaaaatgtggacttcagcatcagccccattccggttcaggcaaaacactgctgagctgccatttacattgctggagatgtgtgtggcactcgtttcagttgtgcagtacacctccttcccagctgttcacagcagccctgatttaggcaaaactgagtttgaattcctgcttttgccacttacggtttgtgaagcagcctgtgtttctgtagccctcccacacttggcctcctcattggtaaaatgggggttatggctcttccctcacaggtaccatggagaacactaaggactaaaggtatgttgaagctatttatgtcatgcctgccacgtggtctgcactccagaagtacttgctattgctgttattgaaatgaaagatctcccttgcacatcttcccctgcccggccacattgtgcactttgaaaaggatatccttcacattcgttttccagaaaattgaggtcactgacttatttccttcttgaaccctctaccctccagtccccatggccatccccactccccccaatcccttgggttaagtcacagcagaggcatgtacagagcatccctcgcaaacatcagttgcctttctgtctgcagcaggcctgtttgattttggcttcttatctgatgtagggaagaagccgcactcctctgagccttgggtaggccagttgtgggctggcccgtaataatacaattatgaaggttaacaggaaaaagtggggtccaggagcaattccaggcagctggcaggcctgctgaattggaagcgccccaccaatgaaaactgcagcaagaagcaaattaaacctcctatctgccatctcactctcttttctcccctttcctgtttggacttgaaaggcgattggagccagggccctgacagttgacggaagtgctgcaaggagagagtatttatttacagtgagtcgtggtgatgcttgttcaggatgcggtttcttgcaggaagttctgtccccacccccgggtttgatcatttctccaaaaaaaaaaaaaaaatccttgattgtttgaggcctcctctctgacttggagcaacattgtagaacctgtctgtacttggagggtttgctgagtgcacctttgtaggagggcctggagtgggacgagaggcagccagtgggcctggctccctccagatgtgttcaggcgcagcaaaaatcattaggcattgaaaatagggaagtaggccgagtacacgtgtggtaagctgtggttggcgcaggccagtctgttcgttaacagaaaccagtgccaattgacgttgatgtactaggcgtttgagagagaaatcactttgaggcaaagtcagtagctatagtgcatagggagtgagtatttaggtagaaaccagttgggctggggctggctggtgaagcccctctgaaggaggctgagtgccaagctgctggtccaaaatgtggggtgctttttgcctttgggggtctcatagaatattgggagagaagggtaaaaggggaaatagtattctgttgaagaggttattttggtatattcttggatcatcataaggccaccctacaatactatagaattttctcatcagctgagaaatagcctccattctttatttaaaagtatatacaagtgagaaaaaaatgacaaaaggatacaaaatgagactcagctcccttctttagtttcagaaatccctagagcaggtcacttggcagcttgctagggatgcaggttctggggccctgttggagggagagtggcagaatcagaaaatctggcatgagggctggcagtctgtgttttaaccagccctataggcgattctgatggtcatgactgttgagaagcatggagagaaggcagtggctttccaactcgagtgtgcatcagggtcacctggagggcttgttagaccgacagacgtgaacccagagttacggttagataggcggaatacgtgcccatgtcctgttcacagtagggcgactgtcattaacaataaagtattgtatatttcaaaagagctagaagaaagtattttgaatgttctcattacaaagaaatgatgaatgttcgaggtgatggataagctaattactctgattttatcatgacaccaaatatacatgtatcaaaacatcacacagtaccccatgaatacatacaattattgtgtgtcagttaaaaacaaaataagggccgggcgtggtggctcacgcctgtgattccagcactttgggaggccgaggcgggtggatcacctgaggtcaggagttcaagaccagtctggccaatatggtgaaaccccatctctaccagaaatacaaaaaaattagccaggtgtggtggtacatgcctgtaatcccaactactcaggaggctgaggaaggagaacctcttgaacccaggaggcagaggttgcagttagctgagatcgcgccactgcactccagcccagcctgggtgacagagcgagactatgtctcaaaaaaataaaaaaaaaataaaaaaagatttaaataaaaactgcaggtgctggagccccaccctcagagattcagattaagtcccaagtggggcctgacaatctgcatgctttcatttttttgagcaggcaactccgcctgcaatccccttctccctggttttcctgatggagcaggcctgggcttttgacaaatccagacgtgggagtgactgtgattgttgtcaaaaaaacaaaaacaaaagaaaaaaccaagaccatggaatggaggaagcttctctgtggcattattactggggccgcggctagtttggtgcaggatgatactgacgacagagaggacctccgtgcccatgtagctttctccagacatcccagcacccaactcactgcgcgagacttgcatgaataatttcactaaaatcagctggacgttctcaagattcagaggaaatcaccagtgtcctcctgtgggtgtctccttgtgtgttttagttgatctctgaatgtggtttttttttttttttggctttttaaggtcttcagccatttctgacaggtgctgtagttggcctgttgtaatatgcaaaacctatacaaagacgtgtccttagtccctgtgtcaagcaactcagtctggttggctaatggttaatgtagagaagtatgcgtacaatgtcagggtgttacagtatggagctatgcagaaggaatgaacaactggggcatctgggacatatatggtcaagctccacaaaagtggggcaccaagtctgaacagggctttgaggcatgaatatgagttccctagatggttcagctcctgagatgtttagtgcttgggaattctcaaagttgtgtaggcatgacttctgaatgggaaggttctggtgaagatatcgttaagaacgtagtgggtgaagccctcttcatgcaaataacatcaggcagaacagagatttattatgtgcaaatgacagtaacctttataaaatctagaaaataatttttccccaatttcccctcgaatccaaacattcttctgcagtctgagtggggttgataggctgccaagatgttgaagggcctcagtgggaagggacttggctaacagttcccagtgccagtgttctctatagcgtgtcttgttgagcactggtgccctggcttgctgcccacaagccagaatgagtttgagaacttgagggtttacgaagcagaggtaagaacaccaccctggaggtctttaggactgatttaaaattccaccagtggtactgactttggacacattcctcaacctctccaaatggttccctgttagtgacgccgggggcatcgtaggatcattctcctagagcatttagcacagggcctgacatgttagtgactactcactccactgcctgctcacaggcatgggtaaaaggaagagcaaaacaaacaagatgcctgaactgctaggccaatctggagcagagctgctaacttcagcgctgttgacatttggggccagaaagttctttgttgtggggtctgtgctgtgcacggtgggatgtgtagcagcatccttgcctctgccattcattcctgcccatgacagtgacaaccaagactgtctccagacatttccacatgtatgtcccgtaggggttaaagctaccttctacttccatgagaatgactgatccatagtacagtcccacctagggagttgtgccatgatttgcaaagttatttacccttactaaaggcactgctaagctaggtctctaatctaaaatatggaacaaaatttcacaagaggcagctgaaaaaagttttatattatcctgtttgcaatagggaatgcagttacctttaaaaaacctgaagtactatcatagctgacagaaaaagagaattcctaacatatacctggtgcatgctttccatttaataccagtttcactttaaaatgtgaggaacagggtagggtcttttgcttgtttagttttccaattttttgttccttattcttattttgttttattttatttttgagacagggtctcactgtgtcacccaggctgaaatgtagtggcatgattatagctcattgcagcctcaaccgcttgggctcaagtgatcctcccacctcagcttcctgggtagctgggaccacaggcacatgccagcatgcctggataactatttttttttttttttttgagacagagtcttgctctgtcacccaggctggagtgcagtggcacgaccttggctcactgcaacctctgccttccgggttcaagtgattcttctgcctcagccgattcttctgcctcaggctcccaagtagctgggactacaggcatgtgccaccatgcccagctaactttcttgtatttttagtagagacggggtttcaccatatcagccaggctggtcttgaactcctgacctcgtgatctgcccgcctcagcttcctaaaatgctaggattacaggcgtgagccaccgcgcccggcacggtgtctcactttgttacccaggctggtctcaaacacctgacctcaagcaattcccctgccttggcctctcaaagtgctgggattacaggcataaaccactgcacctggacttgtttgttatttttaattgtggtaaaatacacataacagaatttatcatcttaaatgttttgaagtgtaaggtttagttgtgttaagtatattcatattgttgtgcaaccagtctccagaactttctcatcttgcataactgaaactccctcctcccctggcaaccagcattctactttgtctatgaatttgacaactctagatacctcatataaatggaatcatatagtatttgtctttttgtgactggcttatttcacttagcataatgtcctcaaggtacgtgcctgttacagcaggattcagaacttcctcctttttttttttttttttcctgagacagagtctcactctctcgcccaggctggagtgtgcaatggtgcaatctccgatcaatgaaacccccatctcctgggttcaggcaattctcctgcctcagcctcccaagtagctgggattacaggcgtgcaccaccacactcagctaatttttttgtatttttactagggatggggttttgccttgttggccaggctggtctcaaactcctgacctgaaatgacctgcctacctcggcctcccaaagttctgggattacaggcttgagctgctgcgcctggccccttctcccttttaaaggctgaataatattctgttgaatgtgtgtacattttgtttatccatcctttgctggacacttggattgccaccaccgtttaagtattgtgaataatagtgccatgaacatgggtgtacaagtatttcttaagtttcttctttcagttctctagggaatattcccagtagtggaaatgctggatcatgtggtaattctatttttccttcttctaagttttcttaccttttcttagctgaaagaaatagaatgcactgcccttcagacccctccccaccctttcttgaaggttttcattacatcactgctacctttgattctttctcccattcccaccctatgcacatggacacacagaaaggttttcaggaaccaggaaaaggcaatcgtttgcatgcatggtcccagggttctgagcagctctcgtgcagccataatcacaccttgaccactttgtcatcaggacctgtgctgcttgtagcctgaagtctgcccgagctctgcatctgtggcaaggcctggcaccctcactgcctgtctgccacctgcataggcagtcccatccttgtgcaatttaatgaaacagtggagaggaagatgagttgtgagagcagcgagctggtgtcttccttcctatagagccttggagagcgggttgtagctccaaccttaaggctctgttccttgcctccgaagagctcctgtccctgctaccatccactctgccctgtggtctccaccagtggggttggggagggctgggtgggatgctcagtcctccagcctgtgtaatttactttatattccggttctgcattgacattctcagtgtaagaaaacaggagagcaaaaaagcaatatgttgaaaagcttgtatctatggagactggttttttttttttttctccaaattagactgaaacctccctaaatctatataattctatttgcagaatgggcctaccaagccttgtgatgaggactagatcttggccatcaactgctggggggtataaatgaggtccaaaagacccaagggagaggcagtctcaatgtttggagaccaaaattatgtgagtggaggggagcctggagaaggtggccgtaagtcgaaatccctactgtgctaggatgctaaatccttttgtgagccagagtttcctctgctgatggccaggaggatggagagtcagccgagataatggaatgcacagggactcatgccacagcaggttactcttaaaggtggataaagaagtggaaataggattagtcttgctgttttcacatttttgaaagcaatccaaaaacaccagtactttccggccgatgtagctcatattaaacgaggctgccagaaaatgaagaataagggacaacattcattcattcattcattcagaaatagattttaagagccaagaattcagtgctgagcaaaaccagacacagtgttcttaaagagtctacatgttattccattcctgtaattcctgtgcgtaactgaacatgttagatgcctacattttcctgaaggtaataaattgttcaattattttgtttgcttttatcccattactttcatataactagtagagatagattccagtggtagaatcacataaatacatttcttctggaaataagtcactgttattgtttcaatccatgttaattttctacccctcccatcagcagatccgtgggctctctttgactcaatttcgtgtacacagcttttcttcacctcctggaaccaagcttttctttttgtactgcaagtgcgggtggggccctgtcctcttgaggcagcttgtttttcacctgatcatttttttggtttgggtctcttacgccccagccagaggaacaggctcttaattcctgtccagcagggtttctttttattcccaaaggcattatgatgatcacagactcggaagttcatgctcctccaccctttgggcttgcgttttatgctgggtggagagagaggatggtggagccattgctgagtgtctgtgataccttcttctttggggaacactcagagagacctggggtgttcctgtgatgggacctcattctgctccctcactctgccccagtccagtgcatctgccattcctggtgagtcaggagagcccagtggagaatggctgttggcttcttgtacctccaaactctgtatgtattcatgatttgttttctgtttgttttgttttgttttgttttgcttttgagacagggtctcattctgtcactcaggctggagtgcagtggtatgatcgtggttgactgcagcctcaacttcccaggttcaagcgatcctcctaccttcatttctcaagtaactaggacaacagttgtgcaccaccaagcctggccaatttctgtgtttttcatagagacgggttttcatcatgttgcccaggttggtctcgaactcctaggctcgagcaatctgcctgccttccagagtgcttggattacaggaatgagccatcatgcccagctctgttttcctttttatacattcttagaagtgacattgttggatcaaagagactgagaaacgttaatgccagctttctgtttttcagaatggtaataccaagtttgttctcaatcagctttgtatgtaatggcccatttccttaaactccaaataatgtgggatattatatgtgaaaatattccctaatttgataggtgaaaaaatggaattgtgttgatcagcgttgctttgatcggtcatggggcttacattttgtttcctgtgttttagatagatgtcaaagttacgccaaaattacattattatagcagacattttgcagtattcctgcctacagatcaccacttgcctggctggctccaagtcggagttggtttccaggtattttggtgtattctcatcatcattctcggaggatgtgctccagacttggtttatgactacagtcggttcagtgctgttggcttagtgaatccttgaaattttttgttcttttcttgttagtattataagggcctatgtgagtcagttccttaagggttttatggaaatacatggaattgtaatagggaccatattttatgactctaaaactaggatttctgatttttatgagagtgagtcatgtttatagggacgataggatggggtatttgaaatgtggactgcagtgttaaatccagaaggtctcatcaccaccagggccagcattccccacactcctcagaccacaagttcggcggcacagttgttccatgcagtaactannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttgtgtttttgttaggtattttgggtcggtttttggtatgcttttgtcttatgtgttttgtgtctgtgtgtttgtttggttgtggttcttttttgtcttttgggtgcctcttttgttatttgttcttatgttgatttggtttcccttttgttgtgggttatttatatattctgatattttgtatgatttttcatttgtgtatgtgtgttcgtttatttttttttttgattggtattgatgttgagtttatgtctgctttctttatgtttttaatgggcagtctttctatgttaggtttattttgttttgatttgtatttatgggatgtttagaagatttgtcctttattgttgagacttgtgcagtgaatgtatgtagtgtatatgtttttttttctggatatatcgtatagtcccatcttccctccctccctccctccctctcttccttcctcccttcttccttccttctttcctgcttcccttccttcccttcttccttccatccctttctaccgtcccctttccctccttctccttcctctcctcctcatcctcaacgtccaccttcccttttgtcttgaagtctcttactttaagctcttatgagaaaaagaatgacatagctgaaaactcatgtgttaattatcagtttaagaactgacgacatgccgtaaagctgaatagagtgggctgtgaaatggccatctaatacctggctatagaagatcaaaggcgagagagacggaggtgacgggggcctgttagccaagcgctttaaactgtttggcggtcaggactccttggtgaagctgaaaaatctctgagtctctctatttgtgtgtgtgcaggcatgtgtgtatatagtacaaatgttcatcttcttactacccagaattaataactgttgacatttggccatattcacctctactctattacctttaataaatacaacatctgtggtaagaagactctactctacaccatttaagtctaactctcacctccctccatccccttcgttacacacacacacacacacacacacacacacacaccccatcccctcatgagggtcaccgtgtccaccttctggttttactatttcatatacatgagtgcccaggaaggctatatagtgtttttgtgtgtacatttctttaatttgcacaagtgtacataatatgtatgtgcataaaacttttaaaacgtaaggcctcaggtacttcctggaccctggaagcccatttctggactcctgtattgagggaagttgggacttgggcttgcagcaagagggacttgggagggacagcaagaggtgcagcctgcaggtggactcccaggactggagtgggaaggaggtgtcttctgaagctgtcatcctgactgcgggggaacaagtcttcgggggggctctaggatccagtgcctaacgtcattattttctgtatctttcacttggcatgtaacacatacttcttcagagctccttatctttggagatgtatttgtcctgtttcttcaagttggtctgtaaactccttaaaagtcaggactttgaatcttgatctcttcccatctcctgttggggctttacctaagaaatattttgtaactctttttctgtttttaaaagcatttgtgtagtagacacattcattatggtgcttggtctttaaataatttttcgaaactaaaacttgaggcatatgaagataaacgattgcaatttaagccagccaggaagctgtaacgtgggcttgggtttccatttggcatggatctgtggctgatgcgatctaagcttccctgtgccatcaggggatggcagacaatgcaggtaagtgtagacacgcctttgcttgcctgccgaccagggcattcacattcatccaggtaaccagtcagggaagagaaaactcacgtgggggattggatgggcttggagctgctctcccgagtaacagaaaaacaggctagcagggttccagaatacattgcaagctggggagaacttatctcaccagggaggaaaatagagcccccgtgaacctgttttatattctgtttgtatagcatgcacgtttttaatgtggatttttattttagtttacagacccttcccccttgcacaatctgagattattcaaagtctcccctgcctgccctctctctgatgtgtgatgtcagatactgaatgtattggaagcctttgcatgtttttatttctcatggttgaacccgtaaagttgtttccctgatcaattgcacgtgcatttcaggaacacacatgaaacccttgctctgttctgatagacacgtagagtgtttatacatttagagacaaagggacacagcaaaagtctggcacctacagtctgattttatagttttaaaaacaatgcctaaagtggttgggggtagttcaggctgacttgctgtgttttcttcagggtccttgtatgtcaatagttcatgacatgatttttaccatttgatggctgaagtcttacatatgctaacatatatgagttacatataagaacatgtatagagttacatgtaataactctaccatcatcactaatttgcccatcgctgagaagagggtaaaaggacaaaatgagttactcaagtcactattttttttttaacaccaaaagatccaagaagaccaagcaggtacaaaatgatcagggtgttctaaccattagaatcattcaaattattttgtctgtcttaaagctcagactctggtatatccttggaaacattgcaaagaatagttcctcagccaaatcatggggcttttttttttaattttttttttttttttttttaacatgttcacatttcctgtcagtgttaagtgtcgaactgctttgaaggcttgacttaggagctccacacttaagcctgaaaatgaatgtaaatgctgtaaatgctgagttctgcttctttggatgggggggatagggtgcttggggatggggtgaagcgatcatgagtagcgctggtgatctgatcccaggattctggtgctgcaggcgcccagggtgttaggcccaaaccctttgaagccacaactgagacactggagccagcccaggccctgccctatgttaggtggggcgtagcctaggggacctggtggaataggagcagattattagactgggagggacaggaaaaggaagcgtccaaagggagagaagaatgagggtcattgggccagggcccgggaggggtgcgtcaattgtgctttgaatgtagggaggggtgcaaggtcagaagctggttcaggggtggtgaggcagggaaggggaaggggaaaatgctctgtgcagggccggggaggagatggaaaaatcaactcgatgggtgcaggaaagtagcaaaagggaatattctgcgtctgtgctgggctgccgttcccggccacgacaaggtcagccgtgagaagtctatgcacaccacagtcgtcagtggttgatctctgcatatctcaatccatcctagttgcttagtgctctgtgggaatggaagttcttgaggacactgatgtcagcgtctgctttctctaaagagtgctcctggcacattgtttggcccttaagaaattcttgccataaataggttttcaaagactagcagccttaagggatcctgcagcttggtcataggttctctctgcttctctgatggttcagatgcaacacagaatgacacccaggggcaacacggcaacaggaattgcacatatgatggtgtttaaatttagtctttttaaaaaaatcactctatagctttggttttccatagacactacacaatgaagtcagaataaatacctggaaagaaaaataaagtcaggaaaaagccaggaggcctggattctgaatttgacccaaggtcatcgggtgacttggaaaagttagtctccattcgtctttggtgtgttttgttgcctgtgaaatgagtttgcaggtaggagttctgaagtttctattaactttagcaaatacctttggaaatatgtttagttgtagtaagtattcaaaccaggcaatggggctgtgtgggaccagatggaccagggtttgaatctctgcttcgccacttacttggttcgcgaccctggaaaattaccagatctcttggaccctcaggttttctatctgtaaattgggcaaaagtcatggtaagaattgagtgcctgaagctcgtagcttagctaagtgcctagcatggtatgagcactgagtcatccatgccagctcttattaggagtattcactggagtgaaaagttaagtcgctgagaaaaccacacaggtacttcctgggcaagcatcttctcacacattgccacttattctcgcactctgtctatggagaataaggcttcctcatccatgaagccttccctgatttcctgcccaccaaccagagaacggccactgaactctgctcccattggagatttgtgatactcctcaagagtggattccttttgtctgtgctgtctttgcatggctcatttgcagatcgacctgcctccctagattgcctgagcttgctgcatgcacgcaagggacatgtccaccggctcatcttccaccactcacctccctgcctggttctgtccaccatgcaccttctaaatgctttgttgcagtaaaatcaaagtggtggggtagaatgtctaggaaagtgtttcatataaattggaggggcccattggtacaggtgccatatttcccggtggttgtggctactgcgttgctctaaagtcagtgacctgtaaggccttcccctgtggccattcttgccatagaaacatgggcctgccccccgccgcctcccctcccccaacagcccatgagtttgggtgacagacaccataaggcagagtttaagcctcttttccaacgtggcagaatgagatgctttctctctttattttcctagaatctgggcaggtagtttcctcttttagggataagtctgggagcttgaagtatagaagaccctgagattgaaaatttaaaattcaatgttgttttaaatcaaagcaggttaaataaggaaccaaataatttctagaataaatggtaaagaatggaccctactgtaagtgaagtaacatgcggatgactcctgttttttttttttctttctttcctcttgaacttgggatccctgcatatcacagacaagcatcaaaacccaagattcaaatctgttactgaatccattccagaaaagtggggaaaagctaccaatttgtcatctgttataaaatttcataacctttctttttctgatattttgtactattattcattcggcttgcaatactgcaccagatttgcgcctgctcattttactgtgtgtgcatggctgtggtctttattttataagtaaggaccgtcggattgagttagcaatgccgaaatcgctcacgctgcaaagtcctcgagtcaggctttccgtggtatgggctggctattttggggtatggtcaggagggagcctgtaaaaaacctgaattgtctcattcccagggtggtctttctctgtcgaggttgtggtcattgtagcaaggcaatttgagaaaacctctcgtatcacttcctgtgtgagcttggatggaggaaaaaggaatcttcatttccgaaagttgccagtttttctagcttcccagtagagcagaagtagcttggaaagattttgaattttgtttttcactggatatgcaaatatgtttgaggaatgctggtaatgggcttgtcttgaggttttagagtgaggaataaaccacacatcatttttgattgtatttaataaagtgaatgaaaaaagccaccaaccaggtgagtgagatcaggcaccgtggggtgatttagctgtctttcaatgacggtgattcttgaagacgagttcctcggaaagtcttattttgagggtttcaccaaattttagctcaatatttagttaacacagacgaatcattatggaacatgttaattctgtttttccatttttatacaatcagtctaacatttccttttcaaatacaatactctttcaggttttgctcctaagctttttctaactttctatttctatttcaatattttctgccacccagacatcaacagatggacagggacgtttcagtacccccccctcccgcccccccacccccaagttctcacgagcagcacacacaagtgctgagttccgcctcgctgcctgcttcttggcacaggcctttgattcctgaaatgctcagagcaaaccaagaaaaaaaaagtgtttctcaggtgagcctgtccaagaagtttttttccttaaagaataatttcttttcctgctgttcttcctccccacacttcaccaaaaagggtgaagacagacagaacccagaccctcccatagttttccttcagtgtccccttgggaatgatgtcaccttggtctggttgcccccacccatgggcgaggttgtgggtgataactccatgggccacgcagagcatgagggcagcctgcatgaagccggaactcccatccaccttctcgtccccagcctgtgccttggttctgatgccttcccctcgtgcttgccggctgtaataacggaaatagcaaaaaatgtcagccgactactgtctgcatgtcggcactagtccagggagtttcaaagggatgttttattgattctgtaattgcacagtagaatggacgagctgaacgggacctcagggccaggaaagccccggcttcagcagtgcctcctggccgagccaggttgtggggagagctcactgagcagttgcagcccaaggtgaagtgtgtgcttaaccccttctttccaatgttccccttcaagtttcttttgtgtgtatgtgtgtccaggccacatctcattgtagggatcacaaatgtttaatttcctttgaatctcatgacctgcctaactattattgttttatgactctgcttcttgaagggctcttttcaaaccttgggcatgaaagacatttcataggggggcctctttagaacaatggactctcaatagggacttctcatgacattaaaaaccagaaggcaggcctctgaacaagacttgttaagatacagtagcccattctctgctaataagctgattgctttccaaacccgaaggggtggaccaagctgttttgccaaaacaattggaaattagctctgtcaacttctactgctgccatattttgcactggcatgcatatctgtactgttcccattaatttggttacagcaggaaacatttggaacaagggcgtttttaaaaccaaaaagggattgcagaggacttgacagagtgtcccacttggaggttaggcgggcaggagacacagtttccagaattgcttcataatatcttcctgatcttcatggtcctgttgggcagaatgatgttcagtcttttcttcctgaatgccttgttctgagggtatgagggctttgaatgtagatgggacagtctcaccctcctacgggaggaaaagggctcttcccttatcacacagtatttatcaacttgattaaaagctatgatagcagtgcctgaagatgggacttgtttctgacttaatttaccctcctctctcccagttccactctttacctcagtatagaggactctgagatagccctgttttgagctgatctttttcttggaattcattttcaggttcctggaagatattttcacaaagaatcccccctgaccttcattcagatctccacataggcatttctgagatgggatttgtcatcttttctttggtgcctgctcatcttcctgggttgcctgcatttgctgatttcatcctcatctgtccagtcattcatgcctgaaagccaggcatcctctttattgtttttgacccctcacccctcatgttcccttagttcctgaatcctgtgacttccgtccatcgcttgtatcattctccttgctgagcatctcctctcattctggtccttggtatgttttgtccatacaattgtgatagcctgaggctgacaactctgcctttatatgtccctcctggaagaacccaaatcatatcacgtgtgtttgttcagaaccttcagtagctcctttttttcacaagagagcccaggctccctagcccggcatccggggccttctgtgatctccttgcaaactccatctgcggcatggtttccagttctcgctagctttacgctttacatgcccttcgctgcagccagaccctctccgtaggatacctctaatatcactgacactctcctgcgcgtgtgtccctgctccttttgctctgtgtgaaatgctttgtctcccttctccgttttgtatccatttattcattcatgtattctgcagccatggattgagtactatatttgtgccagaccctgggctacatattagatatatggtggtgacccaaacagctgcgattcctgcctttatgatctgttaagggaagagtcaaataataaataaaccaagagagacataaaagcataaattggggtgattatatgaaaaaaaaaatgcatctgatttttttttttttttttgagatggagtctcgctctgtcacccaggccagagtgcagtggtgcgatcttggctcactgcagcctctgcctcccaggttcaaacgattctcctgccttagcctcctgagtagttgggattacaggcatgtaccaccatgcccggctaatttttgtatttttagtagagatggggtttcaccatgttggtcaggctggtctcgaactcttgaccttgtgatctgcctgtcttggccttccaaagtgctgggattacaggcgtgagccaccgcgcctggctgcatctgatgttttaagagacagtgcaagaaggggaactattttagaaggacttcccaagaaggtaatttttaagtgaagtgttggaggatgagaggaagaacaccatgcatagaattgagaaagagccttttaggcagaggagaccttgaggtgggatgagcgtgtgtggaagggatggaaaaactctagcactttccctgttaagtttccatttttccttcatatagccacagtaaccctccctttatcagaaaccacatttagttggctcagctgggttcatctctacttatcctgtgcattcattccacttgggtcgtcttgtagaagacttctcctctttgcctaatactaaattttttgaatagtctcccctgaattctttgagggcagtgactatataccatacgtttccatggtccttcctgacatcttcgcaaggagagactcccatctaacaagagtttacagattgtttggtgatttactggggctgcatatttaggaaaatagcttaccattagccaggagttgagcttatagtgttaattccctcccctgactcctttgcctgattctttcaatgttcataggatcttttcaatcctcagacctacctgcatttccagagtgccctgttttctagctcttaggtcaagaggtatcaccatcaagttaatatcctctttcaacatctcataggatcagagctggcatgatgagaggctcatgcattgagctgatgctagggtattttcagtcctgggcagagacctggatgagccagcatgttagtcaaacccagctggcctgcagactgtggtcttaaacaggccacactattgattgatgtggttcagctatacgtgggtgagtgtacatggttgggatcctggaaatttgcaagagtttgaataagctcaatttaatggcccttcatgttggatgaatgtcatggtagagaaagaaatgagggcaaatgttgaggtattcatagatactcataaatctcatgtctttttcagttcttttttttttttaagtggtttgattgccttgaccaaatgaaatcttactcagagcccccccacctttaaaataaacaaaagttgagttattatggttgagtaagggcatgagttcaaagcttctccttgtttttttcattcagcagatacttattaagcatttattttgccagggactctgccaggagctgaggagacggttatacaccaggaagttgagggagttccagctctgagaagttggtctcccctccccaccctccacactgcagtggccccttggaatggatttggaaaccagagtctgtattaagaacagtaaaatggctgggtgtggtggctcacacctgtaattccagcactttgggaggccaaggcgggtggatcacttgaggtcaggagttcgagaccagctgggccaacatagtaaaatcctgtctctactaaaaatacaacaacaacaaataattagccgggtgtggtggcacatgcctgtaatcccagctacgcaggaggctgagacaggagaattgcttgaacctgggaggtgaatgctacagtgagccgagattgtgccactgcactccagcctgggcaacacagtgagaccctgtctcatacaaaacaaaacaaaacaaaacgaaacaaaaaaaaacaggaaaatgaagacaccttgtagattattgtctgacacttgcaagttagtagatttccagtatatgaatacaaattcaagatagtgctttttttctttttctgagtaaacactgagagtatggcaactgccatacacatttccctcttcctagaaaaagctttccctgttcttgatcactccttacctcttacagttggcttgtgacttcctcccaccccaggctggacgttgtttcatgaaagtgtttggcttctccgatgggaacattggattcttgaaggccagggctgtgtcctccacttttgctgacagaagccagcccagcataggcagcagttgctggatgaattctgaggaccacttcttcagctcggcagtgacaccaaccttgttttggtggttttcctatgatggcttggaaattagtggcaaaattggagtgcggatttttgtgggtttttaaaaaccttctgacagttttgggtttgattaatacacctctggaagttagctgcattttatgattcttaggcatggtggtccccagtgttcttacagaaccacctaatttccatggtgtggtgtggtggaaatatcacacatttagagtcaggagaaccagacatggaatcctctttacctggctgtgggcactgggcaaagcacttgtttcctcattggtaacattgcaaggttatggtggggattacaaatgagatagggaaggcgccctacccagtgcttgcaacatcgccagagcttgcaaaagatggacattatcctaattatgacttgaaagcccaaattgggatttatgatcttccctgtttgactgcagaggaggtgatgcctctgtttgcctggtcgccaaaatcattgtcccttccttcttgctgctggtgagactatggttaaaggaccatccttcagcgcagttctttgttacttattgaaaaaggttggcattctggcagaaatgttagcattagaaatgtttctaagccaggcctgacagcttgggcctataatccagcgacttgggaggctgaggcgggaagaccacttgaagccaagaattccagataaacctgggcagcataaggagaccttgtctctaaaaaataaatatgtacataaaataagtaagaaataaaaatagaaatatatttctgctggtgcatctttatggacttgcgggtatatttagggccattcatgaaatcatgtgacctaagacaagctgattaaatacaactgaagatgtctcaggctcagctagatcacacatagaatgggcggggcggcgggggagcataatagcacttccctgccagggttgctgaagggctcagtgaggtgggagatacagtgtgcctgggatgcagataacgtgactgagaaatccacacaggccagcctgggaggcccctgtgttggccccatggccagctacctctctaattctggttctatggcctatgattctttgtcaggtctgctttgtacccctggtagaaccatgtctgagcatgccagccagcagggggatgctctttgtgtgaggagaagctggtctaatcccggatatcctataaagttgagcagtttgtgaggggagacagaggacacgcctttaggactaatgtgtttttccttggcagaagtccaaggtgaacctctgtctttgccaaaggaataccgcttcagggcctgtgactaggatgttctgagtggctgggttggtcttgggagtgggagcctggagccttctcactttggatgcacgcttggtcttgctctgcgatgcgcttggcaagttgccacaattcttatgtctctctctgcttcctcatctgtgaaatgggcttaatagcacctagggaaggaagaacttgtaggtgctgtgtggattcataaattcaccctcagtgagagctttgaagatgtgaaattgtctctggggacttggaggtgttctaaacctgttgaaccagagacattggcatcttactgggttgcctgtagcagctggagagttggaggcctcagatattgggctgggtgttgggcttcaggcagctctttcctggctcctgaatgagttttagttttctccaaggaaatcttgacttgtcttagcttacacatgggggtttgtattggagttttggtttgtgttttctccatatgaaagaaggggtgtgtgagtgtgtgtgtgtgtgcgcgcttgtgtgtgtgtgtacccagaaatggtaggtaactcttactgagatgaaagaatttcaaggcttacacagccaagagagagggcattcacccctttttttcttccattggttaagtttgtcccctagatccttctctgaagtgtgggagctgtacagcactaccagtgagttccttctctgtttaattggaaggacttgttgcagcttgggcgattattctttttggctttcttttcgattatttccccacacttcagattcatttgaaacaagttttcagccttgttcaggtggaaacctgttttcagttgtgggctctcctgacctcactggaagggtgagaagagaggtgaggacgtgggggagggaccccatgccctcactgctcaaagtgtggtcctcaaacgagcagccgcggcatcacctgagttcttattagaaatgcagggtctcgggccccaccccagaccgactgaatcagtcttttgccaagatggccaggtgattcacgtgcatttaggtttaaggagcactagaacattttggattgtatgtagtttttctaataggagtgaaaagggggagggttgttggttgagaagttcgtgtttatgctgatgctgttgcatgcttctctcttctgaagtgcctgcattatcactccccttgacttctaacttccttacgtgttgtccttgacttgtgttagaaagctgtgaagtgtgactgaaactagcgggtgagttaatgtttcctgttccacatcacaccattaagatgtcgcagtgcttgaaagtaaaagatgttcagcatcccaattgcggggtgactgcagactgtcttaaaaagttgggctgggttgtttgaaaatttcaaaaggaagcatctcctaaaatgataaaataggaaaccaaggccacgtcaagaggggatcaaattatgacttgccttctgagcttttcacatggaggtgctccatcagcagttcagaggcagctgggaggctaatcataggagggccaacactggtctgtttttgtttaagagaattatggtaggtggtgatggttttaagagtaagtcagccattctgagagaaggtttgggcagtggcttggtgacatcatcccacttggatgaaagaagagtcaagccagcctttctttggtcaggaggtcctgagaccagcggcccctctgtttctagtgtgaaccattcattacgcaggtgtctctgtcctgagtcggctgggttctgatgtttgcatattgtggttatcctaaaataggatgccctgccatttattgtcctacgctggggagatggccctcacacaatttatgcttctttgaaaaaaatgtcaaattatataaattcaagattatttaggaaacacaagcgattttggtgttcttattgaataaaaagataactagattgttctagcacagaaaaaatattgaaaccatgtgcaactttattctttttttctgaaattacgaacagggcatacatttacctgagggtagaggatgacatcgcctagctaaattcacctttaatgtgtttaattttttttatcctgatgtcagaatcaaggaaaatgatatttattcactttcccctgtagtttctttcttgctttgcgcattcttacttggtttttcccaaagaatttgtcgctcaggtctctgcttcaggaaacacctaactctgggaatgatggtgacagattttgctttgctgtgtctgtcccttgcagtccagtagcatccttggggacatgggcatttctagtctcatctcaacgctatcctagggtgaggctttgtggcgttctgacattatagagcttgagaggaatgtaaaaaaacttgtagtccgtgatttcattcactgggcatagggctcaccagacatgggttaagacaggaggtagaactcacatggtagcctgggcaacatagcaagactctgtctctaccaaaaaattagccgggcatggtggcaggtacatgtagtcctaggtactaaggaggcttaggtgagagaattgcttgagcccaggagttcaaggctacagtgagccttgattgcttcattgcattgcggcctgggtgacagagtgagaccctgtctcaaaaaaaaaaagaaaaaaaaggatagaaactcagatgcttaaggtcaggcaggaaaagcgactttattcataatccttttgcttgctttgctgatccacttgggcagggtctggttgttttacatacatatatgtagaatgtgtgactatgtttgtgtatatgtttataggtgcgtgtatctgtatgtgtttatgtgtatgcatagaatttttttcaccattttaaggagtcccatgataggaacatttgggatgcacagacttcatcttctacacagctgaggacactgatgctcagagaggtgaagtggcccctgtagcatcctgatggaattagaaatcatgccaccttcctgctacttgccctaatattagtctcatcaccttccatgtcactctttgtgtggctagaccattgcttgtcaaactccacaccctcatttttgcctcctctttatacatttgtagtataatatacctaatatttttcctgtaaattgctttttaagttttcatcattagttattttaacatttttcataagaggaaacttcagaatttggctgtaaatggaaaactaatatgatggtgggccagaaaagaaagaacactataaaaataaatacctggtcgggcgcagtggctcccaacactttgggaggccaaggtgggcagatctcaggagttcgagaccagcctggccaacatggtgaaaccccgtctctactaaaattacaaaaattagctgggggtgtggtggcgggcgcctgtaatcccagctactcaggaggctgaggcacgagaatcacttgaacctgggaggcggaggttgcagcgagccgagatcacgcctctgcactctagcctgggcgacaagagcaagactctgtctcaaaataataataataataaaaaaaaatacctagctcctaaaatgtgtgtgtgtgcatatatgtatgtgtatgtacatgtatgtgtatatgctcatccatttgccacctaaaaccatcccacttaccacccggggtacttgcagcacactttgggaaatgctgagttagactagaaacctccaaatcagtttgcaaatgatgtggtgaatggagagacgagtctctaaatgtcattgcccttggtgcactgatggttgagtctaagaatgttcatggagatccagtttctttcttacctgttgagagcaggtgttaggtatggccttgagtcagaccagcacagttttacccatggcctacagcttctgtaaacatctactttttttttttctttttagttcttctacaaagattagaggctgttattgggaatattgtttttctttcattccccttatgtgtcactaacttctaattcttaaattcttaagatatataacctttcaaaaatatataactgattgaatagatgctgtgttttctttttccttccctcccctcccctccctttttttttttttttttttttttttttgagatggagtctccctctgtcacccaggctggagtgcagtagtgcaatcacagctcactgcaacctcttcctcccagtttaaagtgattcttctgcctcagcctcctgctagctgggattacaggtgcctaccaccatacctggcaaatttcttgtatttttagtagagatggggtttcaccatgttggtcaggctggtcttgaactcctgacctcaggtgattcacccaccttggcctcctaaagagctgggattaataggtgtgagccactgcacccggctttttttttttttttttgagaccggtctttcatatattgcagaggttggtctggaactcctggcctcaccctcctgagtatctggtattataagtataagccaccatgcctggcagatgctttcgtaatttttgtgatagtgacagtgatattgtgatttcttaattcttgcgatagtgacagtggtattggtctcaaatggctaactggacaaaatattgttgcctcaaattaatcttttggtttagatttatatcctacctttgaattttgataattgacagttaagtagtgtttagatctgaggtggccatgataaaatatgttggttctgacagttactaatttcttcccctattagctcttttgagtgaaggggaaaatacaccgcttttaacacttcagaataattatagaaaaaagaaccagcattgaattattataggaaacaaatttttgttttctacccttgccatttgaacctagctccctaaaatgaatggtagatttaaattatggagcccatgagggaaaattttttaaaaatgctgctttgccatttttcctgtgcaggagaatatgcaaatggcctttctgtggtcgccctgtcacagccttgtaaaggttctgtggggatccatgcatcttgttgagttgagccttgtgccagcttggagggtttgattgtttttgctaatagagacagattttgtcattagagacaccgaagtgtgattctgtctacattcttctcaagtgtatggtcatagaaatccctttggctttaggtgcaattcagtggaaacacacacacacacacacacacacacacacacccacaagcacacagaatttcactgtggaattggcaaggaataagtgagccaaatttggcctgtagaaattaacactggcaacttcgtgagtaaaaattacatgaaaagcactcatgagggaaggaagaaggaaaaaaaaaaaactaggataacagtgcaacagaccacatttcctatccacagtctgtcttctcgggggtgtttgtctaaacagcattgccagtttttctaaacagtactgctggtgtcctcgatctgtaatatgaagtgaatcggctatgcggaccaaatgctcgttgggttgagagttcctttatttggccaaattaaacccaacagcctcagctctgtccaaacttgtactagtccagggccagctaagatgcctgtcctcatttgtagatctgcatagaaaaataaaaatgatgcattaactgtttcccaaccttttggttgaaaggaatttagctccacataaaatatagtcaatttttgtctcctaaaagctggaaatgtaatactttgagattgtctcagatgtgaaaaaaaaaatcacaagaagctccatgtggtttttagaaagataagttctgatattaaaatcttgtgtggatggtctattatttcatctctgccatccttagcatctgctggggaagatagtccagaagcccagtgctcatttttaggaggacaacttggaatggtttatggttttggttttggtgccgggtcttacacgtcttagtccacaagctcaaatacagagataattggaagtctaaaatcaataaccatggaatatagccaatgcgaaacagatgccggaataaaccatctgtaaatttcatggtgggtgaggtggggactcaaaatgtttatttgcatcgtgtggacgactgggctcagcctggaggatgtcgcgagtctgtaccatttgacttcagcacactcctctctccagccgcagctccacctgtggtctgaagtgtatttgcagaattgctttgagcattttgtaaggacctcctctagttttttgcatataccaggaattcagcgaataggattggacatttgtttttatcagagactgactggttccgccccagtctcccctttgctcatcagcttgagtgattttttttcaaaatgcaaatgtgatcatgtcccactcacctgtttaccaggccgaggtcccttcactggcctcccattacccttatgataaagggaaagttctgtaatttcaggatggcctttatagtgtgagttctgcctcttctccttctatgcggccaccacccccgccccctttttttcctgctgcaaccacatcttaactctgcttccaggtaccacggggtctttgcatatgcagttccttctgcctgtaatatgcctccctctcctcttcactcttcacccatttacctgctgctcatccttcagctctcagctcagttgtcacctcctcagggaagccttccctgacctatctgaccatacgtcatttttttttgcgtgtgtgtgtgtgtgtgtgtgtgtgtgtgtgtgttttgagacagagttttgttctgtggcccaggctggagtgcagtagtgtaatcatagctccctgcagcatcaaactcctgggctaaagtgattcttctgcctcagccccccaaatagctgggattacaggtggtgtacaccaccatacctggcaaatttttattttaaaattgtctgtagagatggggtcttactgtatttcccaggttggtctcgaactcctggcctcaagcaaccctcctgcctcgtcctcccaaagtgttggtattacaggtgtaagtcactgtgcccagcccctgaccatcctaatgcctcccttatattttctcctggacccatataacttgctttttgtggcattcatccctttcggttttatacacatctttgtttctattttgattaatgtctgtcttctccccagctccaaaagacaagaatgtaactttacaggttctttctgttgtgttttggtctctgagtacaatacctggcacaaagtaggtaatttgtaaatatttcttcagcaaatggtgattgatagtagttggtctatcattcctgtgacgaaagatgccgaagtcccagatttctattatcttgagcccctttgaagtcctctttgaaaaccaaaccaaatagtttacttacaaaccaagtggttactctttaagtggtttattttatcagttttctaaagttgcctttatgttacagggctgaggttctttttgaggagtgatgatgtgttttgtggtgttaaggacagtttgtggtcatgactattttacagtcaaagacccaaacatcagatactaaagcccttaatagaaaaaaaaaaaaaaagagcaactaatgattgagttatgttctgcttacacttacacttcctaatgatgtgtctgtctgtttctgcctcattttctttgttcacttgatgttatgggaccatttatgtcctgtgccgttaaagccacttaagtctctcagcctcagtgtccttctctgtgaaaccagggagttggaatccatgatttctacattccttttttgctcagatagtctagattttgtttgtataaatattggctctcacatcaaagacccaggttcaaaaaacatgtttttatgtctacattgtataaagcctcatggtttcttaaaacatattttgttatcaacaggagtgaaaattataatcacaatttatagattaaaaaattatactgaaagatattagctggattaaaaaaattgctgggatcctcatttctcagtgttttttcatgggattttaaataggtaatctatggaggatggttttaaattgagaacatctcagagcgtctgatacagacacgtgtcgaatgaatttcctagagttggggtattgcatacttactttcttgaacacagattccctttctttcttcagaatgcccgtgtggaggaggtagttcagatataggtgactcttaagatatgaatgacagcttaatgttttcaagtacctagatttttcttagggtgagattatagatactttgagtgtgtcttaattttttaaagtgaacaacagaaacaaagtgctgggaaaatgcagtattttgaatgggaacatggtaatggattattaatgtgaagccagatgcaggatttgaatactaaaccctgaagctatgcaattctgctgatccatcagcgagtgctatttaaaaattcacaggcctcatctaagttatcatttttattttgcatgctctgtgattgtctttttagtcatcacccatggcattgtcttaggcacacccggtgtttcccagcaaggctcctaagaggtgcctttgaggccagggctccgcttgtcctcctcgtgccctctccccttactccccctctgcgggctggggcacgtctagaagactccaagagccatgttagaatatcccttggagcagaggcaattccctttatttgttcccttcttttaataattggaagtgagacctaaatcttacccagtaagtcctcgaattggcagacaagtatattggtgggcggcaaaagcctggggctgcatcccctgctgtgtgggtgtggatggtgccgcaggtctgggcagtgcatctgtgactgggattttcctggccttctaaagccagaggctgaggcccaggtggatgctgaccaagtgctttccaatgtgcagggccccgagctgggtgtggaggcacaggacggtggccttgttgcactgggaacctgatgcggtggattctttatgacggctggccaaaaagcagagcctggaaacaggaaatccccatcacgttccgcagacaatctcagggaggtggttggaaattgttttaaaactgcatctgaaaaatcgtgaacctgatactaaaacaatttggatggccggcaagaccgagagttggggtgcttctcggtggcttttctttgccttgggtggccagcaacccgtgggtggctttagcatgagcctccgcagcctaggaagggatggatggatggctttgaatctttcctttctgccctacatccttcctgcctgcttcacattcctcccctcatccttggctccttctcgtaattccatgtctatttatttcacaaggaataaatgttgatggcttaaatgagagataaaagaaaaaagtgcctacaggtaacgaggggaaaagatatataaaatgttactgtaacattgtgtggtatttccttccattgtttttttctaggtatgtaagcacacacacccatgtatatatattttcaaaatgaggtcataccgtacatgctgtttggtagtttgtctttttccttgaaaatatatcatggaacttactgtgatctgtgtcaaaaaccaaaatagatgaacaaagataggctaaagcaagtaaagtaaaatgttaattggcaacatctaagaggcaggtatatgggtgttaaatatgttgtcttttcaacttgtctggatgtttgaacatttttataataaaattttgcagggtggggggaggtttagtgacggacaaaaagacagaaattaaacaagtagtaaaagtacagtatgtgtgtatatgtgtgtgtgggcatgtctgtgtgtgtgtgccattctgctctatcattaatgtaggtatgtatcattctttgtaatggcagcgcagcattgtgtcatatggatgaagtgtcatttatttagccagttccatactggttggctgttttgggtgtgtgtgtgtgtgtgtgtgtgtgtgtgtgtctatttgggggatgtgtgtgtgtctatttgggggggtgtgtgtgtgtctatttgggggggtggtgtgtgtgtgtctatttgagatgtgtgtgtctatttgggggttatgtgtgtggctgtttgggggtgcgtgtgtgtgtgtgttttagctgaatagccggttggctgtttgtcggtttttggtttgtttgttgcctcctccacctttgtgtgtttttcaaagacgaagccctgtgtatgaatttgggcagtcattcctgtacatcagaagacaaagcacctactgaaattcctcctttttttaaactcttactgcatatgtgcacaggcggcacattaattctccagccggttagcctatattaagcaggaaaatatttttaattagacaaacatattcacccccaaatgtgtttattctcccttgtcaattttttaaaaaaatatatgcattacgagttgttttattggtgcctgggttcccagggaggaggtagaggagaggtgggggtaagtcagtggtggagttcacaagatgtgaagggtgagcccagtgtttcttgggactacaacctgtgttaaggacccatttttctttctatatcttttatttctacttacccaaggacaaggtttggttgcatcatgttgagttgttcagaatggtgcatccctcttgggtaacattttcttcaaagggtagttgggcgttcttatgccccatttgtgattttctttggctttatgttttagtccctagtctggcccactttggccagaatactgtgatgtttttccctccttaacagagtcataacatggagatcaagggagaagcagcgttgggggcccagtcgatgagatcatgcccctcaacatgactaatacttcagtcctagaaacctgcccttcaccccaccctataaaccccattatgtctttgcagaaggtagtttgggagatagtaactttgagccctcatggagttccaggcaaagcatctgagaccaagacacattaaataacttgcccaaaggcgcccaggtgccaggagcaagtctaggtgtctctagatcccctacaccatgcgacctgtccctcttaagggtcccaaggattttgaatagattgccagacaggaaaaggaatgatttgtccagaggtcatttcaaggactgcagggggagacaggtgctgtagggcaagacacagtgactcttctgtttagaagcacttgcgcttttaatagtaataacaacattcttcatcatttttgagacttttaggctttacttttagtcacagtgttgggatttgtaatgtaagttatctcatttgacatatccacgtctcagtcggtggatgggtaatgggatgcccgcttcccctactccagatgattgatgaagaaatggaggtgtatggagatgaggtgacttgcccaggatcagagctttaagtgacagaggcaatattggaactgaggtttccctcattcaaaagccagtggtgcttgtttgcactgccacactggagcagactaactgagaccgctcttgatgggtccttttctacgagaggctttgcctgccacctgccagcatcaggtgatcagaagatgtggtatgaagaccattcagccgggcgcagtggctcatgcctgtaatcctagcactttgggaggccagggcgggtggatcacgaggtcaggagatcgagaccatcctggctaacacggtgaaaccctgtctctactaaaaatagaaaaaattagccgggcatggtggcggatgcctgtgtgtgtgtagtcccagctacttggaaggttgaggcaggagaatagcttgaacccgggaggcggagcttgcagtgagcccatatcgcgccactgcactccagcctgggtgacagagcaagactccgtcactcacacacacacatacacacacacacacacacacacacacacacacacacacgcccattcagcctctggtttaagtccacaacaagtttgtccactctggagggggaactggagcagatgcataagaaagaagcgaatggagctaggggttacaaatttgtagacgtcctatatattgtgtgatgtcaaagggtaataagcatgtatatttcatatatgggaatttaaaagttattttatatcctgttgtgctctgtagagagtggattaattcaattacatctttgcatgtgactaacattggagttcctaaagaaagccctaataaccagcatctctgggagtaaacggcttgcctgtttgtctcgtctgctacacatatgaagccacgcgtgataaggcatacctctagtcagcttctaacatgagcagtaggcgaggaaatagacaaataccagccattcttaagaaaagccatagaacaatgtttgttctgggaaaaagacatttattgcttttttatgcaaaggacagaaatatgatgtgtctttcaactttgaaaaggtaaggtatcatggaacaaagcctattccacttgaagtcctgattcttccatgatacatccctctaagagatcagaaacgtaaaatcagtgtttggggaaattttaaaaaaatgtattaaagcagggcttgacatttgtttcataattcctttgggaggacacatgaaacattgatacaatgtgtgtggacaatttaaaaaacccatggatgcctttttgactgcataatcataaggacacagcttatagtgaatgaaggaggttgtgcctcttgtgagtaagtaaaattacgtcaggaaggataagccacaactggaagcataccataatttcttggaatagaaaaaagttggaaacaaagataataatccacctgaaatttgtaaatgttgcaactaactagctccaataaggaaacagactttttaacttaaaaaaaattgtgggcagttgattcagtaaaaaatatcaaaagatctctgattctgtgtctcagaagcttcagtctggtagatacttgcttttttgaaaaggaaaataactcgtaggtacaattttgtgacaattagcttataccaggcactgtgcttatttgaagtcccttattgcatcctcctgaaaactctgagtggttaagtcctgttcttggccatattttacaggtgagggagctgacactgagagaggtaaaataactggccaagccacactgtttttttgttgttttgttgttgctgttgttgttggttttgagacagggtctcatgctgttgttcaggctggagtgcagtggtgtgatcacagctcaccgcacccttgacctctgggtctcaggttatcctcccgtctcacccttccaggtagctgagactacaggcacatgctaccacacctggctaattttttgtatttttagcagagacaaggttttgccatgttgcccaggctggtctcaaactcctgggctcaagtgattcgcctgcctcagcctcccaaagtgctgggattactgcacactgtttttaaggagaggaactgagacttgaacccaggcagtttaaccccagagttaaaacccctaactgctgggctatgttacttttacttccaggttttttgttttaaattttctcactgttaatgtcagaatagcctgagatctcttttttttttttccaaagtaaataacttagattcaaggccattcttcattccgaaaagataggtgagccctagtgcagttgtgtctccatagacagattagcctgcttcttgcctcctgcctaccaaagaggatacagaggtggttgtattagcatattcattcattcattctcctgtttatttctttactcagtaaatatctcagtgctggttacattccaggtactagttcacagattattagtatgcagcagtggccaaaactactccctgatctcatggcacttttatcctagatggggaaacaaatcaaacactatataatgtttctcttggtggtaagtggtatggagaaaataaatcaggataaagaaatggagactgtgggtgaggaatgtgctgtttttacttaggaacattaagaaagaaaaagatagtgagacctgagggggccatgagaatatttgagggaagaccattcctgaatgagaacagcaagtgcaaaggccctgcagtgagagcctgctcataaaggaaaaaacctgctgtgcacgttagtctgcacttcatattccttcctgattggactattatacatttctctgggggaatgtcagcattgatctgcattaaataatgaggtgctaaataagctaaacgtggcatttctggttccaaagattcagtaaacataggatgtagcccaaatgatttgttcatcgattctgcctctaagatacatctttttctagccaatttagtggtttatttttagtggactgtagtctcatcctagtaattagaaaccgggatctttatgctgcactgtggaatggttatgacagggtgtctgctgccccttgcctctacttacccatttagagcaaatgaaaagaattgcctttatgctgtgaaaaagagaaagtcttccatcatggcagagcagaacatccaccaactgttttactatctcatctaaatgcttccgctttagtcaataaaatgtgatcagatgctctgttcctaaaatttgcttggctgtaccattgcaaattgttggtatcggcccattgggaatgatattttcttgaagaaaagtcttctgaaatccacaaattcctgctggacattcatggcacaatgtatatttaaaaacctcgtgaatgtgcgcatggtaacggctgtgtgcgagcctgattagctggttttcaacttgcttggctttctttaaaattatttttcaaaaccatcctttctagttaaggggagcataaaggcatcagaaacccacttacagcatttcatttctgatatccctcaacacagaataaacaatgaaactgatttcagtttgaatggtctctgaaatatttcctttatgcttggcagccctatgcaaaaatttccgcctgttgcaaattaaaagtcttcgagttgcaaacccccctgaagaaaggttctgataatagggacgttgtcagacccttaactaagccacacactgctgggagcctccggaataactttaatgtagttgtagggaagggagtcgttggcagggatgaggatccctgcttgactgctctctttcctgacgaggaagaaaaggacagtgatcaagcacagggtctcaaaggaggtcttaaatcaccagggaacatgaagaatgggacgtacacaggctgctggggaagcgggcacaaagcccctgaattgtagagcgacagataattcttgtacgaacacccagatgactgggaaccttttccttatggattaaacaggacccaagtgcactaggctaatgggaaatgctgaaatggagattttttttttttggtccctatttttgtgctgtttatgatccgccagcaggaatatttcacggcatcaaagacatggccagaaagcaaaaagatgtatacacacacacacacacacgcacagttcttctgtatctcacaaccctgataccacatatggcctttccgaagggagtattgtatgttgtttagtcttggaacttcttttaaagataggatgtcatttacaatcctcaggccatatgtttactcagacttaagaaacatgggctaatctttttctattttgaggagtaataaattgaaaagataattacataatatggtgcataatgtaactctggcttgagccatatgtgtttaattttagaaaaacatgcgtgatgacaggttatgaaaggatgaaactattttagtctttttaaggattagaagcatgatttttaaaatgtgtgttcccgccaccccccaccccagcctccaaaaaacaacccaatacacaaacccagtgaaacatacactactgaaagtcatttgtttttgtggtggccactggcaaagaaaattcaagttagaggacatattactttcaagctcttgtaaaattagatgcaggcttctgtgtgctggggagaatgggtggcgtgccgttcccaatgcaagaaacagagtggagttgctgtatttagaatcaagcagaaatttctcctgtgactatccaattagaaacagcccgggttatctctttccttattgaacatgatagcatatctgatataaactgttgtggcgggagaaatgcaagatcctttctttctttccctccataagcatctgttgagcccctggtgtgctccaagcactgtgcttggtacctaagttgcaggggcaggtaaaatactcaccataaaactgtaaagcaagcaggaggcttgtatactgagacccactttcacgttattgtcagaatgtgtcatttttgcctgcgatcctgatctggaggcagaattgtcaggtgtggaaggcagaataacacaacccaaagagctctacatcctaatcccttggatctgggaatatggtatgttacatggcaagggagaattaaggttgcaaatgcaattaaggttgttgatcacctgcccccttgagaaggggaggttatcttggagtatctcggcgaacccagtggaatcaccagtgtccttaaaagtagaagaaggctgctaaagagagagagcctgagagatagcatcacgagaaggacttggctcaatgttgctgactttggaaatggaataccctgatttgattttcacacaagatacgcatgtgtcaaaaaatcatactgtaccatatatatatatatatatacacatacagttattatgtgtcaattaaaaacaaaagaaaaaaataacgaaaataattcgggaagaggccacaggctaagagatgtgagcagctccaagaagctggaaatagtgaggaagcagattctccactggaaggaacacagtccttgatttcagcccgttggggcccatctgagacttctgatctccagaactgtaagataagaaatgtgtgttgttttaagcccttaagtttgcaggaatttgttacacagcaaaatgaaactaattcatcggggaaggaccacgtgcctggtatggtacggtgactggaacagttgttctccaacaaggctgcatgttggagtgaaaagctttaaaaagtactgctgcctggctgggcgtggtggctcacacctgtaatcccagcactttgggaggccgaggcaggtggattacctgaggtcaggagttcgagaccaccctgcccaacatggtgaaaccctgtctctactaaaaatataaaaaattagccgggcgttggggcgggcacctgtaatcccagctacttgggaggctgaggcaagagaattgcttgaacccgggaggcagaggttgtgatgagccgagattgagccactgcactccagcctgggtgacaagagtgaaactccatctcaaaaaaataaataaataaataaataaatactgttgcctggaccctcgatcttagacattccaatttaattggcctggaggttgacctggacattggccttttataaccttcccaagtgattctgaggtgcagctgggaacgtggaactctggtttagggcctaaatctgtggaatcagatctacctggcctcctagccaacatctgcctcctcctggctgtctgtctgggtggattattctcttagcttcagtttttccatctgcaaactggtaatactgtgaacttctacctagggtggtgcagtccagaaatgtgaaagagcttttgtgtgtctcacatggtcattgctcaataaatggcagctactgtttttactcgtaaggtgatgatttggatgcacagaacatagattcccctgatgtctggctaacttatacaccttacattcacacctgccttctgaggtagctgctgttactataccctttccataggcgaggatggcaggcatcagaaaaggccaaccactcttccatagttgcacagagactaaatatgggagcctggacttgaacccaaggctcactgtgagtttggggccatgcatccttgccccttgtctttgggagacctccacgtaaaggctggcaaggcagatgtgtggaaatttggaagttggtggctgcgtgctggtgcagtgcctttggaggtatttcacaaaccattagcagtgtcagtccttgggctgggggtggcattttgtaccggattcagtctctgcacgataaaccatattgccctgttgcctgccatcagggaaaaggaggttgaaagccatgggaatgaggattcttaatagttataggctgcttgcctctgtctgccgtttagtctaatctcaggttcagttgatactattgattagtctcttttcaaaaccttgtgaggcctatggggcttctctgtgtggggtaaaatggtattcttctcatatgtgaattgagaagaaaaggtgaaagtatacaattaatttgcctgcactttcttgtaaattgtatgctggatttctgtgaaatgctgtatggaacaatattccaagcaaattattgttatttactgtgacttttgcctgcatatttaaagtcaacaattatgggtttttttttttcttcttaatggcctttgtacaacatttttagaaacttggtcaggtgtcactaagaaaacttgtgctttggctctgggatttttgggaaacaaattaacaatatcaaaagtaacaataaagtcttgtttccaaaagaaataacccaatacaggccggcctggtggctcatgcctgtaatcccagcactttgggagactgaggtgggcggatcaactgaggtggggagttcgagaccagcctggccaacatggagaaaccctgtctctactaaaaatacaaaattagccaggcatggtggtgcatgtctataatcccagctactcgggaggctgaggcaggagaatcacttgaacctgggaggcggaggttgcggtgagccaagatcacgccactggactccagcctgggcaacaagagcgaaactccatctcaaaaaaaaaaaaaaaaaaaaaaaagaaaaagaaaagaaaaaaaccccaatacatggggatctccattgcccatcccctcctctaaggtaattatctgtaggccatcgccatatctcttctttgttttagaaagacatcttttgttatcattcatgttaatattattgaaagcaaataaaatggaattttacattcttttcttcacatgccatctattttgatgggcagttttatcatacttggaattccatcatttctcggatcctttacttttttgttgttgttgctgtttttgaggcagtgtcttgctctgttgcacaggctggagtgcagtggtgcgatcttggctcactacaacctccacctcttgggcccaaacaatcttgccacctcagcctcccaagtagctgggactacaggtgcctgccaccacatcgggctattttttttgtatttttagtggagatggggtttcgccatgttgcccaggctggtcttgaattcctaggtgcaagtgatccacccaccttggcctcccaaagtattgggatcacaggcatgagccaccgtgcctaagccagctcctttattcttaacagagagagaataaactctttcctataaacatgaggcacgcgtgcatgcacgcgcacacacactcacacacctctcacatcagtaatcctcctttaatcccagtccaaatcttgaaacagttcccttgtttttctgttgccttttttcttcaccatttatgagccatcaccctgaaaactttcagtgatgagccacatcattttttgaaaacaccatctccagctcagagatccaggcgagctttttgttaaatcagggttccatactcctagccccagctggaattttgaagaacagtttgtgttcttcactacatcagactggaagagacatgtacacgccacacatgaacacatgaggattttgtgacttggagaagatccagcttcactgttcctgatcactcagtaattggggttatgatatttctaccagaaagaaaaaacaaaacaaaaaagtaaacttcctcttttgagaaactaatttggttttgcttatacaatctcttatctgacgaagagggtgcttggctaaatatgtgtaaaaagacaacctagttgattgagggatttttcaaaccatcttcagaattcacttggcagggagtggattgggtggagagcctgagacatataccagttagaggaatatacagggttagcagtcatctgcatcctgttcaccctgaaggaacccctcttagcagcttgtcctatttgcttttagatatatttaaaacaaataaaacatttcagcaacacctaagatctcttataacttttccccttcccacttctcagcagcacattccatcaggagcttggggtacccgttccattccatttatatacacttatgtacacaggtagccttttctgagagtgtgtatttagtttacaagtttagtatcaaactatattgtatcctaactacttcatgctgaatttattcaggcacgattttgaaaaaggtatcatgttgacatgtatagatctcacttaccctgctagaaatgtacaaagtattctgtcatttgtcaatgaattgtgcttattcattccacagataacagacatttatgatttgattgattgagacagggtctcattttttcgcccaggctggagtgcagtggcgcaaacatggtttactgcagtctcaaccttccaggctcaagcgatcctcccacttcagccccccaagtagctgggactacaggcatgcaccaccatggctggctaatttttgtatctttagtagagatggggttttgccatgttgcccaggctggtctcaaacttctgtgctcaagtgatccacctgcctcagcctcccaaagtgctgggtttgtgggtgtgagccaccgcgcccggcctgtgattttatttttaaagcaataaacatctttggcatgcatgagaacttctttagagtaaatacctggaagtagaattaggacaataaaccgcactcactaaggtttcttgatccccagttcagagcctgccacaactccagtgaggaagatgtttgtgtgccattccgtctctcatggcgtttatagcctggtgaggagtaggataggggtggggataggggtgagggataactccacgtacagaataactgtttcccagctggactgaattggtgctccagggaggaagtaacggctgcctgggccccggtgtcttgtaacagacagattcaaatttgtgttgtgtccattcactttgtctgtttgaagagagatatcccgcttcattgattgaatggggagagcctcgtctttagttgcaggttgtaacaagatttagcgaaggaaggtatcaaccaattagtgcagcactagagcagagacagttccagatgcccagcaaaggttgtcttgcatacagacctgttcatgtgctctctcccgcatcccttttaagaggctaacagaaacccagagaggaatgttggaagccaaataaaaatagcattaaaaacaaggaaaatgtaagaataaaagagaggaaggatttctgagtgaatgaggctttcagctgctgcctctcatcctgaattgtgatatgtagatctgtctcttgcttagcctgacagcttctggggacaacacgaatttttcagtcggtgtgagaaatgccccatccacaccaattgataccctcccctggcagctgcctctctctctctcttttatcattcctcttgatccgtcatccagagaatgctagaaggcatgagaatgtaagttccaaataggagttggtgcctgttttctatcttggtttattttcaaaaccctttttgaacttttgaactgttggtacccagggggcaatgtgcaggggagttgataaataaagataatgttgatgtaagtacagtttctttcatatgtaactagagaagcatgtgagttttcagataagcttttcttagaaaaaataaaattttaaatgtcaaagttttttgagtgggggtggaggagactcccgtacggaaggactcgtcttagacaagagacagactgatgaagagaaaagcaaactgacagcatgtaggtaaatttgactgaagatccttctgtttttatgagacgtagacttccctcctccttatgtgttctcctgaagcctctgtttattattggggtattactttctttgtctgaaatagtcattttctaattcttcctcaaaaaaattgcaggggggttctacatctaacacaatgtaggtcattgatctgggagattgttctcttttaaaaacaaaaatgatggggaaaaaattcagcttcttttacttcccaagcatcttttgaaaatgtgaggttctgtattcagatgaaagtccacacaaagcattaattacacataaattggctggccgtggtggctcaggcattgatcccagaactttgggaggccgaggtgggtggaccacttgaggccaggattgcaagaccagcctggccaacatggtgaaacaccatctctactaaacatacaaaaattagccaggcatggtggctcgtgcctgtaatcccagctactcaggaggctgaggcacgagaatcgattgaacccaggaatttggaggttgcagtgagccgagattgcaccactgcactccagcctgggcaacagaacgagactctgtctcaaaaaaaaaatcatacataaattaataaaacagagaaggtgtatgccttagaaacacccaatacactaactacctgattatcagattaagtccatgaaaaatttgaaataattggtttcattgcattcatgccagcactgggttgaatcagccaggtaatgatatcaataagatttacgtcaatattatggtgacataaacattttttacctacttgccaaaatttttttttaatgggttcagccccaaaccctcccaggaaaacatacactgccaagtgcgaggtaaaaaatgaaagtttgtcacatgaaaaaatttatgtatctggaaataatggtcataattattaacactgcattaattagatttggcattggtgttttgagtttcaattttttgtctctgggtttacattttaattatcttgggattcacagattgatgtggaacatactaggcatttgctaaatcgttttcaaattaacaactggagaaatttttaaatgattcgtagagccatttgtagagtttcatggaaagatttcccagtaaaatgaaggtttgtaagaggtgcagagagtgaagtggctgactgtagttatacataaaattgcccctgctaatgtttgaccacactgcttttggattcattttacttacatatttcaggtgtatgcctttcaaaggttgagatgtggtaagaggaaatttcatcatgctccatctcagaaggttgtaggttatcaaaggttgcaaaccccctttccctgccctggttgtcagtagtgcttccgtctgggtgaatgttggaactatgttctgtgtgcaatctgggagttgatttttatcgactttagtgaaatgcataggattttagaacttcaggtatacccaaatagctgcttattttgaaacttgcttgaatttcttgtttctaaaatgtatggtgggagatggtggaataaagggtattttatactttccttaagtgtagtcaccttttcttaaatttctggtttgtagttttgtttcttcatgacttgggagctttagagaatgtatcatactgtgaagttgtttgactcctttagagatgtgtctgagtgtgttttgtgtgtatatacacacatacatatgtatacacctaaacctatgtacatacctgtatatctacacatatacacatatgtgtatgtacacacatagacacacgtatggttgttaaatttcataaacccaaataattcaagtttctttcctaacacagaaagtcacttctacgaacagttgaaaaataaatattataatcagcgaggcatcacaaataacttttatgtctaaatcaagctattaaatgcttttttatttttaagtagataggggaataaaatagctgtatagttcataaagtggtgtgccattactgcctgctgtgcccaagaattatgccagctttttacactcatgaagtaaaagcggattagaactgtgatcaatgtattatcctatatatcttattttgcattgtatttcctttttgagcacctttgtagactaaatggctactaatgacataattacaattgtttgtcaccaccataatgcatgatttcctatctcatcatgaagatgtaagttagataaaggaggagttttggcaggaagacaaagtgcagtgatttattaaaggccagatgtggttgttaaaagcttttctacagaaggcacaattgagtgatgtgaaatgggagcaaaatcactctgcacccccagcccgtggttcttggtgtgagtgacatagttgcttctggaagcatgacaaatgagccacatgttttattgttgtgtacaaattttatgttggaatttaaacagggtgaaaagggttcacattagcttataccagcaaagtaggtgtttaaaggaagctaatgagactaaagggctggcgatgttttcagcgtgcttagtgcttcatagcaagaactgaaatatcttatgtttctgtcaagtttcaaagagggaaaatcccagcactgttttaaaaaaatgagagtggttaatatgagaattcaaagaaatcagaagcaagtggagacaagatattacttaagcactgttgacatacatattgcacacatcgacttgacatatatacaatcagattagatagatgcttctaaggaaagaggcacaatttctggttttagcattatttgcacacacaaagctctgttaaaataatgttaagacattggagtgttagaagctatgagtggtacgaagagtgttttcaagcttttggaggaggataaaaaaagaaaatggttgtatcttaaaagctattctgtggacagaaggtagtgatctttctggttttccttccttcctctccccttctctctctttccccactctctctgcttcttccttctttccctgtctctaccttctccctccttcccttgcatccctgtaaaatgttatacggagaacagttaaactgtaggattaggtctgtctgtacagcttgggacctggaattatactagacataggaactttcctgccttttccagtgtagatggagaaattattctaaatggtataagttgaagacttcaaaggtttctagattaactctgtgaaatcagtgagagctttggtggggttttccttccttgtcctctcagctgaaaatatggggtcctcctattgttttctcccatagtactgcagacttgatagctcttgtagacttgaccatacattgtaattatatgtctatttgtaaaatcatttgtttaacatttatttcccagtgttcagtctgtaagttccacagaggcaaaaactggccccaaggcccgtcgcattgcctggcacataatgtacatttggaaagtatttgttgaacaatccaaagaaccgcaggcagcaatacctacattcaggatatcacttggaaaaactagcaaaatccatccagataaaacgttcccagattataaatgctcatccacataatctgtggagcagttcagatggctcttttgcaactttcttaaagtttggaactttggaatccagttagatctcgttccttccgaatgggtttttgcctcctaagctctcttcatgcaattccagggactgccacttgatggcttagacaatttaaaatataaagtgggaaaggtacacgtgcttccaaccctgcctagactctgctggttccatttaaatgggtatatatacacatatatatatatggatatatatatacacatatatatgtatatatatatacacacatatatgtatatatatatacacacatatatatatggggatatatatggggatatatatatacacatatatnnnnnnnnnnnnnnnnnnnnttatatttcagttgtgtgtgtgtgtttgtgtaggaaaagttaaatattaaatttgaactcaattgaacgagaacacaaacaatggtcaccaagtcccggaagaggttgtgtgagcccctttaggcattcatccagtgctgttttggagaaatctctatttcaatctattcctatatgttagttattgaaaaacaatagacaatcgcaaaaacaagttgacctttttgtgttccttgagcccagtcgcgaagggccctcatgactgggcctcatgtcaaacaacttgttacaaaaagacctagggtcccagtctgtgccaatgtttcatgagacctctcctcatctgtgcatggatgagtgactgactctggagcccaggctgttgcttcctggtctggtggtgaatcctccatagtctggtgggtatatatatatatacacatatatatatatatatgtgtatatatatacacacatatatatatatgtgtatatatatatatacacacatatatatgtgtgtatatatatatatacacatatatatatgtgtgtatatatatatatacacacatatatatgttccttatgactcatacattgaaccttatacggagatgaatacagttgaagtacagggagtaaagtttcggagaaataaaacacttagaatcagggctgtattcgtgggtgtgagacatgcccaatctcacaagacctgacgcttagaagggacccacacttggtttaatgctctgctgctgctgtcttcttaaacattttttaaaattttgaacaaggggtcccaagtgttcattatgccacgggccccataaattatgtagtcagtctgaactggaatttgtgttacttgaaggtaggttgctttaggcctgatcttagctgaccatggctcctttaggagtctttgtttagtgcttggtaggaagcttgttcccacgggacaagcctgtgggttaagagcttggctttgactcagacttcctgggtcaaatcctggctctgcaactgggtcagttacttaaactttccaagcccagtttcctcatttacaaaatggagatgataatagtgtgtctgcttcctagacttgagttgattaaactaacgtcccaggtgcacgtcttagggctgagcactgcatttctgctaggtatggttgcaatcatcgggcaccacattcctggttacacctgacacttactgagcttcctgctctctgtggcagctccaaaagtttcaggattcttgccctgctttgatgctctactgttccagcactcaaggttctgtgtagtccggtagcagagttcaagttagactgaactctaagacttgactcagctctgccctatccctcctcctgaatgaggctctagctgctcttctttaagccttctcttttatgttagatgattaattaatatggaaaggaattgtgtaactaaactttgcatttttgtaacccatctctgtttcctggtgggtgcaaagatgcctcttattcgatatatcattaaagaaaccagtctttttttctgcagagcatttataatatattttaatatagccaagtcattcataaccaacccccccattaattacaggaaatttgcgcaacattgaccatatcaaaggactctacattataaagaggagaatacattattggagaccgatatgatgtgggatatgattcattcattcatttagcaattatttattgaagactttgtgtgtgccaggcagtgttgtacgtactgggaatataactgttaacaagactgccaagaaccttgctgttgtgttgctggtattctagtagggtacagatactaaacaaacaacaaagaacagtatcagaggaaagtgctgtgcagagaaataaaacagaatgatgaaataaggagtgcccctgggccagtttagatgaggtacccaggtaaggcttctcagaggaggtgacttttgagctgaggtctgaatggcaagaaggaggcagccaggagcagcttggaagagaagcattccagacttagggaacaaccagtgttcagaccctggggtatcatgaactgggtgggtctgaggaacagaaaaaaggcatacaagatggagagcagaaacactcaaggcagcagaactagttggggcctgatcttacagactttggaaaccagggtcgcaagacgccgagctttattcttctacctattactttaatgctaaaagggaactaggaatctgttcagtcatgagccaaataatagaatcagtgaaacagtctccagatattaactagggggaagtagatggttttgtctggattatccagttcaattttttttttttttttttttttttgtgacggggtttcactcttgttgcccaggctggagtgcagtggcgcgatcttggctcaccgcaacctctgcctcctgggttcaagcaattctcctgcctcagcctcccaagtagctgggattacaggcatgctccaccacatccggttaattttgtatttttagtagagacgaggtttctccatgttggtcaggctggtctcgaactcccgacctcaggtgatctgcccgtctcggcctcccaaagtgctgggattacaggcgttagccaccgcgcccagcctccagttcaattctttcgttaagagccataatagtgaaaggagcactggaattggagtccccaaacaaatcccagcagttttgggacgagccatttagtttttccagagtcatccatctgtaagactgacactacctttgacacaagggtcggtataatgatgaaatggcagctacctgacaaatgcaaagtcatatacaaaatacaaagttgctattattgatgacccttcaatttgatcatcttatctattaaaatgtctatttttaaaactataaaaatgcatctttgatccattgaagagactttatatcttaccgggagaaacctagcagacaaattcatggtgggtatagttacctttttccctcattggttcctaggcattgcttcacactcacagataacctgtttgaccttttcttctaaggtctgggatgtatttaagaacaaatgaccactgcctatggaattctttcttctagattttttgtccaatagctgaattggatttgaaataggggaggcttaaaaaggagagttgactgttggttttaaaaacgtatctctaaagaggactcatcattgttctgagaaaacaaaaatccgggacttctaaaaataactgctgattgccttggagttgggctggtgcatatgaacaatttacattctgctctttgggagctggtgactcttctggaaattggggctcttttagtggacattgttgatgcaggcatagttggcttttgtttccatgtgcttctcagaaactcttgctctgctccgcagacatttgtatgtgtcaaagaagtatatggggctgagtgcagtggctcatgcctgtaaccccaacactttgggaggccgaggctggaggatcacttgagcccaggagttcaacaccagcctgggcaacacagtgagatcccatctctacaaaaaatttaaaaaatgaaaaagaatcagatgggatgagagagtccataggtcaggttctccaagagtagttttcaggagccatgtaagtggccctagagattctgaactttaaaatgttaaaactgctttgatttcacagacaccctttcaaaagattatctcagattactggaagactttcttgttaagtttagagaattttgcattttgcttagaaatcattttcaagttttattagaacatttactagcaatggtgctaattattttaaatatgaccctggaaatgggctatgtcagcttgaaaagactatttttaacggaatttggttttaaaggcaggttttatagacattatagtaataccgttgttatctaattagcatccactgcgtaaatgtacatgatattagagaggcaagtatacataaaattataaattgtgacattttatgagttttttttttattatgagtcttctatagtcatcattacttaacagtgtgaaatgtggtcttagacattacatcatgtaaagaccaggagacaaaaaaaaactgaggatcaatttttgattataataaagttttagtatgaggcatttctgaatatgtgtcatgaatatgagtcatgattttcacaccaaacctgacctattatgattatgcttcaacttcatggggttttcagtatttaaattctaaacccaattctaaggtttcaaaatgattcacattcaaacctacttttatgttttataattaaataagaaaatattgcttatacctacatttttattattcttgggcatattataattatttctttaatttcaccaataaaatagcccatttcttcattagtaaattatcaggctatctcaataaaaaaattagtttgaatgtggcttgccatctcaaagagtcatttcagtttggaattttctcacttttttcatttgttctttttgtaaaatgtgaagatactttctaggtaaattaatcccttccaaacggtaaaataactttcttcttggaaagagttattacagtcttattctttacaatcttaaataccacttatgttagcgtgaacaatacatgaaaaaaattacactagttaaaaaaagaatgattgcgacctaggccaagtgcattgcaattatatgttcatggaaaagtgagctttctactgggaagagcacgatatagatgcccatgaaatttccaaagtttaagtatttttgtaaattaggttgttcctagttaaacaggtggctttaaaggctggtttcactgttgttttaatcatagtttagttaccatggagaaatatgcaagttagcatttatacacagaagtgaaatttatgctgcatagataatagcctaaatttagcttgacttaagtttaccacttccttttttttaaacaaaaagaatagtaatatatcacatatatccattaacaagttaatttctttaaacgcgactgttatatttttagagaatttcttttcttaagcctcagacacctctgtcactgtgacctcttccagtgctgagtataatgtaacatattacatcagatttgctctaattgtttcacccttaggtttaataaaacactttgctgagtttaaaatcagttatgtggtgaaaaagtaatgtttggacacattgcatctagttgagttttataaaggactattattttctactgaaaatctttaggaaatgtgccatgctgataggaccaatctgatatcataacccaacgataattttgattagatatgttttctaaagaaaattcagagacaggtctatttctaatgaactgttttgatcttaatgccttcttcactgagtaatagatttttcactctgaattaagatgttcgtctgtgtggaatccagcatccgtgagctgtctttcctgctttaccctgtacccctgaacgaaggctaagttttcaaggacaaatgtagtaaaagtgtcctgatccaacatgaggtcccccagcacagagagagagcagcagatccctttcaacaccagctgttctcacagatatagattgctgcagtgaaattttcttaatataattcaggaagctctagagaattctccaaaacaactgtgccaacaaggaaaatgttgaatttttcatcagctgcccaatgctgagagttagtgggcaatccgttcattcatgaccagatgttcagtgtagtaacgctccgcagttaacttgaaccttgtggcctgtttaccattggctgcaaggacattggcagcaacctggcattggagaattgaggcccgcacaagcgaaagaccgaagtgtgtgtctgtggcttcctggttttcaccagcgaccagacaaggtagggaatgatgaaagaaaggaaagacatcacatcaatcattttggaggtgggagaatttgctatatgattgtgtcttgggggaacagtaggcaaattcttaaactcatttttatttggaaagaaaggcagtctttgtttatttagttaggcagatttttcaacctatgtctaaaccatgaaactttttgtagtgggggcaagtaggcatgggtggttaagacagtaagaaaaagatttctaaatttaaactggaggaagtcaataaaattgactcttaatattgaaacctgacaaagtccaatctagaattggaaatatgtgatatttttgttttaggtgagtgttattattacaagtggagaatacttagatcttccattcatacagattcatcatttccttcatatacatgtttggaggccatgacatttttgtgagctctttgaagtaatgatgttcagcgggagggggaacttagatggagcaggagtttttgaacaaacaatttgattttttactttgaaaaggattttgcctgcaaataattaacagtgtttaattctggatttgcaacaggccaggcctggggagggcagagtttgataacgtgaggcttgtctcagatggggggctcatctcttcctgactacacggcactgcacaagaatttgaactgtttatttcaaagcagcatgcacaaaggaacttttaaaatctttcttatttaaccgtttttaacttgggccacgtctgcaagaagttgccatgtctgcaagaagttggcctttgtttacttgaaactggaacagaatgtcatcatggaataaacctttcgctttttggagacttggattgtttttctcttcctatagaattcttgactgccccccccaacccccctccccaccacacacacacacatccttactgacgcccatccatgaggcacaactgtaacttgcaggaccttttaagcagaagccttgcagtaaggatatttgctttggcagagctttctgcctttggtttacaaagttgcagtgaacacttcctttgcatttcctgcttacagagaaggtgggttgcatgtcgcactgagatatggaaattcctcatgactccatttcaagcctgaacctcttggcccttagaatcccactgctgaagtatgtgtttcttttgtctgggtgattttttctttttctgaaaagtcccttggcttgttgacttagaaagaggaggttttgagttacagcaggtcctgacttagggctgctgggatgcaaggtgaaggcattgcgttgttttcctggatgctaacttgctgatagaaaagtgagaaccagtttacagtagctctgacactactgttacctttctgcagtcctctccagctgctccgagcccttcgatgccttcgccatgcacacagtttgttcttgggtgtgaaagcaaatagtatttgagttggcagcgacttctctttcagtggagtttgctgcctcggcaagaaaccgcagcctgagctttctgctgctgaaggtttccactggcaggatggccttttcccacatttccttggtttgaggaaacagatttttgaacttttttttttttttttaaagacagaatgccaacatttaacagctggagtcagtataatttatggttttcactttatgttcttgtggatgtataaaaattaaaaatccacaattattattaaattatgcaagtttttgcaaaaaaagtgattaaaaatagaacctctgttatgaggcattcaagaaagtcattgttacctaaacaggtattctcaattattctatctttaatggtttttaattgttgtaatttactcatattctcttgcatctctcagaggagatgtttctgaaagctcttcgtgttttctttgaggagcaagtaggagtttgttcatttgaaccacttcagtttttttccaccttatttaatttattttattatatttgttttgtacacgtcgttgtgttcatcctcacttcaggtaacccttactgcaacagcacttataaaagcaaagcagtcataaacctgctacctatcgagatgatcctgtgccaagaggaacgcaggtgtcgctcatgaaagtgatgcaggcctttgtgagccacagaccctcccttgtaggaaagcctcagttttcctacatttcctttaggtgaaatttataacccgccccccccgccccccccccccccgccgcttacagatatagcatatggagtcctaattgattggaggcctcactgaatttgcaccatatcggaatcaggaaatgaatgcagtcagccaataaaaagtgatggaatgttgcctcaagatatgtaatatttttgtcctatcagtacacaaatactaaattttttttggttatttaaaaatttctaatgatagagataaagattctgagaacctttattaacatcctcccaaagccacacctttagttaaaaagtagctctgacatttttgttatctcgatttctcagaaaataaaataggaagtgaaaaggccattctacttggtacagtgtgttactataaagaccattcgctctacacgttagatttagggtcagaacattagctgtgatgaatagctagggacaaaatttttcttttcttttcaaggatagtggcagttaatcatttttatctgtccgccttgtagacttgattagatttattatgtatgccgcatgtttatggcatttttattatatgttgttaatttgttgtaactgccactatgtttttttcttcttccctttttctcccttgagcacccttgaaagcaactaagtgttaccttgtgctttaggaaacttcatttaatttttcattttaataaaagccctaatagtcaacaggttaaaaaaataataaccggtgttacaatgtgtatcttcagataaaaggaaaatttgtacttaacgttaattttgaattcttatgttttctgatgttgatgaagtaatgcatgttcgggtagatttagagaatacacggctataaaaacatttcacctgaaacctagaagggcgagctgcggaacgtgcactaaactataattttcttcattagtagaaagccatctatatagttttcaaatcactgctaggtaagacaattgggccgtttaacatttaagctgcttaaaaagtcacgcagttgaatgatgcatttagaacatcttttttagcttactagctctcagaatggatatggaatctgttaaatatagaggccattctttaaataaggccgacagttaaaattgggaagccagagaattagattggaaatgatttacgatgagtctacaggacattaaaaaaaataaagttagaaaaggaaatccactggctgcattggctatattacagcagagaatttttacttttcatcccttttgaattggctggatatatgggtaatgcatagaaacagactttcgggaaaaattgacagaacttttctttttattatatgttctggcattggtttggtattggcatcgtaagcctctgactataaccaagtcagtttcttgttttgacagttacaaactttttttcaataacagagaaccacccattctcttaagagcattagacgttgaaataaatagaagctggattgaacaacgactttgtttgtgtcatgccgcatgaacacatgggtccttaataaataccatttgaagatgacacatgggtgtggttattgagtttataatgtgtaatcatcacacatgcatatatcgcttttaagaattgttatgcattcgttcatacgcacagcaagaagttgatacatttttatggaaaaaaaccaatgtgaattcaaagagacagattacagacaatattaagtcattcaggtgtgaagtggtttcactgatgctaaaacttgttatgatggctcattaaaacatctgaaatccttacttataatgagaaagagaaagaaatacaattttagatgtcttagctataaaatccttaattattccaattgtagcaatacaatattgagttaatcaagaaaaagggatatatttactaactaatggtggaagacttcaaggtgatgaagttattaacccagttttagactttggtgttctgagagatgcactatgccccattgtgtgcacgagaccagcatttgattccagtacctcctgccctattctgatgtttatgtaggcaactttgaaaaagcaaaagttcatattcaaattctgtccttaggaataaagtgtcgaaagaaataagatattttgttaccgtcatgaagcatttcagctagagcttgctgaaaatataaacattagatatttgggttaggggatttctggctcatggcagctgggtgaataagcaacaaagtctaaaaatcttggtgctcagagcaatgaacaattcctttggttggtacacagagctcatagaggagaaaagagaaaatattagtaggttggaaaggtagctgatgtaagatggagaacctcaaattcagagttaaggagtaaagaattcagtaacattaattaatattaatattaaatactaatggcagataacatttgctatgggcaaggcatcaagcttagtggttgacaattcattgtattattttactggtaataagcttccaaggaaggtgattcttttttttttttttttttttgagacggaatcttgctttgtcaacaggctagagtgcagtggcaccatcttggctcactgtaacctctgcctcccgggttcaggtgattctcttgcctcagcctcccgagtagctgggactacaggcatgcgctaccacgcccagctaatttttttgtatttttagtagagacggggtttcaccataatggccaggatggtcttgatcttttgaggtcgtgatctgcccaccttggcctcccaaagtaatgggattacaggcatgagccaccgcacagggcgtgattctattattatgcgtagttaacagagatgagaagactgagtcttggaaaagtcatgtgatcttaccctgggcacgcaatggtcagatggagccaagatttcaaattagactctgtggcttaagaatcagccttttgaggactgactctattgccagtgggcacaaccagggatttttgagcagaggagtctctggtcagaactgtgctctgggataattcatctgtcatattttaaagcaatgtagtgaggagcccagataggaggaaattgtgatgttctgaagagcggcaactacagtctgcagttgagtgtttgatgagattggaaaggcagtgatggagaggtcccaaaatccttaacgttttgggcggtacttggtgtgaaagacagatgattgggagaatggagttggtattcttatcccttgctaatggaagaggagagagggcaggctgggaagggatgagctgaggtttggatgtggcttgaggtgcagacgttaatttcaggcagagtcttttggaaggtgatgaaatacacattgaactagaggttacgaagatagtcagggctggagatgtggatctgaagccacagaagccagtagaaagagtgagactggtacatttagagaggtgcggggaaaagaaagtggctggagaaggagaccacgatataaatcagtcttaggagataaagaaaaatctttctgcacattggagatgacagatttgtaggccatgcttcagacacatacctatacatattcatgtttgtatacatattcatgtacatatttatatatgtattcctatatacattcatatgtattactgtgtgtgtttgtatatgtatcttattcatgagcatgcgctgttctcttatgctcacatatgtattcttgggagcctttcccacctcagcaagtggggagaggaagagtggggtaggcgtcagtctctccccagagcagctgattggggcaggttctgctccctgctgctgcagtttgagagcagtagagggaaaatggggtttactttgtgtacgtgtggttcaggccaacacgcagaattttatacccctcaaaatgcattcctccacagaagcctggcaactttaaatgctctagtaaatgttaggtgatttataatacagttttaaagaattcagcaagattaccattctattgtgaaataagggctgacagtgtggtcagtaaatgtgttaacttttcatttgggttggtatgtctctcctttgcaaatccattcatctgccgaaatgcatatgagaagcattgcttttgccaatgaaggattgcagttaggatttttttttttttttacttccttttcccgtgccccttcttaattactaagaaggttaacagcacacacttcagggtcactgatgttgtgttgtgttctgtttttgtttttcctgtagccaaagaaatgctgtattattgctcaagtctgttttgtgttgttgattgaagggctgagagagtgcccgtttctttttctttcaagataccactaagtgatttcctttcagggttctagaaaatgtgtcaccctgacaaaaattgccttcccatgctagtagccttaagcttctacttcttaattccttacatggccatttcctaaatggttagagttatttggaacaccttaaaattaaaaagctttcattgccacccactccaccactcagactgccagtgatatgaaattcacctgaaccctttacagttggtgacaattgttttaggaaaatatatgtgataagatgctgcaggtcctcataccagtgtcaactcagaatgtcgttcacatttcttctgagagtctccaattggccacattactgagagctttgtcataatgctttaagtcatttatcagctgaggtcactttgacttttgagattctaataaaattggcttgaacttttatcttataccctgtgggaattccaatgagcatttctggaggctttgttttcgtggtggatttttgttagagaactcttgatattccttgtttccgttgcttttctctcttctctcagagttagaaattagcttctttccacaatttccttccacacagctcacacagaccgtggaagtttagggagttggaggaagtttgcatcagagaaatttggaaggatgtttaacagcctgtttgtttgttggtttgtttgtttgtttgtttgtttgttttgctgagacggagtcccactctgttgcccagattgcaacgggcgatctcagctcactgcaacctccacctctgggggttcaagcgattctcctgcctcagcctcccacataactgggactacaggcttacaccaccatgcctggctaatttttttgtatttttagtagaggcagggttacaccacgttggccaggctggtctgggactcctgcctcaggtgatccgcccacctcagcctcccaaagtgctgggattacaggcgtgagccaccgcgcccgccagccttgtatgtttgcacatacatagttgtctctgaagagctttctctatacatcatgacctccaaattgcctgacttaccctcttttatctatcttctcacctctcattcttctggtttctgttaccaactcatgtttcttaaaaacggcaatttagttttctctttctgtctcaccatttccttccaaaccaggttcaagggggcctggtcttccatgtttcaagcgatgtgtcaaggatgagctgactagtaaaatgatctttttagttaagtacatgtgcacagacacccctgctttttctccctccactctctctcccataaatgtagcaaaaactgaagctactttgcatagaaaaagacatattaaggttttacctattttgactggacctgccaccctctattcttttcatgtatttccctttaatcaaataggttgattcaaagtgcatgccctaaataccaacattttcccattgatacttattttctgatactagaccaacaatgtctgccctaaatcctagggcccaaaaccaaaatctcagcctcacagcattttattgttgccattggttatccagtcttccttgtaaagtttaacactttatatgtcattctttaatcgagtcttctctgataatgaattcttccccttcccctagaaattaaggatgccaaagaaagggtaaagtggtgctgtttgatgcagagctagcggaaagcatttgctgttagagagccacctggagctggcccatcttctcatgtcagtttaccataataatgtcagccagcatgggtatctcataattagatgaggaacatcaggcagtttcctgatggtgttatctttcatagttttcacagtgatgttcctgacttggtgttacaaaaactctgaaaaacatctaccaagcttgaagtgcacccttattggttatttttcaagttctcatacccacacctaaatatgtaagatgtatttctcatcagaacagtggctcccaaggcctgggatccccaaaccccaggagatgccgtcaaaggattagaagatgccatccaaggattagaagatgccgtcaaaggattagaagatgttatcctggtgtttttcagtatttaaattaggatgagtttgattgtactcaacagaaagtccagtaaaggcaggcttaaagagtgtcactggcaagtccttagtaggtaggctgcaggagagacttgatccagctctctgctctgcttttcatggtgttggcttatcttcagagtggccctatttgcagtcttaagatgattcctagcaactgtcaagctgtagatttccttgcacatgtgaagcaggagagtggaaaagggaatattttcttaggattttcagaaaaattcttgaaactctagttggacttgtttctgccacataccaccctccctgtggccagggagatggaatatattagttggcatgttttaggccatgtgttttccgccactggagctggggtgcaatcaacttctgcaaaatcccatgacttcccatatgtcagttggtcccgtttggaagtagtttagaggacaagatgctggggacacagccttaaatggttatttcattgacctgtttttttttcctccccaccttttttcttgttttggagacaggtccctgtcgcccatgttggagtgcaggggtgccatcatggctcagtgctgcctctacctcctgggctcaagcaattctcccacctccgcttcccaagtagctgggactataggcgtgcaccaccatgcccagccaaaatattttggattttttgtagagacagggtctcgccatgttgctcaggctggtcttgaagccttggactcaagaaactcgcctgcctaggccttctgaagtattgcatttacaggcgtgagctgggcctgttttcatatttttaaaggctaatgttaattcagtcatttgcataagactttgacgttaatcaaatgtcaatttccttggcttttggtcataaacattttaatctgtgagctctgattggcaatttggtagatgttccctatgaattaatacttaacaaataagtgttggtagaatctgaaacttagcatctatgttggtaggagtgcttagaatttactaaaaggagttctttgtggttaaaaacaatagagggctgggcatgatggcccatgcttataagtcccgcactttgggagactgaggtgggtggattgcttgagcccaggagtttgagaccagcctgggcaacacagagagactccgtctctacaaaaaatagaaaaattagctgagagcggtgttgtatccctgtagtcccagatatttgggaggctgaggtaggcggctcacttgaacccgaggaggttgaggccgcagtgagctgtgatcgtgccactgcactccagcctgggtgacatagcaagaccctgtctcaaaaaaaaaaaaaaaaaaaaaaaggccaggcgcagtggctcacgcctgtaatcctagcactttgggaggccgaggagggcggatcacgaggtcaggagatcgagaccacgataaaaccccgtctctactaaaaatgcaaaaaattagccgggcgcggtggcaggcgcctgtagttccagctactggggaggctgaggcaggagaatggcgtgaacccgggagacggagcttgcagtgagccgagatcacatcactgaactccagcctgggcgacagagcaagactccatctcaaaaaaaaaaaaaaagagagaacctcatgtctcaggtttctgagtcaatagcagataaaactaattgtaatttacctaagaaggtaagaagggacgaccaggtcaaatgttgtgcagatgtggataaaagaaaaaaggacattcatttgtgctactcttatttccaaaattttaaattcaatgtttcaagtccctttttttccagatatggtaagttttacgttttactagcatgttttaaaaacattaatcatatggaaagaaaaagatgatacattttaacactactacgatagcgtctatgactcaacaacagaaattgttgttagcagaaccagcaaaaaaccattctgtcttgggggaaaattgtttggttgaaaggccacagaagagatgcatattcagtaagagtaatgagaggcaaacacaataccataagattgttttgcaaaaaaaaaaaaaaaaaaaaatgtctaaaaagagtatagtcaaactgtggaggaaacttcattgttaaaaaataaacattgtgcatatcaaacattgaagagtgtaaagtgttgtcgatggtaatgtgaacttattctaagttgccgaaaatgtttcgtgctcaatgcattttagaaacaacatttccatcagagtgaaaagaaagcaaagggagccttcttaaactatactggctacaataaccctgccaagcaatattttctgggaagcctttggcctaggctcatgctgagcctcttggcctttgctgttgttttacctgacttacacaacgttggttgttttggatctactgccttcccagttgccagactaggaattcttggccagtgtgtcagggtattgtggatgtaaaattagaacctgcggctcaccatggtgagactggccaacctgatgttcttgggtagtctccctgacctctgtccactaggggtccacatttctgactccactctgaccttaaaagacagattgctacatctggaagtcttatttacatagtctttggttttatatcccaactcctccctgcctgcccgcccccatctttttggtttattattctttagactttgccatgctcaggcattcttggagattttccttgtattttccacgatgttgatctaaataccacctatactgtatttgcttctatatcccctgcaatcccctcacttgttagaatataaattagtctatctagaagaaggctttacattgttccttaaaagaaatagtatcagttgccacagctagatgattacctaaagtaaatactatgaagccagaacaatggtataaacaggagtgggaaaactgtttttgtaaaggccaggtagtaaatatttttggcttcacaggccatctggtctttgttgcaaccactcagttccaccacattgccccagatcagcaagaagcaatacatagatgaatgggaatggtggtgtcccaacaaaactccatttatggacacagcaatttgattttcatataatttttttatttcatgaaatattgcctcttctttagattttttttttcccctaaccatttaaaaacatacaattcattcttagctcgtgggctgtatagaaatcatcagcaggttgggtttggcccgtggactgtaatttgctgacccctggtatgaaattcttgctgcctatagttgcctacttctacctaagataactgagctggagaggttctcgctttgttaaaaatggactttaacatgtgttaggcattagaccagcacccaaatgagactttgtccttgacataatttgaagggttcaagtggaattgaaaagagaacaacttcctgagtatgcggtccagtgtaatttgttgctatgcctgtaccacctaaaatcatcttagaggttcaagtctggagccttaggaaatattgccattgtctgcttgttctacccagttgttctcccaaccatcacacagataacatgaaaatatagatacaaatagagatgagtgaaatgagaggcagcgaaaggaagagttttcaacattaactaaaaaccaccaagatcagtaatgagggcagagggaagaaggactgaaagaatggctgatttttacaaaggagtaaatatctgaagaaggaaaagaagaagttctgagaccagaagttagccaaaacgtaaatattttgccaatttatccatgaccctctttcctttttctgatggtatcatatagtaaatagttccccattattcatgggggatacattccaagacccccagtgaatgcctaaaactacagatagtactaaaccctataggggctatgttttttcctatacatacatacatatgataagatttaatttataacttaggtacagaaacaaattaataataactaataataaaattaaacaatataacagttatatttataaacaataaaacaattatatatatttaatttatttaaaataaaacaattataccaatatgccagcatcactactcttcgactttgaggccattattaggtaaaataaggataccttgaacacaagctctgggatatgattatagttgatctgacaaccaatatggctgctaagtgaccagtggacagtcagtgtagacagcatggagaccctggacaaagcaatgactcatgtgggtaggacagagtgggacagggagaaatgtcctcacgctgctcagcatggtgggcaattgaaaatttatggaattttccatttaatattttcagaccctggttgactgggggtgactgagaccctggaaagcacaacccgtggataacagcagaccctactgtatcatagtatatgatactgtatattactaatccatctccccagcggtaccttctttggtatttatgtattgttctgttagttactgatactagtatttcccctcccctggcaaaaggaagaagagaagctagcgacccagaaaagagtctctttatccacccactttttgccttcctttgtgttagtccatctgatgttaaatctcaaacacaggctttttttttttttttgtttcttggcctgtattgattcccttttcgcatatgatttggaaaggaatctttgagttatttcttgacaaaattctgtttaaaacaaaaaacaaaaaacaggaccagtgtggcttcatctcataagtttagatgtctgggggataaaagaatttagatgttcacaatattctaatattttgctttatattctgatagacaaaaactgtggaaattctgaggaaaatgtgatcttcagtatcaaggaagcatttgtgcatagcattcatagggtaacaattattaatgtaacatgaaaaataatgtcttcgtgttaccagctcaaaagatgttcttaatttcaaaacagcttcttaaaacaaagttgttttttcaagttgcattgccttccagtatcaacatgaaccaagaaaccttacaccaggcatattagctgatatgttctgaagtgtgatagtatagttgttaaataattacccaagttgggaaaaagatctagtttcaaattctggtttagctacttaggaactcggtgaccttgggggggttatttagtattttaagcctcagttttctcatctgatgatggggatgaaaaagtacttacctcattataggaactgaaaatattatagtttatcaaatgccattggttgaatgtgattatgtaaaaatagttcttagtgtagcacatggcacatcaaagtaatatttcctttacatgatatttatatacctgattaaataaaaaatatttccaagtattgttttgctgaatgcctaagctggagttaaatattagaggacatttaattctgggagtaaacagtgctttaaacatccattttaccttttggtatttttaatattcagtttaaaataattttcccttatgtaaagaggccataatgcatgaagttcacatgtatgacagaatttgggtaccttcgcatcagtgagtctgtggcccgctgaactctcttaaatttgcttaaaccaaggaaacattgactcacgttttaacaccttaacatcagttcagttgcacttgctcacctagtcaccatttagtttttttctccagtttttattaattttgagaataaaaaaagatgaagactcaattttgcattttgctcacttttgagtttctgtaggttaaaaaaaaagaatacatatgataggtataattgtgataattctttatctttgcttctttgtataccctcaccttttttcaatttctcgcatcagtttctacattctggagaatgtacatgatgtgtaaaaatcatcctccaactccatggttctcagattctgtctgtcagatgaaaggggaccatggtgtgatgccatcgaggggttaagaggaaaaggctaagaggaagttaaacaaagaactgatttatgtaaagtggaaaattgaagctgatggtgttgtttcccgtgagcccccttttggggcaaagcaaattctaggcttaattggcttcttacgctattttgagttcagatggccacaagttccaatttggtatttctactaaatgaataagccagaatttgaaaccagatctttgttctcatcttcggtgattccttaacaatgtatactaccattgcttttgaatgtactagccaatatcactggtaattttaagatagattttttaagacacaagtctgaactgtaagtactaaggcaaacacatcattgacatattctccgtaaatggactcagtggagacaagtatttatcccattccatgaagaataaattgtttcagtacagcaactttttgggaactcagccacatcatgtagctgcttctgggccttactttgcttgtctataagatgggattaatcttactccagtggtttgtgaggatcacatgatggaatggaggtgaaataattcagtaatgttttgttacattattatggcccatcaatgacatttgatgtaatctttgaaatagatgcttgtggggatttcatctctcttaaatttgctccgtgagcaaaaacagtattgaccttccttggttctttggatggttcttcagcatttgaaagtcagaaattttagtttgcagtccacgaatcttacatcagaaccccaaatcatgttcctttatgtctccatccctaccatactatagagttagcctcttttgaagccatacaatttttgaaaaatactcattttaaaggttaacactccagtgacaccatataatgaaagctgtaaagcgacttttaccaagtccgtttccttctaaggaatcgtctgattttgtaaaagtcatgatgtctagctttgtttatatcaacaactagaacagtgatttctccatccttgtcttttaatgacattgttattatttccaaatgtgaaattggagtatttgacttggagaaaccatttcatttcctcaacgtgtttcagtctagaatgtctccttgtactctttattctttacttggggatacatccaagttctcagatatggaacatttaggacttaatttcaggatgttaagctgagaattcacttgaagttaccttttagttacccctctagagtttacgtttcctaaggtaaggtatgctatacaaaaatatgaaaaatgaaaaagaaacaaaacgtgtatatacatcattaaataacaccaaaatcatataccatttcttgctcatatcacactgtttagtctgtcagaattccagctgtttctttattcaggccaatttgttgtgtcttctctgagtttatctgagtggaagaattaagagaggaatcccttgggttttcttctcagcatgagctgtgagaacccttgtccagttctctactttaccatatagatatcagaagctcttttctgttttttcctcccaaccccctacccactatgaatgcatttagaggtaaccacttttctactgaactggtaacagatttttttctctccttagtcttacagcagttctggtttaatttatttgggcatttaactcttgacgtggctagagattgtctagatttcctagagtagaaaatctagaataaacctagaaaatctaaacatctagagtagcagggagatacactttgctatagagtgaaaggccaggtagtcttcttgttcaagatgttaacatttgggtctggaaatggctagtagatagaggaaagaatgagaataaaagagtagtgaagccaactttcataccattgcctatctgttcagagagtaccaggtgctttgcagctattttactagcacatcatgtgttcagtgtctccagctctttaaaattggcaagtagacaatgctactttcaggttatgatacactgggacaggcatagttacttggatacttgcacaataattatttctcacctttttgctacctccaatagctttggggttcatatactcctagaattcattttctgacagatatttttatttttattttttttttttgagacagagtctcttgctgtgttacctagactggagtttagtggcgcactcttggctcactacaacctctttctcccaggttcaagcaattcttctgcctcagcctcccaagtagctgggattacaggtgtgtgccaccatacccagctaatttttgtatttttagtacaaactggtttcaccttgttggccaggctggcctcaaactcctgacctcaagtgatctgcctgcctcggcctcctaaagtgctgggattacaggcatgagccaccacgcatggcccagatgtaggttttatagaatgcaaattctgaataaaatacttccacaagagactcttatcttaatagtagatgtacagaaatacttctgtgtttcagtggaagttactccattatatagcctttatggatgctgagaacacgttctagaaacggatgtcaaccaagggagattcattcattccatacgttttttaatttcaaaaaacgtacaccgtcaatattttttcttaattgaacagtttgtggaacagacgggtgctttaattatggtggtctaaatttacacacattgcagtggtattttgctacattaattaccttacttgtcaagagtaacaggtaattactacatcaactcaccctcctgcagtatatagaaacagaactttatttgaaaagattcagcaaaccccagtgtatagccactccacacctttgtctttgctacaagaagacagctgtcagagcatttgttttatcattagcagggtagaggtgagttcacccttttctttgtgtctttccacctaagatgcgtgtccagaaacattcataggctcaacaagcatgtggactagcaagaaactttgagatgatcgagttcattaaaccttctcctgataatgtgtttcagagagggtgcatgacttttccaaagccacacaagaagtaaattaatgtccaaaccaggactggcaccagtgtcacctcactatgctgctttttgtgaagcttagtgcattttaatgatttttttataactatagaaaaatcatttggtatagtatactttgaatattcattcacttcatcctcctcacttgaacttctaaccaatgctttggctgccttacaaagagtattgatcctatattctgttgaactgccaggtacaactcatgtcatttggtttcctctccagtgtactagtgtcagcttttatgacaagttgtgttaaaattctactttaacatgttttttttttgtaaaggcgaacattttggagcatataggatgctcttagcaaaatcatgcagcattaactctcctggttgccatggcatagaaagaaaagattttgtcagcttttaggtgtggtccggaatatacacaatgacataatatgggtgtactatcttaaaaggctttgtcccctttttagtcaaacacctgtgacaaaattacgaactgtggttaacatagaatacttacaagtggtttttcggagtcgtccagggtagaggagctcagcgtgcagacaattttagtacctacttttcttcttgcacctggcactgggagtgagtgacattaaaaagaagttcaagaagtcaagagttaaggatcctacctttcagacattgtttgagatattttgtagggggcaaggtgggcctctcaagggtcatttacgacatagaagggagaatctcttccagtcctcaacccaagtcaatttctgatgcctgaattccaagcctagattcatcatttctgtaactgatcttgtcgtgtgcatttgcaaatcactctggcatttataacttgttacattatagcttcgagtgaggttttcttttttcttagctttttattcaatggaaggatagcatggtatatttagatttagtaattcatccattcaacgcatatctgctgagtgcctgctgtgtgacagtcattgtgctgtagatggcaggaggaggagtgcatagcaaggcaggaaacagacctttgccctctcggcttctttctactagagggcaaactctatgacagctccaccaggagaactctgttctcctggagtttgtcctctagtataaagaagcagagagtgcaagtgaaacgaaggaacaagatatctgcgtggaatgggagttcacacaggatacagtggaaagcacagaccttgggaaagcctgtctagccagggaaggcctcttggaaaaggtgactttctatttaagacttaaagaatgatcctcggccaggcacagtggctcacgcctgtaatctcagcacgttggcaggctgagacgggcggatcacctcaagtcaggagttcgagaccaccttgactaacaaggtaaaaccctgtctctactaaaagtacaaaaaaaaaaaaaaaattagccaggaatggtggtgcatgcttgtaatcccagctaattgggaggctgaggcagaagaatcgcttgaaccctggaggccgaggttgcagtgagctgagatcgtgccactgcactccagcctgggtgacagagcaagactccatctcaaaaaaaaaaaaagaaagaaagaaaagacgaaagaatgatcctcatgtacaaagagccaggggaagaacctttcctgcagagaatgaagagggctaagcctcagagtaaggaataagccgagtgtggtgtggggtcagaaagaccagtgtggctccatgtggttattagagaaggaggtagggagtgaggatggtgtgggagaggttagggggtcagcaggaccctgtataccggggcgaaggactgggttttgttctctgccatctaggctggagtgcagtgatgcaattgtagctccccgcagcctcaaattcctgggctcagatgatcctcccacctcagcctcccaagcagctaggaccacaggtgggtgtgccaccatgcctgcgtaattttttaaattttttattgtaatggaatcttgccgtgttgcccaggctggtcacaagctcctggcttcaagcgatcttcctgcctcaggctcacaaaatattggcatcacaggcatgagtcactgcacccagcctggattttattctgaaatggatgcgaagcagttggaggcagtgacttctgattcaggtgtgagaacaaaccacgtggactggggaatggattgcggtgtcaggtgtgttcttgagagtaggcttctttgggggagaggctgagattctggttccctgaggttgagcatggaatcctggaagatgccacacctgagacagactcagctggccctggtgaaatgagaaaacccttttctaactggcggtgagatgcagctacgcaccaatacaagggtggaagcacagtgcttcagagcacagtcctccaagtgtggcgcctgaaccagcagcagtggcggaagcagcacctgagaacttgttagaaattgaaattttctggcctcactgtagccatagtgaatcagaaactctggggttgggggccaggcgcagtggttcacgcctgtaatcctggcaggggattacagggaggctgaagtgggtggattgcctgaggtcaggagttcgagaccagcctagcgtctactaaaaaaattagctgggcgtcgtggcgtgtgcctgtagtcccagttacttgagaggctgagacaggagaattgcttgaacccgggaggtggaggttgcagtgagctgagatcatgccactgcattccatcctgggccacagagcaagactccttctcagtaaaaaaaaaaaaaaaaaacaacaaaaaaaactctagggttgggacctagcaatgtgcttgtaacaagacctccaggtgattttgatgagcatgcaagtttgagaagcccgttatagggtgtttgtggcagatagtggcagaaaagacttgggacttactacaaatgcactaatgcactagtctcatgggaagataagacagacacaataaagggctatagcaaagtggtgccccggtgccgatcggaacctgcgtcttgtgactctgttctagtgccctttcctcaagtgtttatggagtgaaagaataaacaaaactaaccttgtatttttaaggataattatatttctaaaggaggagttgggtggatgtttaaggacaagtgctatggtgtgtgaactcaggtgacctcgtttctcatggtactattttctcagataatttagaaaagcagtgtcagtgtgaataactcactcctttctccctgtcactgatagaaaaacaagtgtttttgtcttaagttacaccattgagacacttagcagagtgtaatagcattcttttatttctgtattactcaatctatttggccctgttttggttttggaagtcctggcactcccaagttatgtttttagtgtcatggaagaaggcagaagattgattattttcaggcctggtatttgtgcttgctcctatctgctttgtccaacagcgctgtcagaaaatcctaggatcatttccctcaccctccacccagtgctctctacctggctaacacccaccgacttctaatttaatggcttgcaggtcatttcttccacgaaatcttttctgaccccttgtgcttaggttacatctgtgtgttaatcattcccatgtgcttttgttagtgtttcctggtagtatgtgggctccaggaggtcttaaacctcatttgtctcaagttcaagctatattgtgcttcaaacatagtgtctggcatgtggtggtactgagaaagtagctgtttcttggatgctttccctctgagttgattaactacactctatggtcgatcttggaagacatagtggcgggttcttcctaaaagggggttacaccggatattaagacatggtccctgctgtgcacagtggctcacgcttgtaatcctagcactttgggagactgaggcgggcggatcacgaggttaggagttcaagaccagcctgaccaacatggtgaaaccccgtctctactaaaaataccaaaattagctgggcatggtggtgcatgcctataatcccagctacttaggaggctgaggcaggagaatcgcttgaacccaggaggcagaggttgcagtgagctgagattgcgccattgtactccagcctgggtgacagagcgagactccgtttctgtttttgtttttttgtttttttgagacggagtctcagttctgttgcccaggctggagtgcagtggagtgatctcaggctcactgcagcctccgcatcccagattcaagctattctcttgcctcagcctgcagaggcaaggctatgccccttacccgccactacgcccagctaatttgtttctatttttagtagagacggggtttcaccatgttggctaggctggtctcgaacgcctggccttctgattcacctgcctcagcctcccaaaatgctgggattacaggcgtgagccaccgtgcccagctgagactccatttcaaaaaaaaaaagacatggtcccatggggtcaagatgggagaagtatagacaaagccagaaataagtatttatttgaggtagatcttaatgagggcagaaataagtatttctttgaggtagatcctaatgcggtatacactcacaatgtgttagctgctgtgactaacacagagattttggtagctttacataataaggtatatgttttcttcccttcatgtctgttgaacctcctcatcttattcttgttatggggtctcagcagttggtggggaagaggaacagggagtgcagttgaccttccatcatgggcttagaagtgctgccccttgctactgctgacatcccattgagcagaaatcagtcacatgggcctgacttgtataaatgccagtgaaattgggattggaattggaaatgtcatttccctgtgtacccaggatgaagacattgcagtgaaattagttatcatgtgacagtcccaaacaattgattactttggttttagctactgaggtttgatcaaaataaagcatacttcctatttttgtagcctgtgcatatatcaataccctttttttctcagagactaatgagagtgatgacccacagtggttcttaacttttgcatgtcatgaagaggatgtctttcatttaaatcccaactaaggccaggcatggtggctcatgcctgtaatcccagcactttgggaggccaaagcaggcggatcacttgaggtcaggaagttcgagaccagcctggccaacatgctgaaaccccatctctcctaaaaatacaaaaattagccaggtgtcgtggcacacgcctgtttatcccagctactcaggaggctgaggcaggagaatcctttgaacctgagaggcagagtttgtagtgagccgagatcacaccattgtactccagcctgggcaaccgagtgaaactccatctaaaaaaataaataaataaataaaataaaaattaaataaataaatcccaactaagagcctgtcttcctctgtaggattcaccagggtaatttgtcgagggtccagctgtagcatgcagtccttatgtcatcaaatgaaatattcaaccctaagtggtgaacacgtttgaatccaaacagattggctctcacaggacaatatctgcttgtgttctgtggttggcattatttttttcttctgctcctggagttgacaactctgggaaaaagtttggtggtattgcagaggactaactagtccattaccactagccatcattatggtcttggaaaggactggtggtcaaattcttatttcttaaggagaaaattgaagttgcttttaagatttgaattttctgttcactaatctcacttattttcatccagaaaatgatatgaaaaatgatccatgatatattcggtggaggaaaacacagagtgtttatagtacactgttttttgttgttgtttttggatttttttaggtaaagatatgttgttttacccactcagcatcacggttctcaggataggagctgaaatcttcatctaatcttcgatatccctccctgccgtccttccagcccagtatgaagactcagtgagaagcttgtagtggagatacgtagttaagcgggaggccagagaggtcaacaggggtcaggtcatacaggaccttgtaaaccacgggaatgcttttggcccctgttctgacactactgggaagccattgagagaatgcaaacagggagtgaatgcaacgtgagagagagggagtgtgtatgtgtatgtgagagagacactgatgaatgctgatcacatttattgtgggttttttggctgtggggaaggagcctctgcaggagagaggaggcgcaaaggcagtgtggtggccttctcctagctgacaggagaggtctcctccctccttctgcacagaagttgcttgtcaatcaggagcttaccatcccagcttcaaagcaggcagtgcatttggggtaaatatttatgaaatgccaaactttgtgatcaagatgtattttgtttttaatgagcaaatgactcagaactgtttgaggttattaaaagacaaattattgtgtgccatcatggaaaaagggaagaggagaaagtataattttacatcaagcaatttatttacagccataatccgcaagcaatcaacctctttaaacaaaattatttaatttcttgtaaaggcttaaagtatgaaaatttaatttatttagggaatctcattaagaggacttttaaaaagtaaggtggtctattcagttgctttaaggaatgttaattgagtgcgtaagataccataaacattgtgtttggggcatgagaaataacatgaatctctgctctcaagacacttctagtctggaaacaagacagtcaaaagccattaataaatgagtagaaatgtgcaaaatgtttcttctttttttaaagtcaaaaccattgtttcaaattgtataacaggtattttggatattacttggttttggaaaatctagagaatacaaaaaattctaaagaaaaatcctgaccgtaatcccatttctctagggcaaatactgttaattttatttttttctgttcttcattgacacatatttttatacagctgagaattactgtagatacaattttcctatcttgcttattttatatcacattaacaagcatttgcacacatttccccatttttaatgactacaacctataaaatatgcctttgtcagactggattatcatttacttgcttttgttctgttttgatagacatttaagataagacagattcataaaatttacccattttatgtctcaaatcatcttttacacttaactgttataataaaacattaatggggaactgagatttaaaaaaagatatctctctgtatgtatgtctctgagctttgccatccacaacgaaaaaaaaagtggaccaagtcgtcattacaataattgtacatccttgagagaatagtgggggaataatacatttgactcattgtttctggcatattctatcactggacatgtagctcctaccctgaaattggttaagaaggaacatcttgttttttgttttgttttgttttgtttttaaaatggagtcttgccctgtcgccaggctggagtgcagtgggctcactgcaacctctgcctcccagtttcaagcaattctcctgcctcagcctccctagtagctgggactagaggcacacgccaccacgctcagctaatttttgtatttttagtagagatggggtttcaccgtgttggccaggctggtctccatctcttgacctcgtgatctgccgggcttggcctcccaaagtgctgggattataggcgtgagccaccgcacccagccggaacatcctttaaatccaagaaagcagtttgcttctaatttagggaatcttcatgcctgattttgaaacttttagtggatgtcatttctgtctcactcttccagtgacatctaaaatctactgtttattttgcttttttaaaaaaggtccaacataaagtcactttaaggtgactgttacctacactatcttaacacaggggcttgactgtattgatgagaaaaagcttcagctttttttttttttttttggttgttgcaagtattccttggatttttgttcggaatggcatgggattctagtaagctgtctatgtgggcgcatgggcccttggaaaggtggcatgacttaggggaaagaaccaggcatggggtgagtgagtggaagctgagcctgccagcactcatctcttaaccctttggcaaattaaggcaactacccttaccatcagtaatccatccctggcagtcagatatcctgagtgaaagtgctgaccagagtctatttcacattattttacataggacaaattttaatgtgttatgtgtcaatgtgcaaaaccctcaatcaatgttctgaagcagaagttggcaaatccagcccactgccagtttgtgtaaataacgttttattagaacacaacaacacccacttgtttacatgtgattacttttctactgtagtacccaagtagttgcaatagagagctgtggcaccagagtctaaaatattcactaagtgttcctttacagaaaaagtttaccaactcttttctaaaatatgactaaaagatagtaaaatatcttatatatacacagctatcacgttaaggatgtaaaaatgtttaaaacattaattagttaacagttaatatgatctcaacatttattttgtttgaaatgtgacttcttttttaatcatgaagaacatctgaaacgcatcacttttgtggctgggttttcaaaacctctagggaggtatctgatgttctaccagttgtactgcaatgtgacacttaaccttcacccatttcgttaaaaatgttacattaaatttgaaggatgtgataggattttttcttttataatagcagcagacaaaactgttttatttagaaataaataaaacatgtattttctgtaaagtttggatattaaaagccaattcaacagcaacaacaaaaggcattcaactaggaaactgtcaactggatcaatattctgtggcatttggttttatttcacttcttagaagctcagtattcttacctgtaaagtgggaatcaaacttccttactgggctacgtgaaggttaagtaagtaaaactatgtctgacacattttgggaatacattagctgttggttccctttccttttactacccttagcttagttagaggagcaaataatggtaactatgaaatattttcagaaaatgttccaaattgacagagcttctgcttacttatggttacctggagacccaagtaaaagccagggagaaattggaaaggtccatgtatttgggtaagagatactagcagctgtaaccaacattccagaatttgaaatttttgaaattagccgggtgtgatggcacgcgcctgtagtcccagctgctcgggagcttaactcagtgcagtttaatgggtgagcacctcccactgttagtgctggttgagggggacaggagcggtggtggctctgctccatgtagtctttcagggacccaggcgaattccatccagtgactccactatctccaggaactaggcgttctctactggatctctgcgcccacgatccagggaagaaagcagtcattaggcagggtgccagaggcttcaggatctgaatgaaagtagtgtatacccacttccatctatttggttagaactcagtcaccaggccccacctaactacaagggatgctgggaaatgcattccagctgtgtgttcaggaaaaagaaatggatttgatgaacgtttagctggtctttgccacagactgaccgcattttcttgtattattatggaggacaaatgtttaccatacataaactgcccagaggtgctgataatctgagaacctgtctccaacaagtcccctgggaagggcagcatttaaagacagtcgtgctggtttggaacaatttatctgcctacttgtttaaatatatttaaaaaattagcctgcaatctgaatctacttcccacatgttgtgtgccatttaggcattttggcgttctaaaatgacagatctatctcagagtgagtaagtttaggaatacatacttaagaaatgttgcatgcagtgacattttccttcccaaagtgatctacgtgtactcaaatttattttgctattttataaaataagaagttgtacacaatattgagtagaattctttatccgtgatggcagatagaacatctgttgaaatactaccactgttacttattttgaattgcacattttacaatgaattatatcagaattatatcaataaaaaattgaaaaaattttcaattttttaacacctttaatagatctaaacacaccttttttttttaaagttattcatttacatcatgattatatgaatattttaggattataatcaccctaaaatgaaggacaaaatttatcacaccaaaatagaaatttaatttaaagtacaaagaacttgattacaaggtttagtagactagaaacaagacataaaagaagacattaaaaaacactttttaagacaccctcagcagtatagttttacagtagatttggaaaaaatataacagcatttattaatgtttgtgaagatcatattatagactaatcaaagatcaaagtttgtaaggttcaaaaaacacacataagcaaattttggtcatttcctggaaaatactaactttaaatatcttcattcaggctgggcatgatggcttatgcctgtagtcccagcactttgggagacaaaggcaggcagattgcttgaggccaggagtttcagaccagcctgggcagcacagtgagacactgtctctacaaaaaatacaaaaattagccagacatagtgacacctgcctgtagtctcagctacttgggaggctgaggtgggaggatggcttgagcctgggagattgaggctgcaaagagcagagatcatgccactgcactgcagcctgagcaacagagtgagaccctttctcaaaaaagtaaataatagggctgggcgcggtggctcacgcctataatcctggcactttgggaggctgaggcaggtggatcacaaggtcaggagatccagaccatcctggctaacacggcaaaaccccgcctctactaaaaatacaaaaaattagctgggcattacagtgggcacctgtagtcccaggtgctcgggaggctgaggcagaagaattgcttgaacccaggaggtggaggttgcagtgagccgagatcataccattgcactccagcctggtgacagagcgagactccatctcaaaaataaataaatgaataaataataaaacacaaattttcattcagtatcatacagttagtgaagtttgtttgagatggaagctgctcttggccatattgtgatccaggggccttagtcaaaagtcagacttgtccacagacatgtgtaattaaaaatactccactcacttttcttggtactccatgacatttcccactacctgtcactttgtccttgacgatatatggggcagaaaacaaattgcttggacgaggttggttttccagtcagctgttccttatttttctccggtgcttctttgttatattagagttcaaatttactattcatgaaacacattttaatcagtgaccatatcagacaaatggaagctaagcgctggttagtctgttgaaaataaacatgagggctctcattaatgtcgctgtctgaataattagttgagcatccagtcctgagcagcggtgaaagcagaccggcgtctcactggaacgacaggctgacagccctgtcttggagaatggtcattagtgtgccccgccatcaatgtcatgttactgtgtcaaattagttagtgtccccttaggagagaagccggacctacaaattatcctcccacatcccttggaaactgtgtttgccaaacctgcaatcgagtgtgagcaaattattaacacggctcataaattaactagtttacaggcttataacattttacaagtagataataaaggggagaaaagttttccaattgcattgccctgacgtggggctgtgatctgccgactgttccttgaggagtccacagctcatagttttttgttaagagtccaaactcatggggtgtcagaacaaatgtttggaaatgtagaatctaaaaggcagccagtgtaaatccactgaaaacaatataattaacttcattatctcgttgctctgataagtcgatgacaatggtcatctttcttttagtggcagttgctcattaatgagttcaccaattaagtttgaacgattacagcctttaccaactgaaattatcttaaaaacatttttgatgcattcttatcatactcttaagctcccttgctcaagagggaaaatgcccacacagcacattaaactcatataagaatgaagattcagaagtcatgtgcaaagagtttatgcacactagacaccagatacctagaaaacatagtgtggacaaatctggcctgagtttatctcatatctagaagagacacccactgggaacaccatctcttaactctcttctgagttctggtaggcagacagcccacatagtttccggagacaggtgactattcaaatcataaaacttcgtgcatctcctttttagtttcaacttctccatctgagtaggttaaaaacatgtaaattcacaaagtattgcctgaatttactattgaaagagaacactgcacacagacgtacatgtacgtgccttgaaagctcaggctttctacccattctatagttccatttttttttttctgtattagtgagagtcctttatttaatcttgaggaccatatagatggcattattatctcaaggatctatgcagaaaagacccggcatgtgaaaccttgctactgacagctattcgcaaaaactttctgaaagtgcttgaggatgagttgacttatctgtcagcaacttcaacttacttggaattggatttggtaaatattctactaataacctaaccaagcgatgaaagctttgcagtctcagcacatgaacagagtgactgtttccatgagaaggtgtgtcacagtctccttctgcatttgaaatgcaactgaaaaaaaaagagttgctaactgtggcaagtaagattttctgtttggctgtcaggagagagcttgtatgtttcgctagtagggcgcctgtgtccatgtatgtacttacttcctcctgtctcttctactgagtgcattgagataggctaaaagatcaaaactcatggcaaaattatcatttggacctatggatcttctttttcttatttctcaggatgtattagcactgtaattatgagaatttatcttgagaaataagaaattataagccgagcatggtggctcatgcctgtaatcccagcactttgagaggccgaggcgggtggatcatttgaggtcaggaatttgagaccagcctggccaacatggtgaaaccttgtctctactaaaaatacaaaaattagccagacacggtggcggacacctgtaatcccagctactcgggaggctgcggcaggataatcgcttgaaactgggaggtggaggttgcagtgagccgagatcatgccactgcactcctctagccttggagatagaagaagactgtgtctggaaaaataattgcagcactttgtaggctgaggcaggagtatcacttgagctcaggagtttgagaccagccggcctactaaaatttagcttgtctactacaattccaaaattatttgggcatggtggcgcacacctatagttcaaggtacttgggagcgcttgagactgggaagttgaggctgcagtgagccctgaatgtgccctgcactccagcctgagtggcagagcgagaccctgtctcagaaaaaagaaaagaaatagaaattatggtacggaagataaaggaacttaacttcctaagtggatgtcagtgccttcaagagtgacagttttactcacctacataacattttgcatcctcctcctgtaattcaggttgtgagctaggtcaaatgctgattctagaaggcaaaggataaaatagatgcttagatacatgattatatactgaaggtaaatgtggtatgtaaatgagggataccaaaggctcgtgtgtctgtgttgcttttgaagcatcaccatttgccccttcacttaacctcttcttttctttttgctttcagcttccctctgtgtgttgcagtcctgtggcattatgcatgccccctcccagtgaccccaggctttttatggctgtgagacacgttaaaatttcagggtaagtgacagacaccactgatgctgtataccacctaaaaattgccatctacctttgcgggggacccagtggtcgatatagtaatcctgcagaagataatggcctttctaattatcaggccctgattctgaagctagcaggcatttgaatgctgctaccccccatgatagctttatggttttcaagaatagggttcataacggggatcatatttgtgggaaggtgacctaatgcaggggttggtaaaatttgtaaggggccagataggaaatattgtcatcctcatgagccatacagtcttttttgcaactagtcaactctgcctttagagcacaaaagcagccatagataatatacaagcaaaggggtgtcactgtgctccagtgagactttatttacaaaaacagacagtaagccatatttggcctgaagactatagtaggctgtcccttgattggatgcatcaaaaacggacatttgacctgtaaacctgacacctcgctgggtaccactccgtctgaccttgagcaaaccatttatctgcgagaaacaggaataaaaaatatatacctgcccttactaccttgaaagatggtgttgtaaggatgaaacaagatataatgcatgtgaaagcactttgaaaatttcgaaactccttacgaatgtgatgatcggctctacagtcattctggttcaccttgtggagtgtgacttcttcacctttttaatcacattgggctttcatgagcgaaatgagtgtgggggaaagctctcttattttctgagtaatgtggtttgtctgtacgttccttctattttacagttgatggactagctgttgaaatgtctttctttttagtatcaaatatggatgaagggatatgcgggtagattatggtaggctaaagatcaaatgccaatgaagaacgattaaatttcctttaatcatcagaatctgagagtgctgtaagatctcacctttaatataggccttaataaataataatgctttggatgcctacaagtatgtttaaatttcacaagtcttgcatgtcaaaacagagagacaggctcagcaaatatgcttccctgggctagcaatactaattaagaaggcaagtcatacttaaacaaacagctttgggaatagagggttaatcagaatcccaattcatgaatcttctagttttttttttccctcagagaaaattgtagtgtcatctttagatatgttttcatgtcattatattagttaagaattgttttctagtaagagagatataagtataaaaaattatttaagtattctgtcgtaaaaacatctgggaagagcagtttgtgtcttctatctttctactctgcttattcaagtgcgttccttcatcttcaaggtcacatggtggctgctggctctcaggccattgcctctacatccaagacaaaaagtagttttcctggctgaggcaggcctttttaaagcactttccctgtagccttatccaatgatgcctgcttacatcctattagccacccctaactgtaagggtgtctgggaaatgcatccttagacttgaacaatttgatgtcccaggtaaattctgggttctagtactaagaaaaggtgaatgcttactgagcaaccattatggttacttttacgaaatcatgctgtcaattttgcttacatgtttaatttttatttattttcaatgaatgccttctgttgactgtgccttgtttgaattttacatgttagaattttagcctgtttaattctcagcagagatacagctcagtaaatattttaagaccacaatattcttactgaaagtgccatggcaaatctgagaaatacatttctttattaagagagctataaagcaaaatttaaactctcgaatatgctagtctagtgggttttccttcctgtggatgtaagatttcattaaggcttgagtactagcatgaggtcttagtggcacgcactcacacccaattctgttccccctatatgggcaggggacattgctgacagctttgcattgtccctctgttcttatgtagactcaaggacgggacagaactctccatcctacctttctgtgatttgttgctccctgtatctctgctgaaagcttaccgtgggagtggggtgcacgggacaagtaagccactcctgtccaaattttctgtcccaaattggcctgtacatgattcttgtgagccactttttatcccataaaatgaatagaatgagacttccctatgctttgtattaataatatattctctgcctatactggcctgtgacgagtagtcataaaacttagggtaatggatgcattcgcagaaactccttggatgcctcctgtggatacaggatagcagcatggttaagagtgtctgctttgaagttagattggcttagactcagattccaccttttccacttcctggctgaacaaccctaggcaagttacttaacctttctgtgccacggcctccttatctggaaaaggggataaaaatagaagccagctcactctgaagagttagagaggtgatgcttgtaaagagcttagcacggatcctggtacatcataaatgccagcattgtactaggcaccccaggtgatacagtggaaatctctgtctctgacaagcttgtaccatcctgttgctggttcactggtcgttgttttactgatagatgacgcatgtttcgcagtccattgctcctcacctggtattcccttgtaaatgcaagtacagccttgggagcttgtcctgctgcacatctgcaaggacacgtgcagctatgtatacagctgctgtagccctgttagcagagcttaggtctctggatcctgttttgaggatttcccctgagaagcatacagttctttttttattcctttttttttttttttttttttgacttagtcagacaatggtcctgcctcgcaagcagaattcactaactgctttcaagttggtattgctgatgataatctgaaactgtagggtttcgctcgtgcaggctgatgttacatgatgtcgatcttctgccacctcatcctccatccctgcctctgtgctgactcggcaaagcaggtcctagtcccccacagatcctcttgggaatggccctcaaaggactgtgtcatctgcacacagaagctgccacaggtccgtggcaaagaatgtcagcagtactcatggatgacccagttggtgacttgtacccagattgaaaaacagtgccaaccacgtgaccctggctgtctcttgagtttttgagccctgttaggtgagacgggtaagagtcacaccacctataataacaaacctgcagtgataattcattaacattgacaccatatcacagaactgatggttttggggcaacagaccccagcctatagtagtacttatcaggggtctgcctgacataggctttgcttccatcatgttcactgtgtggagatagtggcttgaagatctggcgtgttcaaaagactcttggaaacttcgagcttttgccgcgtggtttccaatattttatttaaaccccattactcttctcagatgtcataaaatctcccttgcctctgaattacgggataccttccatgcctcccaggactcactccttctcatcccttagtgttcagttcaaaaatcaaccccttaaacatgcctttgctgaccacctacgtgaaaggggacagcccctttattatttttcttgatccaaacctcttgtttgttccatatgttacagccctgtcccttcatgaattcacctgtttatcaggtaataagcaagaagtaggtcgtattcagtgtggcttctccatggctagcagtgcctaacatatggtaggtatgcatgcagtcggtatttgttgaatcagtcagagtctggggatttccctgtgaatttctgtatttttatggcacctaagaggactgtatctggttgagggagaaagagaaggaacaaagctacacacatcacctttattgtaggaataaaatactgcccttgggttttctctggaaagttcccactatgtactgcatactctgcgtgtcccatccggaaggggttatacattatcttccccatgaagacagaatcatttgccacttgagcctgaaggatattgtgggtggtacaaattgattaaggacattgggatccaagctcaaaccccaacactctcattcagtggctctttttttggacaaattattttctctctctaagactcagtttacttgcctggggcaggggtaatagcattacctagccactgagctattgcgaggattaaattagatggtacgtataaagcactttgcacaacgtctggaacagaataacagtgctgttgatttaagggtatcagcaaaggctttggggacctccactgataaaactcatcttctgctttcttctgatgttcattttagaggtggcaaagatggcaaagaaccttgattcccgattatatttgctcatgtttcatgtgctgaattaacttcaaaaagtacaaaataagcaagcagtgagatagtctgttttatatttgttgttgacgcgttgactgttggatgctcatgacctgtctcaggtagcacatgctagaaacctcaagcgctgcaatggctcagtgtctggagcctgacccacatccagaaaaccatggaaattgagagtttggggtgctgcagtgtctgtacgccttcttgctggggatatgttttgcctttaagttaatcagagctggtttgatctcctgccttgcaatagagggcatcttaaatttccttaaattctcttctctctctctttttttttttctggagacggagtctcgctctgtcacccaggctggagcgcagtggcgcaatctcagctcaccataacctccgctcctgggttcaagcgattctcctgcctcagcctccctagtatttttttttttttttttgtatttttaatacagacggggtttcaccttgctggctaggctggttttgaactcctgatcttgtgatccgctcatctcagcctcccaaagtgctgggattacaggcgtgagccaccgcgcccagcccaattctcttctctttttttaaaaaaatatacttgatgtgtcggtcctgaaaattcacatcacttctcttttgatagaaaaccaaagtctgtatagtctgaaaggagttagatataaatgtctttcattattaacaccaatttcttccacctgcttgaagaagatgatctattatttttgctatattgttccaccatgtcagtggttgacatttgttgttcattgtgaattttttatgtaaaagctgaagcagagagagggacctgtctcactctgtatcacatgactttctagcggacaagaatgaaatctatgaaatcatatactcttatttacacgacttatggagtaactagggttatctaggaaattaaaatagccatttcttttattaattcataacttgtactcttgcaacttaacaataaaaggacatgattaaaatatagtttaaggcatcaaacgtggttactaatatccttttaggaaaggaaaagatgaaatccagtaagtttcagtcaaagtaagtgaataaatcagaaaaaaaaacattggttagactcatgataaccctcagagtggctaacacccagattttttgcatctctaaaaatatataacacccctgtctccaaatatcacttcagaaactaaaataataattcgtgaaaggggaaacagatccgtgtaatatgagacttgatcaggcagtttacgcgggatgcttgagggcctagatcagcccttgtgctgccctcttctcaataccctggtgcctgaggagcagcggggaagattaggagctttctgagggtttttactttaatgctttgaaattttgctgcatcgtctgagtccaatttggttcagcagtctctcagtgccaggtgactctggctaagatgctctagggctgaattttttaatgccagctttcccaggggatcagtaaaggttttgccctgggtattccaaccaggagagcctgtgtcctgtctttgtccacatctgtccccagtcattaatggtgacacaaaatagtctcccactcctgactcacttcctaaacctggcagtttctttgggattctactcctagaataattggtgcttagaccttcttaggtttatctgtatgtatgtacctagaagaacttgcatttcgtgctgtcaccaatattctgcatgcttaaaaagtagggagaggtggaagtagaattttctaaactcatgaaaaatctaaccctaaaaaatctcaataaacagcagttttttaagagaaacattctagcttttgaaaggtctaccctataatagctacctttactgtctgtatgccagacatgattctaagcctttgatatttattaactcatagtaactctgtgaagtaatcatcattctaaaaattcattttacaggtgaggaagctgaagaatagtgagttaaatgactcacccagagccctctgcttatatggagcaaagtaggatctggacctagaaattccttcccctcgtagcctgttgtgttttttttttttttttttttttttgagatggagtctcgctctgttgcccaggctgaagttggagtgcagtggtgcagtctcggctcactgcaacctccacctccctggttccagcgattctcctgcctcagcctcccaagtagctgggactaagatgcatgccaccatgcctggctaatttttgtatttttggtagagacaggattttgccatgttggccaggctggtctcgaactcctgacctcaggtgatccacccccttcagcctcccaaagtgctgagattacaggcatgagtgaccacacccagccgtaccctggttcttaatcactatgccatgcagtcttcctcacgcacacatattcttggggttatcgacttgcaggcattattttgttttcacataaacttttcactctaggactgcatgtggagctgttatacttcaatgctatctaataggccctgcttgatcttactagacttcttcaaatgctttctttttgctaacacaagagctatgggaaataaaagtgtgtcgcaatttgattaggaacaaggacaaccacttaattgccattcttctatctccagttggatgtgcctgttaagacattttctctagatctttgagtcatttttctctgggacatttttctaattaacctcatctctctagccctcattttacttcatattagcctctgaccacctaataattgatttgttctgctcaatcacctgtgtgaaaagtgagagggtctccctcccaaagctttggtcccgtacctgggcattttcccagcaagcaagttcagaatgttcttttagttcttggaaacattcacctggaaggctttttatttaccagggtgaatctggggtactgaaaggtaacattggctaacagagtagaagacctttggttacttagtcagtagaattataggtttataagctgtatgccaaggactttgaccttcaaatattagtaaaatattaggcttgaagaaatgtataaatgccagtttcaagagaccacaaataagcaattttgacttaaaaggtttgaagtgttcatattgccttgttaacacaaagagcagacagcccacttctaaagtgtcggtgccttaaaatactgagctcaccatattttaggtcttgttggttctgagtgaccagcttagtcataaaggggaattaattggctcataatgttgaaaagtcagattgtggaactagctccagggaaatctggagcaggaggttccgatcatgccattaagtcttggtggcagtcttctggctgtgctgtgctccctgttggattcattcacggaggcgattccctggttgtggcaggataacctttcatgagtctgtttttgtagcaactccagcagaaaagatcttttcttaagagttctagcagctgtcatggaatctggatcttcctgcttctgtgattggtctggtgtgtgccacatgcctttcggtgaaacacttactggagctggagcaggagtgagttgggggtggtgggaggtcctgcttggcctaggatgggtcatgtgtccatctctaaaggcatggatggcctttgacctacacaaaacaatgggaagtaggtgaaaagagtgctggtttcagaaggagacagaactctgggaaagtgaactatgtttatgtaccacgtcgggtactatacttgatacacagcaaatacatagaattacagggtggaaggaacctttaaatatcatatggttcagctaacccacaactgaatgtcatctatgggagttttcccagaaagttgtctgcctaatgcttgacatcttcaatgacatttcctaccttgagagtgggctgtgcctcagaaatgctaccatgcctctgtcctcgaggagtctagagttcattcatttcctgccttccttctattcattcttctcttcaaccatccacctaccatctgccacagtttgtcgtcctaaggcaagatgcttgcttttaacatacttacatgtgcaaggtagacagaaaagtcagttataatatggtgatagagaagctacaagaatactggtgtattgtgcgttttgattggggaggggattggagaagggagattggagggcctcatagcaggaatgatgcctcagaggatcaacaggagttgccaagtagccaagggaaagacggtctttttggtggacttagtaggattaaaccctatattaacattcagacttgcttttgaatgacccaggaaaattggcttataaagtagcttagcccagtcaaaatgcatatgtcttttaggtcacataaagaatgtaagtggtgggaataatatcctgatgatgaaacatttttgtacaggtgagccatctgacatcttccaagtcacccccatctcctgtttcttaataaatacgtaataagtgaatggatgaaaccttcttgggaaaaacttcagtgagttaaattacagaattttaacaaccactttcctaataattttgaaaggatcggatattatttgtttattcatacattcttaggggcaaaggaatattttgaacctcagttttctcatctggtacctgaggataaaaatagtacctcctgaagggttagggatatagagaataaacatctggagcatgtgaaacaccaaatatggttctatcacctggtaagccctctgtcaatattacttgttatcaaagggtatctatgatttttatacctcattggttgtcaaaagcttaacatttagttatgtccatttagctacttgatataaatgtttttccatgtgccctggatggaattttttttttatttttgcatgttacttacaccttaaaaattaaagatattaaagatggtgagatttagcaaaaaactttaatttcacatgcttttaatgcttccctgaattaataattttcatgtccatcatattttctccttggcccacaattcatcccatatttggatcttggcaaatgatgacttggttaattaggcagtctgttaactctgattactaagttataacagatcagtgtagaagcatcactgtgcaatttggattaaaaggctcttcattttatcaaaacaaatttacatttatgggtaactgttgaagtgcgttatgttaaaatgatgcatttcataaggaaaatttaaaaaggataaaaattatttcctcctgctaagttatttttttattgtggcattcatcacattatctttcactaggaatatacataaaatcttggaattttcttttaaggcttggaaatttagctgatttaataccttgattatacaaatatgatggatgcattgcatttttatttaagcataatttagtgtagtggcacatggttatattccaattctgaccacagtggcctctgatgttggagttacttatagaagtgaaacttgactgtgttggggcagaattagtgggctacattaggctggctttgttttatagctgaaggcattgatggttattaaatagactgcggcctctgtagtccggtctcttgtctaatggttcatcatcacttaagggaagttggggtatcaaaaacttgcttgcttcttccatgttcatctctgcctaccttctttactttcttagcacacataacagttagcattgtggaaggtgaacagacaaacacagagtaattttccagacttggtgaatcctaaaacctgtgttaattacccctcaagattctgtctagtatcaataacattcaaatgatagcacctccccctttactccctcctctgctcgacacacacacctgcatgtgtgacttatacacacatgcatatgcgtgtgcacacacatacacacctgcatgtgtgacttatacacacatgcatatgcgtgcgcgcgcgcacgcacacacacacacacacacacacacacgcacacacacacacactgaacacagcaactggcacctgggaggtgtttaataggtatttgttgaagactagtgggtggaaaagatgaaacaccaacagcctcccactccaagcttctaagctgctcttagcctggtccaacatctgggaccctgtttgatattacaactgttggaataaatggagttcatgaatttagtatttattctttcaataagcttactgaagtctggcctttatgaattgctgtgttctagttctacgggaaatagataaatcaaagagagaaaatacagtagtttccccttatccatggtttcactttctgtgatttcagttaccagcagtcaatgatggtctgaaaataagtgagtacagtacaagaaaatagttagagagagagagaccacattcacataacttctattacagtattgttaaaattgtcctatgttatttgttatcattaatctcttactgtgcctaatttataaattaaactttttcataggtgtacatgtataggaatacacatcatatgtatagggttcagtactaatcatggttttgggcatccaccggggctcttggactgtatccctgtgtataatgagggacaactctgttttttttttttgtgagacagagttttgctcttgttgctgagccggagttcggtggcacgatctctgctcactgcaacctccgcctcccatgttcaagcgattctcttgcctcagccccccgagtagctggaattacaggcatgggtcaccacgcctggctaattttgtatttttagtagagacggggtttctctatgttggtcaggctggtctcgaacccccgacctcaggtgatccacccacctcggcttcccaaagtgctgggattacaggcatgaaccacctcccccagccgactctgttctttacattcagcaaactcagtatcttgttgattgatgatattgacatgaccctaggccagaaatagtaaaccttagttcttcagttttattcagtgctagcatgtagtttatgcaaaaccagcttttctaaatctagaaggctctggctctgctgatattgatggtagaggcagaagtttgtttaagtcagaatggaagtggaggtttttatgaatttgattattttatcttaattaggaacatttaataataattatgggtgactttcattttggagcaggtatggctggttgttcaaaggtaaagtgatgttttgagctgtaatttgacggatctgaatgacagtcagcctgaataattcagcttcctactagcttccctaccaccccattccttcttaaagaaagaaccaaataaggaattttttaaaacccaaaccattctggattctattaattcttatagttactttcaaaggagcagtttgagagaaagatgcggtctgggacatttatatgtgaggtaaagctttcaacccattagaacattaatttttttgagatggagtcttgctctgttgccaggctggagtgcaatggtggtgcgatcttggctaactgcaacctccatgtcccgggttcaagtgattctcctgcctcagcctccctgaggcaggtgcgtgccaccacgcccagctaatttttgtaattttagtagagacgggtttcaccatgttagccaggatagtctctatctcttgacctcatgatccacccgcctcggcctcattaattttttttaatggggctttagttgcctaaataatatgtgtattatataaagtcttgctaatagagcaagagaaccctctggaaaaaaaactgcctaaggaatgagataagaactgaagtctgcttgggttttcaagcatcccttgagatggaaaagtcttaccccgcatccgtggtcctcaagaagccataaaggcaacattaggaaactttctcgattaggtgcttccttagtgaataggtctgtggatagaagcaagcagacttattataaggttggatactatactattactgtgtggttgtattaattaaatttattcctttaaaataaccttggatgaaaacaaccacctcttctgtggtcatggttagcagatgtttaccgtaattctttgctcagtgaaaaaaatgcctcttccacccaacaaaaacagccacgtttgcttggctaaatcaaaactttggcgcttgggtcttactttatatatcatggctccagtcacacaacctttccaagtgtgaggcttagatcaccaactccaacatctgcaggagagctttgctcacagtgatctattatgtgagtgcttaattcttagactgttcttggcattcgccttccctcattgaaaccaatatcctatatgcaagctgctctttgtttttcttacataagcatgctagcccctcccaaatttttaaagctttcacctagacctatggccatttttgtgaggattttgatcatagaaataaagtcaaactttgccttctcagtctgagagtttagtttttcttcggctctctctgaaataccaagcctctcctttccttatattttgtgcttgaaaagcactttctctcattgcatattgggcctacttaaccacctcactcctctttttttttttttttttttttttttacaaaaactttattgatttcaaacctatagcctatcggtagtccctgcccgcacctgctgttcatggttctaataggtatttcaggaccagctcccccatctgcactgaatttctgcactgaagaatgccgcctgctctcagcagtgctgaaaggaaatacaacagcaaaactttgcttttcttgggaagctcttctctttggaatggagaactctgggtggctcttcttattttgttttcatcgccaaaataagcagggatcttgcataacaccagggtaggaaaaaagaagtaattttaagggaaacatatgttcatgttgagaaaaaggcagttagaactggacaagggatagtggcccacaaagctaaaggcatcttttcaattcagttaggaaaccaggttttgatctttttggtgtatatatgtgtgtgtgtgtgtgtgtgtgtgtgtgtgtgtgtgtgtatatatatatttgagacagattctctctctgtcactgaggctggagttcagtggcacagtcttggctcactgcaacctctgccttctgggttcaagcaatcttcctgcctcagcctcccgagtagctgggactacaggtgtgcaccaccacacccagcgaatttttgtatttttagtagagacatggtttcaccatgttggccagtatgatctcgatctcctgactttgagatctgcctgccttggcctcccaaagtgctgggattacaggcgtgagccaccacacccagccttttttggtatattttataaaatgaaaaataagttgcttccctgtatccccaaatattttctttgattcaattacaaatgaatcttgggacaccaaggcttataaactagttagttgatatatgcagtatagaatgtgtctagttctgtatttgttaaattattttcctatgatcttagcactaagtaatgttcctggaaatcatttcatttaagatgcctgccctaatctgaagtcagagctaaaatgatccaaatatgattttttttttaattgagacggactctcgctctttcccccaggctggactgcaatggcacatctcagctcactgcaacctctgccaggttcaagccattctcgtgcctcagcctcccaagtagctggactacaggtgcatgccactatgcctggctaatttttttgtatttttagtgcacagggggtttcgccatgttggtcagtctggtctcaaactcctgacctcaggtgatctgcccatcttgacctcccaaagtgctgggattacaggcgtgagccacagtacccagcttcaaatatgattcttatttggtctgatttttggagaagagaaatccgggtattaaaatggaccaaagatgtctactttagctgtttggctgattagtggacatattatttgtcgttttaactgattccaaattatgtctgttgatagaaacagcagacactagtgtttcacactgtttgtgggtggcaagttttgaaaatgcagctaatttgcaaaacgacagaagaatagaaaaaaagatagaaaaaaattccttaaggttttccattcaactattctcaaagtatgaacattttagggttaggggaaactctagcagagttcttctttcctcattataaattaaatactcgtatccctaaaacgtagctgtgaaggagggaaggtcctggaacattcttagtactgatatgcgtatgcaatgccacaaccagagagatggcggatgtactcacacaactggttgagggcaagggccaacaggactgtgggatagtgcccagatgggaaggccttggttgcgcctggaactgtttctatatgtagttctttgctgcatgtacaaaaaaatatatccaaacagagatctatttaagaccaatgaaaaaacccggctcttaaagagtcctgctttccttagtgttgacaccagtaggtttggaaactgtgacagggtagatccaggcttgcatttaatctgtttgattcagaaaatctaattgaacgccaggcgtgatgggctcaatgcctgtaatcccagcacattgggaggccaaggcgggcagatcacttaaggtcaggagttcgagagcagtctaggctttgtgaaatcgcatctctacaaaaattagtcaggtgtggtggtacacacctgtagtctcagaggcaggagaattgcttgaacccaggaggctgaggttgcagtgagccgagatcactccactgtactccagcctgggtgacaaagtgagactacatctcaaaaaaaaaaaaaaaaaaaaaatctaattgagatttaaaaactcatagtagggggaaaaaaagaacttatcttccccgccccgtaacccaacaaaaaaggacacaaagccatttaaagtgtaagattattcttagatattggtgtaagatccagctattttatttagttcagtcctttctctcctagaggcctcaaagggcatcgtcagtagcacctgagtcatttgactgttggaaacactaagttaaagaaaaaaaaatcaatgtatgcacataagaagaggaattttgaattacatttccttttagtccttagagtaggctacattctgttgtttttctagtgtttttgtcctttgggatgaaactataaatggtggcagatgccatctctatgttagtgagaagtaggaaggacctcagggaaagtgtcagagcaaactggaaatcccagaagttttgtttaataattataatctggccatttgttctgtgtgacagctacttttataagcaatatactagcaccatcttactgagttcttgtaagtactatgaagtagctcctcttaccaccttcatgttacaggtgaataaagtgaggctcagagagattgcctattattaaattgcctagagttacagaagaagtaacccaaactgaatacaatctgtcatttagttaacagtaatatgtcaatgctaatttcctggttctgatactgtatacagctgtacaagatgtcaccgttggggaaaactggatgaagggtatatgggtattgtactatttttgcaacttcttgtggtctgtaattatttcaaaatttaaaaaaagaaagaggtagattttagacttggatcaaggtctgtttgcttttttttttttagacggagtctctgtcacccaggctggagtgcaatggcgtgatctcggctcactgcagcctccacctccccggtttaagcagttctcctgtctcagcctcctaagtagctggaactacaggagtctgccaccacgaccggctaatttttgtatttttagtagagatggggtttcaccttgttggtcaggctggtctcgaactcctgatcaggctgttctcgaactcctgacctcaggtgatccacctgcctcgatctctcaaagtgctgggattacaggtgtgagccactatgtgcggcctgtttgcttttataatccagatttttcactgctttgccttcttagatcatttgactaggaataatatggtctctgttccactatctttatagggtttgagttttcaggtctctcagaccacatcacatggtttcctataagtcccttgtgatttcaggaataaagattcatccttgatttatgaaatgatttgtaaaatagattgtaattaattcctgatgtgtacatggaacctcatgtggacatctagaaaagagaatggcagtagtaacccaaagatttagtagcttgcagcatgtaaatctgataagcggcaaaaaagttaaattcataagactagttatgtagcagaaaaaaacataagattcaaattcagaagcctgtgttttaaagctgtatttttggctaacttgttatgtgatctcagtttcctcacttaggaaatcattgagaagcgactcatgcatgttctaccacaagcttccatggataaataactttgaaacattccagataatacaacttcaaacctttgtctttactgagtgaaaatgattgctgtagaagtcgttcagtcttacgactggagagtcaagctctaggatatgttggtggatctgttaaccagttgattaaatcctagtaatattttatttcaaatctttcttctttgtttttctttttcttttgagacggagtctcactctgttgcccaggctggagtgcagtggcacaatcttagctcacagcaacctccgcctactgggttcaagtgattctcctgcttcagcctcccgagtagctgggattacaggctggtcgaactcctgacctcaggtgatccacccgcctctgcctcccaaagtgctaggattacaggcattagccaccacgccttgcctcttctttttaaatataggtatttacagctataaatttccctctgagtactgctttatctgtacctcataagttttagtatgtcttcattttcattcatctcaaagtattttctaatctcctttaattcgttggttatataggagtgtatagtttaatctccacttgtttatggatttcccacatttttttgttactgatttctaatttcatttctttgtaattggataacatacttttaaatttactgagccatgttttatggttcagaatatggtatatcctggagagtgtccttgagaagagtgtatattctgttgtcattaggtggaagttgctatggatggatgtctggttggttggttcctaggcctggttggttcctagtgttgttcatgccttctatttccttgctgatcttctgcctcattctgtccaggattggtaggtggagtattgaagtctccagctattattctggagttgtctatttctcctgtcagctctgtcagttttgcttcatatattttggggttctgtttttaggtgaagattttctcaaagcaagcaaaagaaaactcttcttatgttacccactctcagaacttcattcagctttagtgtttaagaattaaaacactctctgaaaaagtttagttttatagtggctccctgacattgatggagacatttaggccatatttacacaggtaaagagagatgagggattggtggctttatttaatcaatatattaattttttttattgtgggcagctggtagggtccaattgaggccaaaccaacattaacttcagtagcagatgactgggagctttgatttacccagatcattgtttcgtctccactattcacttactctgtgtagacatggactaactcaatacaaacatgttccatgggaaaaaatatgctttttattttttttaagaaataagaataaaatgcaattttcttgttgctaaatctctgactctacagccctttctgtgtggaggccacgtggcaaactccaggtgcatctgtcatacagaaattgcttttccccccaaaatacagaaatgtgaaataaaccaatttgggcacaagtagtgtatgctagatttacttagtatctgtcgaacatctccatacactcaatgtattaggacaaatcaaagagttataactgtctagtttctgcacaaatacatatatagtttctacttagacactgatgctactgattgattatttttgctaacagtgctatggccaaacacttaatttgttccttttcagcagtattgtaaatttgttctagacatatgtcagtgggaaaataggggggcagggggttatctacgcaagcacccatgcacacacacaggtacatacacatatgcatcaaaagatacttcctcacttaaagatgtttaaaagggtatttactttgacatgaaataattcttcagcctttttattattgttaaacatcttttggtgtttatgagcaataaaatagtttagccacgactgtatattcactatgaatgaaacatggtttttcagaagagattttacatgtatgttaaagccattttcttttcttgtcatttatgtgaatggtccatagattggattgctagtggaagaagccatgtgattctgtatcttaactttctctcagagaggaattatcgtctttgtcattttgtttcaatgtgctacctccctacctgctgggtttcccaacagccgtcagctaactattcttgtaccatactgctaccagcattcctggttcacaaatatgaagtaaacagaaaatcttgctaatttgagcccagtaggaaccttaacgctgtaatgagggactaattttgaaagcagagagacatctcttacaaaattagagcccaattttttaatgatcttaaataactaattgagagtaagaatggtatttaagaaagagtgagacactgatacgctgaagagttacaacaaggagaggagactcctccaggagccctagtaattatacagtcttccttcgttgccaccaatgctaatctgagtgtgggaatgataatgtaccttagaggacaggtttgtggttgaaatgctcttgatagattttgacaaattaaacagtggtaaagatgtttggaagttatccaggtccttaccattatttatgtcagtgaactagaaatcagtggttaatttgcagttcttataatttttatgatacttgtgttgttgtaaatttagccgtgtgcggcatcaactcagcaggatacattttatgttgtcagctaccttttgacatcataatagatttcatttgccaaatctttctcgatagaataaaatgtaaaagagagctgaagagaatatttggatcatatccagacactagtaaacatatgatggactttctgagatcagaaggctcagatatggaatagggggagaaattagaccctgttagtggttttctttttcttctttttccccttaaaccatcctagtgttctttgctagataggcatcttttatcttgactcaaagctagtgtgtttcttagcgtgtggtaccttgcacaattaccaaagtataatttagttactgcttttccacaccttttaaccattaatgcacctttgttagtgtcttctttattgcactggatcgcaagttctgtagtcctattttttttctcattatgtttttatatccattatattattttaaagaaaaatattggccaggcatagtgtctcatgcctgtaatcccagcactttgggaggccgaggcgggttcaggagttcgagaccatcctggcttaatagggtgaaaccccgcctctacgaaaaatacaaaaaaattagctgggcatggtggcgggcccctgtagtcccagctacttgggaggctggggcaggagaatggcatggacctgggagatggagcttgcagtgagccgagattgcctgggtgacagagtgagactccgtctcaaagaaaaaatttatactctcctgggataattaaagactcgggttggaaaggcattttgtagttaagatgttttgtttctccatcctttttctttaggttattcaaatccgtccctcataattatccactttctataacactgacccttgtcctgctaataaccgaagaggattagtggacacccctgcctttgtacctatttgttctctgagattctttgttttgacctctaagtaatttctttttaggccctctgctctttatgtaacacatgtttttgcagatctcactttgatctgtgtgaacatatagcctcccatttctcttatgtcatttatcctgcttagaaacattttatgagagcataagccacgctttcattttttcctttcgtacacctctttcgaatctcttcagaggaaattcctccttaatacttactatgagctcagcagcagtacagaggtatgatgactgtgacctaaggatgtccagccctgtgaaacgagcgcttcctcgtcctccttgtgtataacggagttacatatcttgagtcccttgtttggagtgtctgtctggcatggacgctgctgctccactctgccatagccttctctgttcccaatgtctaataaatgtttaatgataattgaaatgattagttatcaatccataatggagaagagcttattaaccttttctgatcacagctacattatccttgagatgaaagtttttgctaccatgtaccagcaactggaagtcagatccattggactgattggggtccctgctgtgtcatggcataaaatggtttcatatcattgatcaatcttctggaaggtatatgccctttgttattacttcaaagaatagccaatatttctatatttgagataatatatgtatagctatgtaatgtatttgggggcctgcactttcaatatttttataaagtagaacagttatagaaaactacccacccactcccaactatacacatgctcgcgcacagatcagttctgaaccagatgtcctatttccatactgtataaaaggtagccattgtctactgagcactgcagatgtggctagtataactgagggactaaattttacctaattttaaatttccgttataatagccatatgtggctactgtattaagttgcattcatatatatgtatttgtatatatttacataaaaattgttttaaggcagggaaccttgccacccaaatcaagaaattgaacttagccaccttgaagtttctcctgtgtcctgttccactcacagccctttccaaaaacaactcatgtttttacttttatcataatcatttccatttgttaattatttgatcacctacatgtgcatccttagacaccacagtttaatattgtccactttttaaatgtttgatatgtcttttaagtttcttaatctgaagatttcctgtctatgcctttcttttctttgtactttaccacctttcagagatccctggccccctgagctgtagggttccccagagcctggaagttgctgattgcatcctcagttcaacatgtccctctgccttctctatctcctgcacattggcaagctggatccagaggctcatgtttgatcccttcagcacaactctaggtggtgttgtgttctttcatttgtgagggatataatatcttattgtcttcctttttgtgatattgacggtcattaatccttactgcctagatccattaattcactgggagatgcaacacggtgatattctaattctacttactagctgggatgcttttgtaattttattcttcatctactctttagttacccagtggtactgttcatttaggtaatacaggataaatgtcgaattctttccctctatttactaagtttcaaaataatgagttgactcgctctccttttctgaaagtaaccattaaattttcatgtttttatcgaacacatggacacagggaggggaacctcacacactggggcctatcggggggtggagggcaaggggagggagagcattaggacaaatacctaatgcatgtggggcttaaaatctagatgtctggttgataggtgcagcaaaccaccatggcacacgtatacctgtgtaacctgcacattctgcacatgtatcccagaacttacagtaaaataaaaataaaataaactaaaaattttttatgtttttataaactataaatttaaacatgttagtagatttcaatttattgcattttttaaacttttattgaagatcaaattgtctgtctttcatgagtgtaacttctttgcgttcgctcctctgtccttctgatatgaccctacggtctttcatagcttctttgctccctgctatgacagaatgtttcagactcaccttgtaccttttttttttttttttttttttttttttttttgagatggagtttcgctgttattgcccaggctggagtgcaatggcacgatcttggtccactgcaacctccgcctccgcctccacccccgcctgagtctcctaccttagcctcctgagtagctggaattacaggtgcacgccaacaagtccagctaatttttgtattatttgtagagacggggtttcaccacgttggccaagctggtctcaaactcctgaactcaggtgatccacctgcctcggcctcccaaagtgctaagattataagcgtgagccaccacgcctggccaccttgtacatttcttacctgagaattgaaatcaaccatttatctagaaacccatttcttttagtgggaatttgtgtttcaagacaattatcttagcgctaacagtgctccttgttgtgagtgtgtccaggcctcatgagttcatcctgatatttccatttcataatcaggattacagggcttttatttaacctcctatttattacatctttatctcctttcttccatgctgacagttttggttctcgagaacaaaggggatggtagcattagaatatcccataattgcccatctgcttatttctctaccttacacacaacagtcttagaataacaatactaaatacttccactaccagttatgattagcaagaagagtaaacattttattacatatgctatccctagtctaactccattattatgtttttttttttgaagacaggatattgctgtgttgcccaggctggagcgccgtggcacgattatagctcactgtaatttcgaactcctgggctcaagtgatcctcccacctcagcctctgttgtagctgggactacaggtatgtgccaccatgcctggctaatgatttttaatttttaatttaatttaatttaatttttttgtagaggtggggtctcactaggtttcccaggctgatcttgaactcctggccccaagtgatcctcccaccttggctgcccaaagtgctaggattacaagtgtgagccactcactctttgcattattttttgatagttgtattagatttgcattttcaggacatttagccatttatatgatactctcccccttttaactctaaccctattgtactttttagtaatacaggtatgttcagtgctcagtaccagttcttcagtccttatgtcaatgtctgtagtcattttgtctaaacttcatttctgttagattttttggaaaaggctcatgggtactgtattccctgaattcttgaattttcgtaacagtttgctgtgttctttatacttaaaccacaatctttactgaattaaaaatgttgcctcacattttttctttgcatatcttaaatatgttactcctttttcttctggcataataagtcttaagtccagtaattttattagattatatcttagtgtcggtcatttggagcaaatatgcttcagtgtccagggtccttttgcaatatgtagtttcagaatatttttttaatttcaggaatgtttctttgaattatagttttaggtatttggacaattttcttcctttgctttcctctccagggattcctacttttttttctttcttcttttagttttgagctttgtcacccaggctggagtacagtagcatgatcttggctcgctgcaacctgtgcctcccaggttcaaacgattctcatgcctcagcctcctgagtagctgggactacaggcatgtgccaccatgcctggctaatttttgtctttttagtagagacagaatttcgccatgttgaccaggctggtcttgaactcctgggctcaagcagtcctcccaccttggcctcacaaagtggtgggataacaggcgtgagccaccacacctgacccagggattcctattttctatatgttggatctcctttacctgtcttcagtattcgatactttcccttaaatccttctctctctcttaatttctgtttgattttgtttttcattttaaccttctagttttttttaaagcgttatttgttgtatctatttgctatctgtccctctagtgtattttcttatttctagaatgatttttctttttttcaagtttattctttcttcccccatttctcagccagtcgaattcttatttatgtaattcttttttgtttattttcttttgttttgtttttttaagatagggtctcactctgtcattcaggctgaagtgcagtggtgccatttcagctcactgcaacctgtgcccccaggctcaagcgatcctcccacctcagcctcctaaatagctgggatcacaggcacgcaccaccacacccagctatttctttgtatttttttgtggggacagcgtctcgccatcttgccctggctggcttcaaactcgtgagtgcaagtgatcctcccacctcggcctcccaaagtgctgggattacaggtgtgagccactgtacgtggcttgatttatgtaattctttcaggccgtatatcttattcttaatgtcttttagctcattttgaagtaataggttacagacaagtaatgacatgtctgataaatgctttcattttgtgtaagatgttattctgttcctttttttttatcactttgtatagaattttacctcaaaatttttatattgctcatttttacgtgaaagtgatttttctgaacttttagcagggtggctgtattaagagagatcttctaattccttagagctctctctcttttgggttactttctactacttggctactggcatgctttctaaaatatctttactgtattcttctctactttggggaggcctttctcttatctttcctcttggttttctctgtcctttttgattttgattctgttgccaggagtttttcctcagtgtggagtcctatgctagaatggagacctcacagcccagttttgagagttcataagcactagactcctcccagctctgcagacttttcttaatacgggccctttgctctgaccctttgttggaacgggaaataccccacagccctaagttcagctgctattttaaacttggctcaccatactgtccatttagtacttattggcaatactggggttctttttctcagttctttccgttgctgcattgccgccctctgcttcttcccacctaggtgctactattctgtaggacttgaggctagtcttagcttttccacatctgttgtattacagtgttcaaagtgacactggtcacttgattttattttttacttttttgagatagagtcttgccctgttgcccaggctggagtgcagtggcatgatctcagcacactgcaacctccacctcccaggttcaagtgattcccctgcctcagcctcccgagtagctgtgattaattacaggcacgtgccaccatgcctggccaatttttatatttttagtcaagacagagtttcactattttggccaggctagtctcaaactcctgacctcaagtgatccacccacctcagcctcctaaagtgctggtgtgtccggaattggtgggttcttggtctcactgacttcaagaatgaagccgcggaccctcgctgtgagtgttacagttcttcaaggcggcatgtccggagtttcttctttctgatgttcggatgtgtttggagtttcttccttctggtgggttcgtggtctcgctggctcaggcgtgaagctgcagaccttcgcggtgagcgttacagctcttaaggcggcgcgtctggagttgttcattcctcccggtgggttcgtagtctcgctggcttcaggagtgaagctgcggtgagtgttacagctcataaaggcagtgtggacccaaagagtgagcaatagcaagatttattgcaaacagcgaaagaacaaagcttccacagtatggaaggggacccaagcgggttgccactgctggctcgggcagcctgctttttatttctctatgtggccccacccacatcctgctgattggtccattttacaaagagccagttggtctgttttacagagagctgattggtccatgttgacagggtgctgattggtgcatttacaatccctgaactagacacaaaagttctccacctccccactagattagctagatacagagtgttgattggtgtatttacaaaccctgagctagacacagggtgctgattggtgtgttgacaaaccttgaggtagacacagagtactgattggcgtatttacaatcccttagctagacataaaggttctccaagtctccaccagattaactagatgcagagtgccgattggtccagtcacaaaccctgagctagacacagggtgctgattggtgtatttacaaaccttgagctagatacagagtgctgattggtgtatttacaatcccttagctagacgtgaagattctccaagtccccactagactcaggagcccagttggcttcacccagtggatcccgcaccggggccgcaggtggagctgcgtgccagtcccgcgccgtgcgcccgcactcctcagcccttgggcggtcgatgggactgggtgccgtggagcagggagcggcgcttgtcggggaggcttgggctgcgcaggagcccatggcggggggtggggaggggggaggctcaggcatggaaggctgcaggtcctaagccctgccccgcggggaggcagctaaggcccagggagaaattgagcacagcagctgctggcccaggtgctaagcccctcactgccccaggcttgcgggccagctggccactccaagtgcggggccgccgagcccactcaccccagaactcgcgctggcccacaagcaccctgcgcagccccagttcccgcccacacctctctctccacacctccccacaagctgagggagccgtctccggccttggctagcccagaaagggcctcccacagtgcagcggcgggctgaagggcccctcaagcgcggccagagtgggcaccaaggccgaggaggcacccagagcaagcgagggctgcgagggctgccagcacgctgtcacctctcactgggattacaggtgggagccactgtgcctggcctgattttcttatatgtttgtttgcttgtggatttttggttttgctctctagttgctctgtatgtttttatgtggggactcagcaagattcaaaaactgtgcttctgcaaactctgcctctctcttttgtaatataagttctacctgaggctttatcaagcacatttttccatgtcactaaatgttgccacataaccttatttttaatggctgcataatattccactactgcatgaatgtaacataatttattaaggcaatctactattattgggcactcatgtcttaattgcacttaatgcaaatttcttttagttataaatttgtccacagattctttaccagtttttctcccttctgtaggttttgtggattaaagtaagcacagcaaaaatagggctgtttgctgaaccgctgacttccacttctttatttttgttcattcctatggtcaatatcgatgcatttcaaactcaaatgtgtggactgtcatcttctcaaaggatgtttttttctgacatgacgctttaattatatgaaaagttttataaaaacatagaagtgacttacaatattttatatgtaatgaattgtttatattgataagattaaaatcacaagaaagtagaaatgctcttaaaaatgtgggatcattgtgccttagagttaagaaaacctttgcccaatgaagaaaaagtagaaagcaaaggagaatgttaaagtacatatcacacagcattttatgctggttttatgtcagcctgagaagtgatattgtgtgcttcagctttgaagcatagcaggaggaagagttatacatgttattacatgtataagttcatgttttttcttttcttttctttctgcttttcttttgaaacaggttctccctgtgttgcctaggctagtctcaaactcctaggctcaagagatcttcccaccctgcagccttctgagtagctgggattacaggcacaagccactatgtctggcatgttattttctttgaaaggattgtgtcttgtcaaatgaacactcgcatgttaataaaaatcatcttattctgatatcaaatattaacattgttcttgattgtagatactgttttggaacatgtatgctgcgaattcttccagcggtaatgttatcaaaattacacctagacatttccctgtaactcttctcagtgctgtactatagaaagtattaggcctcaaaccatgatcaaattctgatagttgttcttctcatctcacccacctgcaaatgtgtttattgctggctgttttctcccagtgctttaggggaagatcctgtctttttttttttttttcaacattttgctctctgatgccctgggacaaccctgtgttgtgagatttaagaggtctagactttgtggccgggcgcggtggcttatgcctgtaatcccagcactttgggaggctgagacgggtgatcacgaggtaggagatcaagaccatcctagctaacacagtgaaaccccgtctctactaaaaatacaaaaaaattagccagcctggtggcgggtgcctgtagtcccagctactcggaaggctgaggcaggagaatggtgtgaacccaggaggcggagcttgcagtgagcagagatcacgacactgcactccagcctgtgcgacagagggagactccctctcaaaaaaaagaaaaagaaaaaaaaagaggtctagactttgtgaaaggctatctcagtgggtgacgggatcattcattccacctatgtcagccattgcacccaagcagcttgatcaggtcacagtccagctggatcaaagggcaccaggcgtgagctcagggctgggcaaccaagccagtcacaggtggaggatattgaggaccaactgagccaatttggccattctgaaactgtcagttttttttttttttttttttttttttttagcgagatggagtttcgctcttgttgcccgggctggagtgcaatggcacgatctcggctcaccacaaccttcgcctcctgggttcaagcagttctcctgcctcagcctcccaagtagctaggattacaggcatgcaccaccacgtcggctaattttgtatttttagtagaaacggggtttctccatgttggtcaggctggtcttgaactcccaacctccggtgatccaactgcctcagactcctaaagtgctgggattacaggcatgagccactgcgcccagccaactgtcagattcttttagccaataccgtagctaccctggtcagctgtagaaagggttatgcatttcttcactatcttgtgtctggttgcattgaaagcaagtctctgcaaaattctgccaaatgggcagaaatgtatcaagaaggaagcccagaaaagtcacacattgtgttcctctgaggcatgaagtccctctttgctgccctcactgactccagcaggcatctcatatgaaaggtgtggtaaggagcaagcaatgatattttgatggcaggatcaacccactttctagtccaaagatgacaggttccctcattgtaccaaataagatctatgtgtggagcacagttcttcagctgggagcctcctgatttgccaaattcttcttttttttaatttttaaatttttattttttatttctttggtagaaacggggttttaccatgttggccaagctggtcttgaactcctgggcttggccatctgcccgcctcagcctcccaaagtgccgagattacaggcatgagtgcccagcctgtttgccaaattcttctgcctcctttaatgtaaacatgtttacacccagtcttttcagcttatcacgtatcttgaacactactaatttcaccaatgaaaaacaatttcagatctctctactgctgatgaataaactttctggtgtagttttaaatgacaatatttgaggtgcttgtgtggcctactgtcatgtgtagagaggttgggggaataccctgggagaacattactgatttagaaaaatgttgccacttctgggtaataaaattacagacatttatatgcgccttattttgaaagaatgtgttataataagcaaaaagagtgagttagattagagatactttgagattgagatataatgtatcagtaaacatacaggtttgcacatacacacttatatgtgatagaattgaactaccctttacagcaggtcatttgctctgcttataactttgagaaattgggctgggcacagtggctcacacctgtaaacctagcactttgggaggctgaggcgggcagatcatgaggtcaggagatcaagaccatcctggctaacacggtgaaaccccatctctactaaaaatacaaaaaattagctgggcgtggtggcaggcgcctgtagtcgcagctactcgggaggctaaggcaggagaatggcgtgaacccgggaggcggagcttgcagtgagctgagatcgcaccactgcactccagcctgggtgacagagggagactccgtctaaaaaaaaaaaaaaaaaaaattagctggacatggtggtgatgcacacctataatcccagctactcaggaggctgaggcacaataatctcttgaacccaggaggcggaggttgcagtgagtggagatcgtgccactgcattccagcctggacaatggaaggagactgtctaacacacacacacacacacacacacacacacacacacacacacacacacacacacacaccaaaagttaagaaattgattggtggtcagatttcataatttgtgggtacatatttatacacaatgcagttctcttgcaagtgacgtttctgttgcagccaagaaggctgcttcattgagtacagtgagtctgcctcattcccctctttggactaacaacaaggctgtcacctcctccctcccagccatttccctcattgatccatcaaagtcagcctcaaatgattcccttcacaagcatttctgaaggtatcttttctcttctcacatctggttctgtctttacttgcttttgttcagtatggccctgtggtctcaatcttagggagaccgtgtaacatggtggttaagaccttggattctagaatgggcagtgcagttcaactttaagctttgccatgtattagctatatgaattgggactagttaccttgctgggccttagtttcctcatctgttcaatggagataagaagagtataatgctgtgcctggtacacatttctctttctaatgacttcctccaactatttctcttatagtttggattattgtctcattctgcagtaaaccagttcatccggagttcatcttgacctttctgtaccataaagtctgtcatagtccatctctcccaactctgacaccctttcttttcttccctttccccaactcctggtgggatttaggagtttgctttaaaaaaatatttacccacctaatacatccaaccagtaagcatgatgagaaagctgttctcaagtagatcatttagacgaggaagattttattgcattctgcttatgtaaactgaaatcctgtgccaaagtacctagctccaaactctcccttccttccttctattttttcacaacacatctcttgaagaatctattgcagattttgttctgagagccaggatgccatcagctctgccatcacagaataagcatgaaattcaagttgtcaccaggagtttgttgttgttattattgttgttgttgttttggccatcattgggagctttattacgatgattattggactgttatttttcatccgagcctcttttatgattttctttgggatttcttgcccattgagtccccattgggtatgtacaggacaactcttccaaatgcagactgttttttattagcaatgcctttatttgcactgcagcactgatgttaaggtgatctggtgaccaaagattacatttcatagtgctttgaagaagagggtaatggcatagtccagatatgcttggcctcttcctgctaatgcgtgccagattctttaatatttcatgtaaaaaatggtataacgaaaagagaaatttggtggctttttttttctacttgaaagcaagaaagagagtaatatgcacgccaaataaagtatttttctgttttgaatacactgagggctatatggatgctgtcagcagaatgtaaatcattacatttttatcactaagtgttaaagtccactgtatatttggtatacaaagaatacattcatcaggcgttctcttctccattcaaatcccacagatgtttcatacaaaataatgccattttgagccagatatggtgacacatgccctatagtcctagcttcttgtggggaggaggtgggaagattgctttggcagttcagtgctgcagtgtgctatgagcatgcctgtgaatagccactgcacttcagcctggacaacatagtgagacccacctctaaaatagtgataataataataataataataataatacatttgtaggagatttctttataggcccttaatatgaaggctgcttcaagggccatgctggtattgttggtcaaacttgcttagactgaaagcagtggttagaagtatcttagggacttcagaggacttctttcttacttttaatccatgttttatggtttttcaggttcataaaccatagaaggatggcatactttagggcatgagacaagctggcaatctcagacctgttgtgtttggtctgtaaaatacattaaaataatttgatccgttgccagcatttaaatatcaagggattggctgggcacagtggctcacgcctgtaatcccagcactttgggaggctgaggcgggcaaatcacctgaggccaggagttcgagacccgcctggccaacatggtgaaaccccatttctactaaaaatacaaaaattatccgggtgtggtggtttatgcctgtaatcccagctacttgggagactgaggtgggagaatctcttgaacccgggaggtggaggttgcagtgagctgagatggagccattgcactccagcctggatgacacagcaagacaacatctcaaaaaaaaaaaaaaaaatcaagggattatacctacagcaactctggatttctggccattgcgatagatgtagagcagcgctgggtccacattcccaaatggcagctgggtgggagctgagtcatggctggggtgcccccttagctggggcatggcctagggcttgcctttctcctctgggctgttttgctcattagcatggccctttgttccaacagactttagagttcgcaaccgcttggtttattttttttaatttgttttgaatttacactaatgtatttatttatttatttatttgtttttattatactttaagttctagtgtacatgtgtacaacatgcaggtttgttacatatgtatacatgtgccatgttggtgtgctgcacccattaacttgtcatttacattaggtatatctcctaatgctatccctccccactccccccaccccacgacaggcctcggtgtgtgatgttccccaccctgtgtccaagtgttctcattgttcatttcccacctatgagtgagaacatgcagcatttggttttctgtccttgcgataatttgttcagaatgatgatttccaccttcatccgtgtccctacaagggacatgaactcatccttttttatggctgcatagtattccatgatgtgtatgtgccacattttcttaatccagtctatcattgatgggcatttgggttggttccaagtctttgctattgtgaatagtgcctcagtaaacatacgtgtgcatgtgtctttatagcagcatgatttataatcctttgggcaaccccttactttaatactgcaaaggaaaaacagaaccaaattggtattcagaactaaacaacatgtgtgtgtctttaatggctaaatttaagacaaaaggaaatatatgtatctaattttgggaatctatattttctgaataatataatctcaggaacatagagtatgaattataaatatataattttatatatttaatgtatatttaaatgatagatatgattataaattatagaatttctcctcagaatcttcaaagtggagggccacatggtagtatctaattctaattcagccctgtccttttactaattaggaaattgaagcccagcaagtccagtgatttgttccaggccatgcaatttatataactggtagtgctgggacaggatccctgtgtcctgctggtgaagcaaggcagttagagtcattaatgtgcagtgtggaatagatggaaatagaacaaaatgtttaaagtgcatgtctttgctattgttcccataggttgaagttttacggaaatatttactttgtcaagattgcataagtactcgtgaaaactattctgtgtcccactctaggccttggctttttagaatcagtctaatatttcttccagcctgcggggcctttttacgaggtgctccgtagaatgcagcaggcaatgcatctaaaactgaactagttacacactcttcccctcccaaacctgctcactttcccgtgtgcttggtcttggtccttattgccctgggacagaagttatcatattatattctttttttcttctcttattgctcatattcttggttttgtaggtctcattgattctgtcttagaaacgtctaccaaaatgagcctttcctctccaccctcccagtttctgtgttgggatggtcctccctgtcttttaatagggtcatggcagtagactgttccttatactacttcattctaacttaacctcagtctcagttctttgtcatctccactggttttcaaccctgactatatattggtcattttgggagtttaaaatgtaccaaggccgaggcgggcggatcatgaggtcaggagttcgagaccagcctgaccaacatgatgaaaccccatctctactaaaaatacaaaaattagccagacgtggtggtgcatgtctgtagtcccagctactcaggaggctgaggcaagagaattgcttgaacttgggaggtggaggttgcaatgagccaagataacgccactgcactccagccagggtaacagagcaagactccatctcaaaaaaaaaaaaaaaagtaccgagcttgggccctgtgcccagaaagggatttaatgcatttggggcaagggctctggcatcagcatttttagaagctttccagagttctcatgtccatctccagaggtaaccgccactgctgtactttgtcagcatagttggttttctacaaaacacatccagtggtcactctactgcatccgcatctctgttttccacagtaagtccagacttctagtttggcttgggagaccttcatagttggatcctaatttctccagacttctctgtggccactgctcccccatataattccatgccggtcaccaagaatagtttacccctcctggagctccgaatgccccttgatgacagtgcacctttgcatgtgtgcctcgctccacctggctcctgttttctgtcctataaaaatgaagcctaccatccttcaaaggtactggctccatgagaaaacctcttctgctgccagtttgtcacctatcacagtaggttaaaatgtacctacacactgtacttttttctctagacctgagctgtcccatagaactttctgcagtgatgaaaatgttctatatctacactatccactatgatagctgattgccacatgtggcttttgacactggaaatatgactggtgcaattgaggaactgaatttttagttatatttagttttaatttatttaaacttaaaagccacatgtggctaatgactactgtttttcatagcccagatgttgatatgagcttcttgagggcagcggcctagttttattcatgtttttattccatatagtacagaatggtgttccctaaagtctgctaaacaacggaatgaatgatgtaagagttgtatcaaaaattttcatcttttgtagtttatacacctctctacacatatacaaataaaaatcctgcttatgagtataacacatattctcacatctgacacacagatctcattaccccattttcccgatgaagaaagtgaagatcagcaaagttaagtgacgcaggcaactttataatcatgaaaaataacattgaggctgggcacagtggctcacgcctgtaatcccagcactttgggaggccgaggcaggcggatcacaggtcaggagatcaagaccatcctggctaacatgatgaaaccttgtctactaaaaatacaaaaaaaattagccgggtgtggtggtgcacacttgtagtcccagctacttgggaggctgaggcaggagagttacttgaacctgggaggcagaggttgcagtgagaggagatcgcaccactgcactccggcctgggcaacagagtgagtctccatctcaaaaaaaaaaaagaaaaaagaaagaaaaataagattgaattatgcctgccagttactttaattacattgtgagcacgaaatttcttttgatattctagttgtgggtctctgaaaacctgaaccccagagaaaatgtctatagtcttatgtgttatatatagcccatgtggccatctcacgtttccagaagttggcttttattccatggtcacttaaatgacaccatttcttgagtctggggctatggctggctcataccagatttcttgtcttcattaccaaatctgccaagggttagaggtcactggtttgtcccatgacaactctttcttccacactgttttgaaggccaactgcgaagtttgattttgtcaaagtgggaagcgtgatatcattaaagctgaagttaagcagaccacagcccaagagagggaatggcactaaggctcatctgagaccttaatgcaaaatcgtcttactatctgaaagcgttttttttccttttttttttttttttttggtacagtctaaattaggacactgttagtagcgggagggtaattaggggtgcatagtgaatctcaattcttatttataagaagtcgacttgattaaattcttatagcttccttgctcattctatttcctttgcactgtatcataaacaataagatgattttacttcaagggaacggaagagtttttgttcaaattatatctcagtcattcacataaatatcagctgtgacacatttcttatatcttcagaggtatgaacaaatactatgcagacttgatttgcttggccgcgtgttgctgaaccattgtagtagggagaggaacaaagatggagaagagctgattttatgaaggaaccaaagaaggaaaaattgttgccgttaacgttgtttactgaaattcatcagcttttactttattcattcaagatttattaagtgccttttgtagactgggatagagcttagcaagagaaatgattgattaaatagaccattataataaaatggagtcatgcctgtattaggacaagtactgtgtacaaagggaatagataacagggacattgatctaaagggaggttagggaggacttcttggaggaagtggtatttgtgcctgagttatatgggatgtgtgggatttcttaggtgaaagagggcagagcaatacggtggtaggctagatctgtgcagcggcttagagacaagactgtacagggtgtgtatgtgagtgtctgtccgtggtagaatggtggttccagagccgcaaaaaaagtgcaagcagaggaccaagcagcggctaacatccagcacagccttttgaatacctctagatgcttccccttggccttccgggccttagaaagctaagaaattgttcagctgggatgggatgtgcgtgggtaagcatgcaacgttaagcatccatgtcaatgttgagatgcgtcctaatgtcaaaaatattaaggtgtgactggggaagctgtctgggaattgatggaacgttgtacattcacattttgcaagatgagtttgtcttccccgtgggtaggtttgaggagagcaaaaccaaaggcaggaaagagccttcacaagggaattgcagagtcgtgggaggcacccttgtgtgggccggcaagtgttggtcagggtgaaggaaagagaatggagtggatgtcattgttggatgtggtggaggagtcaaatgtgcctccagagtgtttggccccattggctaggcgtgtggtggtagcattcactgagggaaggcccaaggaagaagaaccagattggcggagaagagggtgctgaagaaggttgtagatcatggagagccaatgttacaggcagactgcttggaaatgggaactgtttgagaagaagggagggtgcactctgccaaatgcagcctatggatcaaacaaaagggactgaaaacttaatgactttggcaacagaggtttcagtggcatggtgtgggctgcaggatgtttagaagatgaataagtggagacagggagtatagcagctctttacagaagtttttgaaagggaggagagagtagggggctatgagactgtgaaaagaatttttgtttcatcactgaacagagattataaagtcacaccagaatctttcttttcagtttaatttaaatctttttttaaatttcagaactatgaattctgaattcatagttagcatagtagttagtagcaacttagaggctttgggaatttagcatagaagtttctagaagcaggcaaatgaaagcacacagcaggctcgatcatatatttatgacagaaatctttaaggagaagacccccaaacagcaacaaaaataacccttattgtggtggtatgggggcttttggtgtaaagagagtcaaccccacacagctcaaaaagctctgaggccattgtgggtgtaaggtgtgcaatggttatttgaaaatgtgtgtgtttgacaaagatttctatcaaaaaaaagttgtggcagtaaagcggtcaagtggttttctagaaaacttcagttaatggcaaaatcacgacttccagtacaactatagggaacagagtcactttgaaatgtttctgccctctttggggtaccctgtaattctattctgtttatgaatgtcctcctcatccttgaatttgtgtgtgctttcctaatggaacacatctttacgctcagtaaccatgttaatttatggtgtattttggtattccaagaagtgaaaaatggggagttaatacgacttctctttgttttactctgaagaggtttttactaccaggaccttgacatcttccaccttagtttatctttaagttatctttaactggaaccattttgtccattagctctattctaatcacctctcagaatagtcagatttacaagcaacacatgacagagaaaacaaaaaaatcagccagcttctcctgacattcaacagcagcccacgtctaaatagtgaaaaagtttatttgctttttctgaagatgtgctaagtgattttgcagttagagtggtacggccttctagcacttaggcctgcatttattaaataaatgtgttctctaactcaagtgttaagtgtgtattatgaaacctcaaagccaatttcggtgattgcaatgtgcaaatatttttaaaattatgtaattaaataggacttggcctgcaaggtccaccaaagtaatttattaattgaatagtctgatttaattgtatgttattttcgtttattcagggaagtgcctgcatctcttgcagagataggagcctcttgtatgcctgtcactggaggtacagaggtcctctccaagaaatctttagcacccaattaaatattaaccaagaagaggggacttgttccttctgtccctgaaactctattttcatgcctgagtctggcgattttaaaggaaaaagaaggaaaaaaaaaaaaaaaaccttgctgggtagaattatttgtaattcattttgtttatcactacattttttaaaaatgacttactcttcttaattgtaccagtgtacagggttatataaagtgtgtgtataaaaagaaaagcccctttaattcagtgttagctacatctaactatggctaaagccacgccgtatctgtttccttaaaatgtcattttaaaggtattgtggttttggagcagcagctgtgactgaaaagtatgtaaactaagctgttcttgctcatatcatttttatattcttatgtcagaccagaaggctgctttaaatttatttttcattgtgtattagttctagagcctggttttttttcttcctcaggaacatatgttctttgggacgtgttatactcagacacttaagaaaataacaattgtgtgggggggacaggtaccaaaatagtttcttatttgagtattgtatttgggggaagattaattaaaaaaaaaattaactctcacaaagtagaattttggggcctagcatctgtgttttaggaaatgaaagaattcaggcatactgtactaagtcacgtgaaaggcagtaacttttagaagcccaaattgctttcccaaaaggaaaatattttttgttgctattaaatatagtttatattgctacttcagaccttttttttttccagtggggccatttacttaaattcttagttaatatttctgtatagaaacgtctttgtctccagagcccgcctgtgcgaattcccatttaatatgcggttgtggataagtatttattcattccatgtggtactccacacctgatcaagtgacagcgtggcgtcatgtcagccagcaaaatgtttgagtgacttttgagtaatggtggcatagaaggtagagggggttgaaggaaataataatgggaatttttttcctttcctatatattttagcatgtataatgcttcaactctctggtggaaatttggaacacaggatagtaaaatattccttttcctagagggtagtaaaagtggagtagaaagtaggagctgttagaatttccatgataaatataatttgattacatatgttggggtgggttccctctgagctgaggattttactttgagagttgtttcacaatggtatatttctttccagttttcagaagcaaatttagccttaagaatttgccctggccaggcgcagtggctcatgcttgaaatcccagcactttgggaggctgaggtgggcggatcacgaggttaggaaatcgagaccatcctggttaacatggtaaaaccccgtttctactaaaatacaaaaaattagctgggcatggtggcaggcgcctgtagtcccagctactcaggaggctgggataggagaatcacttgaacctgggaggcgaaggttgccgtgagctgagatcgcaccactgcgctccagcctggcgacagagcaagactccatctcaaaaaaaaaaaaaaaagaatatgccctaagaagattctgttgacttgcctcatttgtacaggcctacatccgggtgccccaagtgagggaagtaatttggggaggaaggcagctctgtggtggatccactgttgtgcttgttccagcccctctgtctcttgccgggccccacgtgggacccgggtagtggcattctctagggcattagctggccctggtggtccttgcatctagccttggaaagggacctatcagagcatctggggtgatggttagaatagttcacaggtacagcacagctgtggtcatcccgatggccactagctctagccctggagcagggctctgggaaaccctcaccatgccgtggaggaggcaggaaagtccaaggttctggtcaagggtgtgttcaggaggcttgggggcaagggctgtttcccagcgagtacacaagtatttcagcattttagcactttgttcaggcgacccgtctgtagcaattaaacaccatccctgagtaccccaccttgtaccagtgacgagcctggatctggagaagagaaggggcttcccaaatcctagatgagataccggtgggtccaggagcagagccgccctctcttgcctcctaatgaaatgatctctccacttcactttgctgcctcttaacggaagtgtggaaatgtctccttttccacttacttcaaaccagagttggttaaaagaattttcctatgaacaaaactaagaggcaaatagaagatacctggggcctggaagtgaaggacttcataggagaaagtaaagcttgttcaagtccagcttcagatgcaatgggctggcacagtctgtgggacattcatgacttctccttctgttctctggcctctttgctgttcacaggatcctcctcttaaatctcctcttaacatgactgatgttcccaggggccatattctgtagccattgcttttctctatgaattgggagtcacaggcttgagttcctgctttcgtccccaccacctgtgtgaccttggtcacacagagtcccctcccagaggagtggcttgcctggacctctcagaggcacattttagctctaagatatttgctgttctctctcattcaagattttccccatccatgccttattccttccacttagtagtctgggtcacgcaactgaggcagaaaaaaagtctgaattttgatgaagagattgtcacagtttatcccaaatctgttctcaggggacatccttgtctttttttttattggcaaaacttggtcagggaatttctgcttaaatgaacctaccgcttcccattttgaatcaggtttgtgcttgctatcattattaataggagtattaatttctgttgctgataaagcgccctggtgtggctggaaagtggttctgtgccttttccccacccaagtgaagaaggacatgaaaggttgtacggtgtggaaagtgccttagcaattaaataaaaggctggttcatataaaggggcttgtttctatatggaaaatatgagctttttcttttctttttctttctttcttttttttttttttttttacatggaccaggtgtggattagttcactgaaccttttacccagccttatcccagccttattcccgcttgtaattcttctgaggcacagttcagccaagtcaaagaaacatgttattaaaggtgagctgaaaggcatttaaaaaataaacaaactgtttaagatcctaaatcagtaacagaatctatatgcacagacttgaaaagtacaagaaaatgtgtttcaatgccttttggttccaggctggattctcctctttccttctttgaacatctccccaaagtcttttttggtagttggtgggacaggcagccccaaggctaactttggcttgtagcttttttgtaactaatgacttgcctccactgaggtaggtgagaccccaatcttatacctacaattctccaactactattgaggggaaaaaataagtactttgattttattttagcactatgttcttaagaagtttaaaatctgatatacattctcttttatttttccagcctgtagcatggcagacagcccagatatatttatatatatatatattttttagacggagtcttactctgtcaccaggctggagtgcagtgtcattatctcggctcactgcaatctccacctcccgggttcaagtgattctcctgtctcagcctcccgagtagctgggattacaggctcccgccaccacacccagctaatttttgtacttttagtagagatgggtttcaccatgatggccaggatggtctcaatctcctgaccttgagatccgcccacctcagcctcctaaagttctgggattacaggcatgtgccaccatgcctggccagccagctatttttaagaacttgtagagatggtagaaatgaggtgtaggatgttttagatttatttaagttatatcatccctgatcgtaataacggcagccatcatttctttgagcattcactttgtgccatacactattctaagtacttatgacatgtcaatgcatttattctacaaaagcaaataatgcactgtaatgaagcccattttatggatgagaacactgagggacagagagcttaggtaatttgcctaagctcacaaggtcagtcagcaccagagctaataagaacttgggcacttgaatccatgcttgtaaattctgaactattctagtctaaagtatactgtatagtactatattctgtaatacttagttttaggtgaggcagcccaaggatgcattaagaaatacagatactcgaccgggcacggtggctcatgcctgtaatcccagcactttgggaggccgaggtgggcggatcacgaggtcaggagatcgagaccatcctggctaacacggtgaaaccccgtctctactaaaaatacaaaaaattagccgggcatggtggctggtgcctgtagtcccagctaatcgggaggctgaggcaggagaatggcgggaacccgggaggcggagcttgcagtgagcagagatagcgccactgcactccagcctgggcgagagtgcgagactgtctcaaaaaaaaaaagaaaaagaaatgcagatactcgatctgtacaacctcagccttgcctttataaaaattctttcctaactttcaaaacttgtttgtttttgttgtttttgatagcctgttttcagccaatgaataggtagataacaatcacttgcagcctgttgtactgctttttaaagaattagcttggccgggcgcagtggctcacgcctgtaatcccagcactttgggaggcagaggcggacggatcatgaggtcaggagatcgagaccatcctggctaacacagtgaaaccccgtctctactaaaaataccaaaaattagctgggcgtggtggcgggcgcctgtattcctagctactcgggaggctgaggcaggagaatggcatgaatccgggaggcggagcttgcagtgagccgagattgcgccactgcactccagtgtgggtggcacagcgagactccatctcaaaaaaaaaaaaaaaaaaaggatttaaagttttcattgtgattgtgcaattgtacaaagacattcccttattttattttattatttttgagacagggtttcactctgtcacccaggctggagtgcagtggcacgatctcagctcactgcaacctcttcctgcctggttcaaacaattcttccacctcagcctcctgagtacctgggactacaggcaagcaccaccatgcccagctaattttttttgtattttttggtagagataaggtttcaccgtgttggccaggctggcctcgaactcctgacctcaagtgtgatcacctgccttggcctcccagagtgctggatttacaggtatgagccaccgtgcctggcctattcccccattattaaacagtgtctcactttattgcccaggctattgtgcggcagcaccatgctagctcactgcagccttgaattcctgggctcaagcaatcgtcctgcctcaccctccttaatagctggcattgcaggtgtgagccactgagcctagcttattctctcatttttaaagtaatttcaaatagcagaagcagggaaggagaggcattttaggagttcatctttctggtccacctttaatgaagtaagcagctccttccaaggggagcttgaagcctgaattcttcgtagtgaacacagtactcttttcagaaacttatacttagcttaaaaaaattatctatacctccaccctgctgccttatatgatagaaaaggagatgagttcagcaacagcttcctctagcacacttgattacctttctttcgctgaagtccagatgctgagcttgttgaactcatctgccttgttcagccgttcttgttttaggagtgttaacgttctttttgggaaagaagcagcatatgcgtacacccttgccaggcttccattaagtgtcccttcacctttagcaagcccttggtggactcaggggagctttatagttattattaacataacagcctgtaagttgggcttctttctagtgaaggagccaagagggagggccccgcctggttttaaattacgtaggcttttctaaatgtgtttctaatgggagctagagaggtggtgagctttggggaagcctcgccttgggtcatagttgagtgtagaagggagctgggatctgcagatatcagggaatttaggaagagaggcatgggaaaggaaatgggatggaaaggtgccaggaaaagttgcctcatcatttcccactttggtggtggccaaaaggtaagtttctactttgagatcactctcaggccctgtgggcacagagctgccaagtttctcagtttaaggactaataaagtcgggatgtgggtaattctgggagactgggtagtttgaagggaaggattgttggaggtctttccagctatactgacaatgtacatgggttcattcttgagatgagcgtgtccataataaaatctagctgtagagccattcaaggacttctctgtgtgcacgagcatgctagccattttacgtacaacagtaggaacagagtagctggagtaagatacaggaatgtttttgttccactcatacactgattagtgttattcactcattctgtatttactgaacacctaccctgcgtagccgctgctctgtactgggatacagcaagcaagaggcctgcacactggctcatgcctgtaatcccagcactttgggaggcaaaggcaggatgatcacttgaacccaggaattcgacaccagcctgggcaacatagtgagaccttgtccctacaaaaaattgaaaaaactagtgaggcatggtggcacgtgcctctagacccagctactcaggaggctgaggtgggagaaccgcttgagtctagtagttagttccaggctgcagtgagtcatgatcgtgccactgcactgcactccagcttgggcaacagagtgagaccatgtctcaaaaacaaaaaacaaacaaacaaaaaaaagtgggagggggatgcaaatcagataaaatccctgccttcatggagtatatgttctgatatttttgtcataaactgaaattaatacgacttatctgttgcctaaactttttgcccagaacaaccaaacagaatcagttcagctgcagtgggaaccgccaagagccagatgtggccatgagaggaatatctttgagagcgtgtcatctggctccagctgtgttaacctaggcctggtaggcagccatgagttgtgtctgccaactggtggccagacactagtgcaggcttaaacaattagcagaattcctcatccggtggctggattcactgtgtgtgtcctacagacgatcgctgctgtccaaaccaggggactctgggcagaaacgcccagaagagaaccaaaagttagccccttgagaaaccagtcaaagtctcatcccggaacatggagagggaggcaggaatcggggaagaccagcaacagtgagaaaacagaagtaaaccagacgtggccctctgcctggcagaccttaattctgactgagaactcttgcctgatagagaacgtctgcctccagcatgcccctgcagaaaagcaaagagtagagtttgcctgtgaagaaattttttttcagttattttttacattgttgccctttggtgagaatcatttatgatgctttattggttttacccaaactgagatttccatgaaaagtattcattcccaccttttggaagcaattagatccccacaaacaggctataactttcaaatgtctgttatatctgccttcaaaaataagtatataagtaaataaaatgcttcagcctgcctgcatgtggaagattttttataaactgtagagttgctggtttcatgtaccaggcaagtcctgctagcacacgggaaaataatagattctgatcatccattgtccagcatgtttctaataccacagtagttgctcagtaaatgtttgtagactgagctgaataaggaaaaattccagtgaatgtgctgacttgcaagaatggtaattaaaaattagtgcagtcatttcaaatcataagttggggaaacaacccaccatttagtgccccccaaaagtaaaagttctaattggaataagcttaggatttttttttatgtccacatctaaagtctgatgataacagaaagcacaagatggcagagattaaggttttcagggagacttctcttgaggctgaacagatatgtccatgtgagaacatttttatcatggtgaggttcttggtggtctttcaaagaagtcccactctgaacagataacgacaacaaaatcattgaagtggggaaaattcaaaagatgctagtttgtgtgtcaaaatcaacttttgcattctaactgcattgtgtaaatttgctgtgcaggaaacataagtgaagccatttggttttgtggcattggtgtgggttggctcagggggtggggataaggttgaggcattgatatagtaagaggagagccagatggttgtattacacatcttttgtgttcttgtttgcttcttaaagcagttgcagaattttgcccttggcgatattttcttcgtgcctgtgtgttctgctatgaatttacttttgtcagagtactttgaaagaaaagccttgctcagaaaaaaaaaaaaaattacgttataaacttgtgaagtcaacagtgtgttcataaaaatattttttaaatgttaagtatgttagtaaatagttgagagaatcagcttttcttttttcttagcgcagtgatttcgaccatattttatattaattcagggaaagaatttttgcaaaattatgaatgtgcaattggtgatggatggatggatcgagatggatagatgaggagacagacacatggaacagatacattgttattccagtaaggatgaggcctatctgattagagatttaactttttccattacttacagcaagccctcaggttgtggttaacctcttgtgttttatcagcaagcgtaacttggtagtaagttgagtgagagtgggttagggtaggttggtgagttttcgttgacatttggtagaattgctgttacaccaccattgaaatttatatttattccctactaaaaggaaattctattttgcagtcaccagtggcaagggatatttaagatgttctaatgcatgtaaggggtgatattttatcaccgaatgcttttaataaagagttgctttggagctgtcccccctcacccacacacacacacacacacacacacacacacacacacacacacacacacacattgtggtagaatgcttcataataatttaatgtcctttttacagttccagtttatttttttttcctttgctcaaatcagagaagagcaaatatgtaggatccttgggcgacagtttattctcctgttgtgcacagatttccagttttagttggaacctgcagtccctgatgagaaaacaggaaacttacagtcctaaccttattgaaatctctgccgggtttagtcacaagtctgaggcgactccttccaataatgaagccattgtacgcatcgtatctgatcagttcttgaaatgttttagtaggtctatcttacaacattataagaagataatcagcagccttagaaggtccccatctggactgtagagttcttttactgaaagatgttttgcctttttgagatagctctcgcgtttcatcatctgttccgccgagatgaagtgcatatgaaaagtcagtgactctgaatccatctgttgttattattttccactgataattggcttgaacaatgaaatgtctgtgtctgcagcctttgaaactgtacaccctgtttattttctggaggtctcactgcaactacgcccccccatctttccccctgcattttctctcaagcttacagcgagtggcgcttgtgtgaggatgacatctttgactctgtgcatcagtatgtgtcactcagcatctaaagcttgcatacggatttttgtcacaatccctgtgtctgtgccattcgctcccgaatccggcgctctttcagcaaggagcttagctgggccgcaatgcatggatcccttacctggattgtcgtctttatttcactgtcctcattaaaatattaatttagggtacagtatctaatacctatggaattagatactacctataattgtataatatattcagttgcatccaggtttgcatgatacagagcattaatattggattccactaacatcacttccattagcttgctcaaccagtatgagatatagatgagctgggaagcataactaccctcaaaactgccaaaacattcattagaagctccatggggatggacagaagctttctcacagtgatatactgattaaattttgttttgtggtttatttgcagcaaggttagatcactattgtctatggacctgggttatctaacaccttatttggaaggtcatttcaaggcaaaagggtggacaaaatcagcgtcttcagtttctgtgggcaccccgcttagagaacctgtgttttattctctgggtctttgggtatctttttattttgtttgccttttctccatgttatgccataataatgtttgaaatgagttttgggtttgttggtttgtttgtgaaaatattttaaaacttttcagtgatcttcaccttttacagtagaatgatttggccagaaaacagttttgtgttaataaattaaaattgcttttgaaatagaaagctgccctatttcccttggctaggataatcacagcattctcgaaggctgtgaaggatctgtgacctatcctttttagtccaaatacagtaataatatggacacatcctatagcacagccctgctggatttggccacagagttctgtagggcattagtaagtagtagacgaacataatcttatttatgtttcaatcaaaatcatttaatactgcaaaagttattaaaaaataattaagttactaagaccaacatgtagctggaacatagaataagaggtcagtgtgagttgattccataagctgagaaaagtcagtagtgaattcctaacactggcatgtttttcctcttgcttaaattcctgggttgtaaggacaaattatgttgaggtatggcatattttctgccgaaatggagaaaattgttgactgtaattatgttatttaattgaaattataagtggttgaggccactcagttaaaagcatcttttctaatatgggggtaatgtttttaaatgagtggtcatggattggtgacatttgaaaggcaggcatttgggatatatttttggaaaactcgaattattttccttaaatgattagtgaactagagaatatagttaagtagcgtttttttttttttttttttttttggcttattctctttaactagatatgcttgaatgtattatgtgtgagtatatatgcacatatatatatgtgtgtgtatatatttttatatgtacactttatatgcatatatcaaacagatctttgtaggtacagagtcacaagtatcaacttacaatgtgacaaagcagagaaacgagacgtatatctgacaattgtgactaaacaaaccgattgtttaaaattcgttgaatgttaaagattgaaatgcaacccatagtagaactccagggatgggtatactacaagttctttttggagtagctggagatacaacaatagcactcccccccgccccacgagtgagttcttaattactaatgaatacaattcattttaattgttattatagcaacataacatttaactgactcctgtttagtggtgtcccctggaataggcagtgtctcctgtcagagtgaggacaggtagaaggcacagcgggcgtctgattgagccagttattcatttgctgagtgtttgtgtttatgcaaaggggcctcttcctgcatatttaatctagagtaaggcagtggcttttgttgtgtttagcccacataccttcagtccttcctcacactgccgccagcctgggagccctgagagccagcaggcttccaagcgcctgtagtttctcccttacaaactctcaactttcttccgttgtgtgaaaattgcctctcccgccccaaagctttgcctcctcaccatgaacgggtaagtgtgtgcgaagccaaggctgacacttttgtttcattttactaatgttgagagggtactttgctgcccttctgagcgcctcctgaaagcagtcctggttcctgggccgttgtcagcttctggctgcattgaaatagacaagtacaggtgcctcttaggaaatgtggctgaattttggactcgcagagaaaggctcgtgaggactagggggaattaaaaagaaaagagagagagagagcagctttattattctttgtcctaacaaatcctgttttgtaactatcctgcagataatgctgccattgtttgctaaaagccttcaaacagtgtctaagactgaactgtaagaaaacagaaactctgccgctgtattgtctatacccgggccagggtcctccccgaaggtctgtgccggaataggaaaggttttcttctgtggaaatcgaatcgtctcttcattgatattaatagcacactagagatgttggccatgatgctcagagaggcggtcgggagggaaggaaatctgatcttgctggggggaaaatgacagcctcttggccccacggtggaggagacatcatccaggctcagtgtgcataatggcatcctggcttaactgtttgctctaggaattttaatcttgagctgtttgttttactatctggggtcttgctattttttgttcccgtactgtctttagaaagcaccatattcaggggctaatccagtctttttttaaagtgaatttttaaaaacagactcagagaaattcatgtagtgtacacttagatcattctggggtatgatgggggtattctgctttctttttgagggtagagtgttatttcaaaaataagttgccacaattaacaagggtgaaccatccaaggaagatatgtcctgtgtgaagatatttcagggtgtgggaattatgtccaggctctaaaagaaggagttttcatgaccggttaactgttgcctctgtttgagtaactcttttcaacagaagagtgtgctgttcccccgccggttggaaactgtgagaatttaaataaaatttcatcaaccttattaaaatatgtagggacttgtgtcttcttgggtacaaatcagtctagagacttagaagcatttattaacagtgaggctgctgaaggtttttaataacaaaattacaaatactctatctaattgtaagtatatgacttttatacttggtttttaaggggaaaaatacttttttttgaggcaaagtaactccgtcagagcaccttctgtgattagtgctattgtattcttaaattttgattgatagagataatagttttcacttaaaaatacagacaggtactttaactttccatgacaatagctatttgcatttcttttatctttttgtttaacatttgtgggggttgggatggatttgattattaactcttattgcacactaaaggtgaatctaaaacaaaggctttgttagagcttcgaagggaaaacagcaaatattgtttttaggtttcaacatttaaaggctgttaaaggatacccataaaatattttcacatgaccacggccagggttttccttttctgtaaggcaggagagagtcatttttccaaatgagatgggccgatgtggagtgagtggggggctgccagcctgaagtaatttcatgggcaagcatcgactggggtttactgcaccacgtggcttaatgtataatattttaggtttttgccctactagaatggactccaaagttaggtactatgatctgatgagggccccagaggatgaggagaaaggaagtaaaatgttacttgcagggataggagagagatttgaagaatggtggattcaaagtcgcacatttctttgatagagacaagtaaaagaagtgtagtgtttgtgaagctgcaagcctgggtagcgtccaagtttgcctctggtctcagagaccccggctgcacagcagcttcttccttccttttctttcttgtttccttgctttattcttttcctttctttttcccctctgtttttctctattttttcctttctcccctttttccgtttttattttcttcttttctttcttcattccccaccttccccacttttttttcttttcttttttgaaatcttactcagtatttgaagtcttaagggcatagaacaaactttgagattgattttggagtagattttcttcactatagaaaataaagtgactcttgtcttatatttttcaatagtcaaatatatgttgatgtccttatattttctaagaagtcattgaaaaacaagatattaaagcccacagaagataagattccctatttaaagaggcagcaaactcttggaaattggcctatttggaccagtttttgcaaatgagtacaggccatttgattggaggatttgggggtatgggaagtttgaaccatgttccttcctcagtttcctagtaagaaagtgtcctctagccatagacctactgaactgccccccatcaccacccaggggcttgctttgctcatctttgcatctttattaagactggtacacaataggttctcagccagtattgggtaggctgaagattgagatgaactatgttgggcatacttcagagttgcttttgcacaattatataaaatgaaatataatgcagaaatcttaatgcagataatttattttagctgtcaagaaagggaagggggaaatactataaatggggaaaaaaagagctgatactcttcattttcagttttgtgaaatgagattgcacctccacatttacctgcaactcagttccaagtaggacatactagtggacaccgtgtattatatgtcacacagattaaattaagggcaaaatatatccatagaaagtatgatattgaaacactgcaataatctgagggtgctttagaataacagtcctaattagggaggaggggtggttggggaggtagagaaagaggaatgtacatttagtgtctcaccctagagttcgcagtagaaatttggtgtcctggacatggtttttgtggtcactgtgtaacttcaggtaaatgatactgttgcaatcaatagtgaagaggccatggaacaattctggtgttcacaggatcttaactgttacagagaatgacataaaggaaaataagtaatttctgtttaccatatccttggctcacttttaaaacctaaaaccagtaggaaacttaaaaaagaaagagaaaaagaaaaaaaaacgcaattcgtatggagacagcattttttaaaagaagacaagtgggctggaggggaatgtatttcttttatctttatcttttttttttttttttttacataaaagctttgcataatcatttaattttagttttggtgcttgtgctgccagtaagcatacaggtaaatagttgatctatttgataagtaaaagtgatttaaagaaaatagcaaatatagtattggaaagggaagttgtatgctttggaaaaaatgaaatgcctatttttctgctagttgttggtttccaattcttctaagctagtaatgaggcagactcgggccccagtactagccctaattttcttgtctattatattgacacatttcatttactttagcatgatggcaaacagctgttgaactattaatctttttctcagcaaaactagaaaaatgtctgttagattactttgttaatgttataccttctctaaaaatgaaaatcaacagaaataaattaatgagtggccaatcgtgcatgtgcaccaaaatttatggaacttcaaaatggagaaagatagagattatatcccactgcccattttttatgtataagtgaaaattaaatgtagtcagtttcgtattgttttagtatttataaattggatggtcagttgtataattttgttgtaattctttccccagtatccctaggggaaaaaaatgatactggttaaatctgaggctgaatcagcttctatttttgttctgtgttcacttacacactatactgtgtggataggtgagtagaaaaacaggtctagtgtttacctgaaagtgttccgcaggttcaaatgcagcactggagataactttattcgaaggaggcattttcagcagttttttaaaaaaattaaattttaatgaggtccagttgtttgccaggcctatatgatggcaaatctcatctgcattgcaaagtctaatactataggtctgactgccaaacatgcaaaaatagacacagctcaatagataaacatataaattagtttacagtgcatgtattggagaacatctcaagtaaaaaggagagaggaaaaggcgttcttgctttgaattgagtaggatctgccaaagttcacttgctttacatttaagatttgatgagtggtagatgtagaaatttctgtgtgcgctttgtatctactgagctctgatttgtgtagagtggggctctgcagatcttagctctaccttgaggacctgaccatctttgctctgtttttctttcttatcgttgcttgccctgaaatagacttctcactactggagaaaccaatcttggggacatacatcagcagtaaagcacacgattttcattttcaatttgaattgttttgtgtaaaaacaaaaaggttttggtcaggctgcaaaatagtaattttaagtcccagagctagggttttcccccacccaaatggtgaaaatttatggtgaaaacctccaatttcctcttacagtaaacatgaaaattatgatttcactcagagcctgcgtctttttccaatcttaatggcaagaatctgcatacacttgcttgtggaaatgtcataaattggcctcggatcaattcctcaaagatagtacacaccaaagtgccactttcaaatttttagccctcgtgaaataagattttactcttctcaatgatgtttgcctttccacattcagggctgacagcagagggatgagcagggatatattcctataaaattaaaccacttcattacatgctattctgaagagtgagcaaaaagatattaacattttggtaaaatgatgatatgatttcgccaccttaaaaattatatgagcatttggtcaatggatatggaatgaatcctgtaccctcttagtaacttgatctaaattaataaacaaatgtttttcttttcactcgtgccatatgttgatcccagttacatgggcagaaagaggcagcttgtaatgtttcttaaaggattaaacactgttttgcatacgggagtatgcagatgcaggagtaggatgtggggtaaaatgtgttccatggtttctttgtgttttaggaagcttgatttcaattgtttgtttcatgtgacatgaaccctttttaatttaacttagtagctccggtagatacatggtaagagaaaaacattctgtgaacagctttcgccagcaattaactccctgcccctccccaaagtgaaaatggtgctgctttcattcattttgaaaggtccgaagtggcagaaagcatcttgtctacaagacctaactctcttccaaaaggggaaaaaaataagtctttgctttaatgaaataagagatgttgtggatattaaccaaacagagacacgttcaagtggcagtctggtttccaaaaacagaggcctatgagtcacatattattctccatgaaaataaatcgatagacaacaagatgagaaaaagttgatacacaacatttgaaatgtttcaccttgacttttccccaccaagtcaattttgttgtcttgaagagctcaaaggcatatggtccagataagtagagattcttgggacttgtttttattaaccctgaaagtcatttgccattaaatagaattgagtgcttttgttgttttccttgtgtctgtccttggcagaggtggttgctacttctcttgacattcagattttgatgttctcttttgttttcagggtaagacgtgaccttttgaggtgactataactgaagattgctttacagaagccaaaaaaggtaaatgcaaatgtgattagtgaagttatatccagggctgtgtcttttgccttccaggcattttaattcagttgctttttggtctgtatttgtcaaataaacatgtatttatttgcgtgtaaggacatatgtggtgtatttttggaggtcctaagaaaaatggttgcccttaagaaatggtctacaggttcacatttcccccccaaatattatcaaactcttctctgtttgttgaagctgaacttatttttattttttaaatttatttgtttcttgttgacttggtaggtttaaagttagaaaggaatattcacatcacaaaagtggtgattcataaaattaacttgctgcaaacaagagtaacgcatgtcagtattgtgtgctgaagtggtgtcatccaattgatgttcatctggcggctttataatcaccttctttcagaaattaacagtcaggcaccatagcaacacgccacattgatgtaactgctgagcagtgtggggcatatccctgtaatgtcagcgctaggctgccttgttctcttgaccttgcttgaaaatcaaatgagtacttgattttaaaattagaagttttcagagagactaaagtagcttaatgaattaaagccaaatttaattttctcaaattcgcttttgggagggggagtgaaaaagtactccggttaaaatggttatggatgctacatatttacttgatttcaaaagtacctctctgataaaggcaatgatcatcttacagaagatgatcctgccggtcgttttaacatctgatatttctcaagcagtagcatctttgtttcatttagaatttttggcctttaatagttccatttgatttagtagatttgtgtctgtctaaaaacaggttacctgccagcatggttgaacaaagcctttgctcagattttactaaagtttatgtatttgtcagatatagacttattattgagttgaacagagttttttgtggaacttttcataatgtgaagaatctttgatcagtttttgataagtctcacctggggcttgggggggttctagaatgcatatatataaaggatatggatttgtttttgtagttgcattctggcacatttaatttggtctagaaaaatcagacttgcatcatttcaccatctatattgtttaaatgaaacctttgcaggatctacctaattgtatttcagagaggacaaacatacgtttcagatgtttcggcatggaaggaattgattcccaaccagtaattgggattatcaggccacagcaagacacttccctttgctgaggctcaattttctttttctttttctttttttctttttttttctttttgagacggagtttcgctctgttgcccaggctggagtgcagtggcgggatctcggctcactgcaacctctgcctcccgggttcaagtgattctcctgccccaccctcctgagtagctgggattacaggcagtcgccatcatacccagctaatttttgtgtttttaggagaggcggggtttcaccatgttggtcaggctggtctcaaactcctgacctcgtgatccgcccacctcggcctcccaaagtgttgggattacaggcgtgagccactgctcccggcctcagttttctaatctttaaaaggaagacattaatctatatcaagggtctgcaaactttttctgtcaagggccacatagtaaatattttctacttgtgggggcattcagcctctgttgcagctactcagcaaggtggtaatttgctgtctcctggtctctataatctcacagagtgatctcaatccaagatgctcctcatgcaaagtggtgccacatgtctaactcatctcctactgttagcagaggtttctggcaaagctaaaaattatgattaaacaggccaggcatggtggctcatgtctgtaatccctgcactttgggaggctgaggcgagtggatcacctgaggtcaggagttcgagaccaacctggtgaaacctggtgaaaccccgtctctactaaaaatacaaaaattagctgggtgtggtggcgggcacctgtgatcccagctactcaggaggctgaggcaggagaatcacttaaacccgggaggcagaggttgcagtgaactgagatcgcaccactgttctgcaggctgggagacagaaggagactctgtctgaaaaaaaaaaaaaaaaaattaaacaaagctgaaaaagtggtagaaaagatgaaaagtttagcttgagagttgccttatccatacagctccaaatataaccttcactgatgggttttcatttgttgttttgtttttttttttttttgtaatcacctgtaagcatgaattatttttcttctgattcaatatctttataatgtccgttctttcacctgttacctgaaaatggaaatacagtccccaccccaccccaaattctgtaatattgttgaaagttaaaaatatcataggtcaagggaaaaattggaaagaaatgtttctagaaatttgtcattggcattgcctgagaaaaatagtctatattacaaaaaaaatgctttcttcataatcactatcaagtgcatgatctatgggattatttaatatcgtgcaaataatgccccccttgtaaaattacttgatcataaaagtattttatatgctcagtctctatagttgttctctactttcagctttttttgttgtctttgtttttgttctatatacattgtcttcgtctgtttggtgttgctataaaggaatacctgaggctgggtaatttataaagaaaagaattttatttggctcataattctgcagactgtacaagaaacatgtgccagtacctacttctagtaaggaccttaggaagcttccagtcatggcaaaagggggtttggaacaggcatgtcacatgacaagagaaaaaggaagcttggagggaaggggagccaggctctttttaacaaccagatttgtcatgaactaatagagcaagaactcagtcattactctggggaggacactagccattcgtgagagatcagcccccatgatccaaacaccttctattggcccctcctctgacattggggatcagatttcaagagggagatttggaggggacacatttccaaagtatatcatacatcatcttcagtattcctattccaagtgaacatttcattacttaacacttttttttttcttttacagtatccattccatctgtgttttgatgctaatttcaaattttggggagaaataagttagggtatatagacttaagtaataaatgtaatttttacctttgaacaaggtgaaagatctttcaaagactaatttgtatatatcttgatctcttatctagaaagaaataaaaggtttgttggaaatatacaatttaaaaagatgtttcaagtgaatatagtggttagcgtttcttcctgatgaataagccttaaatgaggagaagaccttgccatccagcaatggacaaaaaaatcagcatcatctttcacactgcaagaagcatgtagacttcagatgccaggagcttctcagtaaataccacgcctcaaatttgaaacctgggaattattaagagtcagtatagatgcacagaaatatgcctacaaaggtactatgggaataactgattatatacataaaagtcgccaggcaaattcagaaaaccaaatgaagccattttgaaaatttggattctatggtctgaagagtcataaataacagtcatcatactcgggagtgatataacaattttcttccaactagatctgagtgctttacaaaatggatctggttgctggcattcctaagaggtagctggcaattctcataatccccactttacagactggaaaaacggtcccgttgatgataaatagtttacccaaggtcatccagaatgtcaagatggaaactaaagagggatgcactggtcacaattatacagatgtcattctattatggttgccttggtttggtgatctaataaaggtttctgtggcattttttcctgcctcccctcaccattgacaatttacccacatgcatttgcttaaaattcaaatccaatttgtaaaattcatcatcttatattcaattctgaatggcattgagagttgaagataatcatcaaggccatatagattacaattaaaatggttagttttaaacattaggcatctccaagcttcacattttgtgtattggttcagttttttttttaaagtcaggttatttgagagaaaactaaaaaacaatcaaaaggaagttgaatcattgcaattttccccccactccatccctaatttaaggtgttttatgttagatgaaggaactataaatgcatccttgtagataacattcattgtgtcttacctattataaattatttcttggtgaaaaataaagctaaaatgctattcagttatttgaaatataagttcctttaaaagtgtatatgtgagtgatttgaacatttacctaatgacacagcaattctgagctaaacccattcaaaactacctttttagagtatttagcatttgaattatgtgaccattaattaaggaagttgttatgaagacactggaagcagtcgttactgagttaccagatgaccgcattggctggaatgtgatcagtcaattcagttaagcattgaaatgctccctgatcccccgtacacacatacagtacactcatgcctgggttgtaaccgtcagggtaaagactaggctggtgtaacaaagagaccccagcgtaaaatggcttaaataaaatagaagtctacttctctcgtgaaacaaccagaccaatgtagcttgtctgggcagatctttccgtctgtgctctcctcccttggggctttgtctttatcatatggttgaagctatgttgttgccgcactatggagatgtccaaagcaagcaattttcttttgatcaaaagagttaaacattgtatacatcccactcattgtcacttaactggtaagattgtggtcataaggcccagcaaactttgagggctgctgggaagtgtctctacctaggtggccaggagcctggggagaattgacaaacagatttaaggggacaagtagaatacaagtacttcattgattcagttgctccaatctagtaatttcattcattcattcatacatacagatgtatgtacatacatacatatattaattcttactgcagatgtttattggtgggtgtgtgctaggtgctgagattatagcaccgtgtaagaaggacatggtctctgtcctcacagagttgatagtctagaggggcaggcatacatgaatgacgatgctgatgatgggtgttaggaagggcaattgttggttgatttgagaagtggtctaaaacaaggagtccagggtgtcgggaattatgtgttttagcatcgtatggaagttatgtgagattaacttgatttccttatatgctgttgtgaatgttatcaggcatgttaattttttgttaacagaattactgagatataattcacatacaatacaattcacccatttaaggtgtactgacttttcaatagttcttaatgtgttcagagttgcaaccatctagttcagttttagaatatttcatcgcttaagaaaaaaccctagtaactattagcacttacactgcattctgccctcccgccatcccctgataacaacaaatatacattctgtttgtatagatttacttagtctggacgtttcatagaaatggaatcccacatccttttgtgactggattctttcacttagcaaaatgttttcaaggttcatctaggcatttaaaatttttaactgtcttaaaacctcatgagttcttatttttaaatctaagagaatggttgcttgaaatattcttacaagggacagaactggggaaaaattactgttttttatgctgtgtgtatttccgtagactgacatggcctctcaacagttaaacgtcagaatttaaatgtttgcattttaagttagctgtttttaaacattgttagccataatgctaaactaagttactctgtaaacaagagctgtctctcttgaatgttagtttcaaagaaaaaaaatttcttaaatattgatttccagagaaatatgctcaatagagttcgttttcaagcagaagtcacttgttgaaatgtacatgaaggcatatttagtagtaaagacaatatttgcagcaattatcaaataaccatattttgcacagtgaacaatcaaaaatacaaaaccaaatagcaaatggttttatctatcttttttttttttttaagaaatggggtctggctgtgttgcccaggcaggattacagtggctgttcataggtgtgatcagagcttactgcagccccgaactcctgggcttgagggatcttcctgcctcagcctcctgaatagcttggactataggctcacaccactgaactactgtatccatgtattttttaaatgatgtttttgctgtcctatctgccaaaggcacaaatattccaactgctcaccttgagcattttaggaacacaaacctcatgttaggtggcaacttaacgacgtaccacagatgtaggaaatagagcctttccttggcaattcaaaagcctctgaaagaaatctgaagcttaactgtacaaaaacaaaatattataaaaggtagcacatctgtgttaaccttgtgggcctaccccctcagtatctagtaacaccaaggacctcaaagaaacaaatagtgtactgatgacagaatccttattttatgagcccatttaaaagttgaagctgtagtgacagttactaagcagtgctgagtttggatttgaagtttgtggtatcttttaaaaacactattggtgaatgggactttgtgaatttgaaatgaagatgaatcgtttcagtttgttcctctctgccactgatctggctttgcatggggtcgggaagaaaaaggaaaaacatgaagtctttctgcccttgtcaaattcactctttttaaagggtgaaaatcatgcagatctttcctgaattttgtatattggcatatatgtggtatgtaattaaaggtaattagatgttttgttaattatctgagagtgtgaccagttatttaaaattaccttttaggccgggcatggtggctcacacctgtaatcccagcactctgggaggccaaggcaggtggatcacttgaggttgggagtttgagaccagcctggtcaacatggcgaaacctggtatctgctaaaaatacaaaaattagctgggcatggtggtgcacacctgtagtcccagctacctgggaagctgaggtgagagaattgcttgaacttgggaggcagaggttacagtgatctgagatcatgccactgctctacatcctgggcaacagaggggagactccatctcaaaaaataaataaatcaaaagtaaaataaaattactttttaattaagagaaacctcccattgttggatggactgtgattattgcagtctatggcttgccatggtagcttacatgctcactctttcctccagtcttttttttctggaggttggtctgtttccctttcaaaaggtcctcagtggtctctggaggccagaggaaatatcctaaaatacattcattacaaattccatactttaaagtttatttagaccagtcattttcaaagtggccgttggaaccagtttgtgggttaaggattttagtgtagtggcttgtacccaagacttttaaaaaatggaatcagcggccaggcacagtcgctcaggcctgtaatcccagcactttgggaggccgaggcaggcagatcacgaggtcaagagatcaaaatcatcctggccaacatggtgaaaccccatctctactaaaaatacaaaaattagctgggcatggtggcgcacacctgtagtcccagctacgtgggaggctaaggcaggaaaatcacttgaacccgggaggcagaggttgcagtgagccaagatcacaccactgcactccagcctggtgtgagactccatctcaaaaaaaaaaaaaaaaaaatacagaataagcatacaatacagtaaaataaaaaaatcagaatatgtcacatgtggtaaggattttatgtgtatgcagtaaaacttctgaaacatatgagtactgtctttgcaatgtaaagtagttctttctgcaggttggatttattccctcatctgtttattcacacatctttattaaatgcctgctgtatgccaggcattgtgcttgacctcccctgtccagtgtgggagccactagctacctggagctgctgaacacttgaaatgtgattagcccaaacttggatgtgcagtgtaaaatctacaaagtatttcaaagcctttgtatggaaaaaagaacatgaaatatttgataatttttcttcatcgattacatgttgaaatgatcgttttggatacattaggttaaataaaatattaaaattaatttcagctgtttcttgttacttctgaaaagcgtcacagttacttatgtggcagccattgtatttctattagacagtgttgctggatatagcagtggacagcacagccaccaagccctctgctcattggtttagagggagtggacaaccagcgaagcgtgataaacaagggcgtggtgatagatactgtagagaaaatataaaaggataagggaggtcacattgtcagagggaagggttgctgtgtaaatagggtggtgggtggtcagggtaagtccatgtaaggtgagcagagatgtagcctattctaaagagagcaagtcagccagtatggccgaagcagtgtccttaagggaagagtacaggttgagtatctgttatctgacatgcttgggaccagaaatatttctgatttgggatctttcagattttataatatatgcattaccagctaagcatccttaaccccaaaatcccaaatctgaaatgctcctgtgagcatttcctttgagtgttgtatctgtgctcaaaaagttttggatttcggagcacttttgattgcagaatattggattaaggctactcaagttgtagtaagagacaacgtaacagtgtaacagggccagactgagtagggcattagggctttttatattcttattggggagccattgaggggctttgaggtagagcaagatctcactcatgctttttaaatggatcgctctgggagctgttttgaaaatagactttgggtggatgaggtcataggcagggagacctgtcaggaggccactagaataatcccagtgagatatgatgatggccaggatcacaatggcaggggaggtgctgagaagttgttgaatttggaatttatttaaacattgagccaaaggatttcctagtgaaattgatggggagtttgaaaaagttgcatcacagaagactcttaagatttttgtcttgaatgacgggatataatcaataggattcactgatggattgcttatgggcagaaacagaggagtcagaagacaaatgctttctgttctaaggaactgatagaaggtggtgctcccatcactaaaatacagcaagacagtgggtggggcagttttggaggtaggggaggtaagcaagggagaccaggaatgtagttgtagatatgggaggtttgagctatgcacccagactaagatgccaagtgggcatttggatatgtagtcctggaaatgtcctagcttggtctataaattcaggatttataagcatgtaagtgatacctaaaggcataaacttgactgaactcaccaaggaagcagtggtatagaagaagaaaagaagagttccaggatctgggttctgactctgggaggctgaggtgggaggatctcttgagaccaggagtttgagatcaacctgggcaacatagtgagactcttatctctacattaaaaaaaacaaaaattagctgggcatggtggcgtgtgcctgtagtcccagctacacttgggaggctgaggcaggaggattgttcaagcccaggagcttggggccacagtgagccacagttgcatcacaatactctagcctgagggacagagtgagactctgtctcaaaaaagtaaaataaaaataaaaagccaacaccattaaaagttttagtcatagaatattgagaacaggaaagatcagagatgggatgaaaactctgagattgtgaaccagaaagtcatcaaggtaagtgtttaaagtaggaaacaaagctgagcatgggggctcacacctgtagttccagctactcaggaggctgaggcaggaggattgcttcagtccaggagtttgaggctatagtgtgctatgatcctgcctgtgaataaccacttcactccagcctgggtgacagactatagtgactctgtctctagataaaaaacaaaattaggctgggcacagtggctcatgactgtaataccagcactttgggaggccaaggcaggcggatcatgaggtcaggagttcaagatcagcctggccaacatggggaaaccctgtctctactaaacatacaaaaactagctcggcatggtggctcattcctgtaatctcagctactcaggaggctgaggcaggagaattgcttgaactgggacccgggagacggaggttgcagtgaaccaagatcgcaccactgcactccagcgtgggctacagagagagactccatctcaaaaaataaataaataaataaataaataaataaataaataagaagagagttgtgagccatatcaaattctgccaagtggtcaaaaaagatgatgacaaagaactgaccattggatttgtcaatatggaagtcattgatgaccttagtaagagttagttgtgtttgaatctcactcctatcatatttactggctttatataactagcagtctgctggctggctgaacttacatggtttgtattatttttccaggaatagtaattgttcagcattcttgtttgttacagttaccacattttcccccaccccttgcactcatttttgtgaagtttgggtcatagtacaacctgtgagcagtgaaaaaggaatcctgggcattttgtccctcttgacccgttctctaatctgatggtttggagatttgcagtttaaataaaaggcatagaggaaagtgggatgtgtttatagccctaacttagaatatgtcgattgtaatcatctgaagtatatcacagattggtgtggttaacatagtctctagattagtaaaatactagtttgagcctgagccacgtctgtctatcacctttaccttttactaatataggtagtctttgatgggttcatctgcctttcagattacctaagagcatcacagattctagctttctcaaaacttgtgaaacacagttgaacattttcaagatttcttggccagtcgcaaatcctcaagcatccaggaaatggtaggttaattacaaaaacacacattatctctatatggatgctaaatactgttaagatggtgttggatgaaggaaggacagtttctctttgtggataattttaaatgcacttacgaaacaaaaaataaaggaagcggccttgcgtggtggctcacacctgtaatcccagcactttgggaggccgagacgggcagatcatctgagctcaggagttcgagaccagcctgaccaacatggagaaaccccgtctctactaaaaatacaaaattagccgggcgtggtggcgcatgcctgtaatcccagctactcaggaggctgaggcaggagaatcgcttgaacccgggaggcagaggttgcggtgacgcaagatcgtgccattgcctccagcctgggcaacaggagcaaaactctgtctcaaaatatatatatatgaagaagaagtagtgagaaaaatttcattggtaaccttatttaaacagttcaacattgtaactaaatcctaatgttattgtttttattttatttttattttttgggatgaagtctcgttctgtcacccaggctggaatgcagtggcacgacctcagctcactgcaacctccacctcccaggttcaagtgattctcctgcctcaacctcctgagtagctgggattacagattcccgccaccaagcccagctaattttcgtatttttagtagagacagggtttcgccatgtttgtcaggctggtctcaaactgctgatctcaagtgatctgcccctctcagcctcccaaagagctgggattacaggcgtgagccacagcgcttggccctattactattattattattattttgagacagggtctcgctctttcgcccaggctggagtgcagtggtgcagtctcggctgactgcattctcttgcctcccaggctcaggtgatcctctcccctcagcctcaatgagtagctggtaccacaggcacatgccaccacgcctggctgatttttgtatgtttttagagacagggtttcgccattttccccaggctggtcttaaactcctgggatgaggggatccacccacctcggcctcccaaagttccgaagttcacacctgtaatcccaccttgcctggctatttcttatatatggcatatttaaaaacatttgtctatatatacttttactgtatgtactctttttgtttcctgcttttatcattaaacgatcttaagtgttttcccaagttattacttaatatatctacatcttatttttaaagctacgttcattactaccactgttgtgttttctatacctgcaactggtgggtctttagattccttccagttatttgtgattgtaactacgtctgtgttggacatctcgagataactcagtctcttgaatgagtttcataaaagatgttgtgattttagataatcacctagtttctccctctacttttaaataatattcaaatgaattccaggcacataaaatcattgcttggctctgcgtacatgtgttttctgtgatagcatgaggtagagtttgtatcaactttgatgacaacatttctagacattaagttggtaggcagttttttgttttgttttgttttgtttctgatttgaattctccctcgatattttcccacttccccaacttgatttgcagcttgttagataaggaactttgtatctttcaaaggagagccatttatactttcattgtttaatttatcccaaatatcagtcattctcttgtcccagcacatgccattaatataaatttgtttatagttgcaaattttgctttggttgggtttcattcagattaactctgtaaaattaaaaaagttacagcttttagagtatgaaatttaagttctcttctttgctatacctcagtgatatagttactaattgattaagcaataagtagttactgagtttctatgaggctccctgtgtttaaaattgagctgtgtgctggcgggcggggcgggggtggcgggggacactctacatggtggtagatatcccatctaattctaaaatccccaaatggccaatcaatgaagtacagtcatgtgccacacaaggatgttttggtcaacgatggtttgcatatatgactgtggtcccataaaattataatggagcatacctgatacatagcacttggtattgtcattgcagataaagtaggagaagtgactgacattaggtaacagtgctgggacatacggttttccatatgaaaatatataagtaaaaatatacatactatctgggtttaagtacactcttatgttggcacagtagcaaaatcgcctaacaacacgtttctcagaacctatccctattgtgaagtgatacatgactttattcttaggtttatagattcagagaggaccaaggaatgtcagacttctgtagcccattccttatatttactgaagatgaaactgtgatacagaaaaggaaatgacagaccccaggccactgtgtaattgtagatttctgtgttggtagtgactcccagcctcttccactacatcagttccttccttttgtgatataataccaaagataagtggaaatattaaaatttgactgttaaaaagttgactgttgaaaaaatggaccaactgaaaaccaaggtgtattatttttatgtacatgaccctttctcggatttaatttctaatattctcttctctaagctatgttaagggaatttacaagtgtttcaaaatattaaataggaaaagcatcatctgaaaatgtttatctcagaaagtgcccacttttcacccttcttctctttactctcttcctttttcttcctcgttccctctccctctgtgtctctcctccctctaaagcctgattttttaaaaaacaaggctgtttgatgaagatatgtataaagttagaattatcctgctggttgacaactactgtgcattttttgaatagttgagttttgtgtagcatgagaatttagttgactacactatccttatgcgactgattcatacaaatgactgcctcctatgtgacgtgttttgccaagggctggggtatataagaggataatgatgtgtgtttcttactatttttgaggcataagctaattgattcgaactgcgtgttttctgaggtcttgttctacctggctttggagtggggttaatgttctttatttcccttctgtgggataaaatacctaccaatgtaaaattgtcatcaggaagggtcatataatttcattaactaagttctcattataatattctatgtatgttacatacatagaatagaaagttcttatgaagttaattttttctgattataaatataaaaccatctcattatggggaatttgcaattatagaaaagtagacaaatgcaaaaataaaagtaatttagactcctgaccctgatgataacatatatttccttctactctttttttaatggaatgtacatatagttgacaaagttgtagccatacagtatatagtatttgtgtatccatttttttttttaatttagtatttcatgatgagcattttcctgtgtcatgaagtgttcttaaagacatctggaatggttgtataccacatcatcctttcggatacaataaaatttaaagaactattcttaatgttgggtattgacaccatgtccagttttcctgtaataacgttgcagttggcatatttgtgcacaaatatttgtcttttctttttttgaaacagggtctcctccattacccaggctggattgtagtgatgattatagctcactacagccttgatctctcaggctcaagtgatccttccacatcagctcccgagtagcttagacttcagttgcacacaccatgtccagctaatttttatattttttgtagagacgggtttctgccatgttgcccaggctggtctcgaactcttgggctcaagtgatctgcccgtcttggcctcgcaaagtgctgggattacaggcgtgaaccactgtgcctggcatatttgtctattaatttgcttttctttagatgtattctagaggggggaaaatcagtagaagaacagttatgtaattcttacaagttctccatgtgtcttgccatcttgctttttctcatcctatcagtactggatgagaatgtttatttcactgaactttgccaaagagtttcaacatttttttgtttaatcataggagaaaaaggtttatcttatttttaaaaatttttatttaattctttcattacaaatgaagtcccagaagttgtatttgtttctttaggctgttcttaattgttcattggaacaggcagggtttgaaggagtggggatactgggaaagccagggtgatgagaaaataggaaaggggtcttgtcattgggaggccactataccagtggcccttgtaccaggactaatatggtactttgaagctttaaattcatttctttattcaccagataattattgagtgcttactggttctggacaagtaagcattcaataattttaggcatcccaggatacatcagtgaacaaacaaacataaaaaaaccaaaaggctcttttgcaaattgggtggatcaatctcagtgttgtatagggaggagaaacaacaaatcactgagcaatgcacttagcacagtaagagtaagcagttgctgctattcttacaacttctgctattgctctgttatcctcagcagctaaaataaaaaagggttgtcatccagatcccttcaggagtctccctgtcacatggaggacacaccgtcatgtaggtcctgtcctctccagcccaagaagcttctccccatttctctttcagctccttactcaatgagccagcatcctctggccccatggttccagaagctttgcagtagtgtccatttaagctctaagacccttggaacaggcctatggacttgagggagcacctgccatttgtatcagtttagaagggtgctgctgggggttgggggtggggctccggagtacactgggggcactgggaattacagcccctctctgggtgtttgctctgtgagtccgtaaacccaagcagctcattcttattcattcctgaatgaaggaattagaaaggaagggaaattgaaaggaaagtgcacttcctctccctctctcagccctttctgggatttccctgcactcagcaccagtggaaggcagatgggtacccatggcctggaccatgctctgctttttctctgttcttcccattcctgagagtgcacttagaaactggactgttgttgtgcacttgtctgattcctgctaccaccctttcaaaacaggaccaattttgtaatgggaaattgactatctcaggtgccgacatgatgaaggtatagcttgttgtttggtactagcatgtctccaggcgggaatggacttggagtatgccttggctgagtttggatgccagtttttgggcatggcctgaatactttcagttaattgtccccatctgtgaaacgggtagaatgaaaggacctgccttataggaatgctgtgaagatgatacaaagaatagcgtaggttgggagttcaggtttccatcttgggttgggggcctggtcttgctacttgttagctttctgatcttgaggaagtaaccagatttcttgaagcctttttttttcctgcaaaaatagatactaaactagtacctcccctgtgaagtagttgaggattaactaaattcttttcaggtaaaaagtgcttagagcaatgttttatacacagcaaatgctcagtaaatgtcggctccacaacaccagtaatttttatgattggcacagtacatggaatgtagtaagttctcaaggaggttaataatctttattattaattaaaaattcaagatatggaaagtatttttaaatatctttaataaatatatatatattaaggagagcctaataggaatagaaatgaaacaggcatcctggtactgtcttttggcccaaaatagaaaaaattaagatcctaagtaaaaagaaatgatttttgaatttttatggataacactgtatttgaaatattctctctcttctgctcatttcttacgtgccaccagagagtaaggtgtggtaccacttagagggatcttctcggcttatcttcacttagctttgttacagcttagatttttttttttcactctgtcaccgaggctggagtgcagtggcacaatctcagctcactgcaccctccgcctcctgggttcaagcgagtcttcccctctcagcctcttgagtagctgggattacaggtgcccaccaccacacttggttaattttttttttttttttgtatttttagtagagacagaggtttgccatgttggccaggccggtcttgaactcctgaactcaagtgacatgccttggcctcccaaagtgttgagattacaggcataagccactgtgcccagcctcagcttagatttgagggatgataatgtaaaaggccaagccattgccatccagatgttcctgagttcagaaggagagacctgggctcacgagcttttcagaagttaaaccatggactgaagtactgtgaacaggttttccagggctgtttgtgaggttcattggctctaacatgatgttattttagaacttacacgtagagactgcattaaaagagcattaggctcttgacaggcctgagagcactttgcgttgagcaatgtgggcagaaaccatgtcggtcaggtattcaccatgtcctaggctagatgggaggatgtgtgtgttctacagggcagggagccagaatccctgtctgtttggaagaacatgaagcgggtgctttctcaccactcagatgtgttttgagatagcagagggttggctgtttgtgggtacagttggcaggaatgaccttgaccccattattatctgaaggagaaagagagagtgagtgtgtgcacgcgcacatggttggtgatagcgaccctttctcggaaaactccagaatctgtccttttctttttcttttttttttaaaatttttatcttgagatggggtctgactgttgtccaggctggagtacagtgacatgatcatagctcactgcagccttgaactccctgggctcaggtgatcctctcacctcagcctcctgagtagctaggactacaggcatgcaccacgacgcctggctactttttcttcttcttcttctttttttttttttttttttttgtagagaaggggctttgccgtgttgcccaggctggtaggatctgtcctttttaacaaggaattagaaagggctgcttcgtatatcttcatgacacctaacaagctgttttctctctttgttccttcagaaatgcatgcagtttaatttttctttacctatacaggataactcttatcataacaaacaaacagtaaggaaaacataaatacgaaagcaaacattaccataaattcacccccaggatcacaacttggaccattttggagaccatccttctaaacatttgtctctgctcactgattatggaatagacctgggccgtccaatatggtagccagttaccataggcagctcttgagaagatgaaatgtgggtaacctgaattattttgaaaacaaaaaaaaaagatattgtaggctgggcatggtggctcacacctgtaatcccagcactttgggaggccgaggcaggtggatcacttgaggtcaggagtttgagacgagcctgtccaacatggtgaaaccctgtctctactaaaaatagaaaaaaaattagccgagcatggtggtgggcacctgtaatcccagctattcaagaggctgaggcaggagaatcgcttgaaccagggaggcggaggttgcagtgagctgagatcgcaccactgcactccagcctaggggacaaagcaagactctgtctcaaaaaataaaaaaaaaagatattgtaaaataccggataattttgggtgttgattataggttaaaatgatgataatgttttaaatatattgaattagaacatactattaaaattgattcattcacttcattttagttattaaaaagtacccattagaacaatttaaattacatttgtggcttgcattctattttttttttttttgtttgagacagagtctcactctgttgcgcaggctggagtgcagtggtgcagtctcagttcgctgcaacctctgacttccgggttcacgccattctcctgcctcagcctcccgagtagctgggactacaggcgcccatcaccacgcccggctaattttttatatttttagtagagacagggtttcactgtgttagccaggatagtctcgatctcctgacctcgtgatccgcctgcctcggcctcgcaaagtgctgggattacaggtatgagccaccgcgcctggcctgcattctatttttattgggcagtttggtatagacacataacagttttctcttgccaggagtatgctacatttttcctactttttaaacatttaaaaatgttacccatatctctctgtaacaattgatatatagcaacattattattactttatagctatgtataaatatatcgcagtttatctaaccatttctacttggttggatacacgagattgtatacaaaaagcttgtatatgcatagttgcaagcctgtctatttcctaaggacagtttctcagcatcagcttatttttgtttggggctgactagttttttcttgtgggagactgtgctgtgatttgtgggatattttgcagcgtccctggtctgtacctgctagatgcctataactctgctccccactcaccacccctgccccatgcatgacagggaaaaagtatccgtagacatcgccaagtgtctcatggaggaaaaaattgccctagttgagaagcactaatttagggcaaattaccagattgggacatgctgggtgaaaagctatgtgtatttaaatttgataaacatgtattgatttatattgaaattttatgtatgtattccccaactcttttctggaacaatggtatcaattcctatttctttcttttttttttttttttttttgagatggagtttcactcttgtcacccaggctggagtgcaacggcgtgatcctcccagtttcaagcaattctcctgactctatctcccaaatagctgggattacaggtgcctgccaccacacccagctaatttttgtatttttagtagaagacacagtttcgccatgttggccaggctggtctcgaactcctgacctcaggtgatccacccgcctcggcctcccaaagtgctgggattacaggcctgagccaccatgcccggccccaattcctgtttctatcaagagtaacaaagatcctcattaaaggcctctaagagattcatgaaggcgcggctgggtattatttaattggtattttacttgttaggaattgtttgtttgtttgttttcgagatggagtctcgctctgtcgcccaggctggagtacagtggcatgatctctgcttactgcaagctccgcctcccatgttcaagtggattctcctgcttcagcctcctgcatagctgtgattacaggtgcataccaccatacctggctaatgtttgtgtttgtagtagagatggggtttcaccatgtttgtcaggctggtcttgaactcctgaccttgtgatctgcctgcctcagcatcccaaagtgctgggattacaggtgtgagccaccgtgcccggtcagaaatttgtttaatcaaattgctgctttcctgagaccggccgttttaagcaccaggatggaggcaagctgggttttcttctgggaagccagcttggcagtgagataccatagaccaccttttgtagcctactgtccagtgcttctgtgctcataaaggagggaaagatggagaacatcagagaagacaactctcttactcctttttaatttatctaagacttttctgactgtaaaaaacaggaataatatcaaaagctattgatgacagtagctaattattgaacgtttgctgtgtgtcaggccctgcttaatgcctttatgtataacttcattgaaacttcagaaaaatctggtttctctgggttacgtaggggctactgtttcccgcaggcacagagagggggccagccattcacccagcatgcccaggtcacatccttcctgtgtgtgttatggccaggacttgaagtaggcaatccaagtgaccacactcttcattttctcatgctttgatcacatatttgggcttttcctgcgtgccagccacagcattctttgctgagtttatattagtgagccaatgaagacaaaactgggccctcagagagctgtgatcctgccaccttaccccactttaggcaacagagtgagacctcaaccctaaaaaaatttaattaattaattaattaaataaatactccaacaccattttttttttaactagggaaaatacctctatgaaggtaaacagtttagttgagatgaaaaggagtcagacatgtaaggattagggaaagatcaattcaatgtcgaagcagcaactaatgtccagtcctccaggtgggagtgaacttggcatgcttgaagcaaagaaataaggcctgcatggctggaatataatatgcagggaggagttagaggctgcagtcatcagactgatgcatgtggcaagaggctattgtagagcatgctgtcatttggactgtggtgtcgatagtggacaggcaaggaacaggaagtctttaaaactgtccagcgatgcatgaatggataaagaaattgtgctgtatatatgcaatggaataatattcagcactaaaaaagaatgaaatcttgtcatttgtggcaacatagatggaactggaggacattgttaagtgaaataagccaggaagagaaagttaaacaccgcatgttctcactcatatgtggaagttaaaaaaaaaaaaaaaaaaagttcagccaggtgcggtggctcatgcctgtaatcccagcactttggaaggctgagtcgggcagatcacgaggtcaggagatcgagatgatcctggctaacatggtgaaaccccatctctactaaaaatacaaaaaattagctgggcgtggtggcgggcgcctgtattcctagctactcgggaggctgaggcaggagaatggcgtgaatccgggaggggaagcttgcagtgagccgagatggcaccactgcactccagcctgggcgacagagtgagactccgtctctaaaaaaaaaaaaaaaaaaagttgatctacttaaaaagtagaacagaggatactagagcctgggaagtgtagggggaacggagagatttgttaaaggatacaacattatagctaggtaggaggaataaattctgttgttctgtaccactgtaggctgactgtatagttaacagcaatacataattagtctcaaacacctagaaggaggatactgaacattcctaacaccccgaaatgattcattttgagatgacagatgtgcccatcgctcttacgtggtcactgtgcattatgtgtactgaaacactgtatctatgcatcaccatgcatatatacagttattgtttgttaattaaaaaataaaattttaaaaaggatatacttaggggttaaaattaggcagcagtcactgatggatagagtaagggatgtgagagtgagggaatggttaatgatgccacctagatttctgatgtgaccatgtctgatggagatattggctgagtgagtagcgtgttgagagagccctaatgtggagttggaagataatgaaactggattagacacatcctagatttttcagggaagaaccgtttccattttttttctctcttgtaaccagaaatgccagaaattcctatattataggaccaaaactgagctcacagactaccttttgaaccttgtactcagaacgacttaggcttctaagtcctgattcttcgtccagaaaacatcattactgaagaccatgcagagaaagtaaccctatagcttagaaaagggagaacatgagaaagcagccaagtgtcactactccatactttctcacaagtctgcagaaattgcttggaaaaataaatgtgcatttcataatgcagaaacctgatttctttttaatcattggctttttgggtgtttgctgatttttttcaggcttgttaatttgtgctgtgtctacccgtcatttgtgcaaattagcgtggcttaactataaatgaaaatgtcaaagttattacattatttaaaattgaagaataattagactggaggaaaacaggctaaaagaatgctgcaggatatgttaaaggtaggaaaggacggggaaacacaacaaaacaaaacaaaacaaaaaaacgaagaagggataagcatgagaggatggggaaccactcccgtaacctccagggacacgggcatgtgattactacattgtgtaactctaataatacggcgcatgcccagaagcctcacatacaccactaagtataggttcaaatgattttcttccaggcctttaaaaaaggtggtgggggaatattttacaaggttgtttgcattctgcagtagaattgtgcctcggtatgttttgttctcagcgtccatcaaagacacctgcttgtctgaacctatcagaaaactgccaaaacaaaacaaattaagaaaagtaaaagggaagcccaggtgtagggtgcatgaggtgggaatggggattaattcttccagctcttagggttgttgactctgttagatcacaaatgcagtagggaaaagcgactgttacttctagggacttatacccacccaggtgataaaaggcctgtgttcatggttataacttgtaacattatctgtgggggcaatagcaaataaattccataaatgtctgtcaggagggaattgctaaattatggtccatccccaggatgagggacacccagggacatcactacagagctgttaaaaaagaacgtacacctgtaggtactggtacagaaatatctccaatatatattaagtgaccaagtgggtaaatagaatagtatttggatgaagtgggagaaaaagaaatatacatacaaaatacttatgtgattgtattgtgtacagaatatttttggaatagagagacaagaaactggcaacaatggatgcctttgggaagggaaactggtagttgccaggggctgtggaatttattcttgcttacctctttggtgctgtttaattatgtgtatatgagtataatatgcatttaaacgtagctctagaatggcaaagagcaaagtgttactacctaaaggggcaacaagccctgctacaattgatcagatactgaattttgataatctctcttttaaatccttgcttttaacaacagtgaaaatcagtaagattgctgattgattttagaaacccagtgataagaaactgttgattttgcccagatctacccagcctttacttccagcttctgactcctgactttcgattccgtatggcttgtctcctgtaatgctaaattattatctccacctccgtggatcactgtgttatcgaaaatacttttttagttgcatgccatataagacttagcccacactggctcaagcaaaaagagactttatttgataatataactgaataggtcaggtgtagccctggctagacaaccccatctttgcatttctcccctctgctctcttctgaatttaccccatttctaataggacccctttcctggtggtgacgagctccagcaactccatccttgtcaccttgctgctccaaggggtgcagagaaggtctgagcctcttgtcctgactcttcaggggtagccttgggtcatgtgcttctaaggaccatatttcttcttaatgtccttagttaaggtggccaatcttgagggttgcctttcatttatctgtatcttctgtttcctgtttgcaacatagttaaaatggataaatccctgagctcctataggcctgggaacactaagatgaataaaacatgtctgcagatctcaggaaactcacagcatggtagacaaggcactggtgctagtatggaagtcctttttgatgtgaaatattcgacccaaggaattggaagggagggctccttcatttctacttgggaaaattagtggaagactcctgagggaggctaccctgcagtgaaggctcctgggaggagtaggacttcttcagtagacatgttagaggattgggtgaagccattccagtctgagaagagcatgagcagacaatttgaattatcattaagttgtatttatctagcctcacaatggcctttgcactgccctcttctcattttgtagccaccatccacgaccagacctttcaaggaaatcactcagtgctcagaatagtagagcatttgattccttcatcatgcatttggcatgaagtcatttattactttgtattgttatttatttctctccctccccccagtttctttttttgctcattgtctgggctgcacagttagtgccctattatcaagcagtcatccccccattagcaaagggttgtgttccaaggacagactttgtcatcagaaactttgttctcggatactgaaataatggaggcggcgtaggactgcattcaaggaagactgaagggggatgggcatgtttgaaaataccagccaacttttgtgctagaaaacacaacactggagtcttgaacctgccaaggcaaggggattagaggagagaaggaagcagttgagttagggttgtggtagcaaggaggaagggtgagggcctgagcatgtattggaggtgggagtccaattcggttacagtggtgtaagcatcagatgacactgcttcacataagccagacatgtttgaaggaggacagggccggatgcaaattatcatttgattgttagttagacttgttccttcccagtgcctcattgccagtatttcttggaaattgaacttgaattcacacagaactgattcctcacacaaacctgaatctggtcactcttaagtggaccccatgggacgcacaaggaccagaaggaagaaggatgtgcaccttactgcctctgctcgttgtacaagagaggggattgaacagcagagagggagccagatggatgcgcacacacgagtgtgaggcctccccttagtcctaattcatgtatagtgagaagttaggaggctctactgggggagggagagagcaatttcccttctccagatgctgcaccttccaaaccatggaagaccatggccttgagatggttgcctccaggtccagaaataagctagacctgagctttcccctagcagttcgggaagagatgtcacccttgaaaaggtatctgcagcaatcctggaaagactttccagtcaaaaaaatgaccaaagtcaggtgaccctaataaggggcagagctctttctcccagttagttaggaacagtggacaatatgagtgtcttttctttggtgtaacgcttgactgcagcccagtgacattaaagggttgctagtcaatgagaataaaggactgagaaatgaatttctagttttgaaggaaaacaagggactagagacctgtgtgagaagaccaggggatcagatacccggggtggggggctggggggtaaatgtgggacacaggcatggaagcttctaggtcttctctattactgaggccatcttctgttacttgtcctcctgaaatcccccacccctagtatattgcaagacccatgggagcaatatggtaagggccatactggttttgctcaccactgttgggtataattctacacggagcctcaggaggacatcgaagttgacccacccgggatgccgaggacactgctgagagaaaattgtgcatattatttctcgttttcattgctgaatttccctagtaatctatttatcaaactttgactcttccttctcctataattggtgattcttttgcacaaaagaaccccattattccatgtgtatagaatgttgacagatataatactgccttgttcggtggttgttttttgggtgtatgccttatcttcaagtcactctaaaatcccagtgggtagagaacctgtctattaagactcttttgattcctgatttagaatgtataataggtgctttataattgattatgtccccagtgagactcttaagcttttttgagtacaagaacaatgccttatatgtattcatcgcccctgccaatattttacacatagtaggtcttgtcctagaggcagaaccaatttggacagcagttttaacaattcagacaccctgtaacatgttgcttctgtaacaatccatggctttggacttaagcccagtgaaagcacattagtggttatgagtttctccctgtaaggtttttcctctttgtctcctttctattttttggtacgtgagcagcctctgtctctctgtagggaagcaacagacagcttcagtgagtacaaatgttatattcacatgtggaacatagccccagagataatcatatgtaccagtgatccgtcagtagatgctattacccgtgtggttcttttatcaaaggaattaagttctcttgatgtgttaataaacagtacttttttggccagctctggagtggatgaataggtgtttggatgtctgtctagattgacagctttagattgcttttttcctgaaatctggtaattccagatttacagtgaattttctcttaagttgtgttttcaagtgatcacaccgaattggtgggcagcaattctttcttttaccaaaaaagtaaaattatcgttaacactttttatcaacaaaactaattctttaagaagtctttgttaattttttgtcttttctctctccctacatttgtatttgtttaccacagatctttagatatgtttctgttggaaggaagtattctctttttttgagacagagtctcgatcttgtcacccagactggagtgcagtggcattatctgggctcagtgcaacctccacctcccaggttcaagcagttctcctgcctcagcctgccaagtagctgagattacaggtgtgcgccagtacacccggctaattttgtatttttagcagagtcggggtttcaccatattggccaagctggtcttgaactcctgacctgaggtgatctgcccaccttggcctcccaaagtgctggaattacaggcgtgagccaccacacccagctagaagtattctttaaacagatgggtgcagtagcatttacttcatatcttgcaccttgggagggagaatataacttgcctaatggcataataattgatttccccccttgtcactttagaataagactttataacgcccccagaaagagtcgaagatgaaacatgacaaaccagaaaaatttattggccaaggtgtccactccacttggtaactttttgagggcctgatctggggttatctgtcctgtaagaagattaagatcaacccagttaaaacacggtgggccccatccctgctaagaccaggttacaggataaaactctcatccctcttggttgttaagacgaaattttcattcacttaaagcataaatcctttgcataatatttttatgcttgttcttctcctgtgtgtaaacctttatttggcgccttctctcttctgtgggattgactttttagggcaaatgagaattttgaagataattactctcctcctccattcctgtatctttaacaactgccaggtcccagtgacactttgataaaatgtttttagagccagtcacttgtgttgctgtggtctgccttgtcgtagaggcacatcatttttgcacatcagtattaacagttcaaacaccctgaaatgctaatagcactagtaagcttttaattccatggaatttattgcttgctgtgtttccatgaatttataacgctttgattcttaagagccccatttaatcagttttgcctggcaccgaacataataaacaacttgctggtgaaaaagtgccactcggggaggctgctaacaaggaagttaaatgcttctgccacgagcagtttcttcgctgtatttttcatgagctgtaatgtactttgctggcttcagagcggtggttaaacacagtgacaaaccgaacccactccagcactcggaaactcagactttgctaggtgctttggcaaaaagtatagaagaaatcaacactttcagccttttcccccctgcctctaacttaatggtttctaatactttttcattatctttaccttaatctcttagcatatgatttatggactggaatggtgagtgatatcagtgggcaaaaacaatcattagaggctgttaaggaacatttattgtttatttggctacctgtctataaaagtacacatgaaggccctaatagcaaaatatcaaattatcaagtgctttaaagcagaaaatgtcatttgtttctcaaaactgcaccaactttatataattgcccttttaattatccctagtggcccgtgaaatttgcaaaatagagcatcaaagctttgatttacttacatgttgcactttggcgggattcttaatgaatattgtttagtactaatgctgagatggaattcgtaaatgtttatagtgagggacttacttagaagagtggggaggccagtaatgaaactgaatcaactgggttcttcaagatggaacaatatggccatattcttgggcctaacattttgaaaaattctttttatagtggaattttatttttaattcaggtctagatgaatacacattaagtttagttttgcagaatctttttttttctgcctagctatcttattactttccaagggcttttgaggagtaatttgtttcctggcaatttcggattaaaatcacctgtttcttcataaattgtcatcttcaaggtaacactgagaactggatctctgaaatctcatgttttcgagatgatttttatagctgcagacctgtgggctgattccagactgagagttgaagttttgtgtgcatcatcatgtgccattaaatgaaaaaaaaaaaaaacaaaaaaaaccccactctgagtagctgtgagtccaggaagggcctgcatgggtagtggtgccactgcagagtgaagtttctatctgtctacgttcatttaccttcccagatttttgtcttccttctgcacagatgaaccacgaggctacatgttgggtaataaaagaagtaatgatacaggctggtgatagggagaccctggaatttgattccaggctggctcagtgggcacaggaagctctctcttaatatctcagtgatagagatattaaatcatcctggtggacaggtggacacctgtggaacatcacttgttagacatccccaggttgacagcacaccagcgataaccgccctttgggtgtggtatgcctgcttgcatcttcccagcccactgatgagaatgtcacaagggacagaatcaggggactaacagaagtctgtaagattacatctctcatttcccctttatctacctgtcttatcacttggtcagaggggctggcatgatgtgtctccaagcaaaccatgttggttgtttttctcaaagtgatggtaaaaagattatttcccctcagtatcgcccctggtgtggaagagaagaagatcggttttaattacttggctcatcagtttttgaagcttcttcattatatcccactacccccccaactttcccagtcttctggggcttttcctgccccttggaatctcggaaatacatttgtcagttctcaagcattttggaatactttatccttgtgatgtgactgtatctgatttttagaattattttccgcctccttcatctagctgatggcaatttagaagctgaaataaattagccgggcgaggtggcgggcgcctatagtcccagctactcgggagtctgaggcaggagaatggcgtgaacccgggaggcggagtttgcagtgagccgagatcgtgccactgcactccagcctgggcgacagagcgagactctgtctcaaaaaaaaaaaaaaaaaagaaaagaaaagaaaaaaaagaagctgaaataattttaaaatcattaaaacacagacttttttttttttttttgagacggagtctcgctttgtcgcccaggctagggtacagtgctgtgatcctcagctcactgcaacctccatctcccaagttcaagcgattcttctgccttagcctcccgaatagctgggattacaggcacccactaccatgactggctaattttcgtgtttatagtagagacagggtttcaccatattggccaggctggcctcgaactcctgacctcaggtgatctgcctgcctcggcctccagaagtgctggaattacaggcatgagccactgcgcctggcccaacacagacatttttaagtaatctgttaaccctgtctaccagaagtgataatatttgcctggttcaacctcttttatcttatataattttacataattacatctgccacccttacctgttgtgtcttttgcaaactgtgtctctattcttgcatttttagctccatgaccttgtccttccttatacaatcgcttttgtttttggtcctcaacatcagcaaagtgatttccacctgtttgccatttctactcgcagatgcagttctatgctcagtcaccttgcagccctcaaggacatgactcttgtctttccatgacctctcttggatgcttcaagaacatctagccatcgagtcctttcttttagatttctttccatctggatctactgtatacttatttaaatttttctaatattgaacctctttgtaagaaaaaaggaccactcaaaagtggagagacacctgggccacttccattgcttcagagctcctaatactaatctttaatgcaaaggcaaaacagatttacaaaatttatggtatattctcaatgtttaactcaaataagttaatgtttacacacacacacacacacacacacacacacacacacactctctctcccataaaatgcagcgtgataataatgtgactcacaggatttattcaaaacattacttctgatgtattgaggtgatgtggcccaataatggatctgcaggttcaagttctttgatgaaggattaaattcactcctgtcactgtgtatctgtgatgggaggttaaatctgatttggagagagcattgaaagtccaaaactgcagccataaaaagaatgaaatcatgtttcttactgcaacatggatggagctggcggccattatcgtaagtgaaataactcagaaacagaaaatcaagtaccacatgttctcacttacaagtgggagctaaacattgggtacacacgaacataaagatggaagtaatagacactggagaccccaaaaagggggaaggtgagggttaaaaaattacttagtggatacagtggtccctatttgggcagtgggttcactagaagcccaaacttcagcattatgcaataaatctatgcaacaaacctgtacatataccctgaatttaaaataaaataacaaaaatataaaaataaaaataagcaaaagttgggggccaggcgcagtggctcatgcctgtaatctcagcactttgggaagctgaggtgggcagatcacttgaggtcaggagttcaagaccagcctgggcaacatatggtgaaaccctgtctctactaaaaatacaaaaattagtcatgcatggtggcgggcacctgtagtcccagctactcaggaggctgaggcaggagaattgcttaaacctggggggcagaggttgcagtgagctgagatcaagccactgtgctccatccagcctgggcaacagagtgagactctgtctcaaaaaaaataaacaaatttaaaaaaataaacaaaagtccaaaattatggccctttgtggatgtgagtcctgggctaggtggctttctcaccttgcctcaaggctgtcacatttccagacacctatgtactctctttctctcttcctggcttgcttgctgtgttaactcttcatccatttttgcagcgctagcaaattcttccttagtggtaaaacttgaacccaccatctgatgggtttcgggaccaggcaccattcccgcactgtgtgcctggttggtcaagacgacaccaagtcattagaccgggatggcctcttgcactttggaggtttgctctcaacttttggcatccttgtttcctgaggtgtgaaatgagctcctgccttttgatacctgaaatgtgaccttcacttttcgcgccccctcctacgtgattccaatgaggtttgtctttgggtgattgtcacttggttctcagtttccttcatactcttatcagttcttttggagtcggtccagcgcgtcatgtgcccatgcctgttgctgtaaattatcactgcaccgtgaacatgtgtacattactagggcaagagctagcctgggaaacctaagtctgcacattttccgccgtgttgcatgttttctgttctctgcctctgtgtgtgtgcaagacagagagataggctatttgtcaagtcagctagttgcctaggtatctttgtctcacatctggctgtttcctcctagagaaccatccagttggctttccaggcctggaggtgagctaatggatgagtgaatattagcagtgggtgttcctcatctctttgaggatttgcctcagagttcactaccaagggatttctggaactaggagccattctttacatcagttcttgaggcttctttgatatcaggggcaaaatgatcccttctcttttctttcttatatcctgtgctttgtctcctgggtgatttctcttcaagtcagttgtgggaggtgcctagaacaacgctaacacggggctcagtaagtttggcagatatagttgattttggccaaggttgttgaacagtccagaaatttcttgagagagaaaagaaggtagaatgtgttgttttctctttctgtatttcctcccccagtcacctatagattcctggaattagagctagcacttcacagaacagagctggacttgctctgaagcttacagctggaacctctgagtgtgtatacgtgcacactctagaatcagatgagccagactgcattccagctcagcacctttctcgctatgtgatcttgtgcaagctgcctgacctctgtaactatctcttttctcaactgtatgatagggggaaatggtacccatttttaaaaagtagctgtgagaattaaatccattattgaatataaaagcagtagagcctagtgtataatgaacactcaataaatgttacagttatttttcatattgatgggagtacccaatacaagactgttatcaatcgcgtaattctttacctccagctgaactacagggtgataatggttgaatggagagttttgtgtttggaaactcagagtagaagacagatgacaaggatgctgggaacctccctgaccctctaatatagtgctcagcaaaccagccagggaggataggataggtgataaagcaattaggaaatctaatcagatccctccaagtggcaatgttttctgaagtctaaggacttaagaattgaactaatttctctaaaacaccattcatggctctccattcctgatatcaagattttatgagtcttgcatttctcatcctcatttgagtgcactctggaattatggattttatatttgctggcggtttaccataaataagccttgggtcttgtgaattcatgtgttttgaaaaacatcgcttttgtttagctttccagtctgggtacaataatctcttctttctagaagtcattccagggcaagtcttcaggatatttggtttctatgataaggtgataaacatggatggcttgatcttggagccaccaaactacattgagctttaaattctccattgggtacaatggttacatgcttcttaccctaaaactctggacttacaagtcatagttgtatgtaagtattaaattcactgaatgagatttttctctagacagatatcctttctgaatctgggtttcctggctgggtgcaatggctcactcctgtacttacaacaatttggaaggcccaggcagaaggattgcttgaagccaagagttcgagaccagcctgggcaggaaagtgagacctcatctctaatttaaaaaaaaaaaaaaaaattagctgggagtcgtggcatgtgcctgtagtctcagctattcaggaggctgagtcaagaggatcatttgagcctgggaagtcgaggctgtagtgagccgtgaatcactccattgcactccagcgtgggtgacagagtgagaccctatttcagaagagaaaaaaaaaaaggaatatggattttctctgagtatggtcaacctgatcattattattattaagtaatttttcagtagagctttgaagtgagtgaatctccacaaaggagtagcttaagtatggctggaacttgagtaggtggagcagccttatgtagaaacataggtagtgaagcataggcaccttcctcaagggtcaggaacagagttcactcctgcacacctcgcacatcacaaaagatctggcttgttgtaggacatgatatacatagttgttgaacactgactgagaaggaaggtcaagcatttaattcaggccccagcctgagtagacagcaaaattcaagataagcaacaacagaacaataaaaacccaattcccccacatccgatttttatattctttcagcagccactggtattcctggctttcgtggtgttgcacaggctcggttttgttgttttacttttagtttttaaacaggtttcaattgctctcagtaggtattccacaggacgggaagtctgattctgtccatggctgtgtcccctttgtgctgcatacacagcaaaaagggccatgttttctttccctgcaccctgtgacctagcccagggtgagtatagaggtgttctgaagggcaggggttggaaaaacactgaccttagttttgctgagctactcctgatttgaaatgaatcactttcagggtctcctgaactcttccaggcactgcgtgagaagccctatctcaggtgctttgggcatgttttacttttgctttcaaagggctagccgttttgccaatggagtcccaaggccacccgaagactcagtcccacagcttcttagtggagcacctttgcaacggctcaagatctaccgggtcagatcatgtaagtgaggacctcccagagagaacacttgaaaggtttatttctaaaactagtcacaatactagggtaaccacccaagtgtcatttttaaaaagcaaaaagtcaagcctcaaattagcagagccccagtggaaatctctcctccaaatccattacacaggagatgagctgggtaaatacggaggactcttccatttagactctgaccctcactcaatgaggggaatgatttgtttcccacgttggttctgtgcccacctttttgcaaaccttttaatttaaaagagacagtgattaatgatgcttttgatctgctgacttttttttttcttttaaagggcagcctctttcttttctacataaatttgatgttggaagtaaaccatgagtataaaaattctattgcttatttatttctggaagtattagaaatctgctcagcccctctcctctgccccaaagaggtcctagctttgatagtcatggtgcaggctgggatcatatcttttttgtattcttagcattgagtgtctggtatgtagtagggacctgacaattttttttttttttttttttttttttttttttttgtgacagagtcttgtcctgttgccaggctggagtgcagtggcgcaatcttggctcactgcaacctccacctcctaggttcaagcaattctcctgcctcagcctcccgagtagctgggattacaggtgcgtgccaccatgcccagctaatttttgtatttttagtggagacagggtttcaccatgttggccaggctggtcttgaactcctgacctcgtgatcccgccgcctcggcctcccaaaatgctaggattacaggcgtgagccaccgcactcggccgggatttgacaaatatttgttcagcaaacaaatggatgatgaattaataaatgatacttaataatcaggacttgtatggaggacagttccaaaagtatatttccaagtaacttgtgtaccctcttattggaaaatgtcgactattccataggctatgaagttggattttgttttgaatctgcagtgattcaaataaggtaattcacaatgaaagatctttctgcctccgtcccctcgagagtaacatcagtgtgtctttcctagctgggagatcaggccaccaagagagacagtcattttgaaatgtgcgaatgttttcacaattgttcgagattatttctcagtaacacagctttagtctacagagcttgctaacctgcctcagtattctgtgttcttttattgtgggtagatagatgttgataaatcaaaagaaaaaaaaatcttgttaatttcagcattacatcagatcttagcaaatgtagatttctattataatattttggtctaactatcggaaataaaagtctgtttttctctgtgttataccagtttgctcaattttatgttttttttttaaatttaaatatatgaaaataatacaagaattggctttagttccagattgcagaactggaaactaaagttaaaaaaaatctaatttttttattaatgtatttgatattatgttgaaaacttagtgataatttactaaaagtggcattatttatatcgatttattaaatagagaatatagcccaaaccttaatgtgctggaagataattacttagaatatccgacagctttgcgagaggcctgtattactttaaaaggtataaatgataggttgtgtaataccctacattcttatcttgaactatattatcgggggctctttctgttttaccttaatgtgcccaggggactcctgcttagcttaataggacacccaaaaggaggaaatgcagagttaatggtttaacaaattctaaactttattagcaatttgcatttaggagaagggcagatggtgtgtggtcgaaagctcatgggactgtgaattggtagactttttttaaaatccagcttttgcccctaacttttggtctcggagacctctgttctttaataactagaactgtaggccgggcgtggcggctcatgcctgtaatcccagcactttggtagggtgaggcgggcggatcacaaggtcaggagttcgagaccagcctggcccagcatagtgaaaccctgtctctagtaaaaatacaaaaattagccaggcatggtgacgtgcgcctgtagtctcagctacttggaaggctggggcaggagaattgcttgaacctgggagacggaggttgcagtgagcccagatcaccccgttgcactccagcctgggcgacagagaaaaacaaaaatccttctcaggaaaaaaaaaaaaaaaattaaaggaaattgctctaaatatgatacagaaataattaaattacttattgcatgccattttaggaacatgtgaatgtttaacagacttcatcgtaaagtgtaaagcactaccatgtgaaatagttggcaaaaatgaatcatcccataaattctttgacaaaacatggccaaaagggtaaaagtatcatgtgcccatttcatctctgcatttctccccccgcgccccgagccttccctacgtattagaaagtgttggccgggcgcggtggctcacgcctgtaatcccagcactttgggaggctgaggcgggcggatcacaaggtcaggagatcgcgaccatcctggctaacacggtgaaaccccgcctgtactaaaaatacaaaaaaattagtgggcgtggtggcaggtgcctgtagtcccagctactccggaggctgaggcaggagaatagcgtgaacccgggaggcggagcttgcagtgagccgagattgcgccgctgcactccagcctgggggagagagcgagactctgtctcaaatagaaaagaaaagaaagtgtccctggttagttccctgctgcccttcctcacctcttccttcatgtccctgcctaactgggtaccacgctgagcctccagcagcacccccaccctctatccaccaaaggggcttacctgtggagcttaatctgggctcacttgtcttaagggactttatacgtaactagcaggtggcatccacatcactaagtatttccccagtgcttgttaatatgctgttctaagtgataggcacctcctcttaatatggatagttaattgatttgtaggcacttttgtttcatcacaaccctatttcagttacagttgttcatccttctttttcttcttatcattactcatcacaaaccatctagttcgtctatgaaaaatcagtcgattggggtcgtctccctttaccagacgcccatagggtttagttttcttccaacacagggatcatagacttaggaagtgagtcatttgggacattggtactcatttttcactatccttggtggacaataagaaaaataataggaatgataggaggtaatatttaccaaacactttgtatgtgccagttcagcaaaccattctgaatcctttacgcatgtcttctcttttcatcttcatgataaccttacaaagatatactgcagctgacactattttctaggtcataaaactaagacacagagaggtgaagtgagctctgcaaggtcacactgtagcttgtctgtgctttaagcttgggctcttctgggttctgttagaagcctttggttgccgtgcccactcatgcccatggggcagcccatcccattctttacttcttttttctttttttttctgagacacagtcttagctctgtcacccaggttggagtgcagtggcacgatctcagctcactgcacctctgcctcccaggttcaagcaattctcctgcctccgcctcctgagtcactgggactacaggcgcatgccaccatgcccagctaattttttgtatttttagtagagaaggggtttcactgtattagccagggtagtctcgatctcctgacctcgtgatccggctgtctgggactcccacagtgctgggattacaggcatgagccactgtacccggcctcagcccatcccattcttagggctactgtcaaaggtttctctgcggtcaacattgactttgttaatattatcagtgatagtcctagacacagaattgcttcagttcaaaaagataggttcccacacttaaagccttaagcaaagctctctcttctccattcccctcctacatccttccaattgccacacactgtttatttgacctctgaagtctctcctgctttctgcccttcctgtccttgccttcctgcctgtagaatgaagacttggctccttagcattgccttcaaagctcttcatcccctggccccagtctctgtgtcttctagaagttcctccagcctagctttccacaaaatatctgggtgtcacctaagggactggccctctgctgggagttcaggattgacacaggaatgctcacagagcttataccagaccccttattctgccctttgtttgccctacccttgaacttctatagctcctgttactgcttccttcagtgttggatgccaatcctctgtcttttttttcctcctctcctacctattaacatcctactcatccttcaaggcttggctcaaatatgacttctatgaagccttttcaattgaacccagcctgtgtgactcactcttttgtctgggctcccacaagtgtgtgtttgtatttcattataacctttgttcaagtctgctctgtattttagtgggttcttttcagattcgaaagccacaaattcttgcctgaaggtaagaacctatttaatttatttttgtgtgcccagagcatactatgtagatattcgtaggcgctccgtggatgttattaagcgcagtaataacaattaccattttgttgagggcctactgtgcatcaggactgcgaggtattttgtgttcactgtcatgtttgctcctgccaagtagcttatgagtgagttctagctgtgattgttacccccattttacagatgagaaaacttaggtccagaaagatgatgtgtcttgtttgggtcacatagctggtaagtggaagtgcagacatttgcacacaggtctgcatgcttctaaaagtccatgttgttttcaccacaatgcctgagaaatacattataatgatttgctgtggcccctggaaatccagattaagagtcctgagtcctttaagaaatactcccgtggctccatttctttttctttctgcatcctggaaatttcctccttttagtcacctcctctttttacccattctgcatttttttttttttttttgagatggagttttactcttgttgcccaggctggaatgcaatggcatgatctcaactcactgcaacctccgcctcctgggttcaagcaattctcccacttcaacctcccaagtagctgggattacaggggcctgccaccaccctcggctattttttattttttttatttttagtagagatggggtttcaccgtgttggccaggctggtctcgaaacttctgaccttaggtgatctgcccatctcggcctcccaaagtgttgggattacaggcgtgagccaccatgcctggtcccattctgcgttttttaaatattgccaaaactgtgttgcaaagaactagtaagaatattcctgacttgcaggttcagccactggtctttctttaagtgactgttagccaaatttttataatttaggagcacccataacaaagaagcactatatcacaatattgtgaattatattcagcaagagttcaataaactcagcttcctcccgtgaatcagcatcaagcatgggccttcccatcatactgcttgagttctttggtcacaactaacagagattccctttggccaacttaaaggtaatccttaaaagaagatattggatgaatagctggtagctcagaatgaacagaagatggctaagataggaagcaggacagtcccagtatataggaagtgccagtatcttccccagctcgtcgcagccactgctaaaatcagtactcctcaaacatgtttctgtcctcacatcagtctactcagatgaatcagacaggcctagtctaagtcccatatctaccccatggcgatgacagggcaggggatcttgactaagagtcccagcctacatgcaacagtgggggaaagtagttccttaaaagaacattgaagtgagaggccgggcgcggtggctcacgcctgtaatcccagcactttgggaggccgaggcaggtgaatcatgaggttaagcggttgagaccatcctggccaacatggtgaatccccatctctactaaaaataaaaaaattagctgggtgtgatagtgggcacctgtagtcccagctactcgggaggctgcggcaggagaatggtgtgaacccgagaggtggagcttgcagtaagccaagatggcaccactgcactccagcctgggcaacagagtgagactccgtctcaaaaaaaagaaaagaaaacagaaaattgaagtgagaatggattctggatgccccgcccccaccaccaaattcaacaaacccctgctgtccctgagctctacaggaatagtggagttgattggagagaggcgcagtttgctctctggagtcccatcttttgtgactttcaacctcctttctgagcaggctattgactctgtctttgacgatgtgaggaaaccttccagctttgcatcacagcaagtttgatgagcctgcctttaccttggatgtcttcatctggtatttacgtcattgggaaagatgtaatgacataccaagacctgtagcttagcttgctgctgaagaccttcgtccaactagtcctaataaaacccaagctctaaaaactcatcatcaaataataaaagagaaatagagtaaatgcacaattcatgagattaatatagaccaggaagacagtctttttttccctaataatctttacttttatatcctactttataggggtgctgtttaatttcatgttcatttactttaattacttcttgcatgtagtttgtggggaagtttgccattttccaacgtctaaaagatggcttacttgagtttcgtttcagacccttttaaaattaatatataataaaacataatatgtgtatttgtcatttttcatctccaaggattactcatcataatcgaatcaatttttccagggagattttatcagacttacaagtcaaattagttgaatgcatttcttttgctaataaacagagaacctttaccctggaagcatctccccactgaattccaataatttagtgtttccttgccttaagagctcaaccagtaaatgacctaggcatcaaaagaaatttattagcctaaaagaagattgttaagatgggagaacttaagagtatgaaagcgaggaaacataataaaatcaaaatgtaaatattgaatacatatatgttaggtatttttttaaaacttcattttagagggttaggcttaactctcccccaccccaagcaaaacatttcggggtacagatttttctgtctctatagttgcatttacttctatgttgcacatggggacagtgtaaggctaacgggctattatattctgacctaaacaattcctgtgtttctaatttagaagataattgcagtcaaggtaggacaagaccattttggatggtggctagtctgattgctgcctctgtcttgagttgccttatgatctataggtccgaggttaattgtgggaagattttggccatgaaactacagcaagcctttacaggaatggaaaaagggtgtagtttctttcaagtgcatttattagggtaggtgtgatcaccgactcactgcttggcgttaagtgggcccattggttattgctgtgaggtggttctaaatcctccttttaaaaagctccgttcaagttgctgtgaccttctcatgctgcttgctcccaagtatttcaaatgttgcaatgctgggcattttgtcaagctcataactgaaatgctttctccatataagatatggagtttgaccctatagtagagatatgaatgtggatttgcttttaccctgtagataagatcagctacagtgaaagacacaggtaaatagaatgcttaggcagaaactgttggaatccagtgtacatgtgaaaagagtgaaatttttcagggctaacagtaaagccctcttcagtgtgtaactggaattcaccttctctagtatttttgcacaagattgagaataaaaatggttgtgattgatgaagcattcagtgtatatctaactgtaagtcggactagagggacttttaaatcacccaaatgaaagattgtattatcatgaacattaatatgtaacagttaagtgtgtcatagcttatcataagtcctggcattcgcagagctctttgaggccagccaaccaataaggaaaaactttttagcaaatgccggtccacaatacctccatgagtgaggtcagcccagtagtcatgactcttaataggttatttatttttgtgtgcccaacctacctacctgtacattctagtcacactttgcgggggccttgaagatgtactctgaattttctcctcccaatattcttacagggaagacaaaagcaggttgaaaccaaggggaaaattttacttctggtgagactaggaagttaggggggaggaaaatacccagagtaacttattaaggcatggaggttggattagttaaatgtttagaaattttaaaatttcttatagatttgttaccatttatgtggttgacagattattaactgttcacccctagaaaaccaattcaggaaggtagaaacttctgttttttatcttttgcaaagtaatgtcttttcctccaaatttgtaaggtgtacatgttcatagcagaaaatttgaactataaggcaaaatatttttaaaatcgtaactacctctgttcttaatacccagagaaacttagtaactggaagggctatccttacatgtataacatttttttaaatgttagtgctacatatatttaattaattacatttttaacgggtacatacttttttcatttggcgtatttattatgtggtcatatgtccattgaagctttctttgtctttgtatctaccataacaccaagtccagtaccattttagtgggatgagcttattaatattttttaaaattacaataggtacatcttatcagagttaaatcttcgagttatttgtggaagggagagagaagagaaaaggagtaaatatttactgagaacctagcacatgctgagtactgggttacatacttcatagtaatattgcactttattatcattaaatactgatgatgatgatgatggtagctaagtatcattgtgtacttgctgtgtaaaagatcagaacttggacatgtatcatttcatttaattctcaccacaactcactaaagttaaacacgtctattatttccatattaaagatggaaaacctgaggttcagagaggttaagctaattactcaagatcacacagccaaaaattatgaagccaagttgccggatggttctttatctaccctaagatacatgcccagctgtccacaccagtgcatttgctgcatctatccaacacaccaacctgccttttaatgtttctaagtgacttctgtttaacatgggcccccttttagcaacttcccttgaaggatttttttgaccttttaatttttcttttggtgttaaaattgggggatggaggcactatatgcatcaggccatgccccacttggcccagtacctggaaacagatagccatgaagcgacacccttgcctgctcatggtgtcagctgcattgtggatgctgctgtcacctctgtctcaggcagcatctggggccattgcaggactagcctatgaatccttcctttggtttctgttgcaaactgaggcacagctgtaatgactgtgtgtaacctatgccctgagcccaggtgtctgctgttacatgttagagtaagaaaggtttatcactcggttggcattgaccatgttttgcagttgaggccacatgtgtaaccatttccctactgtgggaccaggttttctgtaacagctgttggcctaggacattttgtttcacttccatccacttctgtttctttatctcaaacactgggaaaatcatagtacctgtcaagtaagggtgtcagaagactgggtgacgtaagtaaaccacttcagtaaaagccttgcatgaagttggcactcagggggcctgaggcattgttgttgttcttcagggatactctaaggactaagaattgttttcttagtgacaagttctcagagaaccaatttagatactgggagattggtaattacactttttattagctccactctctcaaggaagtgacttttctttcgtctttcttggaatttgggatatatcaattagcatgtgttcatggaacacctcactactccacagtggctaaaaacatgaggaaattcattatttacttgcccagaagtttgaagataggcagtgccaggattggtttggcatcttaataatgtctgagtgtggggttagggaagctctttgattccttcaacttttccctctgggccacaagatggctgctgaagcaccaggcatcactttcctacatggttgcatttaaaggcacaaagtaaggaaaaggacagagcggtgagagagagagaaagagatctcttagtgtcctcttatcaagaagaaaaaaagtcattttccccttatatcttttcagtcatcttccccttatatcttttggccagaactaaattagatcaccatccctaactgcagagaaagctgggaagggggagcatctcattttttcagcttggggagtaggaggtgggagaaaagggagggagaagagaaagaacgagttgggattggctgttgggttgccatccggtagtgtgtgccatatggataacacttcatacttgaccagtggaggttaacctaaagtctacgttgagcctacaaaggagatacatatacaattattcagaatgacagtgtacttttggattctcatatcattgctaaagctaaaatttcttggtatcaagacagtgtgggtaactccaacgcactttgttgactttgttcatcatcaggctttatcccatcttaagctctctatatatcactcaggaaatattttgtagatggctcagcttcctgctcagcgccatagttctggatgtttcccaccccacacatggtgttgtgtatgaccaccacccccgcttccaaatggtctttggttctgtatttgcccattgcgaaagaaacatcctgacagctatgatgtatttataacgttgtatggctggttttacagtcactttgttacatcaatactaatctttctcgctaagctgaaaaatccatcacaccttgagttacagtggaaagcttcacctgaattgtgtgcattttgggtttttcaggggagggacaggatggaggcacgtgactgcttaagagacttttcacagtgttactctcgtttccaaatggtatgagttatttgagttgctggagcagagcactttctgcaggatagctgatgtctctgaagacacagtttacattcaatgtgtcccaaagagagtagcaagtacatttttctaacagtgaaaaaagaaatcattttgcaactagcttcttaaagagtgcacttggttctaatctacaggcataaagctttcaagttactcaattatataaatctacaattctaatcaaaaccgtgtttataaaaaataatttttacttaaatttgatgaaaagattcaaagtaagattggaatttttaaaaaagtcattaccaaaaacatttttttttctttctttcttttttttgagacacagtctcactctgtcacccaagctggagtgcagtggcgcagtttcggctcactgcaacctccgcctcctgggttcaagcgattctcctgcctcagcctcctgagtagctgggattacaggcgtgcgccaccatgcctagctaattttttgtattttagtaaagatggggtttcatcattctggccaggctggtctcgaactcctgacctcaggtgatctgcccacctcagcctcccaaaagtgctaggattacaggcgtgagccactgcgcccaacgcaaaaaacactttcaattttagagtttattaatttccgttgagaagaaaatacaatttttaatgaatatgaagaattttgtactggaaaccaagtatccatctgcttaagatccgattgtcatgaatatggaaattctatgaccccctctaaaactgcacagtccaagatatggcagccactaggcatgtgtggctatttaaattaattaaacttacataaaattaaaaattcagttcctcagtgacactagccatatttcaagtgctcaggagcctcatgtggctattggctaccctattggatgttgtaggcatagaacatttccgttgtcacagaaagttctgttgggcagtgatgctctagatgagtggttctcaaccaggaatgactttccccagcaggggacatttggcaacgtctggagacgtttttggaggtcacgaatgcggtgggggcatgtgctactagcatctaggaatgctgttcaacattctgcaatgcatagggtagcttacacaatgaataattaattttctggctcaaaatgttcctagtactgaggttaaaaaatcctgctgtctggtggggtggacttctgtggcccccagctcctcagttcaagttttaaagcaattctctttatacagatgtcagacaacatgtgttctggatataatattggtgctaagtagggttaaacctgtgattacgttcagaaaagacttgttctgagtcccatggcccccagttagaggcaagggaggatccactgggctgcatggggagtctggttgacactgatgctgctgaggctgaagaaatagggcagccatggtgttgtttccctttattcttctgtcttctcccctcctcactttccctctcccttccaactgagtggagccagccatctaagtcatgatgtcttggggtatagtggattggcttgtactccaggccagcttcattattcagggcatttgtgtgagcaacaggggctggtactgacattcctgcttagcagcagttggatgccaatatggtgtccaaggatcaggtgtctcagccagagggctgggttcagatccggactccactgcttagctgttgtgtggccaagagcagattatttaacctctctgagcctcagtctcctcattttcaaaatggaaataataacagcctgcattttgcaaggcaattgtaaagattaggtgaggaaatgcatgtaaagtgactagtataactgccggcatatttaagaataaatggtagcttctattgttgtttttgttattgtttatgttactatggttactagtcccaagaaaggctgactgaattgatctggggttcattcccacccaggaagaggaagtcaaggccctgtttgctgggttggctgggctggagccagggctaaatgccaggcaggcgccaggaccctgcccactccatcccagcttaaatattcttactatattgtttctagcttgcctatggcctctggcatccacatgactctaaactccattcagttattttctttcctccaatgctaaattaggatgttcactttggttcctcctgggtttccagcatctgcagaaattctacacaaaaggattcagaaagtgctggggctgggaagtttgtgttggccttgtttcaatgaccaatgcagctctttctccttcctacccttcccactggcttttttgtgatcagtgaccacaagactaaggactccacaccaggcctgaggcctattgtgtgaaccagctggccattcccctaatctcataggttggtccatccctgactgaaccataactatgaggagcctggagaggaacttcttaagtttgtattcgacttcatgctgaattttttttttttttttttgagatgacgtcttgctctgttgcccaagctggggtgcagtggtgcaatctcggctcactgcaagctccgcctgccaggttcaagcgattctcctgcctcagccacccgagtagctgggattacatgtgcgcgccactatgcctggctaatttttgtatttttagtagagacagggtttcaccatgttggtcaggctggtcttgaactcctgagctcgtgatccacctgcctcggcctcccaaagtgctgggattacaggcgtgagccaccgtgcctggccatgctggatttttttagacctccagtttagtttgctttgagatcatcttgagttctttctgactgtgggtcctgacttctttttccaactccattattagcaggaagagagcatggctgatgaactggttaattacataggaaacacgagatcctacagattttgaatattagttatgagagttaattgatttgtgtgtgcttagttggtttgctttcccataaaggctaacatatattgtagagtaggagagctacatatagaacactatctattttgggctcctgtgtggcaccttatggttgcaaatgacccaaagccaactccagctggctaagcaaataagggaatttaattggcttgtgtaattgacaagtccaagaggaggcctgttctctgtgagcattgttaggaatctgtcttgctattgtgctcaccttcttgccgctgtgtcctggcctctgttcagccagctctctttttgtggaggcaagcccgattcatgcatttaaaagtttagcaagccagcagaaggacagcctttctgtctcccaatagttcctatggaatgctagtagttgagtatcattcttgggacatgtccatccatcagccaatcagtgttgctggcagagcagaactcactgattggtcagacttgggttatggctccaccctctggagctgagagatgcatcagcctcctgtgaaccattaggactgagagtggagaatgggcgtttccccaaaagaaaaatcaggctagtgtcatcagagaaaggggagcatggatgttgggcagacaaaaacaacagatatccactaccatatttcccttttcattgtgctagtgacttggagaaaatctcctgcctggtgtgtcttgatttcgccaccaaagtcgctcgcaggccctcggcctgattttatttacagcagcagcacacctctctcttcttccctgcagtcatgataccccggtctttcccccagaggttggaataaatggccttctctgagccacaatcaatggcattccgtaaggtgtgacagaggaggccatctggcacttgtcccattgtcgtttctccctgcccagggaagaggcacattccaggcagaaggtcgcagctcagccaagtgctgctgtctctcagaagcatcaccctcagactggggtctgcagcacagaaacgccaccagagtcaaacacctggcaggatttccccctttccctttgtgaaattttccaacagaaccaggttgtggaataatacataatgaaaatgattcttgaataaaattataagtttgaatgttctgcacaatactttccccaatattggatggatttttttttaagatgctagcactgagatcactggcccatttcaatttttattgaaacaaataaacccaataaaaacacttatgctgagagctgtagcgccacagtgaaagaatcaccctgtattgaatgtattgatttatttatttactgcaactggaaaatcgagtattgtgttaatgtattttataagaatcacattgctcgatgaaatggctaatttatttgagcgtatacataaatagctagcaattttctctgagacaggctaatgaaaatgatgccatgaaattgtctatacgatgaagagtgacggagacgagttattattgggtgagtgctaagacgcgctgaactggccatcatatctttgaacttttgaactgctacttgtttcgtgtgatttattgattttgctatctctctgtttagctcaactttagtttttgcccagcagtgcagataagtggcataggagatttaatttcatgggtatttggggttaaaacctatctttaaaaagaatgctaaacatgttttaataaaacatgagttgcaggggttttaggtttctgtacgatatggatctgataagaaccaaggcagtttagagggcagcccagaggttccaggctagggaggaactctttctgagctttggaagtttcaccagggccacatgcattttatttgctagatcagcctggcttcattcttaattacatgtatcatttatccccctgcctgtgcccttttgctcatggcacatgttttgcctcgatgcctggtacacagaaggtttctcgggttctcgcaggcagcatcactgtccctgtcctcccgtccttgcacaccgagggctggccgctaccgaagcaccctcattttggctgatctcatggggaaactgctttcaagagcagccacggctctcacctagggaataaagatatggaagccttctcagcgtcggggccagagctggctcgctgctgctcagctgcctccagattagttctctgtggtccccatcagcattgttaccctccttatcagcctagccctgacctttgagtgggatgtttcactcactgctttgtggtggggggggggtggttttcgtactaagtgatcatggcaagaaagcagccttactttttattgttgtctttggacctgcagaacttttcttaaaaatgtaacattttgggaactcattcttcataatattttttattttattagctaatttctaaaggatgatttgacaacagtattttatgctttttgtttatttgtgggtggggggggtggtgattggaggaggtgggaaagagctttatcatgtaaaagtaaccatcctagaaatttcaggtaataaattttcaggtgcatgaatggttaagactcttcactcagtgacacagtatgtgaatgaggaatttttatgaaggtaacggtcttgttctttaaaaatctgatttatttagcaggtacttctaaatgaccaagtaattttaaccttcagagaaagatggggagggggtgggtgggtagagaaggcttgtatctctgcaagggattgaaaattcacatcccttttaatgattaaactggcacggtctttatttggatgttaaaagccttttcttacattgcaaacattcttagcaaatttacagtcagatatttggaaacagctaacacttgaaaaaaaaaaggaggaggagggcctgtttgaactaggaaacaaaattagtaggaatggctgaaaagacaggactgaccccaacaccattagctggagaaaaaaaaattccatttcattgcaactatgttattgtttactttaccatacacatcctaatatggttacctccccgtcagaggaggccaagccaggggttgagaggccccctccgggagaaagctcctaactgcttctcagacaataagaaacaaacggtacaactccacaaaaggcttcccggaaaataagtgtcaaataaatcctacggaactctcgcttctgccactgagctctgtatatgcaaacctgtttttatgccatcgcttccccaggctgagctgcgtttgtttggaaatgtaagccactgccttttctttttttcttttttccttttttttttttcccccctcacttcatctgagggctctggattaattccttgagacatatctttgcatacatatctcatgagttatgtttcctggagccttttactaggaacattaaggtaagaatgttgatttagcctgggacctttgtcactcaaactaatgctcatcagtgatatagacattgtaaagaaatattgcggaggtcttttgtggtccccctcccaaacagagaggtgcagtgcttttaattgtcatgcatggattcagaaaaaaaaaatgccaccagttgtggatgagatgtagcagaggtgtgtactcactggtgtggtgtaaacactgctgaaaacacccccgatctgtggcagccacaacagtttcattagaagccttttcctgctgtttcttccaattcttctctacttgggcgtatttctttttctttttcttcttctatttttttttttttccctttttcaactctcctgatcttttccaaatcctcatggtcttgaggcttgcctgttattatctgcaactccagaacaaaggtaggttgctcaactctgtgcttcggggggagggccaagttattttgggagggatgtcttcctaatgcatgagtggctgacctaaaagaggggggagagatcatgcttggagccgagggatgagagcgcacgcactgtggcagcttttatgtagtggagtttatttttatgcaacttaaagtagcggcagcatctttagtagaatggactcgttaggtttggataatccacactggtgtaacactgatgtgtacattttattaccaaactggggtttcagacatttggggatgcttgaatttatggcagcagctaagattccctgatgagggactgtattgagtttatcaaaattaaataacagatttaggacttttttcttttcttttaaattttaatgtgaaggtgtgtttgggtgactggctatgtactttttcttttcccctttggtctaattgctttaattccttggacaccttcacttatttctcaattattttcttctctaattttgtgtaatctggtgctctgttggagccaaggtggaggtttactgtttttaactaattgtgccttgctgggtggcaatacaatagaaagagtaaagaccacaagaaattcatctccacctgaaaaggggactggactagagtggtgcagcttcataattgaaaacaagtgcaaattaagccttggtgagggatattacaggctattaatcataataaatatgtttggcaacgatgtattttctttctacagttttcagttaaaaaaaatcaaagttggtgattagaagagggaatagttctttggcttatagatgctgggacgtacttgttcattagttcaaaccacgttaaaagtgagcagtttgttccagaatcaagtatgtcattcccaagcagatttgaatacatccctgtccaaatgcaatctcgggttcatgccacagtgcttggctttttctgaacatctcagcttcagcacgggactcgagtgctaagaattttattttacgttatgactgtgctcgcacattcctgttggtttcttggctgcggatcatctctgtgcatgcactgtagccctgtcaaggtgaagctctttgaaaaatagaaattcagtgtatttaaccaaaatgagcttgagcagcccctaagtttctatcttagaaagctgctaattatgcttgtcgaaaaacacatctgagtggaaggttctgagtccaaacaggatcgagtactgctttagaaatataactgtagtctgtgcttttagagaggtttatttttactttggggccatggagggggtgattggaattagtagcctttaattagacggggagatattcaaattttacagggatttatgttagaacatggaatggcgggtggctctttcctcattatgaatcctccctgcacataatgaggttcatcattagttgatggagtgaatttgccctagctctaccttgaaaggcacataatttacatactacttcagagcctaagctttaatggattcttcgatgaataaaatgaaaagctactttctttaaatttttgaacactgtttagataatacgattttaataagacattcaatttgcttgttaagtatatttgaaagtgctttttttttttttttcctttttgggcaaaatatattttggcttgccatgctgtgtatcacagcgatgtaccctcacagttgtctcagaggacatatggggtacgttgttaagaaatgggacaatcttaggcggaaagctttttcacatgtgagcctccagattattgacaaatctttttgtatagaaactcttctgacattaaatggttataacaaaaaggtttggaaacaagcttattattagtgtctggtttcacatatacgaaatttgtgtgcatgctgattccagccaaaattgacaatagctagctgtacctcctgatgtattttaatgatggaagagcaaacttccctagtgcagctgtgtgtttcaaactgctgtgtagctatgattcgatgaggagaaattgagttggaggctgtctaatatgttatcagggcatcagcttaggagcgttctggtctatgccataggtgcagcaagttttctgtcactcttccctctttgggctggaatgaggaaaaaaatcagctttgactcagcacgatttgaacacgaatgtcttttaaatgaatatggggggttagtaatagcatgttaccgaacatgtcctttgcttgttcgagacaggtcacccctgcattgttatcattgctgcaagtagaagcaggtttctggtggtttgtcactttcaagagcagggaaggtgtctaaatataagcgaagccttgttttgatagaatgttttattacctgaaaatgatcagcatatattaacattaatagaatagtccatgtcattctttttttaggcaatttacctctgctacagacctgtctgcttaaaaaaaaatcttcctctcttctaaaacatatatttgtttagagagttttcactgaagtgtacatgacaattacagctgttcattaacaaaattgggtatttgttttaaactttaaccaatcactttgatatgctaattatggtgtaatttaatttgagccctgtaatgatgatgccgttattatggacataaatgatgcagttaagctgagagtaatctcatttgcatactgtacatgccagtaaattaagccctttcttcgactgcttcagctttaattttccacttcttttcacacagctccttttcagcccctctcttataagcccactttgtaatagtcctgatgactgtttgatgtgaagagtttcggcaccacaataatgcacgacagaagatgtaacatttaaaggattcattatcttgctgagtgttcctttaagaaagaaggattagagggtggaggggagaccggagtgtcctttccatgggatatgacagggccccctgttaaagtaatttgagacgccaaatgctctccactcgcccctaagtcagacttgggacctattatttaaaatgatggcttttcccccaccgttctgtagtttatggtcacaaattgtgttgcttttcagcagtagtgaatttcctgtgctcccttatggtaattggaggtaaaagttttttttttgtttttttgttttgttttgttttgtttttttgagatggaatctcacactgtcgcctgggctagagtgcaatggtgggatctcgactcactgcaacgtccgcctcccgggttcaagctagtctcctgcctcagcctcccgagtagctgggattacgagcacccgccaccatgcccggctaattttttgtatttttagtagagatggggtttcactatgttggccaggctggtctcgaactcctgacctcgtgatccgcccgcctaagcctcccaaagtgctgggattacaggcgtgagaaaccgcggcccagcgaaggtaaaagtttaatttagcttgactgttaagattcttcaaatctgggccttcatagatgagattataattttaaacaattctggccaggcgctgtggctcacgcctgtaatcccagtactttgggaggccagggcgggcagatcatgaggtcaggagatcgagaccatcctggctaacatggtgaaacctgtctctactaaaaatacaaaaacaaattagccgggcatggtggcacgcgcctgtaatcccagctactcgggacctgaggcaggagaatggcgtgaaccccggaggcggaggttgcagtaagccgagatcgcgccactacactccagcctgggtgacagagcgagactccgtctaaaaaaaaaaataaaaaaacacaattctgagatatgactgaatgacattttcaaaaggaacttcttttttccccccattctgcctggattatccaaaaaccacccatttcatccacttctgtaagaatggaaacgctttgcacatagatgctcttccatttgtaggcccatcgctgctaccctgcttgagccaggagaccagccatgtgccttttcatggcctttggccagtacactgcccttccattcaaaccaaagaatgcaaagagcatcactaaactcttctacatcgtgaacggattctccccatggctctcgccgaagccagtgggagttgagtgggtgtaactgaggattgaatttagcactgtgtttttaaaagggtcataggcctaaaaatagttcaagctgtttgactctgctgcaggctacttccttagcaaatggaaaaaagtattaaaataaaatagaaatcggctgcctccattctcatttcttgggactgtgaaagtcttgtacttcctttcgaagccccccagttctccatcccctgacccaaagttcttcctagttgattgtcaaccctgcccccagcagttctctgataggaggctgccttttctaatattttgacaggcagaaatttcctggtattgccatggcaaattgtacatagggctcactcagcctggtagcagtggcaactggaatatggaatttcgtccaactttggaaatctcaggggaggtgaatgtctcccagttgtgtttgagttaagcaaaggctgtcacacttgacacaatgtcagactgttttaaagcaaagtgtaacacttaaaaagcgttattttttttcctgcttttacatgctttcaaaaataccatgggcttcaaagtgtgtgtaaaaaaccttgtagaaatacttgtactatggctataattccatatccaatattatacttttttgaaatgtggagctttttggttttctttttgtttgtttgtttgtttttgtttttgagaaggagtcttgctctgttgcccaggctggaatgcagtggcgtgatctcggctcactgcaacctctgcctcccaggtttaagcaattctcctgccttagcctcctgagtagctgggattacgggcacgtgccaccacacctggcaaattttttgtatttttagtagagacggggtttcaccatcttagtcaggctggttctcgatctcctgacctcgtgatctgcctacctcggcctcccaaagtgctgggattacaggcatgagccaccgtgcctgggcagctttttggttttcaatataattgagggagacagggaagaggagaaatgattttatataatagtgtggaaatttttaatttttatcccagcatgtagactggattttctcagtacagaccaagctcaaatgcaatcacatattcccactgtgaaatttcctacttttaggaaggtgggaaaacagagagcataagctctctgaaggcaaggaatgtttatctgaattctcagcacttacactaatgccttgcacataagtaggtattgaagaaatatttcctgattgaaatggacttgcttattcctgaagacttttgaggaaataagaaagaaatcaaatgagaaaatacagaagaaaatgctctctaaagtgtaaagctattaaatatacatgatgatgttgagattgtaaacctcttcaacctcctcttcccgggtccctcccttgtgtgggggagccacttgtaagtgcttgcaggtggacaggagcaatcctagatgggaagccacctcagccccgattatttatgaatgcctgtaacgataatagtcactcttggttactgagctacagctgtggtctagaactgttgtgaacgcttgtcatacttaatgtcatagaatcttaccaatagcttttcaggataggtgctgttattctaatcttttccatgtggcaactgtgatgcagacattgtcccaggtcagacagctgttaggtctggaaccaagacaagtattccttcaggaaaaccccagagtcctcactcctggctgttgcacttgaatcttccctttccttgtagacacacacacacacccccccacacccctttagaggcatgcttatactttgtacattcatttattgaacggcagtagtgttccaggtagcagcctaggcactttacatactctgttttcacagaggcctggcaaggtaactgtaatttgtccctacttactaatgaggaagcagacattcactcggattgaataacttgcttatgcaggtagaaagtgaccaagctgagctttgaagccctgcttgtctgcctgcaaagcccttgttcactgaatcaccactgcatggtccccgctaatctatatgtagcctgagagtgttttgttctcttaaattagttaacttactgtttaattgatttattaatttcatatattttgagtgcctatgggatgtaaagcctttcgtagttaccttatattttggagagtcggactaaatgtgcgccttaagtaactgagaatctcctaatttctcagtcttttagtataacgtcaattcctggcagggagccaccttctcttccttctccccttccccctccagacacataaatgagactgttgttaaattatcctttttcctgggggaggagaatgctgtgctgtctccttccctttgattgaagccttccttactgttatcttgacaggtgacagaatgaatatcagctgtggaacttatagatatgtgggtccatatgtgtttacacatatccccatgtacacgtatggattcattgcttgcactttcatttatacacactgcaggccacatgtagagaaagcagtaggaacatttcaaggaaactctgtgcttcctgatactcctttcctagcaccgttccttggctccatagctctgcaatcccaattcaagcatgggaagtgatgacagtatgtaaagtgtcagtttcccttaccacacagaaactcttccaggccaggatcttgaaatgcttctagtcctgcactgtctgctatggtagctaccagccagatgtggctcttgagccctggaagcgtggctagctagccccaatcaagataggccatatgtataaaatatatgctggcatccaaagacttagtagaaaaaaagaagaaagaaggttaactatctcattcatcttttatattagttgcatgttgaaattaaaacattttggatatattaagtaaaatccaatttttttttttttttttttttttttttttttttcagatggagtcttgctctgtcgcccaggctggagtgcagtggcataatctcagttcattgcaacctctgcctcccaggatcaagtgattctcctgtctcagcctcccaagtggctgggattacaggcgtgcaccaccacgcctggctaatttttgtaattttagtagaggcggggtttcaccatgttggtcaggctggtctcaaactcctgacctcgtgatttgcccgcctcggcctttcaaagtgctgggattacagacatgagccaccgcacctggcccaattgtatttttaaaaccagtttcactacttcttttttattttatttttttctttttctttttcttttttttttccttaagacaggatctcgctgtgtcactcaggctggagtgcagtggcaggattatggctcattgcagcctcagccacctgggctcaaactgtcctcccacctcagcctcctgagtagctgggactgtggaaaccaccatcacacccagctaatgatttttattgtctcttgtggagataaggtctcccgatgttgcccaggctggtctccaacttctgggctcaagccgtcctcctgccttgtcctcccaaagtgttgggattacaggtgtgagccactacacccagccatttttgcttgtttatacgtggctgctagaaattttaaaattacacatgtggcttgcctctgtggctctcattatatgcctgtgggacaatgaagctctagaatctacatgatatctctgtagacaggatgactggtagatcgtgggtgctggagggtggtagctcaaagatttatccaaaaagtcaatcgagaactgcaatgaaagcatgttacagagaacttggcccatagcagaggctcaggaaatacttggggatgaagccacacacagcaaatatttctacatgggaaacactaaagaggtaatcccttccattgtttcaacatcctgcccttcctaatcaaattgagaatatagcacctaccccactattttagagaacttggatttgcaaaatgtttctattctatacccagcttgtgacctggatgccagtaaatattggctcatctgctatgatgattccatgagcataggtcagcagagaggagagaatgggattccttgaatgttcctaggtgattctcttatcctgggctttgattatttgcaagaattgttacatgcggtcctggagccacaggctcttactggggcatttgtcttaggtaaatagatgcatttgtctccttgatactctcctaatatatgttctttacctagtacagaatttaccttacagtattgtgtaagtatagtttcttaaagagagaaatattagccgggtgcggtggcccacacctgtaatcccagcactttgggagaccgaggcgggtggatcatgaggtcaggagatagagaccatcctggctaacacggtgaaaccccatctctactaaaaatgcaaaaaattagccgggcatggtggcacgcacctttagtcccaactacttaggaggctgaggtaggagaatcgcttgaacctgggaggcggaggttgcagtgagctgagattgcaccactgcactccagcctgggcaacagagtgagactccatttcaagagaaaaaaaaaagagaaacattctatgaatgtacatcacttaacaaatactgattttatccctgccttattaggcatggtgggctccctgacttcaggaagcttgttgactacataaaggcaggtaagaaatgtcatagcttcaaccgaagatgtcaagattcaatggttgccaaatcaaagcaatgttgtttggcttataaaaagagtctttaatttttttctagaggtttcgtaatcggtgttcattaaagatccacatctttcctacattctatttattgtatagatgatctagggaaagcataattttaattgtaaattttcagtaaccccaacccctacagaaaagtgagttatacaccaaaaagtttttccctaaacatccatgccagtccttaaaatccaaggggacttagatctacagtcgctttgctaagattttttttttccccatcagaataaatggaagccttcactggaatgagcacatggaaattatagctgtcacattgtccattaaaagcagacattcaagtgggatattatctcactttactttttggtccttcagaagtcaagggacagggtattagatgtgagatgaccataggaagactgggtcctggcaaagatcagtacccagcatgaaatgcgcccacttacttgttaagtgcttaaaattttcacccctcctcctgccctgttctgccctgaagctgcagattcattagtatcaattggttttcagggtgtttctatctctgggccactggctcctggatatgattactgcctgatattttccatacagtgcttccattttcaatcatcttatccacagttggcctaatgtcactctttgaacattcacagaggaataatgtaaatgttagcttttgtcctgtgcataactggagaggaaaatgccttagactcatctgcactaaacatttctttgcagacacctcagagaggacagcctccatctctgcccacagcacacccattttctgaacaaaatcaaagagttgttcttggggatgtccttggggtgacgaaactttctgtaggcggtgcaacttgtgcctccaaggatttgaagagcatcctcgcctccccccactcacccatattttattgtcagttcttttgcaagggtgaaggcagaggacatgttttggaaggacagtctttggtactcttggcttgtccattttgtcggatgatctccagtggtggaggatgagtgtgctgattggattaattccgagttggaatataatgaatggttagtgtccttttactccgttgtgttttgaggtgtttgtccctgacagccatttggcaaataatctggttatccaaaaagatttttggttttttgatttaatgctttaaacttttcttattttttttttttacttataatattaaacatgtaaaagcgattttaatgacttttcattgaagatatacccttctgcctccatctccccaaatgggcatgcgagaaacatcactactgaacagtctggaagtaagtttgcaccaccaaaggtcagtgtgggttgtataaaaaccaggactggaagcagccctcccaccccagataataacggcaattccagagaacattgagaacacaaaccctcgaagaaagagcaaaatttctctgtcatgtaatgatgtttgatttgggctaaaaggaatgtccattttaccaaggtcttaagttctctttttgattccacttttatgcattttaaaaagttttcttagctgccttccttgttttccaaaaatatacaagtcctgatcctcttttgtccttcttggggtccccaggaatcagagaatacaatgtataaaactatagcaccagctgggggggtgcgaggccgaggcaggcagatcatctgaggtcagcctggccaatatggtgaaaccctgtctctactaaaaataccaaaaaaaaaaaaaaaaaaagagtcaaacatggtcgtgggcatttgtaatcccagctactcaggaggctgaggtgagagaatctcttgaaccccggaggcagcggttgcagtgagctgagatcgcgccattgcactctagcctgggtgacaagagtgaaactccatctcaaaaaaacaaaaacaaaaacaaaaaaaaactatagcagctgctttaaccttcctttcaatcatggtaagctgtggatttacagaagctcagctcctgctccctcagttttttatgagttggaccatagacctttcttgatacaaagtggaaaccatttcccttccctcccctcctctcccctccccttccctcctctccccttccctcccctcccatgccttccctccccttctctccctttcttacctttctatttctttcgctttctctctttccctcttttcttttctttcttggggagatagggtctcactctgttgcctaggctggagtgcagttgtgcaatcatagctcactgcagccccaacctcctgggttcaaacgatcctcctgcctcagcctccagagtagctgggactagaggcacatcacacctagcttatgtttttattattattagtagtagtagtagtagtagtcgtggtggtggtggtggtggtagtagtattgtagagaaccactgcacctggtccccatttttcttgcttttttttttttttttttttttgagacagagttttgctctgtggcacgatctcagctcgttataacttccattgccagggctcaagagatcttccctcttcatcccaagtagctgggactacaagtgtgcatcactgcaattggctaaattttttgtatttttggtagacacagggttttaccgtgttgcccagactggtctcgaactcctgaactcaagggatcctcccacctccacctcccaaagtgttgggattacaggcatgagccaccacacccagccctgaccctatcttctttttgttttttttgtcggagtttctattctctgtttcattttttgagatctatggatgtgaataagcttcctgccgtaaagaagacatcattatttatttctgtagcttttgtgtactaccatggagatgacatggagcatcagttgaggggtcctgtagagtgacagctagcagatgggtagaataactattattagtgctgcttctcctctctgtcagttctcatagcagacattgctaattgatcacagtactttttctcagcaagcctgactgtggcctatgaatcttcctctcaaggagtgccagccactgataatcgatagcacttgactgaaatgtatttcccctcccttctctaattgttgtgatttactacatgtgaaattggctgatgagatattattaataaatagtggcacatcttttattttgatactatcagattctttttatattatctcagtttgctaagccacctagccccttccaaatgagctttttaaacacatgctctttcttcagatgtgacctgacaagagagacagacaacccccagaaatccctttcaggtgacgatgctgaaataggccaagtaccagttcttctttgagctgtataactctttcttaggtacataattctttgcacatgcaattgaaggatcacccaggaaatggatgtggccttcctacaggagataacgttgaagtatgaactctttgccctttggcaaattgcctgttcccctcgttctaaatttctaggaatctaggtcctgacaccctacattctttgatatctccatagaccataatctagttgaatctaccagaattatttatgcaccataatgaaaaagaaaaatagggaggctttttctattcactcatctttcatcgttattttaacttatatttccctggaatttttctgtcttaactttatagtttaaaaatgttgcctgataaacagtgcttgtagtccatttatgttttttgcctaatgcatggaaatttgaagtgtccagaattcatagtttctccaaaataaccactgagtcaacaagttggtgttgtgtatttttcccctctttggacatttataataaattatagtaattctctcttgaaagattagaaaatctctcctatttttttttcctataaggtagctataggtggattggttctgtcttatttgtagcatcagaattcatgttttttgattcattgtatttataaggtaaaaaggagaatcagttcactttgtttctcttgaatgcaaaacaagaaggaagcatgtttgcaggtgctatcatgtctcaacatcactgtgcttatgtttagttattttttgagttttaaagcctacatcttcatctttccttgtcaggatgtataaaattgattcatggttcatttaagtaaagaagctattttaaaccaaattgtcctcattgaaagaaaaggggacttttgctgtcagctgcagaaacatgatttttcaccaaaatgatctgttacttaacaaaaaaagtagatttgcaaacttgcttttttccccttcttatgattaaagagcggagggaaaaacaagtatctggatagtcagactctactggaattttttcccgttctctggcaagcctgtcttacttgtaggtgtatctcaaatggaacagaatgtgtgaaagccatttaaatgattatttgataacttaataaaggaaaatgcttcaagccaccacccccctcctacagttgataagtgatgccacctactgtgaaaatattttacaaaacactttcgttttggaatcagtatcaaatagtaattttaaaataaaacatgtgtagagttttctcttggctcttcccagttttgagaattcacagtgagccctgtactcttgagtttatgcaccaatctttctttcttccccgagtattactttactcacaggtttggcttagcagactttagatgttggtttttagctacggattaactactaatatatttgtgcttaattattcttttttggatggtagttgcactttgcactttaaaatactatctgtttactgtcataggtaaaggagatgcatttaaccccctcctgttcctttgtttccaggtagaggagggttttaaagactttaatcattcatgggcattgaacacacagtactacctctgagggcagttttgtctgcccaaggcattctgctatgtaagtagaggcttcttggcaccagaagtcaggagcaccacatgcccttagaatttcactgcatttgttctatgagaaattggttcaaagaacagcagtttttaaagaaagcgatccatttgaaaagctacacagtttgcttggcatctctgaacacttcacagccgcacagtgacgctcttgtaagcctgcggcctttgcaaggttttgttttgtctttttctcctttatcccccacccacccctccccagtggtgtctgctttggctgctggtatcttttcctgcagccctgctgtttggcacaccttgtagaacttgaggctgccttaggagctctaattgtgagtagcaagtttccagggagtcctggaggttgcagcgccactgagataatctgagcttgacagaagtggcacaattatccctaagtcctagatgaagcagtaaccctcaaggaggatactcgagtggccgtggagctttccagaactgaacagaatgggctcctctgtcagtgcagattagctcttgttgttgttgttgtttactagacagtgggtaccttaaggagatggtacggagaacccattgtagctgatccaacttccggcgtttattttatttttttttaaatttcaaagctccattcttgacattgactagaaaacagctgaaagaaagagacacggcccatttgcatattctacaaggatagtgtggagcctgtatgatgaaatctgaataaatacgtggattttgagaaccctttttttccctgacagtattcaacattaagtatatacttaagcagtaatgactctgaagctatgctttgcattcatgaacacactccatagggttacgcttcaagcactaggtgaagccaagattttctgaattatgtttcattggggaatttttacctttttttcctgtttatgacagtcatttcatctggttttataatgaggtcaggaacaggtgaatgtaaaataatactagtaagctgagtgatttctgtgttaatgattaggctattttttaaattaaaaagttctggtatttgaaacatgctcagtactttaagtacacttactagtaattaatcagaatgaaagattttaatgttctctgattatgtacaaatcattatggctacctgtctgcaagaagtcaggagaaactggtatctcggctaaaactgggggaaaaactggtgtcgtctttgcttatttttcccattctcccagtaaatacaaagcattagcatttgtataatataggggtgtacttaactctttccccctaaaaggccaactttccccctttataaaatacaggtctgctcattaaaccaataacctttaaaaaatgagacatcgaaaaaaaaaaaaaacaaccaacagtaaaagcattttactaggaaaccctcttagagcacattttaaacatcttttgtgtttccacatatcaagctactttatggacttttgctgtggcattgcccttcaacgagaaagctttttccattttgtaccataaagaatattatttttctgccagccaattttctctgttagtcactaattggctacataaatctcgggtgttgagaatgaggaatgtttcagtgtcatagagtgtaatcttcacccttatttaccaattcattaagattcattgatgcaggatcggtgagaggaaatgacaacataaatcagacctccaacataatgaccctaatcagttgggaattgctggaaatgtcatgatgaactatgtccttgtgttagtgccactgtacattgtcattgcgctgctttatgagtgggacgcatcttcctgacactgactgtatttaacgaaaaaagagttgttaaaaacctgattccattaaagctatgagatccatacaaggtcctgtggtgtttagccttgtgccctttaccttcattgtaactgcttaatggagctgcagtttaatgcacatttagagtacacctgagtaaaaactccacaggaaaaaaaaaaaagcaggttgatttatggcttgtcatgtctttatttaacccaataatttcggtgcgtatagagaattgaaaacagtaagttctccacttaggtaccaaatctcttgtcactaaactgaggaagcatcccagtgacctagaactccctaaatatcctctctttccgtgatgtgttggattcaaacctcagtctccacaggtttgctgatggtaactgctggtcattcctagaataatgtgtcaattcaaaattagcaatataatttgacaggggcttctgcaaagaggtttctggacacctcccccgccccccacccgccccaccatgatattgatttgattccaccacattcttggaattggttactggaagatcgggagctgcatagctcatacacattcttcgatttaatatagttattcattttagctgtaatgaattaatctggcaacagttttggactagcccagaaggcactcctccttcctctttacttactgcttattaaaatcttgccgatgaatagcaggtaaatacgtttcaggatgtgaagattgaaaattgtcactttatactcctttgactgtttttttttttttttaaaaacattgagcatgatggtaaccattttttaatctcaaaacaaatctttaatctatggtataaggctgagaaagacctgtaagagaacaagacaagtttacttaatcttgacagccctgggtgtaatctcactctgcttgtgacaagtcagactgtaagatttataactccttaatcaaatgtctagaagtctcaggaaatgttatcataggacttcctttcacatgacttactgagaactcaatagaccgttagataagctctagactaagctggaccttagaataatttcaaattgactaatagttttctggggggtttctttggcgggagagtgttttcaatttgttttgacaagtgtatgtttacagactcattatatcagagggctctgttgcttccaataggaagacacggtaatttttgatgccctgtggtcgtggtcttcacgtaaacgctatttgtgttccgaatcttagagttgtgtgggaaggggatccgaggagacatgaggatcataaaagctgcccgatgtcaccatggtcgcgtgcctgtggggctgtaaaggcagacttagacaagagcaggggactgcagtgggctctgagccactgtgtgtcagtggaaggatgactaagagtgtgagaaccactgcatcgctagaaccgcaccagccttctcatgtggtccaggaggcccggcaccgccattaccacgaagaccaaaatgactctccccacccacagccaaaccagagtcgtcctgtgcgctctgccctgtcatcagaggggactgtcagctgccgtctgacatcctgcgtgctttggctcttaccccagtctgaccagtgtgactgtacaggatccctcttcttggccggtgaacagcgcacttagtgcccttgcagggagcctgagaacgagcaaggtagtgcgtgcggggagtgagcaaaagagagactcagcgagacaggatgtgagatggaggtggagagcaagactgcgagaggaaaatgacaagcagagagaaagggatactaagaggaagatggcaaactgaaagggaaagagactgtgtgacagggtgagacagagtgaaagagattgagccagaatgagatgcagaagggggtagggagggagtgagagggagagagacaggagagagagagagagagagagaaccccgggaagcaatagggacccccagagtagaccctgccatcacttgtgcctggaagaggctcttgcataggtgacgggcattttcaggatggctgccgggtggagttgagcagtgaggctggcaggagtcacatctgggcctgaggcaagtagcccaaactgaaaaggcaatgctctgatgtcagcctcatccatctaggcttagaacaaggatctgtactttgaagaatcccagcctcccctgcaagaaagagcccaagattgttaccatttcagacctcaagagccaaagcaagacacaccagttcctaaccagagggacttgagttagctctaggaaatgggaagattcaattgatgtaatttcaacttcttttcctcagaggcgtccagcagcacaggctgccaaaaaagtgcccatgcccttgatgtctaagcaaagtgactgtaaaaatagaagtagtgtctcagaagttttttctctgcccctgtctctcctgaatctgaaccaggctgtttaaaacttggcatcactcagcttgcaaagctaccatttgtttctagaaagtgaaagttttttttggtaagccctctgaaactcagtgttgcctaaatatctgaagacatgatttttctcagtccgtcttgggcccccgtgcccagtctctctttgctgcacccgttcttcctctgcactaatatgtcctcatatccagctcctttccatagatgtgattgggtttctgttcatgtctccactgttcaaaagatttgtttcctccaccattagtatttgagggagaactcccaaaacctagggaggggaaagcaagtgggcagagaactagaaatgagatgagaaaaatcgctagctattcctggcaaggaaaaacatctttacagtaacaggagtgtttaacagacagacaaaataccttcaaaatatgcaaatctctgtttatcttacagaattctacagggaacaaatccgtagcattagcaattatgacttagctcagaaatttttttccttcctcgtcataattataaacatcagtatcgcttagagcttcacgttaaaatgtttttctcctacttcttttaagagttatttgtttaacatgcttttattatcctagatgatgtgatttgggaagaaagtattaattctcttatcagctctgtttcctttccagttgttcagagaattgagctacactagtagtttatgaagtaagaggtattaaatagagagctcactgctgatcagattgagccacttctgaactgtggctatccaggcaaaggggattgacagcttagcatttatgccgcaaatgtgttggaataacatggcaacagaatcacaggcatctttacttctctcacactgccgcctcccagctagtgcctttgtatcattgaaatttttgagaaacaagatgccttaactccttatccaatgttgcttgttcagtctggctttgtgaatattgttccttgagtgtggttttgaaggtggctgtgttttattgcaggtattgtataggtcatgtatattctatcattcattcatccacttaggcactcattcactcattcaaaatattgactgtgatgtgccaagtcctggcagatttgggtaccgttgtagctgagtatttctaattctcttaaacacattgcctacattatcatgttagaataatgtcaaatataaccttgtcacaacaaccagtctgtcgggtgtccttggcctacagtgctaatctgtgattattttctaatttgatgctggcaactcacatagaaccactgggtgaggggatggttctgtcccatctggtcattgattcgtttattcaacaaatgtccacctactatgtgtcactgtgctgggtgctgggccctctccctttgacttgctggataattttagaagcttgtccagtctcactggttttttgctgtgtatgttttctgagacacttccagtcctccgtttgatcacagcttcccatctctgcctcttgcccatcacttgtgcggattgtacttaatcactgtcctgtatccacatccctccacacccagcagagagtccataagtagccatttcagtagtaccctctataccatctctccctcccttatcccttcttctgccactgcagtggctctcgcaacccccaactccatctacgatcacatctactcttcttcctaagggaatgagtatggctggtagctctcccaaaaccatgctgagtccctgtatgcagttctgcatcctagacgtaactgagcaatccctcatgggctcatcaatcccagtgtttatggttttagagtcctctcattcactacagtgatgatcctagaacttgaccaccacccttgagcctctgctatatcctcaccagatttcagcagatgatttgattcttcttttactatacagatggtacaactcgttaatcttaattcctctaaattcagaatctccaacttcttcttctttgatcacctccttagtctatgaggaggaagaaattagcaactcactgaccagctgccatactagggagcgtgattatccaagcctagactctccatccttccattgcccatgagctatccacctatccatccatccagcaaacttctgctgagtgactcctaagtatccagtactattaggctttactgaagcagtaatggggtactcctggcctgagcggagagccatctggtcactatcatattgcaatgaacctgacctttggtcagcataaaaataaaatgcatctcgagtactttagaatgaaatattttctttttttttttttttttttgagacggagtctcgctctgtcaccaggccggagtgcggtggtgcaatctctactcactgcaagctccgtctcctgggttcaggccattctcctgcctcagtctcccgagtagctgggactacaggcgtctgccattacactcggctaattttttgtatttttagtagagactgggtttcatcatattagccaggatggtctcgatctcctgaccttgtgatccacccaccttagcctcccaaagtgctgggattacaggcatgagccaccgcacccggctagaatgaaatattttctttttaaaggtaatatttgaactgggtttgaaagcattcataggaattcaggtcaatgtaggaaaaaaggtgcctccaagaggaggagaatagcataatgtaggtatgaaagagtaaggtatgtttggaaaacagcaactaactaggaaaagtgctgggttcgtggaggaggaagcaggaaagaagtctgggaaattatacaggagacctgttattccattcaaaggagttgagactctttttagaatgggggagcttggggagctttcctggcaagggagtgacttgatcagaatggtttttgtttttaatggtgtttgtggttcagctgaaggttctttgaggatttcaggagaaagatgatgacagctggatgatcgtagtggtgatgaaaagaaaggggaaaaatttattcaatatataagattaagaattgccaggtcctgatgaaagactgaacatcaaaggagttgacagtgacctttccctgatcaggcaaagtagcaggttggaggaaagaatgttgagtttgggagcctgatgaacttaagtggtagaaataatcggtaaaggagagaagggcttgttggggatccaatctgtgatcatcaatgagtaggcaaaggtgaagtatatgtggagggcaaggggaccttgaggaacaccaacagcgaatgggttggggaagacagtgaagtatttgaaaaagaccaaggctttgggaggccaaggcaggcagataacctgaggtcaggagttcgagactagcctggccaacatggtgaaaccccatctctacgaaacatacaaaaggtagccaggcttggtggcgggcacctgtaatcccagctactctggaggctaaggcatgagaattgcttgaacctgagaggcagaggttgcagtgagctgagatcgcgccactgcactccagcctgggcgacagagcgagactccatctcaaaaaaataaaaataaaaataaaaataccaagggagtgaagggtttttgaatcaggctgagcaccagaggatgtgctatcagggaagccatggaagaattttcaaagtggcctccatgtcaggtgtgacagacaccctctggtctcttgggcttggcagtgttaccaggtgtgtccagggaccgccagcgtgttgtgaatgctgcctccagggttccgccccagcccctctcatggatctgggtgaaggacttgggtttttgtttgtttgtttgtttgtttttttgatacggaatctcgctctggcaccaggctggagtgcagtgtcgcaatctcggctcactgcaaccttcacctcccgggttcaagcgattctcttgcctcagcctcctgagtagctgggactactggcgcacgccaccatgcccaggtaatttttgtatttttagtagagacagggttttaccgtgttggccaggatggtctcgatctcttcacctcgtgatccgcctgcctcggcctcccaaagtgctaggattacaggtgtgaaccactgcacccggacgaaggactttgttctgattggcttcagagttgaggaactactgtcctagccataagcattgagtctgcaacgcagagttgtaagtaagaggtagaaacatagagacaggacccttccaaaaagcttagctgcatggaggaaagaggttgcaggatgggaactagagggatagaagagtaacccagaatagttttggtctgagtgccttgagtatatttatatatagactaaaatgagggaggcggtagagatgcggtagagagaaggaggttggtgctggaagaatataagcctggaagacacaggtttcagagtgaatgtagaaagtgaacagcctcttattttcagaaggaaagaagggagggcagaaggatgaaggtatttgatgttggatgggggatctcccttttgcttcgccatcttcgtatcatcctccacttctctaagccacttgaaaccattagccacctcttccttctttgaaactcccttctaagtcttctgtcactctccaagactctaccctggaatgtgcctctagaacagtggaccccaacatttttggcaccaaggaccagtttcgtggaagacaatttttctgaccaggagaggggaagagttggggatgattaaggagcaagcaacctagatccctctcatgcacgtttcacaatagggttcctgctcctatgagaatctaatgcagctgctgatccaacaggaggcagagctcaggcggtgatgcccactcacctgctgctcacctcctgctttaccgaccggttcctaacaggccccagacccttggggagctggggaccccgctctaaaatgtagtgggtggagattggatgagtttgatgctcatatttttgtctgctagctttatatatgtgtgtctaagtctaagtattcttggcctacaggttttcttctttaaaaaaaaaaaaaagaggattaatatgtacctcacaaagtagttgtgaggaccagaacttagtaaatgttattcttcctgtttcctaagtacaggaattacctatggtttgttctgaggacccttcttttctcctcataatcttttattttattttattttattttattttattttattttattttgagacagggtctcactcagtcacccaggttggatcgcagtggtgcgatctcggctcactgcaacctccacctcccaggctcaggtgatcctcccacctcagcctcccaagtagttgggactacaggcgtgcactgccacacctggctaattttttttttgtatttttgatagagacagagttttgctatgttgcccagggtgatctcaaactcctaagctcaggcgatccacctgcttcagcctcccaaagtgcagagattacaggcgtaagccagggtgctggccctcccctcaccatctgactcattccctttcaagtgtcacctctgtgttgatgcctccctgctagcttttgttttcatttctgctttactctgaaagtggcctgttccctcacttggccattctcacaaaagcgtcacttgggctgagaaatatcattcatgttgcctcagttcctataatcagttaccaggtctttcattctagctgtataatatttcattcattcattcattcattcactcgtctgacattaaattatttatcaaactgcctggtatcctgttaggggcaagacatgatccctagcttacaggtaaacattcagaaaactagaatgtagtataatgattactctgcaagagtttagtataaaacttgatggggctcttccagatctggtggtggaggtggtctgcaaaaactttcatggctagaggtgagttgtgaggttcagtaggaatcagccccaccagggttcatggtggaggcggagaggtagagacagaaaggccttggagtactctgcatgcctgagaagcagctggttgttaagtgtggctacagtgtagatagatagggtggaaacagaggagagagagagagtggggagagcactgcaggggcaggtaggccagatcctgaagtgtgtgctgcacgcagcactgcacagtagaaataaaaggagagccacacaaggaattttaaattttctggtaactggattcaaaaaagtaaaaagaataagatacaaattatagtattattctatttaatccaacttgcccaaaatataatttcagcttgtaatcagtattaaaaatatatgaaagacacatttttcattttcttctttcatactaagtttttgaaaaatcatctcaattcagacattaaaatttcattggaaatacttgatctgtatttcgatttcataaaacttacggttaaaagaggagattcacatacccaagttgttcaagacatacttaaacattttctgatgactgaattaggtattggtttttaaatttaaataaactttcatgaaaatcacacatttattaaaaatttagtcctatattcactctagccacatttcaagtgctcagtagccacatgtggccagtggtttttctgttggacagaacaggcctggaggatataggccttatagagacccaggatttaaatcaagtgaggtcacatgatcagatgggctatggcatggccagactaggagttgcatttgttcacattcagagttacaaagtgatgagggcatgtgatgagggcatgctcccaggcaagggtatggagaggcaggtaatatttaaataggaggtagtgtgggtgggaattggtaagatgggaaataaaagagaaggaagattattagataattccttatttggaataggattctttccctgaaaacccaggaataggagctagcttgatttcagagcttggagaaataaataatttcagtttgaggcaaaatttgtggctcttttaggacatcaaagtggaagtggccagaaggttgtaggaacaagggactgcagctctgagaagatattttggttggggaaaataattcaggaatcaccaggatacaggcatgagttgaagccacagaaacgttaaggacttccagggatagtgcttgagagtaggggccccacaaactacagttctatgcgctgaatccagctgtcgcctgttttgtaaataaagttttattggaacagttggaaaacagccacacccgtttgtttacagatgggttgggttatatttgctccacaacagcagcgctaagtagctgggacagagagcatctggcctgcaaagctgaaaatattttactgtacaacaccacagaaaaagtttgcagacccctgctttaagagttttgcagcactgaggccttaactttagacaagatgcaatattgaagaatgagcagaggaaggggatgctcattaaaaaggatgagaaggagccatcagagatagcgccagagaaccaggaatgaggaggacaacctggaggcaaacagaagagagattttctttttcaagagaaatgatatgaatgacagtgtcttgtgtcatcaaagtttaagtaaggtaagggttgaaaactctcttttgaatttagcacctggaaactcattggagttaccatcactatcagttacttaccttcattaaatttgtacatacatggagacctattacatcatattctaaattcctaaagtttgtgagttcacgggaaatgaggaaagggaagaggtgggactttggagagctgttttaaggagacgtgaacacacccaggtgcagtgctatgcaagtttccccattcagtgtgatggactcaagtcacctccgctcattagtaatatgatagggacagtttcagcaaagaggtgaggcagaagcgagcttgcagaggtggagccaggggaggggaggatgtcgacacaatgaagtgtagtcctttcaggcagctggcaatcccagggagagacactcgaggttgagaagatgattttatgattggcgaacctacttgttggagggagaagtagagtttggagagatgagtgttcgatgagcagggcactctggaagcagggagaagtggatgaaagtgtcctaatttgtccctcattctctctgctttggccccatcctgagtacttctatcagatttcacttcctgtaaagctcatttcatcccagcccttccctgctctctgctaatgtagggttccaactccagtcttctctgtcaagcttggccacttcttttctcctatttgcttgcctgccccagcccatctctctcttctccactcccagcctcttgaaatatactactctactcaaatgtctgggcatcacctaagtcttggctaacctgacctataataggtgctcagtttggtagtatttatgaagtagaaacagaagcaaaaaaaatcacaaatcattaaagttttaaggaacataataaatttacttctgaacaagaagtagaactcattgctttgatccctaaataaaaaaaaagaacaaaatcctaggctgggcacagtggctcacacctgtaatcctagcactttgcgaggccaaggcgggtggatcacttgaggttaggagttccagaccaaccaggccaacatgatgaaaccccatctctactaaaaatacaaaacttagctgggcgtggtggcacatgcctgtaatcccagctattcgggaggctgaagcaggagaatcccctgaacctgggaggcggaggttgcagtgagccgaggtcatgccattgcactccagcctgggtgacagaatgagactccatctcaaaaaataataatacattaaagcataaaataaaataaaaataaaaatagaacaaattcttatagaagtgttctctgtcacagcactcttgatgcgtggaccaggtaatttttactgtaggggctctgctgtgcattgtaggatgtccgacagcatccccagcctctccccaccagattccagtggcacaagccccctcctccaggtgtgacaaccaaaatggtcctcagccattgccaaatgtcccctggtgggggagggacaattaaccatcagttgagaacgactgctgtagaaggacagattgttaggcagatatttttccctgattttttttttaattcctggtgtatccttttccctcatactttgcatttttaattgttggacccaaaggaaattatactcaaggtacgtctcattccaggcaataaaaatggaaaccacccatttttgtctgcttaccaagctgctagtggtgctggtcctatcccatcttacatacatcaactcagaaaaatcaaagtaggagccccagtgtgtgaactgatggtcagtatcatgcggctactataccttaagatcttgagggcttacctgaagcacgttgcagctgccccagcttcccagcccattcaaatcaaccattctgtttggacattcttgagttgacgggcattcagataaaagtgaggtcagaattctcccatcacaaatctacacctgttggaaggaagccacatttgtggaaaagaaccagaaatttgtaaatacatggagacttattcaatcatacttaaattcttaaagtttgtgagttcacgcgaaatgaggcaaaggaagaggtgggactttggagagctattttaaggagaagtgaacacacccaggtgcagtgctgtgcaagcttctcattcagtgtgatggactcaaggcgcctctgctcctggggtgggagttgtcagtgatggggatttggttaggagccctgtttgattcctgttcagtccagttttcttgctgtatagacacgtgccaggtgcactaataatcaaccacttgtatccacagtataaggtgcaggatgctaatcctacctgcaattattagcatgtaccttcttgacttcaacaaactgcatatacaaaggagaaatgctgctgaaaagccaattaaagattttctttagatttcgaggctttaaaatggtaatcaaagactgctttgaacagggctggcttgcagtattaccctctgccctgctctgcatttttccctttaactacaacttggtaaacaagagctgattcttaacaataacccagaaagttagtgttgctctctaagctgtcattagaagaaatgttgactttattgatgttatagtcctcatatagccaggagacagcagcaaaacacatttttttctttaagttgaactgagaattcagtgttagttcacgttcattttatgatggggagaagagtatttgcacttgagaattttccagtggcctcccaaagggctgggttttatgagctagtaataatcactgtgatttattgagcacctactacatacaagacactttacatacattattcctctgtgctctcagaacactgtgcatttttcatggtagcacttatcacaattctaatctccacttatttatgtgtctaattgattaatctgtgtcttcttgattagacaatcaccttcatgttgatggaactgtattgatttttgttccatgttggcaccctaacactcagtacagggcctggcatattttgtattaactatagaataaatattgcttagaaggacgagtgaaatcagatgcagaacagcatgattttatagatgaggaaatgagaatagggagtggtgggatatcttgttgaaaacttaaaaattggctgagctagaaatcaagcccaagtatgtctgcctgttttccaccagacctgccttcttaaactttaatatgcatgtgaatcaccttggggatattttaaaatgcaggttctcatttagtaggtctgagatgggctcaggaatttgcatatctaacaagctcccaggtgatgcctttgcggctgtccacagaaccatgctttgtgtagtcatagcctgcaacacagttgcagtgcacaggttgatcactttctcatctgttggaggtatatgtggttctattggaaacccttgtcatgagacagatcccttgtactagtctcctctggaaggtgccacaggggtctactcttggataaatgcactggctcttctcatcaattggttgtgcctaggttatgatcctctctcccccgctcctctctctcttttgggggagaacgtgatcaacaatggctgtgatctttgatgaatcttaactcaggtatttagcatgctcgttattaggagccctgttgtctccgtttacaggtgaagaagactagtaattttaattccctattttagagtgttgttcctgtcccaaagatgtccagtacctccacccctcacagctaccatgggcatgccagggagtagcaacaccctttcaaaagtttctttgggtgtttagttgatgaatgaatcctgttgagaatctggcattatcagacatcagatggtcccgccgttgaccctgtagtcatccagtggccccagcactcagcaggcaaagagaagtggccccactgttggtacctgttctacctattcagggcacctcaagccctgtctttctcgttggcatgttcgtgacagcatgattaaggtagcttgataaaggacttctgtttctttctaaatctcctcccaggctcagcacttccccatgggggagatccaaggtctaggtgcttatttagaccacatgatagcacatggatggatgggcggagcatatctctgtgcgaaggggcccctcagccagagctggacttgcctctcaccaagcaggcagatgcttttgtcccagctccacctaagtacgctttatcaccagcttcgggctgtttctcagattccaagttcaatccttgctaactgtagggacaatatctgcattcttgacttttaggccgactgattctttgtacttcccagccattcactctagatccattcatcatcgtagtacctgattggaacccactgcacccttcattcatcatgtaacacaatgttaccatttttatgtgtttgtaagatttgaatatatacatatgtatgttgcattttatttttattttattttttttgaaatggagtcttgctctgtcgcccaggctggagtgcagtggcacgatcttggctgactgcaacctccacttcccgggttcaagcgattcacctgcctccgcctcccgagtagctgggactacaggcacccaccagcacacccggctaatttttgtatttttagtaaagacaggatttcaccatattggccaggctggtctcgaacttctgaccttgtgatccgcctgcctcggcctctcaaaagtgctgggattacaggcgtgagccaccatgcccggccatgtgtatgctgcatttgaattgtgtggtggtaaaaattgaaggggtgccttaaaaaagatttactttagctctgtattttgaaaaaacgctttcagatacagttctttatagtgttcagctgtgttaaatggtcttgaagggtagcttaatgagaaaaggtcttatgtgttaaggacatcattatattgttaaaattctgctgaatgtaaataggcagatgcctgtagtttgtcctgaatcctttactgaagggcttgccttagttgtcttcacatggacaaacaaggcacaggaattacagatgatgaatgaggaatataccactgatggaattttcttaaaacacaccgtgtgtttccacatctttctttttacattagagtttctcccttcatttaattttcatttgtttgggagtgttattttggatttaatctatgtaaactatatgcccatgcctttggattaatggacttcacaaaggtagtgattaaagtttacagatgtgggaagctacaaatacgaaaggaggcttacatttttctctttttattcattcatatatatatatatatatatatattcccattttgtaattccttagcatcatgtcattgttcccataaaaatatactgtattttctgaaatgatacaatctatgaagcatttcccattacgtagacaccatgtctttaaattatagcaatttcttaagattttaaggcaaaatgagctcttagaagtgtgattaatagcagggaatgaggctaatgctgggtcatcagtggcactccattacaaaaaggttggtttaataaaagcattcatctttttgaccaataaagcatttgaatgatatgcttatagttcttatagtagttacttgctactaaataaactctgaacttgtattgtggaaaggcggcatgacttaagtggctgatgcacaagttttttgatggtgtgagaaaaggcaggcctggatgggaggctcattgttggagctactggtttttagggtgtcttctacaagcgtaatacccatgaactaggagcctcatttggtttgggggcaagtgtaaacaatctggcttcttggttgattatgtctttagcagtgtaagtgtccatgtagcccctcagtacgtgctttgtgaattgcactgttaggaatccagtgcttaagggtcaagattatagcgtggaggttcatgagggtctcttaagtctcctgtagctcagttgcccaatatatgagccttgtaccactcacagataggttgggagaggattttttggtggctcgtaaatcattcaccaattcgcattactgtggttcaatgttgaagcaattccattttcaattcttttttaatccttctgataaagccaaggagaaagtctcaatttggtactagtatctttaatctgtctctcccagttgtaagctcattatttaacaaagaaagaacatggttccactcagagcctctgagaaacagcaggttctagcagaatttaatatcattggttaggttttataacatgcattataaaagtctttctcacctacaaagggttacatactggttttccatttgaagaagtgatacaaagtttcctctgaaggtagatttatttatcaaaagtgaatcattttttaaaataacaatatggtagatgtggatggagatggtgaaaataatgaagacagaagtaaaagtgaatgcatggggcttgggaaactagctccggtgtccactaagatgccacaacctttctgagattctcagaatttgtaagattttcattctggggaggagttgtgaaaagaaaaatcagtccttcccaatcttgagttagcccaaggcctctttagaactattttctattttaaaaataatttgttgaacagcttatataaaagccttcttaatgtacttttttaaaaataaaacttttacaatttgggattcatggggaataaaataagtaaactgggtacatagaagtaaaactaaatgtgggcccggcatggtggcttatacctgtaattccagcactttaggaggccaaggggggaagatcacttgaggtcaggagttggagaccagcttggccaacatgatgaaaccctgtctgtactaaaaatacaaaaattagccggttttggtggtacacccctgtaatcccagctactcgggaagctgagacaggagaatcactggaaccaagaggaagaggttgcagtgagccaagattgcgccactgcactctggccagggcaaaagagcaagactcccatctcaaaaataaaaatggaaaaatagaactaaatgtgggttagggcaagtgtaacaccactgctggggaagaggaaagaagacacattatttatcctgctcgtgataaggaataggtgaaaccatcttcaaacagaaaagagtaccccattcaagcaatgattatatgcccaggtttagcctagctttcaaaactccaggactcaattatgatttccctttatgaagggaaattgttacaactctttggattaccatttagaattgtcaactatgtttataatcctttactaatattctggttcatccagggttcaggaaaagaaaataaaaactgaagctcaggagaactggacaagagctgaagtgcagagagtgaatcatcagcattttctcctgaagacaggacagtgaggataccaggacacagccctccactttgactttttcattttgtttttctcttaggttttcactggggtgttggttatagaagccccttcacttttctctacctcctagtcatccatagggtagtgagcacggaatctgagaacgttctgttctcaaaacattagagggaagattctctctgttagttgttccagcagccggacttgcatcatcaatcagttgagcaagtctgattttctttctcaagggcagtagaacagctccagccctagagggcttttaagggaagttcttgatgtctcttccctgcatgtccatcaggtgttaacaggtccttgagcctgaaaaatggcctcctaccagggcactgaatgctcagtggaaattttcttcccctgacattgtcgaggcctcagggactatgttgatttggggaaagatgatggttggcagagagggacttagggaacaaaccacagagcaacaaaacaaaaacatgaaagacaacacactagttactttgtgactttaggtttgcagaacaaagattagataattcaagcaaggcctggaaacaagagcagctagagaaggttgaggagtttattcacagtggaactccggagggggatatctgttgtgggggttggggcagaccaacacaatttttgttactttctttttagacagagtggaaaattccaataacctgattgttaatcatgtaattgccagaatccacttaggtgtatctttatttttttaatatccttttctcatttccatattttgctttggatatccagcagacagtgttttgctgcactttgcactgacatcacgcagaatttaaaaaaattagctaactgattataagtgtaagatatagataaattaccaaactgtttttcagtatgttttgcttattaaattttaagtaatggaaggaggtttttcacatgtatcaaaattaaattaatggtgttaaagtatctgtaaaatagattgaaactaatgttttaattgccgattgtgtttctaaatatagtatctctgataaggcatgataactttcttgtaacacacagtaagctgctttatgtggtagtgcacatcagggaaatttttagagattaaacgtttcttcttaacacttttgttagggacacaccgaacttattgttcattctgggctttgaagagctaagattttattgataagctgacagaatgaacccctgagtggttacatgggacatcaactgattattttattttttgatattttgtaaggaaaacatcataaactgatatagttggatttttgcagagtagttgagaatgctctgcatctgtttgtgggcccactgggcttaaaggtatcttagaatagaagcttgatatggggagactggagcattaaggttttccttctggatgaaacattaaagattcgaatctgtgtttgacccatatatttcattgataaaagaagatgagcccaagaaatgaatgcagagttactgaagcatgaaaacattatagtgttttaaagctgttttcaaatccaacctttagtggtttaaaccatgtggatgctttatttttatctgcaagccaggaaataaaagggtattgactgaggtctcttggtcttattttggggtgactgacctctttttcttaaaggggcctgttttttgttttttaatttctaagtaatgtcaccagtaaagagttaagcggatctgactggcttcactctggcttatatgatgatgagtaatgtgatgttggtaacagcaaattgttgtttataagcaaacatggcattgtgcaaacaagcaggcttggtctccaaccggtttgatttcatggtggtcagcagctgatctatgtaacatacaacctttctgcctctctaaatgtcagaatgactgtttgtttatcttgccttcttcccagctgtttactctgtaatgcatttacctcgaccttgattctcaaagagtggcctctttctcctccccagttctgtttacgttagccctgcccctgctgtcacctatgaaatctgttgattattccacctggttaatgttaaattgctcttgtaagatgatgtgtttgttcataaacacaaatgctgggccccttgtttactgtacccatggcagcaatcgttattaaacagatattgctttgtttgcgggtgtgagcagcagtttatcctgcaaggtctgtttaacagacacacacacacacacacacacacacacacacacagaaacttaaatgctagaattttgataaagaaagaaaaaggggaacttgtccctggaatgtggttgaaacagacttaggtttgcttttcttatcttttgcttggatgaaggggctggtgagattagcaagttgtttggtttttctaagagatttccttagtgtaatgatatctatgcagttgtttgcttttttctgaagggagagagctctcctgaaaggccactagctcagtaatagagcatcagatggctagaaatttctttgtggaacaaacaaggacttagaaggtgtaggagaaaaagtctagtactatgaacaaggcagtcaccattgaaaggtacaatccttggattttgtgttactgtgtctatcttgcgtgttgtcctgtaggcttgatatgatcctgttggatgcatgtactctttgtcaagtttgagaagggaggattaacttttactttgatgtgttctgaataaatcccccctgccataaatgaagatattttaactgggaagaaactacacagttaatatgcataatgtatttttaaaagccagtgtttttactcttacctgtggttcttacctgtccattttaaagtgagtttgtgctttgtatcatttctagttaagtaaagcaagcatgtggctctttatctagtttggtgtgtgcacatgacgcttgtcccttggacactgggagccaccttagataagacctgaacattagcctggcctttgtcatgttttgcaaacagtagagaaaactctcagctcgcatcatatcatcatttttttttaagttattgtttgttgctgtttctgaatttgccttgtgtttcaatatgaggtatgctctcctagcatttgctgtaaattacaaagatacaacaccgaccagggtgagggtggaggctggagggtcatgacctgcagaggcaaatggtggtcttttatgtcagagaagccttgctcatctgtctgtgagagcaagtttcaggggggaaaatacatatatgtatattggagtttttgaaggataaaattaaataattgttccttttgcacaatggaaaaatgcaagcaacagaattctgatggcccacattcactacattaccatgatgctgtgaacatattgttcactttggccactagagcggtgaggggcttgagccaaagcgggagatacgtgaagtgtgtcatagatcacgccagtcattaatcgatgttatgaacctggcctcgtgtacattaaatgatagaaaatatagaaatgaaaaaaaaaaaaaacacttttctgaactggttgttggtcactttattccactgggctatttgtgagaattcagctgtttgaatgttcaaatgattaaagttccgtgggctttgttagttctcaaacttaaaatctattttgttctgtaaaaatgcattttaattacgctccccagaacacctggccccatcatgcctgaccttcagaggcttccttgtggcaaagcaaacagcctagcactggattggcaaagctccttttcagtctctatttaattatttgagctcctcaggattaatatgcgagggagtgggtatgcattctgctttgtacttgtttcctagagcggcttctttctaacttccctcgtttgcccacagttgctatgattacggcacttaaactcttgtctattaggaaagaagcgaaccaagacccaccagagctgaaaagctaaaaaatataaattgagacatctgtaatttttggagcggggtcaacttgttatctgtgctcattggtgtcttataaagattacgttatccaagaaagtttgatgaagacagttctgaagaataagacatttacagttgctctgaacaactttactgccttggcattggaatgcagaaatcctttttttccttggaaatatgaagtctctgtcttcacattgaaagcctggtgaagaagggggaagcctgtgcttttgttaggaacattattttattaccaccctatcccgccaactctattctgagtcatgaattacagggaaaattaaacatcccattgtctaccttctccagcccatctgaattgtccatatatatattcagtgtttccaatgggtttttgtaggaaatttcattggttgattatctttcaatgtttaatgagatcatcctacttctcttaagacctaacagatttaattaatggcttgttacttttggagtttcagaacaccaaaacagttaaagaagtgtacaggaaatagagtatttttaaagttggaatataaaagttggaggccagcacaagcccttgatctcatttgatcaagaggttggccttggaattttgtgtcatttaatcatttagtcaaacatttagtaattatgtgttaaattcttgttatgtgcaaggcatacctgaaagttaaacttgagataaaagatgtatttatttattattcttattaaacaaatggagctggggaaagtggacaagcaaactattttaatctgaatgcttcttccatttaattgataaatataaactattcctggtttaattgataaatacaagttagttcctatttcttttcttcctcttttgaaggcaagaaagctgccgtattacattattgaaaataagcatgggttttctaagtttttgccaatttagtgttccttgcttgcgttggtcatcatagctatagatgatccccactggccatgtcagatgcattcaaatgcatcttgcctttgcttacgtgtaccaagccctgcacctcctgcgttccagagggcaggacaggtcagtggcgccgtttggacacagatgctgtgttctctaggaggggtgcccctacagctggtttgtttctcctccctggggaggcccgactcctcacttccatgggttcttagcctctactcacctgagacctggaatgattccagttttacctgatcctcctgtatggctaaatgagtggccacatttgttttggttttgtttttttttaaaacatgcttttgacaatttcattgctcctgaactttttttccagaggggctaaatgaaattccagatttttaaagatacatgtagatagacatctatggtgcatgataaagttgataatacataaatcatttttaacaacaggtaatatgcataatttatggtgttacagtgctatccttctgatatttatgatggataatgttcagttttggccctcatattactgctttaaattataccacaagaaaattaatgagaaagtagatttatgggtttcatttgtttgtcaattcggaaattaattgggtgttaattttagccgtcccttatcagaccaggactgtagtatgtgtgcattactttgcattcattgtagcttacctcccatttactgtgggtcactagctttgcatacattaaaatagccctccggctcattcccttgattactttttgaactgccatgctttagaaaatttacgcctttctgttataattatgaaaatgtggtattggaagacggtgccttcataacacagtcagcacactgactttgcctcctaaacttggctcttgggtagtctttccatgaaatgggacccgggtcaggaggacagtggatagacaaatggtgtgtctgtagggttcattcataatttgtagaagttatctcaggtgagaaaacaattgtctgatctaactctgtttctcttgttttgttctttctcctcccatctaccctttttgtttttttcttcaagagtagcccatccaagcccatttgtagacagtaactctacatcttggggctgccatctttctgtctgcttccttaaccactaagtctcatttgtcatcccctccaccagtcagtgcctcatctcctcattgccacctgctccagcagcatctcgccaggtgacgggtgagcagtgtaaaagcatggccctcatgctagcaaatgtgatgtctccattgttgcagtcctctactgagagtctgtggctttcatctgggatttccattgcttgattccctctctgttgtgaagagagtaacacccacacgagcattaaagagtacagaactggtttaatatcctaggccaccctaccgtttgcctactaggggaaaaaagtctgtggagctgcaccccactgcttaaaactcctttgtttgtcttatgttgccttgtaaaccctttgcacattaaaagggaaccagttcgtttgcttgatgagaaccagaactaaatgtatgctttatatcataatatagacaggttggtcttcttttttcctcagtggcatgaacacgattattgaaggttttaaatcttaatgatgcaacgtgagtaattttaaaagtacctctcttagagctaaagctagtctgagtctcatccttattctttctcagtctactaactgcatggagttaactgacaataaagtaagaggcatgtgttcaatatttccaaaataatgaaatctacacagtgaaattcacattcttttccttccttccttccttcccttccttccttccttccttccttcctccttccttttccatgagcttctgttatctcttcagaattgcatgccatcttccttttttctctgcacatggatgaacaatgagaaagagaatttttcttttcggatggggggtggactgtgtaattactctaataattttcctaatagtgatttcaccattaacttctcttctccccatagaaatagaaacatattttacaaaactatgtttagtttaatttacacatccttttatgaagagaccaacttctttaagggcatttattctgcttcatataaataattgatcagccaagttaatttacttctgcctgacttggtcaaccttaattaactgccctggaatcaagactgaactttttgttagcttaaaatctttcacaagcatgataacaagggctttattttccctaaattttcagcatcaacactgtaaccaaggaaataatcataataataaagcacagctttaatttactataaatacattggcctggacattatgaattttccagaatacttccagagagcagctctgttggcaacaacaataaataagcatgctaaactcagtccttgtccttttctacaagtccctccagcacaaaaatcgaacctttgaagtcagtagctctgtaatgtttccaagcaagatgagaagtagatcattttggcttctttaggctttttgacatctatgcaattgcagcattgacctttgtagggttatattaaatggatcacgtgatttaaacaggctcagttcatctggagatgccacacaggaaagcagaggaagatttggtcttgtttctggaagaaggacttgtttgtgggtatggtgtggccatacctttgtattcaggcactttgtatgattacacagtgtttcctgctgtcagtatgtcatggagcaaggcagttagttagttatagggttagttattcccccagagagaagcagaggttatgcataccgggtgcctgagacaagcttcctcgaagaaaagagggtgcaacgtcccttgatggagaagatagattcctctcctatatattgacttgatttcagatgactctaatagtgaaaagtcaaaagaaaaagacagttgtttgcaaaatagtgcagatggcttatatcattgtattttaatgcttttctttgtccacctgccactctcattgttgtcttttctggaatttccttagttttcttttcattaatttcattatccactacccagcacaggactttacaaactggagattcttaataatggacaagttcatgtctgaaacagaatagttatggctacatctatcccttaaccgattgagctttagttttcttatctgtgaaatggggataacatttacctgccttatctccctcctagccttgttacaagtttgaaaagcacatcagagggcttttgcaatttgtgaagtgtgatacagatataaaggcttattaaatgacttggaacgtttgatagaaatattgctggcccagacactgttagaaatgttcttagacattgacactcctattttttcacatgtgcttttcaaaaagctgttttctcctgattggtgtgggagattatgggaaattttaaatcttccaacctacatactactgttagcacttgactaattaaggacatcctcagaccaaaataatcctttctgcaattttggtcccaaagcctgcactctcacaaacctgattcacaagccaagctgcttggcttgatgcctgcaaaacttgtactggaggacttggcagtctgctttggaactgcatggagcaaaaacagggccttctcatcaaattgtgtattggagactgttcttactccacccaccagaatggtgtctcaccaaggaaacaaaagcaggaccaatctcttagacacctgctctcaggcctgggatcccgatggtcacatagtctgaaagcagcattctacctgcagttctcttccatcaggacaggatatttggctaaatatttatgcctcattcttagggcagggatagagtttatatatgtgcaatgttgttgtcttttggggatcaagtccctggtatgggaaggtattcccagaaggaaaaatatctatatatatacatatttttaaatctatatctatagattttttctttatatatatttgagatatatcccgataattagatggatttccttgctacctactctaagacaaatgctctcttgcttaaatacctaacactgtgccttttcctataattcttttttttttccctctccccgcccccttttttcgagacagagccttgctctgttgcatgctgtctgctcactgcaacctctgcctcctgggttcaagcagttctcctgcctcagcctcccgagtagctgggattacaggcatgtgccaccatgcccggctaatttttttgtatttttagtagagagcagtttcaccatgttggccaggctggtctcgaactcctgacctcaagtgatctgcctgccttggcctcccaaagtgctgggattacaggcatgagccactgcacccggctcttttcctttagttctgtacaaaggggcaagtttgtggaagagagactgaaacgcccagggaaaagtacctaggtttcactaattcatttcttttttggtgatgaacaaggcactcatgttgtcacaaattatcttgttacctgattcttatatcttagggaagattttggttatttttgatagacgctttactctgtggacagtaagaatataactgcaatttctaaaggactgtagttattagaaagtctgatctgaagacatgagaatgaaaaaataataatagaaatcaaaaaatgagagtgaatcagctgttacttctgagtttgtttcccacctgctagtgaaaaatgccattctcaatccacttttgaattggatcaacttaaaaaatatatacgtctttgggtttatgaagagtctgtatcaagttggatcatgctatacagtgaaaggaaatgaagaaacatgtgaatttttctgcttttaatttttccatttggtttttgtgcaagtctgtagaaaacagacttcatccaatttctagcaagaaaacaatgtcctctaaagatacccaaagattgaaatttccctgttgtcacatttcatgtatggggcagaaatctgtagcattggttgtacatatgtccttccacaattggaacacatttgcctaaaaattttctgccctttaatctgggattggtatttcacattaaagtcttaattattcaggcatttctcagctttcatgtttgaactcttcacttcctttaatgattgttgcttttccttttccaaattctggtctgtgaacttggagtgtgagcctgccgttctcattgttttgcccccactgaacctcaactttaaaaatacacattgtggtaaagggctttgacttaactgaactgcttcaaatcctgattccaccattactagctgtgacatgtagtggacaaactaaataacttgtggatccttagttttctcatccgcaaactgggggtaacaatcatcagcagcactaaattggagaatatgtgtaaatcacctgcattagggcctgcctgacccaacactggtgatcagtagatggtagcagttggtattagcaaatgctatctgtcttttctcatctttgaacatcttttctgagccaagtgctgaatcggctctctgggataatggttttgtgcccagagagtaataagagtgaatgtgaaatgtatttacacctaagtgatattttctctctttttttttttttttttttttttgtgagatggagtctcgccctgtagctcaggctggagtgcagtggtgcgatctcagctcactgcaacctccgcctcccaggtcccggttcaagcaattctcctgccttagcctcctgagtagctgggattacaggtacacaccaccatgtccagctaatttttgtatttttagtagaggcagggtttcaccatattggccaggctggtcttgaactcctgacctcgtgatccacccgcctcggcctcccaaagtcctgggattacaggcgtgagccaccgcgcctggccctaagtgatattttctagctactcattttgcaccctatttttttttcttttgttttgagacggagtctcaccctgtcacctaggctggagtacaatggcgtgatcttggctcactgcaacctccaccccctaggttcaagcaattctcatgcctcagcttcccgagtagctgggattagaggcacctgtcaccatgactggctaattttttttttctttttttctactgttagtagagacagggtttcaccatgttggccagactggtctcgaactcctgaccttaagtgttccacctgcctcatcctcctaaagtgctgggattacaggtgtgagccaccgcccccaggcctatatatattttttctattagaattttagtaccttaggccaggtgccatggctcacgaggcctgtaatcccagcacttcgggaggccgagacgggtgcatcacctgaggtcatgagttcaaaaccagcctggccaatatggtgaaaccctgtctctactaaaaatacaaaaattagctgggcctggtggtgggcatctgtaatcccagctacttgggagtctgaagcaggagaattgcttgagcccgggaggcggaggcagtgagcagagatagcgccactgcacttcatcctcggcgacagagcaaggctctgtctcaaaaaaaaaaaaaaaagtgtaataccaacaaatagtgcctgcacatgttaaaatttaatgtttatacctaatatgctctataggatgacttgctggtttttgagcaaaggaaccagatagaagaaaaatttaatcttgggcccggcgcagtggctgcaatcccagtactttgggaggccgaggcgggtggatcacgaggtcaggaatttgagaccagcctaaccaacatggtgaaacacccctttctttactaaaaatacacaaaaaattagccgggcatggtggcatgcacctgtaatcctagctactcggaggctgaggcaggagaatctcttgaacccgggaggtggaggttgcagtgagccgagattgcaccgctgcactccagcctggggcgactgagccgtgctccatctcaaaaaaaaaaagaaaaaagaaaaatttaatcttgaattctaggtttacttacaaatactagtttttctaagggtaaaaaagtaatatatttaaaacaatactactgaaacttgaattgggaatgacagtttcagacccgaaactaggggcatggcccactaatgaggggataagttgagtgaaagaaaatgacaactgtttacagattttggcaacatttaaaccaaggcccttctccttatgcacaacaactgctttaacagctgctttttttttctcccccccaccctccccccatcttggaaatccttgtatcaggtttttgagtcatgatgcaagaatctgggactgagacaaaaagtaacggttcagccatccagaatgggtcgggcggcagcaaccacttactagagtgcggcggtcttcgggaggggcggtccaacggagagacgccggccgtggacatcggggcagctgacctcgcccacgcccagcagcagcagcaacaggtactgggctttggagtcttgggaggtggaggtggtgggtgcgaatttcactgctgaattttacacttaatcgcgatctcgcgatcagtgttttgtgttcacctgtctgtccatctgtctttctgtctgtcagtggcatctcataaaccatcagccctctaggagtcccagcagttggcttaagagactaatttcaagcccttgggagttggaagtcctgcaggtccccttgtggggagcagttgctgagacgaagatgagtggacctgtgtgtcagcctaacccttccccattttgaataaaattattctttggagaaatggttcccactgctttcatgcaaaaataaaaattaaacgaaaaacaggcttaagcctgtgaagaaggaaataagagctaaggaataaaagagagaaaaagagtagatgagtaaggagagttgaaataaatacatagaaagacaggcggagatggcgagataacagccaaaacatctagaacacgggcatcactgtaggaagctgcttccctctacgagtaggatttgggggtatagagtatttacatatgttccctgtattcatgcagcactgggtttgtggctaagtcttactgctttaaattagctcttattggtgcctccccaaaatgtacataagttgggatgtactcattcctgttagttatactttttacaggtatggacctgggtacctgtgagtgactggtaaaatatttccgaatggtacaggcgacccaagaaatagtgttctgttgtcaaagtgttgataaatattcaaataagtaaacaacatttgcttgaagactggctttggttttcccgcctttcctgattcctcggaatcaggaaatattattaggctttgttaataataatagatggtttatgaccggttttgttcttgatttacttattcaaaacatagttatggcgccactcagaaacaggtgaattaaaaagaatgaagtatctttgggcctttctgaaagctgcaggaactcttgtggggaggaagaagatagggacaaagtgctcaaaccattttcttggaatctgtgtcagagaagctaagcttgtttgggatgcaacttggagacaagctataaagcatgttttattttctccttgcgaagagttttttaaggaataaggaatgattagactgttagctccttacaaggtggtggaaccaacatgagcctgtggaacctgttgggagaaagatgcaacaaagcgaaagaaaggaaaagtaacagaccagcaaaagtcttaattcagaggacttcctgcaagtgatttgatctttctttcattggcagcccaaacccatttgtgcctgcaccactggctcacttcagctggaatttgtgatgcttgttgtgtataaactttgtgcatttaagttagtgcagatggccaaattccaaccagtgaggttgttagcaaaacccagcagtagatagtaaaagggtctccgtgtatttgtgcaagtacatgttcatgtgatgttctcagccattttattcagaacaaatagttaatgttgctgaatgctatcttctgtgcccttaccagacaagtgtcaagattgcccatttctttatgaagcacttgagcacttgatatggggctactactgactgatgtgatactaaataattaatatttagagtacattaattacataaatgggaaattctgattttttttgaggagctaaaaatcattcaggatctcaaagtagtaagccagccaaaaaactttacatataaaccatcaaaacatgtgcacacacacatgcgcccacacacacaacagtgataacaaattggctacatagaataaaattataaaagcatatttcaccaacatcttccttaaaaagtatcagttgcaaacatatttatccacatcttcctttggctgtgtccactttggaaaatttgttgttatgggttattgacacaaaggtcaagaaatgtattatgattagacttttatactgtttttaaatgtttttatgacagttttttctccgtatgtcgttgacacattttgggaagaaacaaagcagtggggtctatcactgtggctaaaaccccctgtattgtgattagcaaagccttttgaagtcttttaaaatataacattgacagctgttcaactcccctaagtatatgataaggcttttaacaggttgttggggaaaagggaaatctgtagatgaaataagaaaaactacaggcctgaaaatatttctacaggactagagttatcagagttttcttccagactgaaaactgcgacaattagacagtttggagaaatgtgagcattctacaatggactatggttgttttcatcatttttattctacaggtttttacttgaagtgagaataccagcagtgagaaaatcatagccatgctgaattcattactgcggtagtcacacaaaaccacggataaaatttcaataactgcaggccacagttgagtaaacagttgcactgaaatttaattcctgttgacttttcccccattcctcgccaggggcacattcagattccgtagtacaaagacaacaggggttacagctttgattaatgtaggacagtggaagagaattagaactgtaaaatatgttagaagtccatggaacacaaagatctggcttaaaagggcctggtataaaaacgagttaattacgctgtgtgttatattgaatgttggaggattttccagttgcaccaataccatcattgaggatacggggagagtttttactcagtgccaggatataaaataaataaatgcaaacctttccatgtttgcttcatattatcaaagataattacaaattacagcaaatgccgttttcagaatgggagggccctgacaaagattcactatggagtgcactagttccatagtgagttttgtttataggttggcttaattgcgttcaaatggtattgtcatttctaaaaattagttagttgacaacctagagaaatggggcaaatctggcttttccatcttcttttgaaaaattagaatatctggtaaccttgggctgatagtcccacaacggcaacaattgttgggagatgaattgctattgaagacagggagccctccagcctgctctcgttcccaccagcagcattgctcatttatgcctctaggtagcggagttggcgattctgggctggaaggtagactcatcactcagaagccatcagcccaagagaggtgctgccattagctggtagagcccgccaacacactcacaaactgtctttcttcctcaagactaaatgtattatctctgtaatgtttcaactctatttatgtctgagccatgaaactattataacaatagttttctaataatataatttgatagagtttctgaacattttcttttatctgttgagtaattctttacccgataccataactgctttttatttcctattatccctgcaccatttctatgtctgtaaaagttgtattggatgtgcactgctccattatgaaactcagcaacaaatactattagcaattactaaagtttttttttttccttaaagaaaggattttaaaatgtccagaacaatttcataaactgtgtggattaatgcattttaaaagtcttgaattttagaaagcagaattttatttccatattgctgcaaatgagagctttttcagataagcatattacatagagcataatgtttagaagtttctccatatacagcatatgctgtcaggtcaattaacagaatgcatactagaaaatgtttattcaataaaaatgaatagctgttaaataaaacagctatttcttaacaacattccatttaatgatgaggtttttgtggggtttctttctttcttttttttttttttttggtaccacctggcagttttattgtctgcaagtcagtatagagagagctttggttgctgcagttctgaggtgtggctatcattttatatgaagagagcagtttagagggaatctgtgagaaaaaacttttaagatatgccatatttagaatttgaacatgtattatttagaaagtgtggataagcaaagtgtttacttcccgtggcttctttctttgacatctggtttaaggtgttgggtcttgtggcccagaagacagtgagtatgttttaagttaacaatgtaaaagaaggagagaaaatgtgaaatgactagcaaggaggtgggaacggtagatagggaacttctcttgaaaaagaagaaggggagtaaagaggacccatcgggttgaatttttccaatgaaccattgaaggaggtcaaagattagtcatttcccagaacgcaagaagctcagagaaatgggtgggactcaggcaaagagtctagttatgtacattcaaaggggatgtagaggctgtctgtggtggctcatgcctgtaatcccagcacttagggaggccgaggcgggctgatcacttggggccaggagttggagaccagcctggccaacatggcaaaaccccatctctactaaaaatacaaaaattagctgggcatggtggtgcacgattgtagtcccagctactcaggaggctgaggcaggagaatcacttgaacctgggaggcagaggttgcagtgagccaaggttgcaccactgcactccagcctgggcgacaaagtgagaatatgtctaaaaaaaaaaaacaaataacggctgggcgcagtggctcacgcctgtaatcccagcactttgggaggctgaggagggcagatcacgaggtcaggagattgagaccatcctggctaacatggtgaaaccccgcctctactaaaaaatacaaaaaattagccgggtgtggtggtgggcgcctgcagtcccagctactctggaggctgaggtaggagaatggcgtgaacctgggaggcggagcttgcagtgagccgagatcccaccactgcactccagcctgggcaacagagcaagactccgtctcaaaaaaaaaacacaaataaacaacaacaacaacaacaacaaacaaaggggatgtagaaaatacagtgccagaggaacctgagagaatcaggaattgatatcccagggtcctctgaacatgggaaatggtatttgagggaccatagtatcagtgttttaagtgggggaggagggtagaaatacttttttcttttcagcataaagaaatatacaagcaggctgcgtgcagtgtctcatgcctgtaatcccaccattttgggagggcaaggcgggcagattccttgagctgaggagtttgagactagcctgggcagcatggcaaaacctcgtctctacaaaaaatgcaaaagttatctaggggtgatggcacatgcctgtggtcccagctactcatgaggctgaggtgggaggatcccttgagcatgggaggtcgaggccgcagtgaactgagatcttgccactgcactccagcctgggctgggtgacagattgagaccctgtttcaagaaacaaaaaatacacaagcaaatgaaaattattttcttcacattcaaaatggcaaaatccatcccttcattagtttttgttagtgaaattgctggtggacattgagtagaagaagaaagctgtctcacaaacatttccagctttttaactgcctctgtgagaaacaatgcctgcaagaaatagctgttggtgtctgtactggcagcaaccaccactggatgaaggtgcttattgcatctcattctttggatctcatttttacccataggcctctggggcaccatattaaaattccagaggccattcctggccttgtttcataccttatgggaaatgacgcaggttatatggtatggatctataggtgtaaagactgggtagcaatggctggattggccgtaccattctaccacttttttctttgaaaaaggtggcttatgaactttgttagaaatgccctcaattggcctttcccgttgtagctgctggagactgactgtgtctgaaaggagggtctcttgatgctgacagggaaaagctgatcagcacctctgtgtcctagaaggggaacttccagaaagggggcatagaagaaggtattattagtatttattgaatgctttcatggggccaggtactgtgctgggggctagcaccttcccttgctagtaggtaaaaacccagctgtaattttaaaggaattgctatgctgagatacacttttattgaagaccttgcatagttcaaataacgtgaaaagtattgatggtcaaaaatattttgtgtaggaatcaatgccaccaaaatgttagtgataaccgtacaaacaaattgaaacaaaactgagacaggattcagataattctgacaaataaagaaaaagcagccacaacactgaccccccaacatgttcttaattccctttggggctgtttctagaaaaggcatatttcaccctgaatgctaaatttagttctctactctgttagtttagacctgccttccatcaaaatattgttgtcaaagatttatgtaacttgtgatttgagccttgtatgaaattctttcaagttttgattactaaacagttatgtgtcattaatctctccattgaaaattaaaatggcacaagaagcaaaagaagaaaaaagacctgtaacagaggagaatgtggtaatagaaagccaggtgccacatttcattatgagtgaagtgtaccctcttgacttcaagagaaagctttgccactttgaaaagataattttaagccctgaccggtgagctaataaaaataatcataaaaaaagaacgccctatctcttgtctactcacaagtctgtttttgaactttcaggaggtatgactttaatggtaatttgttgacagattagtttcagtgattgccaagagtttgtttttgcagaactggcaggtcctatctgctctctgaaggcaaggaacctactttgctgttttgcaatggcttgcgtttatcaacaactagtgctgagcaggcagaattggaatgtttatataatgtaaacctatagctcgcctgatggagtctagtgtacttttaggtagtgcatagattacttgataaaaagggttacaaggtgactgcttttatgacaaagaagaatagcaatataaatgccagtggtacactgagccacaagaaggaagtttatgtagggaattgaaccccatgttagaaagtttcttttcatcactttgtctttgaactcaaatctattgtaattatgaagtgttacttgtaacattccagagaccctttgctaaatactgtgtttgatttgattcataaaaatagagccacattatctcccctcccctgccgacaagaaaatgtcatgaagagtttcccatactgaccttgtctcagctttgttgcaagtgggctcataagtgagctccactagaaaacagctgcaatttatttctttgatcatttgcatattttcatttaactttttctttttttttttttttttttttttggagatggggtctagctcggtcacccaggttagagtacagagagtacagggttgcgatcatggcttacatggcttactgaaggctttacctccccgggctcaagcgattctcccaccatcaggcttctgagttgctgggacggcaggccagctgttttttttttgttgttgtttttctttttgttttcctgtagagatatgggtctcactatattgcctaggctggtcttgaactcctgggctcaagcgatcctcctgcctcagcctcccaaagtgccaggattacagacatgtgccaccacacccagcctcatttaactattatttattgagcctccgtatgtggaagaaaatgggggtggagggggaactgatatgttaggtgctaggaaaacatgggagaataacttagagtttacttagctagatcccgaagaataactatggaggcagtaggaagatgggaagatggtgaaaaggcagattgggttcggcttatgggagggttctaagtagagaagaaagatcatataagaggtggtgtattaaaagtaaatgagaaggttgaacctagctggcttggaagggaagaaatcccggagagatgagtggccatgacagcgctactgcagttggtctgacatttagtaatcggccactaacgtggccccagtgaattgagggcaccctgttgttgatccctcctggcttcttgaacatctcctcctccatctgaatcccttagtgaagtctaggttccatcagggaatgggggccgggatcaccttcctcattacctggtacttccacagcacacagcacagtacctgatgtagggcagttctgtgacagactatttatgaatgagtgacacagaaagagaaaggaaggactggataagaagagattgttgaggggagtgttgggaaaaacaggaccttttgaattatgaggtatgcaaataccaaggagtgggagttaccaatgatgagtcaggatgttccatcttaatgactggcaaaatgggggcaccaatgaaacagaaagagagaggcatggggaagaacctgaactcctttcttagctgccactaggaggttaagaacttataataaaggatgggcttattttgaaaaagtcattttttaaaaagacttctacagaaagacattctgtgtagctaaaactcactattttgattgcatatgtttatttgtgttaaaattatcaagtattttccatttagcctttgacagttactaatgaatacatcttccaaaagtcacatgggaagtactgataaaatgcttgtgttcccattgatcatggaatgggcttatctctttgagagaacaaaactatgaagttagatctttgataaagtctttgttccatattgacacaagcttcttataatgactttgtttttaaggtggtgggggagcgtatgttgtgtttcttttgttggaaaagtacaatgtgcaattattaaacagctggtgctattggaagactcatttaggaggtatagattaaactgcctggggacataaaggcccagtcttctttgtgtatttaaatttagccatgcccagagagggaaggcaggaagcaagctctgtttttctctttagtccttccatgtggacattttgcaggatcttctgcataaactgatagtgcagataccaactgtggaggatattggatttttttttaaggttggtaaccctgtgttccccttgaattaactattttatccctattgttagacagctcctttttgactgtaccaaaaataaaatgaacttcctaacacatattaatcttcagcaaagtttcttcaggtagaccattaatttcagaatttattatccacacaaacacaactgagttgtcagtatcacagccacctattaaaagagacaaagcagctggtggctcacgcctgtaatcccctttggagggcgaggtgggcggatcacctgaggtcaggagttcgagaccagcctagccaacatggcgaaaccccatctctactgaaagtacaaaaattagccgggcgtgttggcatccacctgtgatcccagctactactcaggaggctgaggcaggagaatcacttgaacctgggaggcagaggttgcagtgagccgagattgtgccactgcactccagcctgggctacaagagcgagagtccatctcaaaaaaaaaaaaggaaaaaaaaaataaagaaaaaaagaggcaaagcatccactgatcctacattcgtgtttttatcacattaccttgtctcatcttcaacttcggtctctccacattgaagggaaggtgacatgatgtcttcttagtcattcaaatccaataacttttaatctgaaggttaagtagtgagatataaactaagagatgataatatcaattttatgttcactgaagggcacaatatacctcttcctagtagagggaaaattgtgcgtaaaatgtcttttgcttttcaacagcagagtcatgcctctcagagccaaaggaaggaatatttttggaaaaaattaacaaaataagaggtagcatcctaaagcagggcaaaagtgactttttattattataattattaagtgttaatttttcagggctgcatgatacgaagtagttctctttatagcctcctgtattcactcttgatataccctttacaaactcaacaaccttttacaaggttaaagactgggagagaatgacataatgctctttctttcctgactatttttagtcctaatgtgtatgataaataatactgtgataatattgcttacctttcctcatttttttcttcctatggatgatatttccatttcaactcagtaggaattcaacatccaaaagcattaagtgaaaatgcatttacagtgtgtatttttatgattatattctgatttttctcattcaatttctatttcttataaacacaaagttttgtgctgtgtgctatatgtatatatcacatgtatttatatagacttactgtatcattagtagtttttttgttttttgagatggagtttcactcttgtcgcccaggctggagtgcaatggtgcgatctcagctcactgcagcctttgcctcccaggttcaagtgattctcctgcctcagcttccctagtagctgggatttcagatgtgcgccaccatgcccacaattttgtatttttagtagagacagggtttcaccatgttgtccaagctggtctcaaactcctgacctcaggtgatccacccgcctcagcctcccaaagtgctgggattataggtgtaagccaccacccccagcccattaataggttcttgggacaggaaaagcatcacgcataagctgagtatgtgacattcacagttataattatcaagattatattctgtaatgtagtgattcacaattgtaattgtcaagattgcattctgtacataattttaaacttgtctcagctgttcattcagtaccttctttgagtaggggctaggtataaggcactataactctgcagactacaccaggaatcagcaaactggcccttgggccagatccagcctgccacctagtaaataaaagttctgttgaaacacagccacacccgcttgcctactgttgcctataactgcgttcatgctgcagcagcagaggtgagttgttgcaacagagattgtgtggctcacaaagcctaagatattaatctgacactctgcagaaagtttgtcaatctctggattaatgaatggcagatgtgacaagatttgccttctacagacttctacccttactttacagtgacaaaactgaggaagcattcgtcactcttttctaaattctctctgaaaaatatctatttatttatactatatatatttgtttgtttgtttgttcgtttgagacggagtcttgctctgttgccaggctggagtacagtggccctgtctcagctcactgcaacctccacctcccgggttcaagagattctcctgtctcagcctcccaagtagctgggactacaggcttgcgccaccacacccagctaatttttgtatttttagtagaaacggagtttcaccatgttggccaggatggtctcgatctcttgacctcgtgatccgcctgcctcggcttcccaaagtgctgggattacaggcgtgagccaccgcacctggccataggtatactattgtttaagactttgtttcacaatttctggagtggcaaaattacttctaattgtcatcattcctctagagttcctttctaatcattcagctgacagcatcttacaagataaaagttttgacgttattggtggttaaaagaatcttcagccagtctagtaaggaaatggaggttggactcacttagtgagtcactcacagagcagacagatgtccttggccctggctccatgccaaagaaaattaacataaaaacataacctatcttatgttcatagtcctatagttggctagaggatataaaaatatattattctcagtatcaccctgcattcaaagatttcataatttagtaaaggtgcagtaagacataaacagataacatgaaaagttcttacaatttttaaagcaaattgaagataaactgtagaagagatgtatatgactaattgataggtgagtgatttaggtaataaatcttcagtagccaggagaggatgaatctgtgtctatgttggtgggattctagaccttggtgaagttaggaaagagtctcagtatgtgcacatctgctgatttgttttaacctcttccatcaggagataatggatggtaagtatacactgaactatatgggtttggcttctgacttagagattttaaaggccccaaagctgtgtcttttccattttgccattttaaattttgagacaagtaagtttggatttgcacttggaaagactagaggcacatggtgaggagaggtcttcttataccatactgtagcatctgagcttattggtctccaggaaatggcctgggactatctgtctacccaggtgcaaagttgattgtacgatttccagagattagatgtgggctgacaagtgtgataatttagttggtgttgtccatatttcacaaacgtttatattgaattttagctaatttacctctattgataatggagctgaaataactgaaaccataatacctaatttaaaaatagttgccaaattcgaaggcatttgctcaatttagttgtttatgaactgacaggatttctgaagagatggtgttgcccttgtattttctcccttccaacttttcttctttcccttcttactttcttgattctgtttttaagtttgtaattggatcacttatatctcacaatttgcaaaaatctgtactggcatagttcatgtttctaatactttttttttttgagacggagtcgtggtctgtcatccagtctagagtgcaatggcttgatctcggctcactgcaacctctgcctcccgtgttcaagcaattcttgtgcctcagcctcctgagtagctgggattacaggctactgccaccacacctggctaatttttgtatttttagtagagatggggtttcatcatattggccaggctgatctggaactcctgacctcaggtgatccgcctgccttggcctcccaaagtgctaggattacaggcgtgagccaccacacccagcctctaataccatcatttttatgttttgcaggtttatggcccctcctttgtgaatttgatgaaacccaaataactttttccctgaaaagtgtgtttgtatgtgtaattttgcgattgcaatttcatctacaatatgccccccccaaaaaaaaaaacgttacacagctattctgtatgttaattagatttgccaaatgtttcaatcttttgacaaatactcttaggcttttctatgattagttgatgttaactatgttagtgacctgtctatctttaatttggaaaagggttcctcttttggaagaatgcttcccagtatgtccctggaataatttctcaggtatttaaaatgtagcactgtacacgccagctctgaagcaaactctggaaagtaaggtcatataaagcaatctgtaccaagagccatttcatgtctattgaaatgtaaacaccagatttacacactcttgaaattcttctaactacagaaccctataaaccagttgaaagatctttgactaaatgagcacagattacagtaagtgcacagacaaccccttatagggctgaaggcagtgtaaatttgtacaccctattctgagggtattttggcattggacatcaagaggcttaaaacagccacaccctttgaatcagggatacaattttactgagtggctctatggcagtcagcagtggttctcaaacttttatgtgcgtgagcatcatctgaagggcttttttgtttgtttgtttgtttttgagacagtcttgctcttgttgcccaggctggagtgcaatggcgtgatctcagcttaccacaacctccgcctcccaggttcaagtgattctcctgcctcagcctctcaagtagctaggattacaggcatgcaccacctcgccgggctaattttttatttttagtagagacagggtttctccatgttggtcaggctggtctcgaagtcccaacctcaggtgatcttcccacctcggcctcccaaagtgctgggattacagacgtgagccaccacgccaggcgctggagggcttcttaaaacatagattactggacccacccctaaagtactttattctgtagatctggggcagggcctccaaatttgcatatctatttctagctcttctttgctgccagttgaagaaccactggcagagtttaacagcatagactgtggagtcagtatgtttggcctgagtcatggctctgccacttgctagttgggtgactgtgtaagtttctctgtgcctcagtttatatatccatcaaacggaaataattttagcatttaatagtctaaataaaatgtatcatgcttggaagtttgcacaccacatggtaaattgtctgcaaacattagcttttgggttttttttgttttgttttgtttttgagacagggtgttactctgtcgcccagactgcagtgcagtggggccatctcggctcactgcaacctccgcctcctgggttcaagcgattctcctccctcagcctcctgagtagctgggattgcaggctcgcgccactattgcccagctaatgtttttttgtatttttagtagagacaggttttcaccatgttggccaggctggtcttgaactccagacctcaaatgatccacccgcctcggcctcccaaagtgctgggattacaggcatgagcctccatgcatggccaacttttggtattcttatcatcatcaccaccaccgccatgatcatcatcaccaggaatttaacctaccgaaataatgtgaggcatgcagaaagatttatgcctaaggatgttcattgtaatggtatttacaatatgaaaaattaaatgcaccctaaatctctgaccttagaagaaggttaaaaaatgctaacatataagtttgatataatattaattatatacccattaaaatgtagaacatttaattactttaaaaattatcataatgtaatgattgctgggggaaaaacctaaaagcaacatgctgtcaatggttttttttgggggggtctgttaatgggattatagtttattttatatacattaagccaggcatggcggctcatgcctgtaattcctgcactttgggaggctaaggctggaagatcacctgagctcaggagttcgagatcagtctgggcagcttagacctcgtatctactaaaaattaagaaaaacaacaacaacaacaaacttagctgggcatggcggcacttgcctgtagtcccagctactcaggaggctgaggtgggagaatcacttgagccccaggaggctgagactgcagtgagccatgactggtgacagcaagaccctgtctctactaaaaaaaaaaaaaaaagaatatatacatatacacacacacacacacacacacacacacacacacatatatatagtttacacttttctgtatatccccaaatttctacaataacatgtattgcctttataataaaaatgaacagttatttttaatttaattcacattcacactgttggaaaactcttgtgagatatataaaaatgatatatataaatggcagagaatacctgcaccttgaacaagatttattttttgcataggaataagggaatacaatttgtgcaggtacaaggattttctcccataatgtctttaagttttccgctaccacttagctgctccctggtgttatctctccacagggagatctctgcctcacttctaggtgcttccaccatcaaatttgacaaccactactcattatctaacattttgtgacaaaaatcactttcctgtcaataaaaagagtatggatttttaaaaaaccacatttgttttctttttctttttttttcttttttttcttttttttgagatggagtctcgctctgtcacccaggctggagtgcagtggcgcgatctcggctcactgcaagctctgcctcccaggttcacgccattctcctgcctcagcctcctgagtagctgggactacaggcacccaccaccatgcctggctaatttttttgtatttttttagtagagatagggtttcaccatgttagccaggatagtcttgatctcctgacctcatcatccgtcctcctcagcctctcaaagtgttgggattacaggcgtgagccaccgcgcccggccacatttgttttctttaaatttccaccactgctccccacttctaagtttcttcccagtctgtgtgggcttaatcatgtcgcatgtccacagtcattacagatacacttcgttgcttaccccatttcatgttgtttctgctagagactgatttaaactgccctggggagctggaaagggcaggaggaatattttattggaggcattttggaatgccactgatgagagttgaaaacccacccaccagcgcctacactcgatgagtgaagttgggcaagttttgccatctctcacagcctcacttttctcatctgtaaaacagggcaatagagataacttcctgagagggtcgatgtgatgaatatgctaaataatttattgaccttggcacaatagccaaccctttaaaacgtgctccttactttattattgtcctttcttagaatcttttgaagactgggaaaagccatggttgaggtcttggggacccaaaggtggaggtcaggagggaatcaagttgttcttagaaccgttccattttttagcccacctcatccgctttatattaaaatccaatcatcttgggtcattgtagatatggctgttggagacctccaaggagaacccttctccatggaagtacagttctgtctttcctcattgaggcgataaatggaactcagtacgaattcttatttgacaggcaaaccttcatttagaaactgacctctacttggagactgcagggaaccggttcttgtgggcaattagtgccccaatttaccattttagaaaagaaaacacatatcctaatcaatacagaatttctccaccatacctactagcaacgttactgaaggggccccacacacaaatgttttaaatttagacgcagagttaaggacacagtttgcctccagaatctgaattgaatcagggttttatttcagataaaatctttggggctcataacttaaaaaacacaacttttactggcattacgcaatttgccacgggtcatttagcaaaatgtttgtatatgtaagcccaggttcttctttttaaaaaaggaagggtggagggcggggattggattttgctgaaatccaggtggcgtttcagtttatatttaattttaattggaaatcaaatacaggcaagggagaaaaaaatctaccatgttttctttactaagagtatcctttggggagaggaaggacactgccagccagattttaagaagcagcttttttattggcatgtctatttttttttcttgctaaattcttgtgcctgcatttttttttaaaacatctacgattttacacgtggcaaagactttcatgtctcaatgttccttgctgccgtctttctatattttccatgggattagtacctagaaccaagacagcaaataattatatactacatataatcagtagcttcctaggctgttacctggtgagtctcttttttaggttctagtctgaaataatacatgattcttgtggcccgtgttgatttctggaaggctgaggaagtttctaaagaatcaagaacaagaaaaacaaaaaggtgggttttttttttaagcaagaactttagaaggtcttccgatttctgagtataagtagctgtaggtgcatcttgtaaaactcccataaaatattggcagagagactatggcataattagagaatggttgctgagtgtgctggaagaggtggcgagacagtcacttcactccaccagtgcctacaaaatatcccatgtgccagagctgagtgaaatcctcagcactggctctgtgtaatgcttgggtgcaattcagatgttttcaattggaaattgaatagcaaataattttgaattttcaacggcacaattaatgacacattcgttgtagaaaaattagaagatgcaactaagaaagcaaacagagaaaaaagctatatcgcttgcaatcctgtttaatggaggtaacaactgttaacatttcagtggataccctgttttccctttcttgtaaaaatcatgtcttctcattttatgtatttgtattctcattgccaccatcgaacattatagatgagaaaagagctagcagtaatgttgctgatgagtgagaattgtgagggttaattctcttacatggtgtttcacattttcatcttaattttaatttcacattttgtgtgtttacagttttaagggaaaattcatgttcttggtttcaagtggcatcattcatgggctaatgtttttctaactcctcccctcttcatcttcttccagctgtgccaggtaattccatatttaggcacaattcttaaacagttattgttaagacttgtgtagtggctcacacctgtaatcccagcactttgagaggccgaggcaggtggatcacttgaactcaggagttcaaaaccctgtctctactaaaaatacaaaaaaattagctgggcgtggtggcaggcacctgtaatcccagctactcgggaggctgaggcaggagaatcgcttgaacccgggaggcggaggttgcagtgagctgacgttgtgctactcagcctgggtgacagaaagtgactctgtctcaaaaaaaaaaaaaaaaaaaagattgttaagaggaaacttccaacatggtaaaataggtaggccatcctagtttcaataaatgagtatatttcttccttttattgaaaatcctgaacatcttgtcaatttttttttttttttttttagacaggagtgcctcctaggttcaaatgattctcatgccttagcctctcaagtagctgggattacaggcatgcaccaccacacccagataatttttgttttttttttgtttgtttgttttttgtttttgagttggagtctcgctctgtcgcccaggctgcagtgcagtggtgcgatcttggctcactgcaagctccgcctcccaggttcctgccattctcctgcttcagcctcccaagtagctgggactacaggcgcctgccaccttgcctggctaatttttttgtatttttagtagagacagggtttcaccatgttagccaggatggtctcgatctcctgacctcgtgatccgcctgcctcggcctcccaaagtgctgggattacaggcttgagacaccgcacccggccaatttttgtatttttagtagaggcaaggtgtcaccacattgaccaggctggtctcaagctcctggcctcaagtgatccacctgccttggcctcccaaatgcagtgattacaggcatgagtgagccactgcacccagctgtcaaagatgtttatgggttagaaattactggccgggcgcgatggctcacgcctctcatcccagcactttgagagaccgaagcgggtggattacgaggtcaggagactgagaccatcttggccaacatggtgaaaccccgcctctactaaaatacaaacaaattagccaggtgtggtggtacgtgcctgtaatcccagctacttgggagactgaggcaggggaattgcttgaacccgggaggcggaggttgcagggagctgagatcgcgccactgcattccagcctggtgacagagcaagactctctcaaaaaaaaaaaaaaaaagactgactgggtgtggtggctcacacctgtaaatcccagcactttgggaggccgaggcaggatgatttcttgaacccaggagttcaagaccagcctgggcaacatagcgagacctcatctttactaaaaataaaaaatagccaggtgtggtggcacatgcctgtggtcccagatactaggaaggctgagatgaaaggtgagcctgggaggtcaaggctgcagtgaaccatgatcgcaccactgccctccagcttgggcaacagagcgagaccctttctcaaaaaaaaaaaaaaaagaaaaagaaagaaagaaaagaaaataaactatcagtattattagtagtaagagtagtagaagtaataataatagcaatggaaaatttatggaaagcctctgctctccatactcatgcttagtactgtacctgtgttagtacagttccttctcacaagcaccctgtgagctaagtacttttaaaatacttgttctacacaggaagaaacttaattagctgcccacgctcgttcacacagcttacgactggacaagcccagatttcaccctacatctgcccgactccagagcctgagctcttcatcagagctctcaagcatctcttactgtgtttgtttattgtggtgatgatcagttcattctgaaaggatttctcccattttgcctgctctccttccccattgagtttcctgaaatgttttgtcattcagaatcattccacttcaacccaacttttcttgctgagttcagaaagcaaatactaagtattcccatagacagcagcttttccatttccaccctctcctattttcagatggagcccttatttgtagcagatgtacctaattttactcttaagcaactgcgccttgtaacttaggttggtttcatttcatttcaacgggagagagtcctgcttcacacctgttgcagtgtgtccttccagtgaacacccaagcctggcaccgtcagaccgaagttagcctgattccatctgtttctaaaacactttgattggaaggcctttgttttctttcttcctttttttcatttgtttttgtttttgagacaagccttgctctgttgcccaggctggagtgcagtggcacgatctcggctcactgcaacctccgcctcccaggttccattgatcctcttgcctcaaactccttagtagctgggactacaggcgcccaccaccacacccggctaattttttgtatttttagtagagatggggtttcacgatgttggccaggctggtcttgaactcctgacctcaagctgtctgcgcacatcagcctcccaaagtgctgggattataggcgtgagccaccgcacccgccccccggctcttttttttttttttttttttttttttgagatagcctcttgctctgttgccctggctggagtagtacagtagtccaatcatagctcactgcagccttgaactcctgggctcaagcaatcctcccacccgagcctctcaagtaggtgaagctacaggcacatgccaccaggcccagccagcaggcctttgttttatccagaaatagcagaaattcggcagtgcctctggtggtgacgtttgcagcatgctataggcaataaagctaaggcattagggtcctgaaggatctgaaccatacctccagcacagaaaacttttctgattgctgtctcctttgactggtcagggggatggaagtattgcttctaagaacgcggaaatctgggtttattaataaggctgcacataataaattgcaagtaagtagtggtggttgcaactggtattttatagacaactgaaaagcagctattttgagtttgacatggtcccctttattgcccttgtgtttgggaacatggaacccgaagacttaaactgtagactttctccaggtgccccaaacagctgtcacacactgacaggatgagggaaataccttctgtgttttcttaggattatgtaacaggcttgaaccctattctgaccaacaaaaatgtatttggataaaatatttctggtaccttgtgtttcttgaggaaattattcacccagcttcactgattaatgagttagtccttttgaagttgccacagttactttcgttattttaataactggggagagtggattattttgcttcaagagtgattagctctgttgagaaaatgtcctttgctccctgagtggtattttgtgttcctgtgtctgtgtctcacctgctttgctcacatagaacactgctccagtcaacaaagaacaattgcttagcacgataaataaaagatagtactcacaaacgaggtatgatgggacttagggtaggagttttaaagattcataacctacaagtcaaactatgtacatttccctagcagcaaaagcatatatttgtttccggtttaggaaagtctttacctttcctggcttattttatgaagtcagctgattacccggagtccgtgagtccttgctttaccatgaaatcactaacatcttagttggtcaccattctggatcagcacaaaagcccaactaactaggctacagaggatcatttttagtctgtctttatctctctctcacctttgaaaaacaagctgatgggtctgcttttgaaaagaacagtggaaaaggctgaaaagcaatcttatttgaagaaaagtcatcaattgaaaatctcccagttttggggctgctattggagaggcagggagcctccattccttgaaggtgtcatcgtggccacatacgtgttgtcagtgcaaaaaagagacacacttgatgggccaaagaagtaagtcaagctcttttgattcccagaatgagaaatgaagtacatgcatgtttctgggtggcttacatatttgcccctcaagctactttgaaagtccaaaataggccgggtgcggtggctcaagcctgtaatcccagcactttgggaggccaaggcggatggatcacgaggtcaggagttcgagaccagcctggccaatatagtgaaacctcgtctctactgaaaacacaaaaaattagcgaggcgtggtggcaggcgcttgtaatcccagctactggggaggctgaggcaggagaatggcttgaacccgggggcggaggttgcagtgagctgagatcatggcgctgctctccagtctgggcaacaagagcgagactccatctcaaaaaaaaaaaaaaacatttatgtactccaacttggtcatacctgcaatctgctgtgtccttgattcttctacccttctcttcctaccctggggtatattggggtgtgtgtgtgtgtgtgtgtgtgtgtgtgtgtgtgtgtgtgtgtgtgtgtatgcatgtgcatacattgtgtattcgctttgctccttattccttatctgtagagtcatagcatttctaaaattccttagatgatccagactcacattttatggatgaagaaactaagctcagacagaataaaggctttgtcctttgattaacttttgcatggatacccctgatgtattcagaaacagtcttgtggggtatgatgtggacccttccatgatctgtgaagatggatgaaatcaggaattttatttctatggtactgacactattaacaacaacaattcatacatagggtatgtgtgtattactatgtacatgtatgtctgtgttttcctggtttcctttgtttgtttgtttgtttttgagacaggatcttgccgtgttgcccaggctggagtgcagtggctatttagaggcagctgggctcaagcaaatctcctgcctcaccctccccagtagctgggactacaggtgcatgccgctgcacccagcttactcttaaattctcactatcagttattgggaagtgggtttttcccccctccacagtaatctttctacaataaggatctgtaaactctaaattttcttttaagtagtaaaaaaattgtttttggctttggaggctgttctttctgtcacaaatactccatatgaaagcagctatagatcttacataaataatggatctgtctgtgttctagtaaaactttacttacaaaaacagaggactagggcagtagtttgcaaaacccttcctagaccatgcatagatgggtattttttctgtgtagagggtggtaaagttcccctgctaatcacatgatactgtaagattggtaactttattttgtcactttcttcttcaacaacaattacaacaaaaacttccccatttcatccttcccaccatggttggtttcccaactcccattccttaaagcttccttcattgtggttttcctgatgacttcaagcccatgttttcttgaatgctgttggaaagaggcttagacttcccagaatatgccagcaatccctggtgagatgacttcagccctcatctccacatctaattgttatcagccatgcaggagataacctcggtaattccttactagatattcatagtcttcatgaactggcctattgtcacccacacccccaccctcactttaaagttgcctttcactgaatttctaactggaatgtgtagcatcttaactttggcctaggccttctgcttctccatgtctaatgtatggttttactaatgtatgacagctaatatgttgcatcagaagatcatgctatcctatgcttgcaggactttttatgcagggcaagaactaaggcaaaaagtgtgtgtgtgtgtgtgtgtgtgtgtgtgtgtgtgtgtgtgaattttttcttttttttctaaattgaggcagttcccattctagaaattttgtgaatagagtcaggctgattgggtagtgatggtgaggagaagagaatggagactggggttgagacagtctcatgaaatatcttactggctgattattcctatccaactatgatgatttttcagaaatctttagggatactgactcattttcttaggcaatagatgagaaactttcagtagagggggaaaaaaggtgacctctggaccaatagggaaaaaaaagcaatctctcaagtttgcaaaatgcatgggctcttgcgaaaaatctgagaatgttgatagaggtttcagccagcctgagtgttgctgctgtaacttaccctgtgatttgaagcaagtcactcactctttgagcctctggatacgacttcatttctaagtttacttttgcctctgaaactgtatgttgcttctcctatcttaagtttctgagtaaactagaaatcagactcagtttgagacaattggcgcttcagtaattttgggggaaggtggtacctcacaaatcagtgggcagggcagccctttaaaaatggaattccaggcagctaacgaaatttcccagcaacaagtaaaaataccaacagtgaatccagaaggaagagggaaggaagatagaaggaaatcctcattttgaacacaggaccaatcaacaaggtgggatgcaaaactcttggtgagaaaacctaggattcggagtccctgccctcctgccttctgtcctggtgaccttaggcagttgcttagcctcagttttttcatctgtaaaataaggttaataataactgccctgcacacctcagaggagtattagaggaagcaagtgaagtgttataggtcaaaatgcctggtaagcaatgaaacactacataaatgtaggtgtcaccattattggatgcgattttcatttgctttacattctttgagactctcacatattttgaaacccgatggattccctcgagacccttcatgttgttgtaggactgcagggatttagttccttgggatttctgttgagtaattctgcacataaccaacagggcattaaaaagcaggcatattctatttttccaagatttttgttcttttcctttagtgtaatgtatcagaaacttttcattttataacaaaaggcactgtttgtgaattttcttgtattaaaaaaaaagtaatggaggactaccctcgagcttccagaaaacaaaagccacgatatccatgattaagcaaaggaggctacatgagatttggcaggaaggatagcaggttgggttgttacttatcaaaggaatatttgctgttggccttagtataataatgttaatgagattattaggtgggggagatttttaataaataattgataaggattagaaagtgccttttctgcaaataaacttcagaataattaatattcatggactctgtttgtcaacagaaaaatgtaaatgaagagccggtcccatcaccagacacacgtcctgaaggacatctgtaagatagggttaaagatagaaaaggtgaatgcagaggcctggcccagaccccagccctgtgtgtcaatacaacttttcacgttgttacatacacattttccagtctgtgtctccctctgaaagaaaccctgaaattcaggttgctaatagattgttggttgcaagtatgaaggacagaggaggtaagagaggaggcaacttgctaatgcaaaagcagtgtactgaaagtcacttttatttcttatttataatctacatgcacactctggataatagatgacactgctcattcagtactttaacttcaaagcagagagaagccatggatgacagagccgggagcgggaatacaaaggtactaacaacaagaggaaaaatgcctgtttacgggattgcatttgttagcacgctctcttcagatattgttcccccaggaatagcgaaaatatgtgcagcgcgaacaatgatttaacatctgaaaatggtacttaaagagtttctgtctggtagtaatgtgatggaggcttctgaagggaacctggggacttcatttcttctatttatctatatgtctctctggttttagtgagcggtaattgcatatttaacccctcaaatagctttaaccctcacgatgccaactttttaccctgtataaaatgtacttttatcccagcaaaggcagactcagaaattccctagccaaaaaattatttaaattaaaaaaaaaaaaaagtgagtgtgtatttgtatgaatggatggaaggctggatggatggatggctgaaaagaagttatagcagcattttgcagttagttttaggtgaagaatcatgcccgccttcctggtttggaagaagaccagttaaagtacagatattataaagagtgaaaactcaaacaaaaagaagaaaagaaagacggactaaaacaactgtgtttttattttgaattcattgtggctggagctcagagaggaaagagacggccccatggaaggaagttgtagatggacgctgaatcaagagtataaatttgccgcatgcctcagcaatatggttttctcaattagtggtcgttctgggaggcctgcttaacagcttatgcgaaacaaatattaacacaaattgtataattacatcaaaatcccaaattcctcaaagatgcaaaatggttttcagctaagaatacgcgagcaataaaacatcctatagtcaaaagaagcacactccaaggaaaccatgaagactggatccgagcgactttcacagtttattttcatggtatttaaattatgataccagtgggtatttttaattagtgtgcacttgtctacataagccatgttggcaaatttgactcattcatacagtagttgctgtaaaagaggccagcacagcctgcaggaattaaaattaaaagtttctgcaagctgttgtcgacatgaccatatctcattaactttaaaaatggagattatttgcctgaaagcttgatttgactagcagtaatcaaatattaggctcaacggagtgagggcgtggggggagcgtcattgttgtgatatataccgctaagtgttttgcagttcactttaaatagcaatataagatttttgttttgacaaaagggataggaaagagaaacacagacatatggccttgaaagtattattaggacagttttattttagattaagactcattatttactaagtttgctgaagataaatacgattgtgctgattaccagttctcctctcattaagcaggctgattaattatctggagtagctccccctgcttgatcaaagtttaagtattggaaatggggcctatctcgtgattatcttttcttttttcaatgctaattggcatgaaacttaaatttgtacattcgattcatcccatcgttttaactaaatatgatggaggttgcaaaattgtgcgtaaaatgaaccaaaatagaagagccttcttcttatctactctttaaatagcttgttatttgaattacatatctgagcaaaaaatcttttttttttttttttgccagtaattttttagccagtaattaaggagcctaatgttgaaaacctaaagtaactgaaatatggtagacatgggctcattttagaccctgttttatattttctcaggcacaaaagaacatttctaatgcatcaggataaactataagatgaagatacatttgcggggggcggtgggggaggaaggaaagataaaaggtgcagttaaacaaaagccagaagataaagtcttacacctttttatgtctttgaactgagaacatgctctgcattttactaaaggaacatgaggctagaatgtaagtaactggtttttgcattaggctctccctggaggtagcagaaaaatatcatgtccctgcatgaaatgtgaatgtgaaatctaccagaaagaaatatttatgaccattttatgcttgattaggcttggatgacatctgttagaagacagggactggacaaagagagagacgctcgggggcaaatgttaacggagttgtttagaagacgctagggcagaggcgtccatttactgccaggcaaaacacaggaattgtgttagcaagagtgcagctgacaggcgtccactgtgatggagacactgtaaactgactcgatgaaatagtcaaatacagctgttgatagtcacggcaccacctcagtttatgagcaggtatctatgcttaaccctgatccagtaacttccaggatgctggcaccttaatcaagttacataaatgtgactcagctgtaaaaagagctcatcttcactttttcaagtgagttttacgctctcctcccatgcgggctcagcagcactgagaaactcttctctatttctctgtgaaaggagaagtaattaaatcgcaaagttacctctgtacccatctataacctgtctctttccttatcttaagtttcccctgtttaaaaaaagaaaaatctaggccccttggttctatagaagtacttcatcactttaaacagtgcaaatgtttgcctaaaaacgggggaaaaaagttttccagcactggcaaacattttatcaattgttaaacatttcactgttcaagtaagtgctgtttgtctgaagaaatggctctaccaagagtggaggtatgagcagttatttcattctggttcttttcccagcttcttttcctgtaaattttctgtctggaatgctgatgggaaatgttattttgtttttgtttgcagcagttctgttgttttgattttgtctgagtggtatggaaaacagtacgtcacttagagtgggtgttttgtctaccggccatttggccattgcacatatatttctcatacttattacatgatgacaagggaaccgacaaggcacaattttccagttgaatttttctttccagtttaataatagtgaaaaaagaaaacaaagttaatagatttagcagtttgatggtactcatgatgtgatagctgactttgttttgttttttttttcttttaaactcattccttgtggttaaggaggtatttaggtaaaggtcagattaatgcatacatcagtttctataataaactgtatgtggttacagtgtttcacattttgcatagagttgcgaaattcggtaatttaagcaggaaaattcataaaaggataataaacaattttaacgtcattcctatgattagcctggggtactcttgccctggttttaggccacatgtaacaaacctctatcaataaatgcgtcttaattaaaattatttgaaatgaaatttggatgaaaacccagcatacaaatctcaaagaataacttaaggctgtttactggctcagtttggacatgctttatctgaaatcattctcagcatttgcaatgttaaggaacatattgcaggagtgtagaagttagctctacaagtaagtaatttttagtgtaatacaaaaatataaaatggaaaccatgattaatttttcagtttctctctgcaggtatctaatcattgtacccatggaccgccagaggctcccattaaagatttaaaatgcaagaggaaggtagaatccaaaagatgggatttgggattaaataatgtaaaataactgcagggcagtaatgaagtgaaagctattggtgcagtaagacatcctcttaagactttcttgggatccacttaaaatattgacactgacacacagtgtcagagatttgatataaataaaattatttgtaactgattaagttctaaaaccatgtttttcatctttccgacattagctttcaccaaataataataatcaataataataacaacatcaacaagaaactatcagaaaagctctctgaaaattcacacgtgctctcttacgctttaaatactgccctgttattaaaggattttgcctgcaatgttatactaatgtatgttgcttcttccttgaggattttagttatagatggggaaacgcaatggttgggggtcacctgtatatgtccagagtgattttcttcaaatcaagggaacttttataatctgaaagaaagggacatcaccgccttcgtatataaaagctgtcagtgcggtccagccgggcttctccaggctctgctgtactgtctttatcactttgctcagttccacataataacatcttcatctgagattgctgtggcacaggggaactgcatttgttgatcaaatttggctggataacactgtgatctcgtatcctgaagtgcggagatgtgcctggaatatgtaagtgcaaagctggcctcttgattgattgattctgcctgtcacagaacaagataaccggatcagtaaataccctgtgcacttcaacatcatctccacaatcaaaagtgagggcattacggggctggaaaaacactggagcatgatgggaatgcacacaattcagaaggatcgtcaagaacatatatatgtagacacacacacacagaaaataaaattctttgtgtgtgtttttgtttttgctttttgtttttttaagaaaaggacagcattaaaaaagtattttctgtgtgtttagaatgctttctggttgtaaaagtagtttattttgcagcagtcatcttggaggtgttcagcatttatcataaaaagttgttattcaagttttgtttacagaagagatttagaatgcagattagggaaacagagctggagaagaggccagtagtggtctcaagcacaaaaggagcttgcacccaagagttgctcctattaaaataaacaagaagtttaaacagatgggccaaacacatgtaaacaagttgtttaaactttttactaaattcccagggagtgcctttcaaaattagcatgggttgccaaatttggtgtttaattacacagaaagttcaagaaaagtttaaagaatggaactgcgtgaatctttggaagatgggggccgtaacaggtctccaggtgtcattaatgattcatggctctgtgatggtcacgctagcggctcttgtcaccccccacttgcttgtgttcctctcatgtacttgtcttttcctctcataagactgtaagctccttgaaggcaagggctgccttttcttcctgtgtctgtgcccccattttcctggaagactccctgcacatactacacagaaaatggcaagtgggccaaggaggcgctaagtattgggctgtcttcttaagtgtttctcagagtgattgttacttcccaagatattattggtcaccagaatttggctaatgttttaacctggagtcattcttttggggaacttgttttcttaatgtcaagcaatccagtgagaatgtttagccttctgtcttcatacaaagtgaaagattgagttcagttgctcaaacgtggtgcttctgttaccaccagcaacacagttacttgatgatcacgttgcttctcattctacaacctggactggtggctgatggagcctgttgcctgcctcacctatgaattttgcacagacctccaagtggttcgtggcatgccatgtggcattctggttgtctcggatgcctctgggtgggtgatgtctagaccattctggccatattttttctttttttgttttgtttggcttaaatcgacacctgtccccctcctagtttgcctccatggaccacatggcaaatttaaggcaaggcaaggtggggtttagaaccagccattaagacaagaaacttctgtcttcgaagaaatttctcccatggaaggaaggtatacattagttaaaacaaacatttcaatagaaatttttatatagcgaaaccagctctcacacctaagaaaaaattattaccacttttgaaatgtctggttagtcctttgtgactgacttgttttttattcgaaatgattaaaaatgccttttggcagaattggtctccttaattttttgaatataaagaaagcttaaatgaggtaaacgttcattaaacacaaaaacattcgtgagctgctgatgattttagagaagtcattctgggaaacaggttttgatttttttttttttttttttttacaaaaaaatagctttcaatttggtaaaagctattcctagtaacgttttataaaatcatcttcttttcagggtgtgttttatttcctttccatccctttcaggaaagagaaagtgttttattggatatttttgtttcagtccttgtttccattatttttgccaaaattcatgggagttcactttccgtttaaatgcctgaaatattccttgaagaatctacattttgggatagctaggaaaaaggctatgtaaatttgtttaagggctatgtaaattggtttaaggaagaaaataacagttgtaactctggtcatcttaactactctcttttttctttataactttggaggcaaataatttcaagtataatgcgctggaatgtaggaagaggggggacattggatttgaagttcaaagaaagtttgctgttggttgtatgataaaacatttcttagtttccgaatgaagggagaaagtaagctttattcattgaaaaaatggtcaatagatttattataagaaaacataaaacaggtctctaaaaaatgtgtacacgtgaagagattagctacaagattttggtgaaaataatctttccccttttgtgaatagactttctataaaaatgtattagtctctgggaattaatattgggaagtttctgttcaaattccattcactgtttctagcaatgtgttttctcctttggagccaactgtgctttcattactttaaatagagcagtcgggaccgggcgctgtgcctcacgcctataatcccagcactttgcgaggccgaggcgggcagatcacgaggtcaggagatcgagaccatcctggctaacatggtgaaaacctgtctccactaaaaatacaaaaaattctccgggcgtggtggcgggcgcctgtagtcccagctactccggaggctgaggcaggagaatggcatgaacccgggaggcggagcttgcagtgagccgagattgcgccactgcactccagcctgggcgactgagcaagactctgtttcaaaaaaaaataaaaaataaaaataaataaataagtacagcagtctaagttgtaggtagcatccatgtttatttctagccctaacatggaagagaaaccatctgattatataggctactcattactttggaaccaactctgtttctttatttggggattggactgatggcatgggattgagctttcgtctgtgcagaattttacagacagactcatgttctgccaggcagacattcagcccttgatcttctcacagtcgccattgtgaaggagagcaagccctttctccacactctctgtggactactttctaacttttctattgtcatgggagaaaaatttaaaaaactgattaaaagggggcaagtgcatggcttctatgaaaactctaccgctctaaactgtgggactgcttgaaactgtttgttttggctggcctcggtggcaagactgacatatttatgtagcaagctcacatgtaatatttaacttggaattttacacataggaatgatgaactaaacagaatataaggttttgttgttgttgttgtttccctgcttgttctgaaatgtgagaaaatatcgagttgacaagtttcaacatggtcacctcttgcttggccagcacgattcataattagccaaattccttgataatgctgcagagattgggcactgagcagccgccacgtttgctatgcaagagagttaataaaatttttcagtgctggaggaaagcttatatacagtagtctgtttgtcctgtgtttccaccacctgagtcacagccaaaaaagcaattgtctactacatatttcaaacagatgctgaggggtagaaagggtgaccagaattcacagcaataaaatcccgctctctaagttcccttgaaggaagtgaactcataaaatttttgctgctgacttatttgtccactcctttgaagtatttaacattaatttcacctataaatcattggcacctcaatttttcattgaagtatcaggactgttaaagacataccctggatgtgcctggaaaaaaagatttgggaagcagatccactaatttaactgttattcacgtgcatcgttttggttgaaaccaatcctagttaccgtcaaagttctctaactcaaagtccgttttctttctagtttgtatttgtttgtgcatataattacagaaaacacattttagatggaacaccagcttgcttttttcagtttctttctgttgcattgatacatcttctaatggggaaagacatatgatggtacttggaaaaatgatgacagccgtaactggaataataaatgctaccgggaagattttatcaaatgtaaaaaataaaaatgaagagatcagccttcaactcaagtacccagtagctagactatcagtagacaaggtctcctacctcattaatctgtgggctttgattaattaacatatgtggataaaggggtactatgttccaaaggaagctttttgggttctttttccacatgttggcaagtaacaatgggtggggcttcaccagacacctgcccctgtctaagtttctgtgcctcctgtctctatcagtttgacttttgccactgaatgtaagttccaataaggtggggaccttgtttatgacgttctctgctatatccttggtgcttgacaaatagtaggaacccaatagatattggattggaatgggcagttattcaaaaagtcttaaccatcttaacattggatgtcttaatggtactggctcccccttcagtcagaataaaacttctaaaaggatcatatggacaatgcttatatcagtagagatgtatgaacaaaggctgtgggaagcagtggttaatcagaattctgggctagtatttagttgcatttgtcctagtattttggccaggtttcagttagctaagcatctcttataccctgtaatttagtatatggtttcagctctccaaataatggcttgctaatggtaaatgctgtttaactttctaattcagaggagctacctgttcagcagaattttaaaaaattgtaagtgatgattgaaaccaggttaaaaagcacttaaggtacatctggctgtatgcttggtgtctacttcgattggcctgtggctatcattattctttttgactctgcacataaactgcgggtagggatttttcctcaattggtccagaactgaaacttatctatactaagggagcttttcccttttgggtgaataatgcatccttcttttagttgctgtgatgtggaatgttggctcagtttctctccagtgccttcagttataggtgctcatcactgttgatttttatctatgtagtggttcttgtgacttccccattccctctaaggacatctgaatgtgttgttaagtgatgctaaaattataaccacttaacagatctctgtatccactgtttttgttcatcccactcatcaaaatttggttattctctgtaaagcacaactctgatggcatcattgtcttgctccctgtttcttaggaaattgagcttaaattctcttgcttgacatgcagggaatcaggtggattaaaagtggccacacattcttttccattcctttcttcaagaggtagagtctaagtgccttctcacatttactctgggcagctgcgcttttcacttgctttgggcagtagaatgcagtggaagtgacactgtgccagttccaagcctggtggctttctctttgttctgtaggaacatgcttgccactgctgtgtcaggaagcttgggccaaatggctgaatgatgagaggtcacgtggagagagaggagggaggatgagaaagagaaagagacagacaggaagaactgaagtacccacatcttggaggcccagatgagctaccagctgaatgcagctgcataaattaccccaaccaaagaatcgcctagctgagcccagccaatccccagaattttgagaaaaaacaaattgttattttaagccttctgcgttttaggatagtttgttacaaaggaatagggaactgaagcgggaaccttggaaagcaagcctcaatttatcctcccattcttattctacattttcttagaccttctaaaatgtcaggcacgtgtgactcagaaacccacaaaaatgattagtgcttctctttgcttatgctatatcttactcctagaatatgtttatactctatgctttgtacctgggaaattccttaagttcagtcactcccgtctttggtctttcctaaggcccccatgactcagtgacttctgacctctctcaggcttctgtagttcaatctacattggtatgaggttgggggaaagatgatcattaactatttgagcaagtaacattctctgtggaggccttcgtttctacatttgtattaattatctggctgatttttcaagtctcagccttcagtattctagaacagatgcccaataaaatgctgtgcattggtcatggaattgttgatttatctgtgcagtcccatgaggtaaccactagccaatgtagctatggagcacctgaaatgtgagtgcaactgaggaactgacttctttattcttatttaattgtaattaattaatttaaatagccacatgtggctagttgctaccatttggggtagtagggttttagaattctctggaactcaagtggaaatatctgttttcacttaacgccaacagtggtttatcacttgattttcacaagattatcagcatttgctcttcaggatcacttttcaggaccacagataaacaacccagtggccaaagttttcccagtacctgaccagctccctcttaccttaaattttctcttgcatttagaatcctcacctccacctagagccaatgctgagaccagttatctctaggagtgtaaatcatcctttacctttgaccacagcccaaacagagaccaacaggctagtgtggagttgcagtgttttacaaaaccccaataggcccaagttggggaaaaaaaaaagaaatacatacacggcagtgtcaattgaaaaccagccgggtggcaagaacagcgtggtgaggatggagctgccttcggccctttggttgattgggacacagtggagatactgcgaaattaccttttttattggttcttgagccttctgcagtaaatgcctcttcttgaaggaagtgaacagaatccttgtgttcagcttgaatttagcacatgtgcatgacagttctacacttaatctgtaattcagcagaatcaggacctgtggctgtcttacatttgggctaatttttcttatgagcgtaactgtgttaattagttcttcttttgcttatgtttattgtcataaaaaatcagtggaaaagttgcatccattttattgtgttataaagtattatcattgataaacccattgtgtgtggatcttcctagatcttgattttttttaaacctcttgtaaggtaggaaatggaatattagtaaagccttcctgcatttatgaaccaaaagttgaaatatcatagaaaggactgctgaaggtcagttggtctcaactccacctcactgtacccagtaagggctatttataatcaaagagaatgggttatttgtgtaaaaagctctccaggaagagaaattcgccagcctcccttgatgaagctgggtccggtcaaggaacttactcttgaatcttactcaattcacttgctagctctctttcttctgctgcaatttaaggcaatttcctctgtcctctcttgttatagaaaataacttgttggcatctcctttgtaataacctgtcatatacttgaaggcagttattaagtcaccccttagccttctctttttcaggctaaaccatcataacccttttaacctttcctcggaggctccattttccatcctcttaatcattttacttgcccttctctggattctctccaatcttttacagttttctaaaaacgtgaaatcaggaagcaggtcctttatacattactctcagtttctgctgattttcatgcgttgtttttcttttaattttgaagtacttttcaacttttttttttttttttttttttgagatagggttccgccctgtcacctaagctgaagtgcagtgttgcaatcatggcttactgcacctcgacctcctgggctccagggattctcctacctcagcctccagagtatttgggaccaaaggcatgcgccatcttgcccagatcatttttgtattgtttgtagaggtaggggtctccctatgttgtccaggctggtctcgaactcctgggctcaagtgatgacccaccttggccccccaaagtgctgggattacaggcatgagccaccttgcttggcccttttcaactgtttatttccacattcaagccaacctttgacaacgtaacatatcaggatttgtgatcaccatttacctttttttttttttttttttggtctgtgggctgaaagagaattccagaggtcaaatgactttacctttcagtctgtgtttatctgtatgttaatttggagtccttttagtttacttctgttatgttatttacatgaagactttctctgttgcctgtaccatatatgaaaagttttagagcagagcattcagcagacagtgaaaagggaacatgctttgattactgagctctcattggtttcatgatccctgctcacccctgcctaaatggcagtgtctttgtcatccataccttaggatgagtgcctcagagggacagctcaggggcctcctaactttgtctgcaacttgtctttccctttctgcaggtaagtgggtaacattccctgggcactatttattatatcatctacttgtgtcttctaacaagctcaggctctgcagttaccacttttatttattgatctactacctgacttctccccttcaggcactcactcactctttctgtctctcttctgtctttcttttttctttctttccctttctttctttccctccctccttccctccttccttccttccctgcctccctccctccttccctgcctccctccctcccgcccgcccgccctccctcccttccttccttccttccttccttctttcgtcttaccctcccacccaggctggagtgcagtggtgcaatcttggctcactgtaacctctgccctccaagctcaagcgatcctcccgcctcagcctccccagtagctgggactacaggcacacaccaccacaccaggctaatttttgtatcttctgatagagatgaggtttcaccatgttggcctggctggtctcaaactcctgacctgaggtgacctgcttgcctcagcctcccagagtgctgggattataggcatgagccactactcctggcctccctccacactttagaatagaagcttcatgaggacaggcaccttgactagcttcttagcccaactttgtatcactagcctctaactagcaaagatttcttcatgaaaggccagaaaagaagtgaaggaacaacctggtatcagaagatttacatacttaatgctgtgggttcacagtgtgacatttggcagtacactggatattactggcattcctttcctctcctatttaatcaataggttaaaggatgtgttctaaaagttatataaatctctacaactcttcacctttacaaccatattcagatttaatgatttgactttaattttcacctttttgtggggcaggtatgtcggtaacattccaatttgtatttaagagtcatttcaggagtaaactttttcacactgccttatctttttaatattttggtgtgattttgttcttggatccaaaagactatttttaaaaaggcattccaaatttggaggcattcaagattgagaagtcctttctgtgttattctctcctccatcccctccctctcctgaaccttctcagcagtctcttttcgttctgtgttccaacactccaaaaacatgtttgaaaatctatacctgtttggttgtcctatcaacattctcctggtggtttgccgccaaggttagatccagacctgaagccacttgatttaattaacctgaggtggcatcatctgctttgcttctctgcattggaagtgtatgctcctccactctcttgtgcttttcctgtaccctctgaaccaggcagtctttctttttactaggccttgaaactggcttttctttagtcacctcgtggtcaggacatgcactgttcaccagcttttcagtcctgattagccagcctggcccagtgtggcaggcaggaccaatggttgcccaggtgtgctggacctgagcagcctaggaggcccaccttccttccttttatctcctggactccttgctgtgtatggaagcatgtcagaatcatagagattttgtcttcttttttgcccatttcaaaaattctagatgtccaactagcctttgggcactaaaatcaagttcctttggatgatgttgaattaccactcatgctatggcctctgcccattagaaaagagcttatcctctgttttcccctgcaccattccaagcccaaattctggcaggaccctgaactctccaggcttctgacacctctgtgcctttgcaaatgctagcctcattctgcaaaatacctttctctttgctcactcttttccccccctcccaggctcatttaaattctttcatttttggaaaggctttcccctctcctcctgtttggtgcacccctccattgaagcacaaatgctgctgggttgtagttaatggctgaattaaggcctttgaggctggcaatgttgtatttacctctctgtgttcagtgctagatgctgagtaggtgctgagtgcatgatgaaagaaagtgatacagggaagaaggtaagagagcaggaatgaggaagaggacccatccttcattcccagagccatgcatcatgggatccccaggttactcaccttctcttgaaaactttcaccccccctccccctggagctggttcccttttccttgtgatgctttgctctgaaagatcactcagtcgttcagcagtcctcctgatttctctctcaattaagtgttcatctctgggctgtgtcctccctgcaggagagattgctgtcagacaggcaatcagtgagaaccccaactgagccctacctcccttaccaaagaagttcatggccaagccatttttatttagcaaataagggcttgttttccttgattgtccaaagcacaaggggagaaaaaccacccattggcttcatgtttacctgcactgcggggctgtcttgtctgtttcagttctgtttcacatgtggagttttcactgatttcaagaaggaatgtatgcatggagttgagcaggatacagtatcctgaatgagggctgaatgttctgcactagaagtgagcgtatcaagtctttgtaactaagaatgtgatgttagattgtagctgaggggaagaaacacaaatggcttgggttgtatctaaatcctgggtctgccaggtgaaaacttagatgttgctttcaaatgacactaatgatttctttcagtgctgtttagcatgagtggtcattgcaaagagctgtgaccactgtactacccagtatggtggctactggtcccatgtggctcttgagcacttgaaatatgggtaatctaaatggagatgtggaaaatacaaactggattttaaagacttagtagacttagtattttgaaagagcaaaatagcccattgacaattttatgttgattatacatacattaattttacttgttatcttttaccatttttaagtgcagctactaaaaatttaaaattctgtatgttgcttacattatattgctcttggacagcactatactaaaggcataaatgtaagattgtgtttcagagggcacccgagcactgcttggtttatatgtattttctaggccttccctttggttccctggttacctttaaaaatacatgtcatgatatagacatggcatatctgagacaaaccttggactgagacaaacctgagtttcaatctcaattgtttgtttgtggcttgcctctcagcatcttaaattctctgaatcttaagttcctccactgtgtaaaagaaataatatccctctgacctcactgtggttaggcaagagacaatgcagtgattttttcagtaatattatgagacattttattactataattaaatgattgtattttccccagattgacaaattcaaattttctattttgaaatcttattgcaaatgttaaaaaaacaaacaacccaccctttggctcctgttatgttgtcttccagctgctagtaatggaattgggacagctaatgttccctgagagccatggggaaccaggcagtgtgcttttcaggaactgtcttactttatcctcacaacaatcccaaaaggaaaaacctagttttatctctatttaatagctgcagtgactgaggcaccgcaaggttaggtgacttgcccaaggtcacacagcgaagcattgagcccgggcagtccagctctagagccgtgttctttgcctccgcccaatattgtccaccagtgaggagaagacggaaccaaagaaccaacagtgaatgaatactaacaggaatcctggctttcatggacatctattcttgtgatttgacagtgtatatgtgagatacttcctcttagaatgctttttctaattcatacagtaggcttaaatatgtcatggttttagagttttccttaaggaatacgttgattcccaggcacattacagtctgaatcagtcttaagaaattccaggatagaggtggaagaagttttagtaaattgttgtgcagcatggtgaccgcagttaataataatgtattatatatttcaaaattgctgaaagaggagatttcaaatgttctcaccacacccacacacacaaaaaaatgataagtaggtgaggtgatggatatattaactagcttaatttaatttttctcaaaatatcacattatacttcataaatacattcaattattattagtcaattgcaaaaaaaaagaagaagaagaagaagaagaatgcaaaggggaaaaacaaaattccatagagttatatgagaacaaatagattacacaatatctagaccacaataaatgtttgctttgtgtttgagggccttgtgtcaattgtacataatcactatggacctagtatgctacgtgtcatatgtgtatagtaggggcccaataaatgttattcattaatgtttattgccgtacctctgaaaacacacctttagaaaggaaagtatacagtatttacaatttactgtcatttattccattaggttgtctgacttgtgatgtggaggtgctatctcatcaggtatgattgtctcttagaataattccctttgatcagagtggagctttgagtggatttattttgttaagctggaatccacctctttaggttaatgtgacacacctacatacaccccagcagatacaacagggccattccatgatgtgtatcttcagttgtcatttcatgtttaaccaagaggattagaaggcattgatgtattaatagcttttttttttttttttctcaagcatggtactaattcttaggtggggtcaagatgattgcggggggcagtgggggcagcctgtggtcaacgttcaaagccttccagtcatttagaaagttgaaatgtgcttggtgctgggctagaatcattaggaggaaatagctgcaaacctggaaacgtccctggagaatacttaattcaggaataaaggtttggattgatgagggctaaaataaaacttggcagcgacagcattctagtaacttttagccacttctccccatctcactggggtattcctgctggtatattcactagcctgagctctgctcctgagagggctgcaggagctgggtgggttgggagacacaggtgtgtgggaggcgccttcaccaagtgccgcacaattgccgggtacccctctgtgcctttaactggtcggtaaacagaaagcaggatgtgcttatctgaatagtgacaacagttgcaagcactcagtcacaaagttcagcattctggctttagatggaccagcgtggggctctggaagctggtgacttgggagtgcctgccgtacacatgggtggggaagggatggaaagtttgtcaaggacttgccgagttattaagcaaagactctgtaagtgcgtcagaatgggaaggcagctcagaacctttccactccaccctttttgttgttggaaataggtaaactgaggccagtgaacaggaatgtgtatttcaataataccaaagctaacttctatcactgtgagttgtgtgccaggccctgggttcactgccttctgagtgttgtctcttttaatctctgccacagctctgtggggtaagcactggtgttatacccatttttcagataaggaaacagagcctcagagagtcaggttacttcctcaaggtcatagaactagtaagtcacagacctagggcacgggagcaggtctgtgtgggggtcagagccacagctgtcccccacacgctgggggcctcctccacaaagcggtttcaggtggggctcagcccacctctgggggaacccattcatatactatgcaaggtttcacaggtgtgtgaattcattttccattgctgcgtaataaattaccacaaacttaatagcttcaaacaacacatatctgtcattccacagtttctgtggaggccaggcctggttttcctgagttctctgctcagagtctcacaaatctgtactcagggggtcagcctgattatggtcccacctgaggcttgggatccccttccaaactcactaactgttggtggaattcaattcatgcagggagagcactgaggctgcaagctcatggagaccacccactgtttcctatgtgtggccctctccacaacacagccctttgcttcttcaaaacccaaccaaagaatctctgtcttcaggaacagcctccgaccctctttgaaggggctcacctaattaggccaggcccacagaggaaaagctctcttttgattaactcagagtcaactgattagggactttatacctgcaaaatctcttttgccacacagcataacttaatcaaaggaatgtattccatcccattcatggatcctgcccatactcaagggaaggccataatacaagcatatggtcattaggggccatcttagtcactactgttcgtggattgttctccagcttcctggaggagaggagagcaggagacagagctaagagtgtttgtaaaatagggcagtgggaaaaggtaggtcttgtgagtagcaggctacttaagatgcctagtgggtctaaatgtcaaatgctattggcagattttccgtgcaaggtatgaccaaaaaataattatttcattaactttgtgcaaaaaaaaaaaaaaaaaatgttttagacatgcatcctctcgactaaagggagttcattttgccaaactactggacttcacacctgtgtctttctatctagtgcagaggtggctatatcccttgcccttgaaatgttccttcgtgtttcttcccaagtggttacttttacaaactccttaataaaaaagaaggaagggacacatttagtggtctttgggcaggcaggcagatgagcagcattcagaatctctttgtcctgtttccccacaatcataagtgctcccccaatacaactttgttcccacattgaactaggcagtgttcctattatataaatcctgacgcgcgtagtgaaagctgccaatttaacttatatgggtgagagtccgggtcttcgcaaaagaagatcaataaaatacagcatgaatgtccactcatgacgtgtaccttgcaagaacttggctatattaatctctcaaataagtctgtgctcccaggtagcagtattcccatttcacagttgagaaggctgagactcagatgagttaaataactggctctttgttacatggtaacaaggggctaagaaggaatttgcacaggtgtggtaggtgctaaagccagtgctcttaaaccagtaaggtaagcagctggaatattggcgataattttcagacttggagcctactcttgacccccatatgccttccctttgtctttccagtattccaaatatcttacaatctaggaagttgaaagatggggacatggcaactggcttcacagggccagtatcctggggaatacgaaaagaggaaaaaagagaccgtaacggggtagacaacaaaacaccgccatgccacatacttaacgttgaactagaggaaaactctattacaagcgatacttctaatctgcttgcggtaaagattcataactggaaaataagcatgtgacagttctgcatttgagtgtaaacttaactcattaatttaaattagagtgcttttttttaacaaaggggaaattctagtaataataataagtaatggctgttgtagagaatgtaaaaagatgttagaaatttgtgctttgggaagttggagggtgttaaggattaattttcactcacagagatcaaaaaggtctcgatgagtaagataagtatcgagtttcagggttgttgtgtttttttcacctcctgccagactgtctgaaacttatctcaagtatcatggtaaaaagagaagtggcggatagacacaaaaatgtaatagatatattctaggggtagaatatgaactgcctttctaaatgcatatcagaaggagaatttattccagttgagtaggtttaatgatataattttaccatattaaatcataattgctctttaaaggaaaatagagatgcatgcattgccactgccagggcatcccactccatccaaatagcatcctccctagtactcgttgatttcgcccttatctcacagcagagccgatttgtggctttcctttggaaattgggtggggagagaggaaaagaaggaagaatagtctgagcatcagaatctgcgtcaagcaattgccatggctttagcaaaatcatttcctgctattagactgccaaccaaacacttccaaatggattgcagctctgatttttgtggaaccaaattatttttcaaaattagactgtgtatcaagatgatccagatacctggattagtcagggactaaaatatttgcattgttatggatgttgataattattttagtaaattctcatggctgcttttattgctaaatgatttccaatcctgtcgcattcccttctctccttcccaccaagaataagaaaagggagaggagagaatgaaagagaagaatgaaaacatgcattgattgcatatatggatgaaaacagagttgaagtcatgcatttagttttaacagaatctgattttacatcacgagctgaattagatggaggcataattcatctatgtatttatcggctataccttccatatctgtctttttttaatagcaaacaaaataatactgagcttatttgactgataaaaggcataaatgtagttttaaaaaatatttttatatctttctaaaaaatacttgatacataaaaaagaatatgccgtatttcattgggccttctgtaggccctttatcttataaaccagtaataaagtaaaaatgcagccaagctagttagcacataatgctttcttatcccatgtcttttaagaggcatcccaattttagagatgttaaaatggaaagaaaaaaacaatgtactttagactctattaaatacaatatacaatgtgctggtgaattataaagcataatgtaagaaacatttatgaataccctgcctctcaatccaagaactgttcattacttataacttgcctttcctcccatagcccacgcagacaggcaacccttctgcctgttattgctttacttcttaaacgtacttaaactctctttcccactacactcagaatgccccaagagtagaggctgtctgtgttctcttctactttgtcttcagcgcctgacacagaacctggcctaataattgcagaagaactattattgactaactgtacaagcacgttgtctgaggcctatccaaattgtctttacccttcaagctctggtttaaacaccagttcctctaggaaatctttgacatcctgaactggaagtgcccttgcctcctttttgaactcatgtagcaatttatctttactcctagtactatagatataccaccttctcttttgagtagagtgcttcacccatgtctgccttcctgctggactggaaaagcaggatttccatttgctctagtttggtgaccctcccattacctggcataataataaaagataaccatagattcaatggtgctttatatgtattctcaccaaattgtcataaattaaggacagttctatattcccatttaacagataaataaactgaggctagtgctcataatcacttaagcaataagtatatgtcaaaggaagaagacagtaatgcatttaaattactttgccttagtatgcttcagtttttgcctgtcattcaggggcctatgcttattcttgggtatgagactcaaaaataaatgagaaaaaatgtaataaaaacaaatcagtaaaacaaatgcaagttttctttaagagtgagattgaataaccttttaaaaatgtttgagactttttgttgttgttattattagttttttttttatttttgagaccgagtctcgttctgttgcccaggctggagtgcaatgaatggcatgatctctgctcactgcaacctccgcctcccgggttcaagtgattctcttgcctcagcctcctgagtatctgggattacaggtgcctgtcaccatgcccggctaatttttgtacttttaatagagacaaggtttcgccatgttggccaggctggtctcgaactcctgacctcaggtgatctgcctgcctcggcctcccaaagtgctgggattacaggcgtgagccaccgtgcctggccgacatttgtattttcatattatctggctaattttctattggattttatttatttccatattgatttatgcgatttttatgaaccataaaaattataatttctttctaggttctgacacgcaaatatttctctagtgttttggcgatcttttgtctttgctatgctgttttagacatattcagttttaacataattctatttatcaagtgttttctttatggttcctaaatttttcgtaattacatttgaaaatgcattcccacttctgagatgacgagaattttttttttactattttaaaaataaatgccgataaggctaggatcttggaagcacctccctaccttggtatgatcatttattcatttggttgttgatataaccaagacattgatttagccattgttgtagacagagatgaacctgactagaaaattttcagggcagttttcaatccagtagagagagataaatttcacacttatttgtaaatcaataagcataatatttttagatggtggaattgctgagaggacagtggaacagaatgatggggggcattaatggtggagaggatgttacctctgaggtgataagatcagctaacatcttcgggttccagctgtgttgagatataagtaatagtgtgtatggcggaagaacagccctgagagggaaggggatcatgaagatggctggagcagcaagaccatggcagttgtaaaggtgatatgagatgaaggtagacaggaaggtgtggacaagaccccatctttgaaaggcaggctttggaatgtggctttgatcctgagcacaaaatcttttgcaacaaaatgacctgatgtgcattttcaaaagattcctctggctgctatgcagggaagagattatagggggcaagaagggaagcaaagagagggttgtgtaggaaaattgtgcctacttggtgcagacccagaatatagtcagtagatccaaggttaaactaagacttctccaagttagaggtagggcacagatgctggctgaaacgccaggtaatttaggcatccagagtaaatgctagtttgaacttggagcacgaggggctttgtgtgggggaccattcaaaggcaagctggacaggtggtaaccttgctcactgggcgccagcaagtagagcagcgctcgctggtgatggatggcttaacattgttccccgcgctgtgctcagagccgggaggagggcacagcccctggggactaggaggagtctccaggctttccttgcactttgtcttccgcttagtgtttcagccaagatattaattctatgttctagccatgttgctgcctcagagtctcactattgttagttatgctctcgttcacagtcctagtgttgatatttttacacgttttaaactcaaaagtatctgaatttcggagacaatgagacaattagagtagtttgtaaagtatagtgaaggtttttaaaagaagtgagtgtgtgactgctacatgcaatttattattataatcctctcttttgtgaaggtccacaaacattttttgttcaatcagatttttattttttattttttatttttttgctcttcattgtataatgtattcttcccccttaacttcccccaatctcaggagacaacagtatttcccttgaaaatacagagggtggattggccctgtgtgtgtgttttccaagtgctggctttccaagacattctcatgaaaaggactggtattgctaagtcattttttaatataaggaggtccatgtttgggcattgaaattaattttccttatcttgccatacaaatagccaccctggcttctttgatttattacctgggatggttcagcagcactaaaaacagaggacgggaagacatcacctttacgtggcatcattagtcacagcattaaaagcatcaccctgaagggactgcttctcccagtcttccctgtgccatgacagcatcctgtttgttccctctctgtgcactcaagacgctgggcccatccacagcttccgggttgcatttttcatttcctagtaagttgctgctatccaacatcctttctgtcttttctccatagcatagtgtaaaagaactttcaaaagtgcagatacaatccctgattaaagacaagctactgactgtaagaaaatgttttaaaatcatttctccagcaagggactcgtgtacagaatatataaagaaccttccaaactctataatacaaaacaaacatactcagtttaaaaagaggcaagagacttgaccaaaaataagcacatgaaaagtcattccacatcattagacattagggaaatgcaacttaaaattatagggaaagggaaaaaaataggatgcgataccactatacacctatgaaaatggctaaaataattactggtaattctaagtgagggtgaagatgtggagcaagtgaactctcatgcattgccggtgggaatataaagtgatgctgccaccttggaaaacagctgggcagttttttttgttttgttttgtttttgtttttttgagatggagtctcgctctttcacccaggctggagtgcagtggtacgatctcagctcattgcaacctctgccctccggttcaagcgattcttctgcctcagcctcagcctccctagtagctgggattacaggcatgtgccaccacgcccagctaatttttgtgttattagtagagacagggcttcactatgttggccaggctggtctctaactcctgacctcaggtgatccacctgccttgacctcccaaagtcctgggattacaggtgtgagccaccacgcccagcctgggcagtttctttaaaaaaaataaataaataaaaataaacatacagttactcatactcttgtatatgtattgaagagaagtgaggacgtatgttcacacaaaaacctataggctaaggtttgtggaagctgtatttatagttgccccaagctggaaacaacctggacatgcttcactgggcatgtgcgtaagcagactgtggcacctccgtacaatggaatcctactctgcaagaataagggatgaactcttaacagacccacagcttagaatggtctcagaggtattaagtcaaaaaaagccaatctccaaagattacacactatatgattccatttatatgccatttcagaaaagacaaaacagtgatagagactccatcagtggttgcccggggccaggggtggtgaggagggtgtgattacaacaggttggcacaagggagtttggggggtggtggaggccttctgtatcccgactgtgctggtgattatacacatccatgcatgtgaggagactcatactctgtacccccctgccaaaaatcaatgtgtcagtccaaactgctgcacatgctctacacagcccagcctatctcttgtgattcatccagttccttctcagcctcctcgcccgttctgtcaggtcccgaacacttgtggtcatttttattttctagcagggcacaatcacgctcagccttttgcccaagaacctctcctgcccacttttctgccaacccatcttacctgccgaatgagatgctttctttacagctcaggtgtggagactctagcacacgcactgggacctctgaacaacacccagtcttggacatttcttgctcctgtcagggttcccagggcaccactctcattgcctggttctttggctgccttgcatgctgggttgtaggtttgggaagagctgattccactgctcattctccagccctgagaaagaggccacagagagttcagtacatacactagtgaggatgagaggtctctgctccggaggtggactcagcctttgtctggttttacttttgccttctttttctgagtgcttttatctctgaccctcttgctgaaatttcttacctttcatggctcttttagcaggggaatcgtctttgctggttttgcccaaactacttcttaaaaagcagtaagccaaagttttaagacttgtatacttttttttttcctattcatgtaaaagtaaaattatgtggcaaaaatcatgagtatagaagggttttctttttcatcagaggttagatgggttttatagtgcgacgtgaaaagtcattagtaaaagccgtattataaacatatttttatatatttacttagccccatcttccaaattcccttggagggacaacagattttctggaaaataaaaatcagctcctattcatagcagtggtaaaagtaatcgtcgtaacacttacatggtgcttatgaagtgctggacactctcttaacatgtactttatgcattttattttattttttgtagagatggggtcttgcaatgttgcccagggtggcctctaactcctgggctcaagcgatcctcccatctcagcctcccaaagcactggaattacatatgtgagccactgtgcccagcctaatttatgtattttaaatgacttactcctcacaacagccttaggaggtggtgtcattattatttccattttacatatgaggaaactgtggtgcagtgtggttcgatcactgcctaaggtcaggagtgaagctaggattcaaatgcaggcctctggcttcatcttccagaagactgtgcaacaaagaggggaaggaagatgagagacagggttttcctcaccagggacctcatgctgacctcctttcactttttcccagggaggtatccccacatcccttgcatggtctgccaagaagatccacaatagcttaaaatgcttcttctcttttctagccaaggacaattccgtatttgtgtcctgatcattattagaataagtaatcaaaataattagaaaaggaagctaaaaatgaaaatggtccaggaaagaatataaaataacttggattgtgcttttcaactttcaaactgttttcacttagtgttttcccaagacgtccctcaccaccacccattgttattgccaactttttgcagatgaggaaagtgaggcccagagaggagaagcgattgctcccctgggtcaccatgtcgttccttgtgggaccagtatgcaagccctgccctgccctgccctgccctgccctttctttcctgcccccttatctctcttcccacctccctcccatctgagttcttactcattaagagaaactcttttataaactttagatgcaagcagtgtgatttcatctctttttctgcgtgtgttagttttttgttgttgcataacaaattgccacaaattagctcatagttctgtaggtcagaagcccaggtgcactgttaatggagtctctcctcagagaatagggaggcaagtggaagctgcactgattcctcgtcaagaggctccgggaaagaatctgctcctaagctcatccaggatgttggtagaatccatttccttctggctgtaggactgaggtccctgcttccttgctggctgtcagcctgcagctgctctcagcatctagagtctacccacatttcttgccatatggtctcttccatcgtgaagccagtaggggcacatcagtctttcttgtgcttcagaatctgacttcctctatctctgggctctaaactccaattgaaagggttcatgtgattccatcaggcccactcagataatctccctttcttcaagtcagctgatttgggaccttaattacatccacaaaaccccttcacatagcacctggattagtgcacgattgactctctgggaaggggtgtgttataccaggcataggaatgtaagggtcacctgagaattctgccaaccacatgacattacaaccttaaaaatggtacacattgacaggaccaagggccacctccaaggtatttgttttctgtggtaattatatcaattccttaatgtttttacaggttttttttttgtttgtcaacatgacacattttgtatttattaagtcatttgattgaaagcatatttgtaatctgtgtacttctgtttaccttaaaagggttgaagaagaatgaagtagacataggattagttgaacaacacaattctgtttcactaacgattcaataagttaatttcttaagcactgtttcatgctttcttttcagcctctgtgctccatcttcttgaaccttctttctgctccttggctatttgatttcttctttacttgtgggtttccaattaaatgtcacctcttcgtggatgaattccttgatggacttatctagagtaggttaaaaatgagaagttaagtttttcttttttttaatgaaggctgaggcttccttcacagtggctctaattatttctggatttgttgattgctgatgtcttactctatctcctgctagactgtagtatcagaaagggaagggccaggtctgtcttgttctccctcctaggcccagtgcctagactgtgcttagtacaaagtagtcaccaaaaattatgtgtttaattggtgtgtaaatagaagctaatgttctggtgcctgtagaatggttaactttaacatttgttttgaaaggttgcctgagtagtgaaaccgagttaatcatgaggtcactgcttaagcgtttattgtttgaaaagcacctgattgacagtcacaaagctcttaaaagtgggggaggggactctacaaatggtagagccaaagaagaatgatttttgtgtcgtccttgaaaacatgcagtgtcactggaaaggaggcgtgtgatgagtttttcaagtcatggacagtctgatgtttggatcacagtttcttttttttttttttttttttgagacagagtcttgctctgtcaccaggctggaatgcggtggtgccatcttggctcactgcaacctccaccttccgggttcaactgattgtcctgcctcagcctccctagtagctggaactacaggcgcctgccaccacgcctggctaattttttgtaattttagtaaagatggggtttcatcgagttagccaggatggtctctatctcttgacctcgtgatccacccaccttggcctcccagagtgctgggattacaggcatgaaccaccacgcccagcctggatcacagtttcttggcaattttttttttttttcttggagaccaagtcttactatgttgcctgtgctggcctcaaacttctgagctcaagagatcctcccaccttggcctcctgaatagctaggactacggttgccccatgcctggcttcttgacacatttttttaacatcccaagacagatgcctctcctttctcaaagtcctctttcgaaaagttcctctctctgattttcccttaagcttcacctccagacagtcacagtatttggatacctacttagaagctgtgtgacattgggcaagatagtcaaccactctgagctttgttttccttccctgtaaaataggcatgataattcccaccttgaaaagtcattggaaggatagcgaatacaaatgcctgacataaagtgagattgataaatgctgttttcacaattattagactatattattttaactatgactgcaaatctggtgtggaattgaaatgctcatcttaacaacagagcttttggaagttgcaggttgaaatccctaacaggaaaatccaaaaccagaagtacttcaaaatctgagacttcttgagtgccaccatgataccacaagcgaaaaattccacacctgacctcatgtgatgggtctcagtcataaatgcgatcaaatctttgtttcttgccccaaattatcaaaagtcttgtatcagattgtcttcaggctttgtgtataaggtgtatatgaaacataaatggatgtcatgctgagacttgggtcccatctctaagatatcttaccatgtgtatgcagatattccaagatcctaaaaaatctgaaatcattgatcccaatcattttggataaggagtactcaaccttaaaaaaagttacagtagattttaggatcaatggagaagatattctatgtaacagatttttattatcatatattaagtgaggactactttgtttaaaatctttagactgaaataaacacgttctgcatacaaccaccgtgaacacaatttgtctttttttaaattcagaggcacttaggaaccttgtagtgcccctgggttttattatgaactccagttagcattttattgtggctgcctagaagtattgattcatatccagtccggaaagcaacttctacctgttcaccttttcccattccttaacacataatagcgaaagagtctgtttcagtaaatgcagactggcttgcctgtgcccagccctgtctccacttggttggcttccttgggatgaggactctcctgccctggcttgtgctgggaagtaatagaaccaaagcagtgacatccatagagccgaggaacagaagtcagtggggcttgaaagagttcatttcccataaagtatccaaagttgttcaaagtcggtcaagctgtcatcacatttcagatgagactattttagggagtaacaagggcagagtagatcaattaacgtttctttttttttttttaatcactctacattcaatgaatgttcaaggcaggttaaacactaatagcaaatgtggtgatggaagaattgaggcagcttctgttgtagtatttactgtggttatcatttctatacctaaagctgcattcctatcttctcatttattttgcctcccttttaattcactgagtttgatttagagaagtcagtgcattgtattacagtgccattatgagtctgaatttctgatttaattcagacagtgtgagcccagaacagaggaccaggagattctgcgttaccccaattagcccgggaaagcttagacaactggctccgtatctctatgtatgccccaatttcccctcctgtaaaatggagctatttacttatctcaggattgtaatcataaaagaaaatttcctgtagatgtgaaacaaattttaaatagcatgcagatacttgcatttgtatttttattttaacccaaattaacatgcgaaaccaggatgccgttttcagagttgttggcatccgttcatcatatttctaggtgaagtatgtgtaagtgattataggtaataaatatcttttttttttttaacttattgcagaggcagtttttccactgttaatgagggtaatttgacttggttgaaggattgcagttcttaagaattaatgcagtaatccaattcaaagatttaaagagatctaagatttttcacaggtcgcgtgccagtgaatgtgctcctatcacatagcagctaatggacttgaacgccagtctgtcatttactgttccctcactgcatagcagctttgcccttggtagtgagtatactttccaagcattgcaggttatttagaagtgtggtatatttgtatcacttttgagagatagtatcctatttcccacagcccctaattactataaaaactggggttatctttcttaattacatgtttgaatcctaatctgctaaggtctgaggaatatcaggctcagaggagctgccttctcgcctttctttttcagaggagggccttttattttttttaatgtatttttaaaaactaattcatgtatcattgtattcgtacatataggttaattcacgtgaatacaaaggttacatgcactgtattcatgactttccatttttgataatgatgtattattaacagctaacaatattttgtaaaggcttatttataaaggatgttggaagtgttcttatttcccgatcccattacgttcctaaatattaaaaatcccattttgaggcaattagaagcattcgcttcttcctccacgtgtgttctccagacagcgtcaccattctgcgcacacaggaacctttgttccttaattagaaaaaggactagagctcattagttgtggttccttgtggtgtctgctcaaacactcaggcaataatacattacaaggagagatccagcctaaatctgagaggctctccacagttccaagaactgtgaaaagataaatatatcttggagggtccttgtaaggccgttctcacatcctgcactgtccttgagggcctggctggtgggtgctcatcagttttaaagtcaaagagatttctgtattcacaggaggagggaaggggagaaggcacaacttgtatagaaatctagaactttacctttattgaaagcccatggtcttgcaccaaaaaaaaaaaataataataaataaataaataaatagaattatcttttggattttttggtaggttagtgggcaccatccagatgcattcggatgttattgaaggtgggcgaattgttgacaaacatgatagaagaccagataccttaggctgattttcactgctggcattggacatcggaggagctgcatgagctttgaaagctaaaactcccaaactggagccacaaaagctttaggctgcatcagttatcaacaaagagccctgatttccacaatcagaacaggcatttctccagcctccaggaaacctcatgcatctaatgttccccaaaatattaatagtacaaatggtggacccatctcactggttaagattaagcttcccgcagcagagaagtgagcaagtgaagtgaaaaatctcagaccgtatggaggatgttttgctgtgccttggctgggctggcgaggatgttttgctgtgccttggctgggctggcaaggatgtgctgaaatataaagggatatggagaagagagcaaagtgtcagtttgaaagccagagattggaaaatagagcagttattttgagggtcaattcacttctctttgagaaggtttatccagtcaggtagctaacaccctggaaggaaaagaactcagaggccgctaggcgtgtctgagatactctcccaccacccactacactaaccccctcctcatatcttgccttctctttccatccctgccaaaggataaattgccctcatcctgctaatgctaatggaagacattattaacaaaagggagtgcttcataaaggaagctgagatctggcaagtggaggcatgacatccttatgctgatagtggtacaggtcagaaatagtgaatatggaaacaaatatttcactgaaatgttctgccatttaaagggacatgtctagatagccatgtacatatatacttttttccaccagtaatcttttttttttgttgtatttctcagagaaagaaaaatagattttaaaatgtaaaaacctgttcttcaattgcgtatgcaaaaatctcactgcagtgtttattctaaacctgctctcataatgttcagtcaaggagaaaacagcaaaaaacagttgttgatggacttagcacagaactggattaaataagcattagtctactgaagctgattacaggaatatgaaaatgcagtatcttaatggtacatatttttatgtggcagctcagttgcctttcattttgcagctaatatgtctattcttatgagtcatttacttctttaattaccttttgcaggcaaggcaccatggtatattaatgtgaatgatttttactgccagtttatcatacaatgccccagaagttgaaaggcgtaattgacttggaagaacagctcatgaaggaaacaatatttagttgacagttttccttgtactatctgttgacgtttatgagtttacactatgctaaaggagtaataaacacaattttctttcaataacaggaaagggtagcttctaaaatacatttgtggaaaacacatttgttcatttcttgaataatatgaaaataacacatttccagtgataagacttctcagattgccaattgaattaaaccttcaaaggtgcatttataacctgtctcagagcattaggagatattagggttcatgtgattgaatctacttaatgaatatttaaattataaacagatttagataaatcatatttaactctgggtgttagggtgagacaatttggtcctgcgctcccaacttccaggagaaggaaaggcagaacgggagcttggggattgggaactgtctgaaggaagattttctttctccaaagggagggaaagtctgacagtacattttggaaaagtaaagaaggcatagtcgatgcaactccttatatggcctggcccttgaagagttaaataaagatttgggtgggtcgctgccgttttggagcctggaaaggtgctttgacttgacttgggcagtgttattttaaccatcacttccacagtccccttggccttaagctggttcactggctctgggcaggccctggtttggcacattggttcagagggagttaaacttttcacagttttctgggttgtttgcagttcagtcctgtgcaacataatgaaagttttctagccatctgttgttaagctggcggtgaacaaggccagtatatccaaacaaagttctggcctgctgtaaactgaacctgtcagtttagcatagctttgctgacccctccaaggaacagggcagccctcggtaccaggcactcaccgcttagaactttcaaaggggaactattttgggagtagggggtaggggcctgtttacttttttcctctgtgttcctctcactggcttggactggtttatacttaatctttacatgtacaaatggatattggtctcccctccttttggtcccccctcctttttcagagggaaggacatttcttcttaataggggattataactttttttttttttttttttttttgagacggaggctcactgttgccgggctgaagtgcagtggtgcgatcttggctcactgcaacctccacctcctgggttcaagcaattctcctgccttagcctcccgagcagctgggacaacaggcacgcatcaccgcgcccagctaatttttgtatttttggtagagatggggtttcaccgtgttggccaggatggtctcgatctcttttgacctcgtgatccgcccacctcggcctcccaaagtgctgggattacaggcgtgagccaccgtgcctggccggggattataacttttagaagaaggtaggattgtctagaaatgtatgtgaggtggctgtgattcaaagggaagttctatgcagttatttttgtttcattattttgtctttcagtgttggggggtacaaatagtccaggaaaagaagtgcctatatttattacttagcttatatagttaaagttttcatagctttaagagggcttttcccccctttctgctgcattttgtatttcatcatcagaagttaatatacagcataacttggcagagcagcagttagacaatactcccagctgtatgggctatttcgtgcttctctgttctcatttacaaggtgtatctttggctttaattgcccagcttaaccttaaaataattccattgtttcgctgtattttttcctactgtagtatatgtttcattttcattttctgtttggcagtatttccttggctatatatgaaatgctcctatacatttggatccttgagctatctgtctatctacctacctacctatctcaatacctatctaacacttcccctaatctttgtgggtttccttttgttaatgataccttggaggtgctgctgtatttttctcttggccttgctatcatgtatttcttgtccagccttggttacatttgtgccctgttaagagagggccctggggagccatcattaaaccttggtgtccattcgaaattgtaaaaatatcaaggagaatagccaccgtttttgaataattattttggctgctctaacggccaccttagtctgtctaggtagaagcagaccacagtcccacacagcaacaaagaaacaagatactgaaagcctttagacaaatgtctgaagcaccagtgtgagcgggtttgggctcaacttcagctgcaatcaagaaatggacaagggtcaagaattccataaatgggggtggggacagaataggcaaaggaataaacaaggagacacccaagccttcccgtttaagggacaaggagtattacagctgtgaaaaatattcaatttaaaatttaaatgaatgcacttactaggaaatactatagagtcataatctgtttgtgaggtgactgacatataaagtgtttttttgttttaaagtgaaaaaaaaacatcacacacacacacatattcggggtagactttcgggtataaaatgtcaggtgcaatgtaacgtgtactcaactccaagagtcaagcaaataaccttggtatttaggatgttgccttttagaacatgaaattgtattttgttgtgtgtcctttttttttttatttagaggaggactacattaagaggtcacctattagctgtgtttttgctgtcttaaactcagcccttctgtctattaaaatcaaaccactgtgtaaacattccgtgttgttcttggtctctacaatggccacggggatcaggtttcacctgcctgcacatcttcaagcaattacagcaattagcgtgaagccatttcacattcaaggattcaaggtctatggtgacattcaagtccaggagaagtctgaaagggagaggaggaagaggcccagagcgagacgactattccatggccctgagcagacaatttctcttttaaaaatggtggccctttaatgatgttattatgaggtttttaaatgacatatcaaaagttgtttatatcacaaaaacccaacagtcatttaattatactaatgaaggtctttatacgtgtcagattttttaaaaaagacttctaatggccatgagaaatggactgttgctgctgcttgcatcacagcagtggtggcagcattctttgtagaggaagaacatattttataatgtataagggaatttgcatttcgcttttcacggcaaacctttctgtgttttttgtaaatctaacaattgcaacaacatggaatatttagttgggagatgtttggagtaagtgttgaaagcaactatgtttgcttgctttttttttttttatggttagagaacaactgtggcgactttcacagattgaactagtacagttcaaaggaaaatcatcgactttagcacatctgatagctatataggcatggcagaggtgtcttgaaaaaacactcttaggatccagtagggctttggctttgtttgtttgtgttgttttttgcatttgtaacttagttacccaggactcgtttgcacaaggcaaatgctaaactgattacagcttttaaaaattggtttgtacattttttaatccatattttaatgttggtttattatgcaaaaaaagaggggcactaattttaaaaatccaagcgtgctgcaaaagaagatcttgctttgcagtcccagagggtgcttgcaatcaggaataaccgcaggctaaattataatgtggaattctgttgccctttaacctgatgctgcctgttcacattcagtgtttgttaacaaacagctttaagaacaaaattgttgggagaattactatttgattgtatgcactgactttattgaaaataagaggctttattttttttaattgcatgtctctgagaaagttgtgataattcctttacagaactgccctagttggcttaaaagctactaggtgttaagcagttacatatctgtaggacagaacacatctatttgtgtgactgaggctggaacatttgtgttcattccataactagccattttagggaactggactgcttagagctctctagccccatctcgaactacttatagctcttctgttgagagatggttttcctgaccgcccactttcatggcgcccaggctgtgtgccttttgatactgcaacgcagagcagctgcaggggatgctaataaaatgcaggattttggacactgagcaaggtaagagtctgcctttttctcctgccccttgaaaagggattgctaggaaatcatttcctggtctctaactggaccagctgagttagagaggaacatttgcattggatactccacccctccccaaagtggagaaggcaggcgtggaagcactgtgagactcagaagggagatgaggcagtaaaccagatctttcccattttttcccccagcctagtcttctgtttctatgatctgccttttgaactgtttttgtggctgatcagttccacctaatatgtctcttgatttctgctattgtaatactcaggcgacatgctgttctcttcatttttataagctttagatgcttctgcctgtcattttctggcggtttatcttcagcgtctggatttgctttcagacttgaatgtctatcaagctgccgttgctttgaatgtgagatcaaaagaagatgaattccagtaaaaaatttccttctatgaagaaaagattggggcctatgtaaacatcccactgacagctcccaatgagttattttagccgagtattagcacctggatgacagacagtccagcattccatgctaaataacaaatcagtagcttctgtggcagaagaacattgccacaagagcaatacattttcagaaggaatccttttcttcctcctttttttttttttttttttgttattgaatatggctgttcaactcttcctcctgtttttcaagctgacttgctgtgccttcagcagtttacttttcttcacagtatttgctgaattactccggtgacggaagacaggactgtgacaatcattttggggcgggttaaggagtgttccattaggcaagctaggcatctggagataaacaggtagtttggttgatggtggagaaagaaaatgtaaaggacagccagtcaaagccagatccagggcatatccctggaatacgggacgatgtgttctttaaaaatacatgtgacaaaatcctctaaagtctgcaaaatctgaattttcttcttcttcttttttttttcttttaaagcatcctgcctatgtaaatgtcaccacaaaaatatctcaagagcaggtttcccgaaaccctgttggtgtgtatttgtctgcgtgaatgagctgtgtttggctagggcttggtctagccagggcgcactgcgtgtgctgtgtcgctgcttgcagacctggagcggtttagatatgtgtggcattaatagatttctttaagtgctaaatgcaactttgaaaattacctgcaagctccaactgatctttcaactttgaaagtgaagaattacttgaggaattcttgtggtttctttgtcatttagtgagagcccagccagctactgtggaggcaaacctccctgaggttgcctacaaagggcaatgttccagtgtgttttctcttcgagtgtgcttcagccgcacagtacttcctgtttattcaaacatcttttttaccactcggcaacccccgcttcgcagaaacagccagaacccatctacagcaagaagacggaaatccaaaggcagacagtacgggctcccttcgccaaactcttcattttctctgtaagtgtccagagaaaaagaaacatttttttgctgggttaaacttttaaactagggatccgttcttgtgcagacattctctgaagggcgaaataaggtgatccaacttgtttactgctttttttcctcccccttccctcctctctccatcagaggcttttttctttttagagatttgagaggaccgtttccttctaactccttgtttaattcactcttgttttcaaatatgtctttggatataatcagctaagtaagcagccgggtggtgtcaggatagttttataggctaaacgtagattggaacctctctctgcttactgtgacattgtttcgtgttgccttctttttcttcctgttatcacaagtagtaagagaatgtggggatggtgcctttgtaattctgcatctacagaattgtcccctgatgtttgcatcacgacaccgtcatcatttgtgaatcggtcttggtaatatttgtaccaatttcatgccaataaaagtcagactgctgaaacacgcacggtcattatctcattcatattcctattgtttcaacggagtgggctgcagagggaaagggaaagcctgcctcactttccgtgatggttgttaactttgatgttggaaggctcttttcaaaattttccttgtggataatcagtatagcaggaaaagcccttggacttgggctgcctcctggctctgagtagaagagcaatctaacggctctcttagtcctttctgttgaaatgactttttaaacacatgatttgacatttttgaaaaaggttccaccttttcctgtctgtagtcactccttttgcctctctcccctccctccacaccccccttccctgacccccaacttcagtttaattggtaagccaggtgttaatatttcttttttaactatatggtggtcagggaatagacaggaaatggaaaataagctcttttgatcttaagagaattgttattactgtgaacctcgtttgctagtccgcagtctaaatatttttaaattttagtatctaaaacagcatctattagaatagagaaagaaatatgctctggggttgtccaaacctctcatagaagaaacatttagatacataaaataattgtatgtatgtgtgtgtgcatgtgtgtgtattgctatcgctatggtggcttttttgaatgttcagaagttgttctcttttgcaagaaaaaataagatgtttgcgactgccttaaggacaatttgtttaacagtaggagtaattgcagggaaaatggaaagagtgactgaaggtatttactcagatgttagtgtaggtgtgggggccgaaaactcagtgtgggaacagtgggctgcttttcttggtatcttagtctatttgatgaccatcaaatttcccagctcgctcgttttgttttttctggatggcatgtttgattatttatcagaaggggaagggagtagctgaagcaaataaacatgtgaccaagttctgttttgttttccactccgaaagccatgccctttaacagatatacagaaaataataaatgcattgtcttatgataaaaggaaattatatgtgtctttttttttttaaggcaagtgagttaacccttaaggctcaggaggctttttgccttctgagaatttgccaggctttttattgagaattagcctattgcaactaatggttttatgggacaggatttcccaggattacttggttcattaatttagctttttctagacagttcacttaggaatgtctgcctcagtagttcgactgtgtggtgtatgtgtgtgtgttttaaataataataccattggacaaaccagtgactcttaccgttttgtcgaaggctatattctgatgtttaaagctaaacatgaatagctcaactaaaggaaagtataccatagtgtctgtggctagggtacaacgtaatttatcagaggccaacattttgcccctctctttaaagatgttaggcaggtgctgtaatacagagagtctacttatatgtctgtgtccctcagaaataccttctagtctttaatattatgtaacccatttcattatcttcaaggctgtcattatctcaaattgattcctccagaggccaagggaaaggctcaaatctatattaaatttagatttaaaatttgcgttttttttttttttagttctcaagtggggtttgcatggctttgtgaaatcattcttaatatgtaggcattcactgatatatgtgcgcatactggcacattctttaaataccggaacatgattttctgtaggggcttccttacttctccacatcctgaagaagtgatgtgcgtgattctagcacagtgcctggcccagtcgtatcaagacctataaatcacaactgaaaatctgtttcattgcctatactgttttggaatgtgaattgaaaatatgcacacagaagggattccctcttccttgactatataagggaacggtgcagcagaggctcagatacagtgcaactttcatgagtattgccctgcagataactaggaggttgctttgcccttgagaagacaaggatggaagcagtggcctttccgcctctctccaaaaggcagttgggttggataatcatactttgtatttatacggagccctttgtctgtagaaatcaaagtgcctgactaatgctaacttgttaatactcagaacaccccagggacataggtaggctgcaaagattatcccagttttgaggtgggaaaatgtcctgttgttaaaatcatttacaatttccgggtgtgtctgtatttaatgctcaggctagacctggaagcgctgtgatctagagatcatgagaagcattttttcctgtgacatagtcagccctgaccacaggcagtctcatgagaaagtgttttaccatgaagaaactggcctggaaaatatagctagtgcatgatgttgatggttgggggagggaggaggtggtgaagactaatcgttctttattttaatctatttagggtcaaaggatgtattttttttaaagatacagcatgggctgaaacttctgatttttgttttgtttctctttaactcaatatgatgttggcaatttaacttccacaaaaatcaagtcaagtttgttctttgtgaagaaacagatacagtactgcttatgggcgctgcaaagttaagtcagcggttgctctgtagtttcatgctttgggggcaaaagaattgaaacctgctgttaacctggtatggtactgtgtgattcttcaattctggagtgccgtgggcctccttcctgggtttctaaagcacagtgtaaaaattagacaagtgccatttactgttcagactccttcgttgaaagcttttccagaaaactccacagtagggtggaggtgcctgggttgtttggctcctgaaactgtttgtttgttggaacctgaatatagaaattagatttgaaaaaaaaatctctactcaaaatgtgcttttaatttcaaaatgtaattttcaaaagaccatacaaaatgattccagtttttgcttaagaaatattcttttcttttttcttctttctttttttttttgtttttgttttttttttttgtttgtttgttttttttctttttggtttgtttgtttcgtttttttctttgagacagagtcttgctctgtaacccagtctggggtacagtggtgctatctcagccgactgcagcctccatctcacgggttcaagggattctcatgcatcgtcctcctaagtagctgggactacaggtgtgcaccatcacacctggctaatttttgtatttttagtagagacggagttttgccatgttgcctgggctggtctccaactcctgggctcaagcggtctccctgcctcggcctcccaaagtgctgggattacaggcgtgagccacagtgcttggcccaagaaaatttcttttcttttctttttatttttatttatttgattatttttttgagacagagtctcactctgtggcccaggctagagtacagtagtgtcatctcggctcactgcaagctctgccttccgggttcacgccattctctggccctagcctccagagtagctgggactacaggcgcctgccaccacgcctggctaatttttttttttgtatttttaatagagacggggtttcgctgtgttagccagtatggtctcgatctcctgacctggtgatccgcccgccttggcctcccaaattgctgggattacaggtgtgagccaccacgcccggccaaaaatttcttttcttaatcatatccccaaatgctgacaatgtgtcattgcaggtgatggtgtcatattttttatttttctcccaattcatgtatacattttacatatcttctaccatgaagttattactttcataatctatagttatacagcacttttcaaaatcacttgttacttattgagtgtgaggctctagactatgcactttacatgtatcaatttgacataggtactttcagttcctcccattcttattgaagaagaaactaagacacagagaggttaagtaacttgtctcaggtcacacagctagcgaatggtagaattgggcttcaaatccagacacagtgattggtgtgcattcaaccactatgtatgctgcttctgtggacatacattaatgtttttcaaagcaaacttctatttctttgtaatttctgttattctctcagggtcagtaattcccccatattcccagagaatccttacttcttcatgcctggagactcaagttccatcttatgctaaaccatggttactggaagttcaaaagatcattgtcactttttgagcacaactctgtgagcacaactgtgtatcagatgaccaaagtttttttcagattccctcttaaagagttactaattcctcaaccaaaccaatcaaatctgtatttctttgcctccataagatgtaatctttctaaagttcattacaaagttacctttttgtgtggtttagattaaccgaatatatttttctatacgtgtctaattttttttaatcggtcatgtcaagcaagtagttctagttccaggtgaatggaagaactccaaatccatacgtctatggattagtggactttttgtgtgtatgtcattcttgaatacagtgaagggattctatccaggctgtgtgaccttgaccacattacataaactttctgtttatataaagtaatttagaaccaatcgtagttgggattcagtgttagttaccattttcttcattgatagtatcaccaccagtatcatcatctccccctagctcaatatttggcctcttaggcagccattcctgcattgagaattggcaaggcatgggtgaatgtttggtaagagtcagagtcatagttgctcaagtacatttgccattggaaagagccaggattctcacctgcatgtcatctgtgtaactgcagataaaccatgtacccctcttgtcctcagtttgctttttgtacaattaaagttgactgccttagatccctttgggttcaagagaggatgctgcaacttttcttagtgtttctgtaaagaggacgaccaatggtttgagatcactgggagaaaggaatctttgctttccattgagaaaatatattctcttatgcctgggggcagtgtgttatagatataataatagttttagtttccatttactgaataactatcatgtttcaggtgctgtgctaaggactttacctacacatgtcacataatctttataatttatcctctctggtcttatgtttctcttttttttttctttttttttttgacacacagtttatgatctacaagttaaagtaaccacaaacataatatgtgcaccacacacttgcatacatcatgctgtattataagtatcaattgtaatagtgatatttgaaacatttttctataggctttgcataataagtaacaaatattttggagtaggtaaaataatttaactattgtagttattttacatactttaaacaatgtatttatagtaaacaattgtggtgtttttatttggggattttttaaatattcttttttccaagaattgtccagtatttttttctctccagagaggaaaaaaaaaaattgtaagcatatgactgctcaaaaggcaaaaactgagaaaggcccaacctgaaaagaaatttttttcaggttgggcctgtcaaacgactatgcaggtacacacaaatagaaatgactttgttttaaaatatttgtgaaaaactagataatagacataatggagtccctctgtatcattttttttttaaaaaaatataactttaacttttattttaaattcatgggtacatgtgcagatttgttacctgggtatgttgcatgatgctgagtttggggatatcccgacacccaggtaccgagcatagtacccaatagttaattttttcacccttgtcgccctccctgtctctctccctcatctgttaactgggtataatttacctcaaagcattgtgaaaaaataaataatataatgggtttgcactgtttagtacttgtctggcaataaacactaaaaacattacaatttttaattatcttccttatccccaatgaccagggaccagggcaggtttaataacacagtaatttagcacccataccacctccaccaaaaaaagaagaagaagaatgtatttatagcagagtgcaagagtctacagtggcttaaaaaaagagctggaaatcccactggacctaaaagccatgccgagtgggtcaggagaagagatctcacttagatggaggtgaagtgtaagatacaggtgtccagaggcattaactgtggctggactttagtgaaatttgggttaaaaaggaaaagacctgtactctcttagctctgcttttctattatttgctttatgaaaagctcgttttgaaaaaaatccaaccttggcttagctgaaccagagaacgagggacttgtccagaatggggcttgaggaagagctgagaatcaaggtatgatggggacaacatcaatattccaagagaagatgagtgaactcagttaaccagagaggtgaaaacacagcgtgcgagagagcagagatagctgggcttgttaattccttcctgtccgcctgcttggagtttgccatcacaacagtagaaacacaggatgctgctgcagggattcagatgcagggctggtcccttgggtctggggatatcaggggacactgctgcttgaaggaattggattgtggacagagtttttaggcaaaggttgaatttagatgaaagaagatacttggatgccatgtaaatgtgggcagagaacagggagggcagacttgtggatatggttatggctcacagagtcctggccatggaaaggtctggttgaaaaaaagcaagtcttttgtgtggggaaaagaagggagattaaagttagaaggtgtgacactgagaaaagacccttcctttcattctggaggcaaaagggcccacagtcagtcatgcatttttagctccggaggtctgcatagccatttgccaagattacccgtggccatctttggtctaatcagtgaccttgatacagtgtgagtatcaagttctcatgagacaatgttttgttcgtttttgtttttccatcctagccactctgtagacttgtgaccttgggcaagtcactgaacttgacaatctgtctctgtttgcccattttaaatcaagacttacaaaactttcccgaacttcccttagaaaagttgggaacaagaaatgagattagtgtagagagcaccttaactagcacagtgtctggttcatagtaagcaattcaatacagtgtttttatttagtgtcttaaatgtagggaagttatgctgcacttgtccctatgtttccagatgtgcctcatttcttaaattgttatacagatacaatcttagctattcgaaataacttgctttaaggagtgtaaattaatggagaatattaggattcccccccatcctaatatttggccagtagtgagtagttccgcattttggattattattcttgtttggccctttcctatattcccatttctgtttctttcttttgtcttctatctctgctggaatgttgcctctaaatcatttttactctttgcttctttgcccaaattcaggcaagaaaaggaaggtactttgtgaagcaaagcattcataggtgttaattgcctcttagggcatcccgagtatgtgtgacttacagtataagaaaaaaaggaatacagtaccatatttgtttgagaaagaactgggttcagtgttactaggaaaatcatggaaaatcctccattattttgagcataattctagttagattcttccacaagcttcaaaattagcaagtctcattctgaggtatgaaaagatgtgaatctgaattattcataatgagagttgctgagctgcacctcataaaaggcaattgcaaaaaacagtgggttaaatacagtgagttaatagagccttttgattcatttatccttgcatttgaccccaagtttttctactttgggaacctggaggatgggtccaacttatttatttttaaacacaatctagtcttaaacagaggcaaaaaagagtttgatgcagcatccaacttaacattttagacattttctaataaacttcacttctgttttacttcactgcaatgctaatgtggcctacagtcatagcatcctaggctgtgatcttgtcagctctcgtgagctaaacaggctcaggcttgggcactgcttgaatggaatccctccaaagacaactcaggtgccggagacttggtgtagtgattcagcgtctggcactggctccaagaggggcaaccagccagtgcctcagcaaggtggttatagggccctatgttaatgggagtaggagtatgatggtgggttttttttttagctcttcccaaagacttaaagcagacttcctgactgtttgtagtcattaaacttactacatctaattttgcaagaggaccatagatatccccccccccttttttttttctggtgtcatgaaaatcctatcctttaccttgctggctgggaagtatcctgtacgtgcctttcaagtaaaaaaggttactcataattgcaagcggatacagggtttgctgaccccttcctgggcttgattggcggtggggtttgtagcagaatgccacctcctatctagagccttcggcatctctctctgtccatgtctcctgtagttggtgcgcaggatggcatttgagctcacaacgctaatgcaggcaaatcatgacgtggtgcaggaaaacatttgcgtaattttttctctttagtcccagttcttgtaaaaaaaaaaaaaagaaagaaagaaaaaatataattttttgccatcttttcctccccaagaaaatatactcaagttgctgactttaaaagaaacaaaaagcacaactcccaaacctacctttgcggtatttgttaaacattaaagtaaaagaaaagcaaggaatatacataatcggcatcatagcaatgataaccaccctacgtgtagcttaaagaatataaaatcatgtctgtaagtatatgtgaaacctaacattggaagtagatctagaagaggggttcaggctggtgtggggtgataaagtggtccaagtactggagggagtgctttggcctggcctttacctcttccccaccgtccccacgcagagatgacactgcccatgacccatgactgtaactcctctgcagttaggacaatgatgaccaaagagaagagtgacttttctatttcttgtccctttccactttgactcaaacacataatgttggaatgctgtaggtgtggagttatctctgctctgatttttctccatgcctatcttgacattgtctcataaacttatttgcaaagactggaacactttttaaaatccatgcaaaatgtcctacctaaatatcagctgttattaaatgctctgtaagcataggacaatttgtccagctgttggaactcttgaggatggatgatgctacatagagcctttcccttctcagccactgattcaaattcagtatatcccagttgatgtaagacttggctgtctactgcacctgcttttggggttgagtcaagtgaatttactaccaatgaatgttcagagtccacacccttatttgcagtatcatagagtagaccaaacagtgactggtacaaagaaactgttaaaggctgtctgtgaatggtcattaccccctgtaagttttgttggagaatgtgttttgttttctatttatgacaccaataacctgactcaatgatttactgcagtgctttctttcttctcttgtgtatctaatatttacacagtcattagtattggaatctttctttgaacatctaatattttcacaatcaccagaatccttccatgagattaacttacttttccattgtcttgttacaaccaaatgttctatttgtaaaataaaattttaaaaaattgtttgaagaacctgttgctttggaatactattgactctgtatgaatacttccagttctacaagtgactgtcatttctttctttttcttttttttaagtcagtcacaacccttaattccttcctgcactggagtgattgctctgtctaaaggaagaaggtgatgaagtttccttgcatactcagtcctcggtcttgctacagagtgattgtcaggttgtgttaaatgatcactgctttggttgctggggttgaacaaagatagcaaactagtttaggggaaccaggctctctacagggagtcaaagagtatgtagaggatgagaaacagaggagagaacacgactcctttcctactaatgttcctatgctgcttttctttttttttacaagcttttcctcccacccctatatccacagtgactgttgattagtccatgaaattatctgaaaaacaggtttgatcttgaggggtggagagagtctaggaaaagaaattagaagaaggatggctgactcagaccagcctttcaagctggaaatgggacaacttctcagggcagacaggaaataaccaactctcgactggccaccaataaggcacatgctgtcttcattctgtgggtgctcaggatctcatactgatctgaactgctatcaattacctaccagcagaaacacatcttcaaagtttgaggcaagttttaaacagtttcagatcaagaagcacatggatgtatttccttttcagaacatcaacattgaatttgagcttaaagaacagctaattaataatgttcttgctccttggccaaactctaaaattattttggggaactgattggaagatgtgtttatataggattctatccagtgaaatctttggggatctcagactacagatagcaacctaagatggggattgacagacttttctagtaaagagccagataagaaatattttaggtctgaagggccatgtggtctctgtcaaaagtccttgactccgtttgtagcacaaaagtagccatagattatatataagggaatgagcttaactgtattcaaataaaattttattggtaaataccaaaatttgaataccatataagtttcacatgtcataatataatcttattttatttttttctcaaccatttaagtaagcaaaaaccattcttatatcatgagctgatatatgacagatgatacaacacaggtgatagaccgaatttggtccacgggctatagtttgctgacccgtgactagaaactttccagttagtcatattttttgaagacctccatgtgtcagttggttatctcagaccccgtcaccaagtgtgttatgcaaaacattttagaaagattttctccttctaccagcttgctttatgtatgtgtgcatgcctgttcaaaccatattttatataaacttgttgatgtttcttaaaatatggtagacatgtttttgaacatcggctaccttgataaacatgctaaacatagaattacctagcccctataagcacctgctatgatcttagaatgtaaatagctcagaagttgtaaacacgcttatgtaaaacataatttgtaaataacagatggcacttatttactaagaatatgaaggcactgatgagaatgaagtaatcttggaccaatagaatggaaggtgtgtcaaaaatgtccaggttccaagttagtatgaaaacaggacctaccgagccagcagcgagagggccatctcactggctctgagtgctgagagctggccgtggaccatgacatgccagccatcgggcagttccaactccttgtgcagatccgggcatagatgggagactagtcaatccacagaagagatgaaagtgatgcgtgcctgccaccactccccctgacccacccacttcttcttttagctcagagagccacttattttagcttgaaggaaaataaatgtgaatgtgtgcaactgggctctaagtgcctggttttatcattcacctccactctgtgacatcctcaaactgtgtctttactgtaacccgagcctagcatgaaaatacagcaccaggttatccagtgccaggcaattgtcacatctgttataaaggaagtgttgactcaacccacccaggaaccacccaagagtaaaaggtctccagagatgggattggaccttttaagttatttacattagcaattgatctggaacttgagtcagagttgatccttgcttcttaaaagagaaattctttcatttattcatatcctttctgtctctctctttctgctgcttgccctctccttcttcctttttcacccttctctctccctctcccatacacacaaacacatattcacacgcattctgtatccagagaatctaattttatcttcaaacaatgtatcctaagggacttttctctaattgtggttgagatattgttataaaaataagaaaagtccattctcactcctcagttgtattggaataatatctggcctgccacagtggctcacacttgtaatcccaaccctttgagaggccaaagtgggaggattgcttgagcccaggaatttgaaaccagctggggcaacacaatgagaccccgtctctacaaaaatggaaaaattagttggatgtggtggctcatgcctgtagtcccagctattcaggaggctgaggtgggaggattgcttgagcccaggaggtcaaggctacagtgagccgtgattgtgctattgcacttcagcccaggtaacatagtgagaccttgtctcaaagaaaaaaaaaaaagatttatctctggggattaggcattggagttggagatgaaggacataatctgttctgatcacataacaggtaaaaatggctatcaagtcatcatctgcaggaaacatggtgaacataggtctctgacacagattccaaaggggatcccatcagtcattccacattttccactgatcaacactgaacattataataagcatgttttttactttttacaaatcatagatggtggagatttgtattataatgcccagatacatagtgttatacactaaggatttattgcctctccttgcatgtgacaatttaaaatctagaccacagtgatttatagatcatggaaattagaaaagaaaacaccttttagtggttgatttcaaagcatgttataaattctgttcagttaggttttaaaactcctgctgagacctaaggcaatttttaaatggattttaatttggggaggatatggataataatttgttcctactctgttaacatactcatgataaagctggggaattattgtgggataattcatagcaattcacatcaaaatgaattattctctgcactagtgttgtctctccatcccaaatatttaaagttattttacctgtgtttattcatttgggggctgaaatttggaagtcagtttgcacatctttatctcgtggtgttctctgttcagtaggtcggctgcagtttcccttgggttcatacaagtttgcaaaccttttccccccgtgcttgtatcttggattatcatctttagtgggcctctgtatgagatggtatgaagaggctggggtttacagtatgattatttaagttcatgtaccctatgttgggtctgaaaaaaaaacttatacatgacttttttacccccttcaaaccagaagaataaatctgaggatcccagtagctaattttgaaatgtgtgatcattctgtagagccagctcagtaagcatttgttgaaaacttaagttctatactttcctttccttatgtacatttatgagaccatgctcatgtaagaatagttttgtgatggccggacacggtggctcacgcctataatcccagcactttgggaagctgaggcgggcagatcactgaggtcaggagttcaagactagcccggccgacgtggcaaaaccccgcctctactaaaaatacaaaagctagcaaggcatggtggcaggtgcctgtagtcccagctactcgggaggcttgggcaggagaattgcttgaacctaggaggcagaggttgcagtgaaccgaggttgcactactgcactccagcctgggcaacacagcaagactttgtccaaaaaaaaaaaaaaaaaagaatagttttgtgtgtatgtgtgaatgtttttcttaaagacactttgctgaagtgaggagttgactatagctgctctgagacttgactatttaaaaattgagactgggtgcagtggctcacacctgtaatcccagcactttgggaggccaaggcaggtagatcacctgaggtcaggagttagagaccagcctggccaacatggtgaaaccccgtctctactaaaaatacaaaaattagctgggtgtggtggcacacgtctgtagtcccagctactcaggaggctgaggcaggagaattgcttgaacccgggaggcagaggttgcagcgagctgagattgcaccactgcactccagcctgggtgacagagcgagactccgtctccaaaataaataaataaataaataaataaataaataaaataataataataataataattgagtgcccattctcccagtatttggtggaatgtggtaagttatatagagtcttcattactttgtttttctttgcttgctttattttagccttaaatgtgtgtaacctttctcctcttccccaccatatttttctctgcactgtcatctatagtccctctctctgcctttccaactagcaaccaaacccttctttgctgatcagtctattactctgagaactctgatgatagcacttaaaatatataacagttccctttctacattaaaaagccataaaaccttcatgtgcaatagctaagggaacatatatagtaggagaagaggcttttgctcctgcaggcaccttgcaaaggggactatttttcttatatgatataaatgaaatcttcactctgcccacttttacacctacgcatgtactgagcgtctccaaggagacaaggaaacccggagtccagtgatggtgaatcctccctgagacagcaggctagagtctcaggcaactctcccaggcgtcttggcttccagatgccccactcagacagccccttttctcgaggctcttccaggcaggccttgtcgaatctgtctctcccttcacagatgaactagcctgtgcattacatctgaagggctggtcgtggtgagttcagtaggcagaaggcctccctgggacacgggggtggatgcagtaggcaggtgggatagcagggttccactttcccatggtcttttctttgtcactcatctatcggtgcttgtgtttcttagctttcctttgcacctcttaaacacaaaggcgccactcaaccttacgcagtgtcttaaaagtattatttgttacaactctagttatgagcacagttcagtgagcgtgtccttttaggagaagcactgctcttgcacactccacgtttttacgtgtctgctcatgaacattaatcctctagaccactctgttctctctttcttctgagttccatgcacagggacacgcaggcccccttacctctcttccattccactattgtccctgtaacttttcttgtaaatatccatgttgttttcttatgtaaatgaagcacctgttcctttttaaggaacacactaccgtcataagtccattatgctaactttctaaggctatagcttcaggtccttttgatgtattgatgacatctatgtgtgcctcttctttgatgcgcaaataatttggttaccatatagaaattattattgatataataagaagtctcattttgtgtctaaactctaagcacatcgtttaatgagcattcttgacatctctgccatgtgtacattcttggttctcagctgcattgactcaagtaacccaacttttcatatgactttctagcatgatatcctcaaacttcagttttctgttgctggtcctactgccatctttggaaaggtgtgtggctagccagtattcctgttcttaattctttggcagtgaatgtcttcatggcggtttattgatgacattgtttttttctttttttacttgaccttttattttattttattttattttattttattttattttattttattttattttattttattttgagatggaagcttattctgttacccaggctgaagcacagtggtgcgatctcgacttaccctaacctctgcctcccaggtgcaagcgattctcctgcctcagcctcccaagaagctgggattataggcatctgccaccacacccagctaatttttgtatttttagtagagacagggtttcaccatgttggccaggctgttctcgaactcctgacctcggtctcccaaggtgctgggattacaggcgtgagccacaacgcccagcctgcttgaacttttaaaaagatttgtcagtcatatgttaaacattttagaggactcttctgttttcttcctgctttatctccaattcatactacctccccaatgtctacctttaaggagaaaccatcccatattgtaagcttgaaagggtcatttataataaacgtaaccagttttgttcacagatacataatgtgcctctttaagatgactagagatcagatttgccaaattttcctctctgatttctatcaaggtcatcctaggtatgtctcatctgtttaatcttcctttctacgtagcctaatccatagtatatttttttttgtggtccaccacttagttctttttctttatttggactcagatggggtgaaagtattactttcaacttgagtcgctacatttccccaagaagaatttggggagggtgaaggtgaccctgaaaagggccctgtagtgtctcccaagttttcgtctttgcttgggtccctcctggtctctctgtcatctttgttcagagtctcaatcactcatggtcttaaatttcatgtcagatctttagtaggaataaaatgtctgcttagatgcctgtggaaccgtggatgaaactggccgagtcaaagggaacgtaaacaaattctggaaagttttccaactaagactggtgggaagtttcatttgctgtttcatttgccaggaaataggaaagtcaggacccagtcccaaagcgcacttcctggaatccttttttatgaagagtcccctgaacctgtgtagtaacgcaaaggattttcttgtttttccttccaggcacttcaggtggcaagacagctccttcttcagcagcaacagcagcagcaagttagtggattaaaatctcccaagaggaatgacaaacaaccagctcttcaggtaacaattctttttctttttaaattgacattataccctttgggataagtgacaagcagttcaggagtggattgtgttgagcattgcaaatcatgtaagaaaatcttctgtggaaagtgcatttttggtttaccagcaagttgtaacattttggggaaaatgtgtatttgaccaaaagttttattgtcaggagtaagatctgctgattagtgaatataatagaaggataaggagttgtaagtgttgagttgctaataggcagtgtaggttaccaatgagaaaagttcatagtactcagaattgtcaccacattctcttatgttgggtctagaaatggcataaacacacacagacacacaccttactttagtgtagtcatcctcaattgggaagattttggcgacccccccacccccccacccaccaccaggagacaatgggcaatgtctagagacgtttttcgttgccacaactagcagggcagaggtgttgctggcatccagtaagtacaggccagggatgttgccaaacatcctgcaatgcacaggacacgacacaccgtgattcatcccagaatgtcaatagcatcaagaactatgactcggcctgaggaggatgtggtacttttaacattatggcttgtaatgattataatatatacccaattcttcagtggatatgttcagaatgtttctaggtcaataatttttaaatggcaagaaatttttatgtaaagatacaaaaatggttgttctagcaacttctgatttcaggcacattgaaggcaagggcttaatggagtagaagaatgagtaagtttataaaaatctaatttggggccaggcatggtggctcacgcctgtaatcccagcactttgggaagctgaggcaggcggatcacttgaggtcaggagttcgagacgaggctggccaacctggtgaaactccatctctaccaaaaaatacaaaagttagccaagcttggtggcgggtgcctgtaatcccagctactagggaggctgaggcaggagaatcgcttgaacccgggaggtggaggttgcagtgagccaagctcgcaccactgtgctccagcctgggcgacaagagtgaaactccatctcaaaaaacaacaaaaaaaatctaatttgggtttttgactcaaagtagaaaattgtaatagaagtttcaaagagacttgaatcagggtcttcatgctcacgtttaagagagggcacttggcacccgggtcctaagtggttcagactactttcatagctgaaggtgggcatccttgtcacaggaggggacagaatctataagcggtagctgataggtatataacttggtgccaattaattggataatgaggtcaacctaaattctagcttgtgtttacttttcacaggtcagggtgaaccacagcctgttcccagattatccccaaagatcaaactgaccttgaccaacaagttctagttcttctacatgtacttgggaaactgtcactttccagagagagttcagcactatagtgacgctttattggaaaagttgacaatctgccttgtttactaacccttctgtaaacacttatttggtaaaccatcaccagaccatgtgccttggaatgcgtgcgcatgcaggggacatttttaatgaggtacagtgccattgagggcccatgtcaggtgctataagaagtgctttgttgtgcagatgtcttaagaacagctctggaggatgaaatacgactatgttgacctttcagctgtgagcttatttgtcaggattcaaataagttgaaaggatcaaactgaacagtttccgtagtcagactgggaattgtgtttcagaggtcagcagcggaggccacattgcagattccataacatagccaattgttggtacatattaaagtactggggcatctcctgtggacagagacacaattaaaattctaatttattaatgtatacagggagctagcccagcctgtcactcagtgattcaaatgatggtccattctttttgcctccctcttggagctcttacagccttaaaaataccccgagtcctcttgaattcatcaggcctcaagtgcattgggaaaatgaaaatatattattgggggggaaatcttacacatagtagagctttggttagagataataaaaaaacacacacatacacaatctgtctgatcacactgctcttcagtattgaatatcatttgtgattttttttatggtagaattattttccctcatacttgctttttaaaaacatatggcatttttaggtaacttcttttccaagatgaacgaagttccttgagggctaaatataagaagtaaagtttcaggggatttccttttgagggctctttttcttcttgcctgttacagggtttttagccaccatgcagaagtggatgatatagagggctccgtttttcttggcaaggacagtgtcaaaaccaacctcacacattctgctgagcacttcagtctgtataaaaagtagggggagaaggggtaatcttgaacgctggttttggtaaagaagatgtcttgagtttttcccctaccccccaagtagaggaattgacaagcagagaatttagaccagctttaagatttggccgggggaaataaatctaaaaggttggtggactggtgtgtgtgtgtgtgtatcacagacgattgctgaaggacccctcagctgcctgatagggtcatgcacattcagtaagctttattaggttggctggccttccacaaacagaggagaaattactatcctaggtcacatggtatattacctcattataaaaatatgcatatagactggtgattcacagaaggaataaccttcatatttaaatatatcttgccatactgcatccttgctgaggcgtctccgccggagtggctctgaaatgaaagggaaatcctacagcaaatcttaacagtgctcatctctgatcttctcacccttcataactacactgagagaccgattttagcaaatttcagatcttctgcatagaggaaggcttgacagggaagaaggatttgatctgctgatagcttgagggaaaaaaaaaaaacccccaaatccccaaatatactgtgactcatattttaagcatatctcacacttccctgctttatgtttggcagcgctctctggtttcacaggctgatgatacaaacaaaagaaaatggaaagttagaggaggctataagtggttactcgatagagatcataaaatatagtcaaacatcaccaatttggtctaatttcagggagatgagagtaaataagagagaagtggcactctttgcagatccacatactgaaccaaatctgagctggtcacattcttgggtgatgtggtttattaatgaaggcattaatcgggtatagatattgcttctgaagttcttgagaaatattctacttagtaaccaaaattatctttttacttagtctgttcatttgcttcgcaaatttttttatgaatgatacaaatgaaaattgaaaattggccccatcataaattcagaatcagaatgatctgaattaattaagtgcaagttggtgaacatttccaaagcaggctggtcatggtgctggtgttcatgggatacagaactgttgaagatacacaccctgccttcaggaggcttatgagttgtaaacaaattaacaagattttgctgcaaaacgaaaattacagatgagtaaaaatagtaggctctttttttttgagatggagtcttgctctttcatccaggctggagtgcagtggagcgatctcggctcactgcaacctccgtcttccaggttcaagcgattctcctgcttagcctcccaagtagttgggactacaggcatgcaccaccacgcccagataatttttgtaattttagtagagacttggtttcaccatgttgaccaggctggtcttgaattcctgacctcaggtgatccacctgcctcgacctcccaaagtgttaggattacaggcatgagccactgtgcccagcataggctttcttctataaatatttatatacttctgaagattgcttaaacaagtgaaataaatgcttaacagtgcaggtgtactcataacctcgaaaatgcgtaactttactggctgaagattaatttgtgagtcgatgagcaattttattgatcaaattttggaactttgaccaccgtttctgggtagtaattcatcttggttctttaagcattttagttgttggcacgagtacataaactggaaggaaatcaaatgacacattttctcctaagaaagtaagagtacatgtgtattctggcagcattaaagttaggaaagaaagtaaactttgtgtgttgcttacagtggaaagctcaccagcttcaggccctctataaagaatttgaacctgaagccagtcatctgatagttttccttcctgcccatgcccttccttccaaggtgatgtcatgtgtgagccccttactcagaaggccatttcactgcagggaaagtgaaacccacttagaaggccggccctttagtccacttggaagctcagggtgatcatgtggattcttgctttaagtggaggaggttaaaatacaagattcagcaggtgtttttttagcatttttatttgcagttatataaaacatgctttaggcagcattttgctttgcattaatgccgcatataatcttagtagctcatatcatttccacgttattcactaaagaagaaattggcaagaggaaacctgtaaaggaaactacaattttatgttgttgatagtgaaatggaatggttttgaagtactgacccttaagaaatagccctatgcactgattagtaaggaggataatttaggagagggaagcaaacttttttttttaatgtctagagttaacatagtctagaattggcacccctagcattttaaattgatacaaagcattgaaattttgatatctttaagatgttactgttatcacatgacttttgagaatcccaaaaccctaaaaataagtctcgataagaaataataaaacagaaatattttagaaatagttcttaagcctttctgattacatgcaccattacaaatatgatagaaacagtgacccctcctcccagaaaaacgcacatgaacacagaatgtcacatccagttttagggatttcatgaacttcaagaagttcaccttggggtccaggctgatactcctgctttaagattttgtttttctttgatagtctgttttgtccttgcctccaaaattttggtgcaagttgtaatataatgagttcgttcatttttgttatttcaacttcagctgtgcataggtggccctgtgtcccagtctgcccaggacagcccactccatggctattgattggttttgtttattcataattcccactcttgaaggtatccccaggtacagtggctcacacctgtaatcccagcattttgagaggctgaggcaggcagatcacttaagtccaggagttagagaccagcctgggcaacatggcaaaaccccatctctgtgaataatacaaaaatattagccgggcccggtgcctgtagtcccagctactctgatggctgaggtggcaggattgaatgagcccaggaggtagaggctacaatgagccatgatggtgccaccgcattccagcctgggaaacagagcaagatcctagctcaaaaaaaaaaaaaaaatccctatttgaaccaggtgcaactgcagtggtgtgcaccatatctcagctactaagaaggctgaggccagaggatctcttgagctcaggagtttgaggccagtctgggtaacatagcaagactctatttcgattaaaaaaaaaaaaaagtggccgggtgcggtggctcacgcctataaccccagcactttgagaagccaaggcgagcggatcacaaggtcaggtgttcaagaccagcctggccaacaaggtgaaaccccatcttgcaaaaattagctgggcgtggtggcacgcacctgtagtcccagctactcgggaggctgaggcaggagaatcgcttgaacctggaaggcggaggttgcagtgagccgagatcacgccactgcactccagcctgggcgacagcgagactctgtctcaaaaagaaacaaaaaataaggaactcagtttggactttaattatatgatcactagtttaaatgtatctaagaattacaatgcaaatgtgatgctaatattttatatgtaatcatgtctttgccaccacatgcaaagtgtgatagataatgaatgtttagtcagtgctgaacgtgggccagctccttagctactctgtagtataggcagtgtccttaaatcatttaatggatgaggaagatggaaacagagagattaactgacttgctacacagcacaaaggtagtaacagcaccaggatgggaagccaggttttttagaaccacagataaccagtgtgccgtcaagaggttaattattgcctctctttttatgtgtgtttactcagcacctactgagtgtcatattttccataaataagtaaattacgctattttccatattataagcaaaaaaaagacagctgaaaccaacaaaaatcagttccactataaatatctggatttcaattaagaggactcagatctgcataattaccctaagtatatctttatttgtctgtgtgtgtgcctgtgcgtgtgtgtctctgtgtgtgtctgtgtgtgtggtggggacagaaaggtgatcaacaacagcaaagcaaagttatttcttattttcaagtctgaagtgctcttatgagcgtccatgtgtttggaacatggactagtttgttataatcattgttggggctaggaggtggagagggacaggggaaaaacatacttgactggtcaaaaatgtgtaaattgctgacaaaatgacacatgtaattaagagtgctcctgccattttaccttgtggtttacacctccagtgttgaaaaagagagtgactcccacctcgctaattaccattatcactaaaatgctagggttggagtcattagttccatgtgcatttaattagaggaaggctgaaattggatttaacttattactttttcatggatcactttcttgtcatcacttcaaattggattgcagccccaggtaactaattatgagagccacaggatcaagagtgaaaaaaaaggtaattaggaataacactgtcggacccttgctggtcgtccacttgtgcttcagggaaagagggggaaaaaaaaagaaaacgcaagccatattttgtagtatcacggattaaggagttaggggcatgtacagttgctaggcatcatgggactctgtcaccacccatagtggtttctgtgatatacagctgagttgaagatgtcgaagcaacgtggttccacaatcagctgcttaataactagattgaacttgtaaaagcaacagattggttgtaggtatgaggcatctctacaactgtgtagactgggggcctcacatatatgattacaacaaagctgtcaagatgcctctgagccaaagtagagaatattttaagtatagggagttagaatttaatgaacatattaatgctccagaaacatcattcatatctgacagaaagatgtatcagtcagcacaacagtcaggtttagggtttatatatcaggacgttttgtcaaagtttccagcgtccggtaatgttcaggatgtttactttgctttggatttgctccctcccacccctccccaaatgttgtggatgggtttcctgaggttccatttctccttccatccctattgaaaattctttaaaataaattatattgtttccatatgcagaacagaattcagaactgcaagcaatcaattttattgacaccatctgaaaaaatgttgatgacagttcgaggatgtgaaagaattggatttttaaagtccccaggactaagtgtggcaaaagaaaaaaaactgaaatgtaatctcattactcaaaagttctgttagacactcctaagaagtgattcttcttaacgaaaaaaataaaagcagcagcaacagcagcagaagggcggcttcttcttggataggctgtgatcccacaatgaggtcttgctatcaagcctattggttgccttgaagggagaaaagagcttcttggtttcccatggcagtgaatcacccagcaaagatggctcgagtttccttaagttgtttaaaattggttttagtgttctgttaatgtaagcaaataatcatgattttagtcttgagtgactttcaggcctgggcgagtcaggcttgctcagtattctccagtgcaatgggagtatagacgatgatgcgccccgccaatagagaccactacatcattatccccaaagtggtaaaatactcttcctggaattttgagtctttttcctgtgtgaatcttctgagcaaaatctcagaaccaaaatagtgatcatcaagtctaatgtagaaaattaaagcctctctctttttttggggggggaacatcttaagttgatttagaatttttgtacacaatattcgtctgtggttgaaagggggcacgctgaggtcaagtgatgtagtgttttccatttttccatatgagtctcacagtgtgcgataaaagcaaactcctttattttgtaagtctgcaagaatttctgctgaagtgcagaggtcacgttccctgtcaatttgagtagccagcattttttaactactgttttttcttttggtgtgtcttttcttccctccccccaccttgctataaaccgtggcacttttctgacacatgcacagtgaggtcctccaatctgaaactcattagcacacagcattggaccctgtccagtggttagaaaatttcctggagcctagaataacagcatttggtgcaataccatggaccagaagtgacaatggaggtagtcgcactcccctggcaccctgcccggtcaggaaagccagctgaccacacaacacggtgagacagaggttgtgcatataggatgagctcgaaaagtttggtgcttagagaaatacacttctaaaatcacaaggcaatatctgttttccctacacttattatttctattgggtcagagatgtttatcaacattcattgcaggaacatgaaaataagcaattagagaaaataggatgaagctcaagttccacaatatagtatttttcacttctgtaactatgggttattttcaggacctatattttcattcattcattcatacatgcatgcattcattcattcaaactttactcattgaacttcactatcttgagataatgtgaccaggctgcaaccccctaccctgacattagaaaaattaaacagtttaccctaagtcaggttaatttaagccaggttttcaaacaggaaactgagtcccagaaagataatagttatcatattaaatagtaaatactatatagtactttctaggagccaactactgtacaacaaccatatggggtaagttctattattattcccattttacaggggaggaaagtggagcatagagaagttaacttgtccaaggccatacagctgataagtggcagagctgggattctagcccacacaatctggctcaagagtctatgctttcatccattacactctactgcctctccctgagctaccacctgggccccgcaaacagggaaagcaaaaggaatggaatcagagttgctgatgcttaatgctcctcgctaaccaccagaccacaccgtctcctaatttggacatatgttgatgggcatatttgaaaaatagtgcttataattgaaatatgcactttctaaagggaaatgacgcttgggaaagagaagaaagacgggtattactcaaagcctgcagacagctctgcaagtaattgtctaaaggcagccgttgaaattgagaagcagtttggaaaatgtacagtttgggaaatttgtgtaccgatgtaattacggtagttgtgagctgatgtcatgcctagtaactgtttttgtattgcttgggcctttgttactgagctgtgatatcatgagcaaactattataaacatagcatggatatagcatgcttgtgtaacaaaagatcgggaacttttattaagtttgttttccttgtcatattgtaaaaatttattatgtgtactgtgtatattagaaacagatttgggtaattctgtctaaatgaagtcatcccggctatttccagactgtctgtttttggttgtgaataattttcatacatcagatggttgtcatatttagtcgctctcaaaattttaaagagaacatatcccattttgaacttttggtggacttcagccaccttgctgttgggattgtttgagtttgaaattattgcccagtaaattacagggactgaatactagtcatttctaaagggtctggggttgctgccttctattcataagttctctccttcaacaaaagaacagatttttaactacttaagtagtagaatttaaagctgctggacacagttgggcaaagagcgccggcccttgtccttttacattatgtcccattgaagaactttggtaaatattcaagcagacagagctcaacgtttagcggtgttcgtggtaaatgtggagtttaaatgggtagttccaaaactttgaatgactcgatccttcccagctactctcctctagctccttcttttgctgccaagcttttagactcagaatattgtgcctgctgcttccttgtggtgtttttttttttttttttgctttttcccagtcactttctttcctaaactcctcccaagtctggcttttctcctcatcattttcttgaattttattgtcactaaatttagtggccatgtctccatccttctaacctgtctggccttcttagtaatacattgcatgggctaacttgttttttttggaaaatgccatcatttaaacttcttcaaatcagtaccccctggcctccatgctgttttctttctgcttcccagttcatttctggaacccaagttcactctttcccccaagttcagtttctttgatcccctttaatttcagtgcatctgggctgtgtgcttgttctagaaccttcacacacatgggtgcctccagacctgttgtactgctcctaagtgcctacctgtggttctctcttagctcgccttcacatgaatttcagtatctctaatccagcagatcccttttgtccccaggtcttattagtcacagtcatttgactcatcactgacctaggaatttccttcatcctcagcatgttattcatcctcacatgtgccatttttccttccgctggtattttctgtccgttcctttttctgtgtttcccctgctgccaccttattctagagctgtcccttcaggtgccacctgctgggattttggcaaagactttttccaacccgtcaccccctcccctcaaagaatcttctgttctttatgcatcgctcacctcctatcctctcctcgaacgccatgtcattctgctcttcagaaccgttatgtatcataccatgtctccatcctgctgccttcatctagttaattagcattccagctttgcattaaattagatgtcccgagaagaagtttatagccttctgactggggagaggggagagagtcatgaattcagagtcatcattcctttgtaaggagctggataaaagtgcagtccatttgataacagttcagagtccccaaaatccagaattgcagatactgtgtactgtgttgcctgctgtttagagagaagacctttggtgattaaattgtgtgtgagtttaatttcaggagattatctttgtctgctttcttcagaaagaaactaaaaaccacatgatgtgaagggctgtcccgttcctaagttctccaccatgtgactgcctgcttcttttccattggtatctaccactgccccctagaaggtttcttctgatctcctctgactataagaccttaaggcgagacactcccttgtctgcacatgggagagccgctttgtcagacttaatgaaattgcttttaataagacatcagtgaaattatgtctggtttgttgtttgtttgagagcgtaaagggattgttatttattctagaaacagaataagagtctgaaccacatagaattacacactgaagaggttttgttgtgactaccaactttgttgaggatatgaagtggctctacctagagtgctgtttgaaggactgtgggtctgagatgggctctgaagagtgccacgattgattaggtatgtctgccatgggcactggagatgggagaagtgctatgtgcaccttctgtttgccaagcttgccatagacctatctgaccatagtctatgctgatccatgtcagagtggagaggtctttttctctgggaagtctaatagactctgtggtaactattgaagtattatctaaacttaaacatatgctttgtgtttttccctgtaaccttaaatgagactgggcaaattgcattcttatcctaaaaccatgtctcttcttgatcagctctgaaatgtgatttgtcctttaaagccacaggatcttttacactggactgccacacaaactcagctgcatggttgagttttggagattgtatatgtcagaatatgttgggggaggaggcagcattacattgtgattaataccatggcctctggtgtctgactggcaggttatagtcccggtaccacctttaatcctgtgtgaccttggaaaagtagcttaacttctctgtatttctgttttcttatctagagaatgtggctggtaacctcacctacctaaggcagttgtgaagattaactgattaatgcatgaaaagtgcctgtgtaaaaactgtggggtttttttgttttgttttgttttgttttgttttgctttgttgagatggagtctcgatctgtcgcccaggctggagtgcactggcatgatctcagctcactgcaacctccgcctccagggttcaagcaattctcccgcctcagcctctggagtagctgggattacaggggcgcaccaccacgcccagccaattttttatatttttagtagggacgaggtttcaccatgttggccaggctggtctcaaactcctgacctcaaatgatttgcccacctcggcctcccacagtgctgggattataggcgtgagccactgtgtgcaacctaaaagctgtttttaaagggaaaataacctagtaaattccaagttatatttagttcactaggtactggccatttttcaaatgcatgttttagctgtgtaatgtggaccatcgttttgcttataatcaacttttgggtaaccggaattgatgggaggacatcaggctcttcatctgtaaaatgtggtaatcatagcatttatcccatggtgttgttatgaatattagctgagtaacatctgtaaatagcttagaaagacatataaaaagtacttaataaagtttagcttctgtcatcatccgtgctactaactacttttagcagcattattttgattgcacagtgtttttcctaaatgtgtcactttaggcacaaataagggtcatggtcttctaaaaattccatcctggtctttcttttgttcttgtcttccagaattttacatgaattaatgataggtagtctcaccagcaaagaactggtccttaatctgaaatcttgatgctgtgacattccgcaccattcctgacataaagcatagacacttattcatgaatgagttagtgaataactgagtgatgaatgagtgactgaatgaaggagtaaaatacctaagccaaaaagaaaggaaaattgatactggttcacagttgaagaggcttcagactggtctcaggttcgcgagcccctagaaacatttcaagaccataaaaacagcattaaaaaaaatcctgtgtcagtcctgcctaaatctttcattgggttgatgaaatgaatcctgccaggtatggagtgaaaatcagaacattcctgtagtgcggttagactaccctaatgccctgtgcctgcctttgtacatttgctaatccatttaaggtataatattaatggcatagaactttaattcgtaagtatagaaaattaaaggagactaaaggcaaaatacagaaatgtatttggtgtcaagattacgttcaatgaagcatagtgaagatggaatatacttgcagggaggaaggaaaatacacctaaatctctcattttgaaaggaattggtttacttgattatttgcaacagtatcacactcagggaaatctaagacaaatgaaagcaaaacagaatttaattgagctattattttgcagactttggcttggtttcagacagtctaatcaaattgtcctttgcacaaataactaatgttaaatgcagcctaccaacagatgtttaaaaggagtctaattggaaaatctacatcctggatttagtctgtctcactggaaaaaatagcttcaaatttatatttttgaggatgacacccagtggcaagcatttccagaagataaaattttcttcaaagatgctcggtgcttggatggaattgtcttggatagtcaaaggtggcactctagaaattcaatttcctggaaattctccagctctgtgccatgtagagctctacaaagaaatctctttatcatgttacgtcaccagagccctgttaccctccctggattgtgtcagtggcccgtgtgctgtaatttataatgagcccctgcaagtcctgcaaggcgcattctgattgatgacatttaaaggtactgtcaaggtggctgggtaatgaagttgaccttcctccatcgttgtctcagtttcaagtttgtatgtataaactatttcacctgccatgtttgcttggaactttttatgatatctgcaaaaggaatttggtttactagtagttcttttcttcccattagatcagggattaacaaaatttctctgtaaagagccagatagtgaatattttaggttttgtgggccatactgtctctgtggcaactacttactctgttttttgtcatgtaaaagtatccatagacaatatgtaaatgaatgagcatggctgtattccaataaaaattcatttgtggacactgaagtataaatttcacataattttcacatcacaaaacattcttcttttgtttttccctgctatttaagaatataaaaacaattcttggctcaagggccatacacaggtggcagcccagatttgggctgtagttggctgacctgtgctttagatgactggatatgatcatgcagtttgttcattgaaccaggattccttattgaggggactagcaagggccgaaatctagcaattgtttatcccagtgtaccctggcatggcactggggctgtgtcagcttggaggaagaggcatccatttttttcatttgcgcagaggtgccacctaacaccccactttccttccttttcattgtgttagtttgaaatctatccgtgcattaagataggtgtaatggtgaaactagtaattttttgggtattttgagattcaggaaaatggccacagctggcagggctacagttggcttataccacatacttgtgtgatattgaggaaggtaccctttcaagacactttactctcgtccttctgaatattttcataatatatctgattgtattacattaaaacacttcactactatctgtctgagaaatatcttactggtgatatagatctacagtatctaaaatgcatacagctctgtcttgaatccaagacataatgggactgcttcaacatggagccctcctaagatgcccagtcaggtgctcacataattttcctccattgtttgtattttgaacccaagcatgttggattttggcaaagtgacttacatttgtaagtctcagtttcttatctataaatgactagtcagtggttttcaatcctaggggtgcatcagaactaaggtaattattacccttatcaagatctagggatcaaagcttttaaaactcacagttaggctccggaactcttatcttctgaatgagaatcttaggatggggcccaagcatgtgtatatttaaaaaccttcataagtgctttttatgcccacccatgtttgaagaccaccagtcaagaagacagctaagtacatttccaacttaaagtcttagtattgatttcattctgctttttcctcatttcttcattccctagccttcttctagggtagcagaaatgaactctctgaccttatttcagcaatgcaagccatctatagtcatcagaagatattgggaaatcccagctcaggagtcttagattttgcctttgtgtaaatttatgcaggatgtagcattggacaggaagctgaatatcctaatacaagaattaagtaggccacccaccctgttaatcttaaagtcctattgagaagtccagggagtgacaaaaatgggtggtccatttggtatattgaaggtctaccttgagatttaaaatgtacagttcatctccttttctctacacattttatgcacttctgctttgaaatgattatgccacattttttgtaatatgcatccatttttacaatattcctagctcagcccaaattgggaaatactgtgtctcaccagatcgctaacttgatatctgaccaaagtgatttggatacctttcaggtaagtgttgaaattggcccatgtctcagtgtcacacctggtctctaggagtttagggcatacctcattcagcagcctaaatgttatttaaaatgtagactctgtgttgatctaggagctttcttctgccagtattttaaaaacaaataccttctttgctcattctgcaaaatatggaaagaaaaaactgccagtgtggaactaggaagaccaactgggcctcttacctctttatctgttttacattagcatatcatttggcttttaacaaatagaatcctcttcattctacaactgttctggaattttggggccattaattgatgaaggcaaaatcaccttactacagcatgttccatgagggccacatggcaattaaggcagtttttctttaaggtaagaccaaccgtgtgaggcccagatacccaccatctaatggcagtaggcagtctaatattttttttaacacaatttaccaattggattcctacaaaagagagattatattttttgacttatgaacagcaggtcagacatttcaaagaaaatttagagagcagtaattttgaaaatgtacacagatgaatttgaaaataaatatttcgctgcctacgcagctctatttctaaggctggctttggaaacgtattccagaggcctcaccattttgcatgacacggtgtcagttcacacacaatatattaatgcttaattgaagataatgtaactgcagatcaaaggcataattaatgggcttgcagaaactcttatgtagatcaggattttgactaatagaagtctggacaaaactggtttataaaaggatcttgagaccagctgaggcttcatctgtctgctcagctgatggtgaccacagctggagctgccaccaggggtaggtgggtgaataaaggatagctctcatctccaccattccccgtccccaaaccaacacttcctggtgtggctcctggttggcctctggaactgctggactgtagagctattgaatatctgttgtatacaataagcaattagtttctgttagattcaggatatctctatgactctgtgacctgaaacttttagtgggaagcacatgatcaggaaacaggccttagaatggaagttggcagttgtaaacccatgggccaaaccccgaagcttgtttctatagtactgaggagccaagaaaattgttacattttttaatggttggggaaagatcaaaagacgaataatatttcatgaaacatgaaaattatattagccgggcatggtggcgtgcgcctgtagtcccagctactcgggaggctgaggcaggagaatggtgtgaacctgggaggcggagcttgcagtgagctgagatcacgccactgcactccagcctgggcgacagagcgagactctgtctcaaaaaaaaaaaaaaaaaaagaaaagaaaaaaaagggaattatatgaaattcagatttcagtgtccacaactatagctttattggaatacagccattgtgaacttgtttttctgtctatggctgctttcagcagagatgagtgggtgcgacagagactgtgcgtcctgcagtgcctaaaatatttattctctggccttttatagagaaagtttttggcccctggcttcaaagttcaggtttggtctctaggacacctttgggagaaggagcttgggcatctagaaacttactgaatttatagggaaaaacacatgaaaaacaagaaaacagctttcttaccaaaatgtttgggaactgatagagaacaatgttactgagaggcaagaatacagcattctcatgagaagattattgatttttatcgttaccatcaccatcaacaatatctaagtctcattttgatctttattgatattattataatcataggattcatttggttttaaagtttggtgtaaatgacatagcgattctgagagcaaggcctctgggaagtaaatgtgagaacagaccagaggcttagtgattctttcatccatccatctattcacttatcctcattctaacatttattatgtgcctgtagtgtaccgatcctgcttagtactgaagtagagaattgcatatttcttagtccttatatcacagttgaaactgaacagagaattataatatgatgtaataaatgtactaacagaggtaatctgtactagccacatttcaagttctgttcctaaactgggaacacacacaggaacagaacttgaaatgtggctagtacagtcaaagagttggatttttaaattgtatttacattaaataaatttaaatttaaatagccatatgtggccagtggctattattttgattaatgcagatatagaacatttccatcattgtgaaaagatctattggacagtgctatctagaatgttcttttgctttttttaattttttttttttttcatttttatttttattttttgaaatggagtcttgctcttgtcgcccaggctgagtgcactagtgcgatcttggctcactgcaccctctgcctcccaggttcaagcgattcttctgcctcagcctcccaagtagctgaggcgtgtgccactatgcccggctaatttttgtatttttagtagagacggggtttcaccatgttggccaggctggtctcaaactcctgacctcaggtgatctgcctgccttggcctcccaaagggctgggattataggcgtgagccaccacgcctgagcttttttgccttttaaagcatttggtaaatatgtcttcctgatgaaaaatcaagaactaatctcttttaatgtggtgtcttcatatatctctaaagtatatctgtgcaactctttgtcacgtgtctctctatatccttcttttactgtattgctaccagtgtaagacaatactccagtcatctctgggaacatctactgcctccattttctctgtgggagctcaagttttccttcaaaataagaaaaactcccaagacctggaagtttgaaggaaaataagccaaacgccctccctcacatttgaaaactgacaattatttttatttgtgcaggcttaagatggaaataagaacttctaaaagaatttgaaaaataccctacttaccaaaaaagcttaaatcatttcctctgaaagtttccttccatctaaggtttgcttcggttccacagaccagcctcctcctgtcctcaatctgagggggaggaacgtgaccttcagtttccgctgatactgattttagggtcccacaagggtctctgtacttgccctccctcttagagacacagactggcacatcctggttttcttttttttctttttttgagatggagcctccttctgtcacccaggctggagtgcagtgatgccatcttgctcactgcaacctcctccctaactcaccaggttcaagcgattctcctgcctcagcctcccgagtagctgggattacaggcgtgcaccaccatgcccagctaattttgtttttttttgttttttgttttttttctgagacagagtctctcactctgtcgcccaggctggagtgcagtggtgcgatctcagctcactacaacctccacctcctgggttcaagcgattcttctgcctcagcctcccaagtagctgggactacaggcgtgtgccaccatgcccggctaatttttgtatttttagtagagacggggtttcaccatgttggccaggctggtctcaaactcctgacctcaagtgatctgcctgcctcggcctcccaaagtgctggaattacaggcgtgagtcatggcactcagcctacattgtgattttcctgttggcttttgtaaaagccagatccttgaactttgtttcttatttccaaatgttgattacagttgtgtttctcatacctctctcccagctgtgaagtttattggtctttgttttattaataattctataattgagaattatattttattttagactcataatgtcatagcattacattcattggttgaatatgttaactggttaggaaaaagcttggggttacccttaatcttgagcttgagatattgatgagacaattaagcttaatttggtaactctttggagtagatagacccaaattctaaaaaccatcatttaccatctctgggaccttgtccaagtaaagctcagttttttttttgtttgtttgttttgttttgttttgttttgttttgttttgagacggagtcttgctctgtcacccaggctggcatgcagtggtgcgatctcggctcactacaacctccgcctcccgggttcaagcacttctgcctcagcctcccaagtagctgggattactggcatgtgccaccatgcccagctcattttatttgtatttttagtagagacggggtttcttcatgttggtcaggctggtctcgaactcctgacctcaggtgatccacccaccttggcctcccaaagtgctggggttacagacgtgagccaccgtgcctgggctaaagctcacttttgagcttctataaagtagaaatgtctacccagcagattaattcagaggattaatttaagaatacatacacacacacacacacacacacacacacacacagaatctggcacctgtagctcaaaatgttacctgcccttcttatagctgttgttctgatcattatattatgatgatgttggtttgggttattacttgtgagatcctacagtggtctggacacacaaaaaattgaattttatataatactgaggctttctgatggtagtagatgggcagagagtggcagttgtcaaccccctatgcatttcagagcgaagtgcatttagaatggccatacctatgttatcatatacctatgttatcgtctctgaatctttgatatatgccagatgggttgcaaattctacagtgaattgttcacttctgtaggtcttctgtgcaggaccctagctctcctgtaatggcactgcaactgctgagaagaaaagacagagtgcaatgatcatgcttccccactctgaccccctcctagttcttccctgcactcttaaggaggcagttgcacagttattttttatttgacattatagttacatatatgcaaagaagatcagggagtatgctcattttattgtgtcttgatgtgttgggaagggaagcatggattataaaattatcttttcatcaagccttctagttagagttgacttgcttctcctggggactgagtaatttgttactcttcattgccctgttactttttccccccaagggtggttctcctcacacctgcaggagacttgttctttcacttctgtattatcacattacatactgcacttatgaaaaacggggcaaatgttttctaacagccatcgtgacaactctgttacaaacagggaggtactgtttagttgaaaaacatgggaatatccaagaaaaatgtgaaagaagcttagaaaatgaaatttcttgaaaataggaatcgagagatttgttttatgatgggagcaaggttgaagaaagtaaggaattgattccccattagagattgcaaactgatggcccgcaggctagatactgttttgtttatgcacacaacatttaacctttttttggttcgaactttttgaaggctttctttttctttgcaaagatttaaaaaatctggagatttcccatgaaaatctcattttctgtcatctcctaaaaaagaaaaaaatcagaagttcaagcaatatacatagcaccagttatctggagcagagaaatgctgcccattcccactttgccatggacttcaactcatttcagtagcctgcctgtctgctgtctatccctcttctaagtggctcaaggtttcatgaacagattcacctcagagtctcaaaggcaacagcacgctatagtggcccagctagagcccaggcattttggaattcttgatttctttgtatctttgtaccctgattatagactgatgtctttttaaactggctgccttgtgaaaattagagttcctctttcttaactaggactgtgggtagtagtgatccccatgtggcaaggatggggcagggaagagtgttcctgcaggaagaaagtgtgtgcaagccagatgacatgcaactgccctcatgatcagatttggataactctgttatttactccaaaccttagtgtcttacagtttaaacatttattcttttacacactttctgtgagtcagagataggggagtggcttagctgggtggttcaggctcatagcatctcatgagattgcagtcaaaatgtgaggctggggcatgattggggctaggggagccgcttccaagatggctcgctcacatggctgtcagcaggaggcctcaagttctcaggctgtggacctctccatagtgtgacttcagtgcccttgtgatgtggcagctggcttttcccagagtgatccaagttgtgacctagccttggaaatcacataccattacttctgccatatttattggtcacagagaccggccctgacatggtgttggaaggtactatccaaggcatgaataccaaatggtgagaatctttggggcttgtttcggaggttgggtgccactgattccaacctcctcattagccctatttagaatcagagtaagagcaagtcagtgtaattgtttataaagtgtcatatccttcagctatgttggatggaagaaaggtcaaaatgtgacctgagcactggtgtactcttggcgtaaggtcattggccaaagtattattcacttcactaaaagatttgcctgtactaataagaaagagagattgacaaaagagatgaactgcactaaggtatttggtgagttcgatttctttctcaaattatgcaaatttcctccagcgtttccccctaaacaatgggaagttgcatattctcaaagctgtaagaccttcaaagataatctcagagtgattttaaggcaaaataagtagtttaatatttatatctaactgcgtctctggtgtctcagaagtctttgacatcattggaatgactttgttagtacctttcccataaatagttagctagacaggtgaaagttcaagaaaaataatgagatcctttacgcaactcaaatagactgttcatgagattccctgttcaacaaacatctgacaaattattgggtggttgtgttgacctagacacctagagtgaggcacctagagtgagcagcagagaaagcagccgggagattacattcttatgggacattaaactggtaagccaaaaaaaaaaaaacaaaaaacaaaacaatgtatcaccacatgttgtgtgacgatgaaatctgtaagaaaacaaagtagattaagataaacaccgtggtgatgacagtcccatgtttgactggctggccagggaaggactctgaggaaatggtctttgagtagagaccttgactgagtgagggactgagtcttgcgtctatctagggaagaaagtttcaggttcggggaagagcaagtttaagagcccccaatcagaaacaagcttggttgctctttcgcaatttccagagactccatctattccccagcatcttggttctcaccactgcactgcttatggttgaccgtcagctttgcttttttgaccatagtcttacagccctggcttagccttctctgaaaacatacatttgcacactaagccagattcacatgggaggtacattatgccgtggcctagtctagtgtgtatttcccctttctctccccacaaagattttacaaaacttatacatgcaaacaggtatttttgtttgtttcacatgagtcgcttttgcataatataacaagcccatgatttcacatgtacagtaattcatagaaagtgatagtcatcttgcttagacaccttagttctcaaatctagcctgctaaatatagtaccttctcagacccatataaggtgtcataaaaaaagaaaaaataaaggtcaaagtttccccacccacaaatttggttataaaaacagcaaagcagggtttttctgaacttgaatcagtaaatttttaatttaaatagtatcctgttttgacaaagtgctaaaccacagaggtctgagaaagacactcttaagcctttgtcaataccagctggcatctctcaacaggaaaccttggatgacttttgttgtcattttgtgatgcactgacaaggaatgcgtgcccttatttgttgcatcaaggaaatggtcagagtacctctgatgcggctcgatgccgtttacatcaatatgttgcataatcctttgccagacaaaaccggtattttgttgtcgttgtttgatcaattaacattggatttctggctttgctaagtgcacctccagagcaagacacaaaatgatgtcacatgagttctgttctctgacccacccaacaaagaactgagctaacctgcaacccttttcctgccttggtcttttgatctcatcagttgtgcagctcacctcttcagggcctgcacagctcttgaatggtgtggactgtcccgaggaaatccaaggtactataagagctctttgttggaattcagtccctagccctctctttatctcactttgtttcatgttgaatagtaagttgcattttactgttatggtgactgcatttttcttatggggccttcagggtaaacagccgttagtttccatctgtgaacacacatgtagcttgtgtttgggtagggtgcctggtgcttccaaagtcattattttctctgtaatgtttgttctccatggttgtgcatagatagattctatgccccagtgcaggacgaagaggtagcctgtaattccagctgaatgtgttgcagttgaaagtgggacgggagtggaagcaagtgatggatcaagcaaatcgcttttaattttacataaattggttttctgctttcctctggggcagaagtttgctgctcagggtcatgttaaatgtcgctgatgatttggaagagaggcattcctggaaaatatccggtgagacagaacttgggatttcagtccctgcctctcattgacagacttggggaaattagagatggagtctctagcctgggatgggagccgttatctctggaccagctagagacactggagattagaaaaggcaacagcaattttagattcccgaagaataaaattatcatgacatttatcaaatgtgctccctttccccccggtacattgcataataatgatgtttgtatatgttgttgtcacataagcaagaacgagagaagatcccctttcatgggatgctcacagatttccttaatatgaaattaactagcagtcctagataagtaagctagaactgtaatgggcacagtctgaaagagggcagagctttctttttgccccttggccaaggacaaaacatgggcaaggccagttgtcaacatgagacactggtttcaggtttgcagctacaaagaatacagttgtgatggatttcaatccgatatttgcagttccaatgctagaattttcagccatgtcatcctgagtctctttaggctttagaaacaaaggattcatgtttgaatcgtgacctgccaccatgaccttgggcaaaatagaaaactttgtttctttgtctataaaatggccgtaaatgtgcggtggctcacgcctgtaatcctagcactttgggaggccaaggcgggcagatcacgaggtcaagagatcaaggccatcctggccaacatggtgaaatcctgtctctactaaaaatacaaaaaatagctgggtgtggtggcacccgcctgtggtcccagctactcaggaggctgaggcaggagaatcgcttgaacccaggaggcggaggttgcagtgagccaagatcacaccactgcactccagtctggcaacacagtgagactccatgtaaaaaaaaaaaaaaaaaaaaaaaaaaaaaaaaaaaaaaaaaggccataaatgatacccaccatacaagaaccaaatgaaaacttggacataaagcacccagctagagacacacagcatgtgacatacgcttaacgaaaggtgctaataatgttattagaatttcactggattgttgttgatgattctaatataatattccttaatagtaaaaagctgaagccataggagcccagtaatcttcacctggaatttcacagtaacaggaaaataaatgaaactttgggatactaaatattaatggggtgaagtaaaaaaagctaagtggggcctggcgtagtagctcacacctgtgatgtgaggcactttgggaggccaaggcaagagaattgcttgaggccaggacttcgggaccagcctgggtaacacagggagaccctatctctacaaaaaaaaatttttttttaaattagctgaatgtggtgttatgcacctggagtcgcagctacttaggaggctgacatgggaggattgcttgaccatgggaggttgaggttgcagtgagctgtgattgtgtcactgtactccagcctgggggacagagtgagacctcgtctcagaaaagaaaagcaaaaagctaagtggaagaaaaaaagtagttgcaagctgttacagagctggacagaaaatgcatagaaataagtggcttttggcaaattctttgagtgaaagaaatgaacagccactaacaaggaatgactattttatgcccaaatccatatatttaaacaatgattgattgattgatttgtttgtttatttattcaagcaactattgtgcctcatcctccctggtaactgggattaacaggtacccaacaccacacccaggtaatttttgtgtttttagtagagacggggtcttgctgtgttgcacaggctggcctcgaactcctgggctccagcgattcccccacctcagcctcccaaagttctgggattacaggcatgagccactgcgcctggccaacaatgatttattttaaaaaatcattttatttaggagaaagcaaagactttgaaaaatagtgttaactatgcaagggcaggttattcatgaaaaatctattctatattttaacatgcctggtctcagtaagtgatttcagtcagatagcttgaaagaggccaccatgaagaaaaatgtgtatttctccagaatgtatgtattacaataaaatagttgctaatgaattcctttaaatcatttattaccagactctatgaaagtgagattatcataatttggcagagtggatcaagaacaaaaaataaactatcagattcaggaaaaatgagaaacaaacccatgggtgaggaatcagtgaatcattgtagagtttgtttttgggggaaaaaaaaaaaccacacacactgaaagaattttgagtgaaaacccactggactgagaactcttaatagtatggtcatcataagactttgaggggatttctttattttttttagagggtgaaaatgtcttgaagaaattcccagggcttggtgaatagaagatactttactgaatttcaaagtgatgttgcaggcatacccttgaaagaaatttgtgaattggggtgatcgaaagaaaaatgcacaggtggtgaactgaaacctggtgaatggtgcatggctgggacaggccgtgtacagttggggttgacttggggaatccctcccagaatggcatcagatgaaccaagatttgcaactgcaatggtgtgccttgtaatttggggtttccctcaggcagtgcttttctaggttgtttggaagtgttacactatgaccacttcctaatcttcttgtggaaggaggtacctgtattagtcaagactttttcccatgcaaatgtcaaaacccagctcagactggcaagtgatgaggggttggggtgagagagtgtgtacgctcacagagcttaaaagttcaagggttagcctggcctcagacccagctggaaccaggcactcaggtaacgtcatcaggaagggtctgttccaattgttctgttctgttctgtttctttcctattggctccgttctttgtcaggtttttcccttgctgaggccagagggcttctgagagtccctgcttcacatacttacagcttagcaacccctcagaaagagagtatctcttgctcagtaattccagcgaaatcccttgaatcaattgagtgacttgggtcacttatctatacatgaaccagtcactgtggagaagggaggagatgtgctgattggtaagtgtgttaggctgttcttgtgtcactataaagaaatacctgtggctgggtaatttataaagaaaagaggtttatttggctcatggttccacaagctgcattaacatggtgccagcatctgctgagcttccggggaggcctcagggaacttttgctcatggtggaaggcagaaggggagccagcatgtcacatggcaagagcaggagtgagagagagatttgggggtgagggggcacacacttaaccagatctcaggggaactcactgtcacgaggacagcaccaagacatgagggatctgcccctgtgacccaaatacctcccaccaggccccacctccgacactggggattacagttcaacacaagatttggtggggacatatattcaaactatatcagtgggacctagcattatatccacccctgcatcccccggatgatgttggctcccttaaaaccacgtagatccagaatagataaggagtaacttgttgccactcaggttccttttagaagatggaggagtaagtgctatatagacattttgctccttatcttaaagaggtgagccatatcatattgctagccatattgtttagccagtcagctggttagcggaaaaatcacttcctagatttggacaattcgacgtttaatcccaaacctggattgggagcgcagtataaataaatgttttaggactcagttccttcattagaaaccagaaaaagttgctctagaatatttctgcagtcccttgttactgtaaaaagtttatataataaacttacaatttttgtctgttttttttttgttgttgttgttttctttttttttttatttgattatactttaagttctgggttacatgtgcagaacgtgcaggtttgttacataggtatacatgtgccctggtggtttgctgcgcccatcaacccgtcatctacattaggtatttctcctaatgttatccctcccctaccccccaccccctgacaggccccggtgtgtgatgttcccctccctgtgtccatgtgttcatgttgttcagctcccacttacgagtgagaacgtgtgttgtttacaaacttataatttatgtggtggctttcatatgatgcccatttcacagactagtatgttctagacatcagcaccgtctattcttttttttttttttttcttttttttaaacagagtctcactgtgtcacccaggctggagtgcggtggtgcaatctcggctcactgcaacctctgcctcccaagttcaagcaattctcttgcctcagcctcctgagtagctgggattacaggcgtgcgccaccacgcccagctcatttttgtatttttagtagagatgaggtttcaccatgttggtcaggctggtctcaaactcctgacctcaagtgatctgcccacctcagcttctcaaagtgctgggattacaggcgtgagccaccgcgcccagcgcagcaccgtctattctatgtctgcactttgcagcatggtagttactagccacattggctattgtgcacttcaaatgtggataatatgttagaggaactaaattattttatttaagtgtaattcatttaaatttagatagccatttgtgactactgtgtacactgttggacaattcagccctgggttaatgacaaaatctagctacatagtagacaagtgaaatgtgagtgaccatggaagatgacttaaatcttgtcttgtgcctttggtgagtaatacttagttgtatttttcattcataatttgtagtggaaataaaaagcactgctccttccaacaaatacagaaagactgttttctccctatgtatcccccaaccaaagcagttctaagtgttggaggctgattattttagttttgtggttcctcatgtatcttccttgtctggtggcgtgaagcaatggaaagaatgcttaataaggagtcgcaggttttaggttctggtctcggttctgcctgtaactatttagaggtatgacctttggctcttcatgtttccctccgtggcatcagtttccttatctggagtgagggggtgggattaagatgatcgctaaatctattccagatcagagtttctatgattctgtgtctttttcttaattcggatgaccaggataatggctgagggttctctttgtgtaattactgagctgagtacaggtgctggaaagaactggggagataccttgggccatttcagttttgaattatggagtgttagaacacttttcagattgccacgggatctgaaggagccctgaggaaagtcaagttctgcttcattattgtttagtgtcgtatccaaggtaaacctggacacaaatgcagaacacttagcgttaagcagtatatactttaaaaattagtttagtcggaggttgcctccttctgccactttcagagttgcaaatcctgtggaggtaaaggtttcagacaaagtgctggtagaatgggccaaagtgaagatcacccagtgagagacaaaagggaaaggttagtaccttaagtgcgcttgagaaatgggttcattgagtcaaatcataactactactgcttgctaagccagaagaaggaaattcagagatggtaagactttctttgatacccagggaaattagggttaaggatggttgcttggagtgacttcatctgtagaaggctggattctgaaggagatgaatcacaaatgaagagaaagaggaagggaagaacattggccagatttgcaagagcaggtaggtggatttgaagtgttccaaaggacagtgtggtaggatgtgtcaaagcagtacagaggcagaaagccatcagctggggctgaatagaaataagatgtttatttggtgatttaattgcaatgttcaatagtacatttgatgattgtgttgttatcgtgtaataatgcgacaaagttaaacatttattgatgtggtcacgctagtgaattcccattgtaaatagtagctcctattctctgtctccataggatctttcagacacagttgcatcttgtagctttatttttattttttaactggctatctttatgtatgggaacagtcatctccagagattcattttcatctcaaaaaacttctaaaggtgttaattgcattttttcaaaactcttatgtaattatttaaaattattccaccggcactataaatcagaacttttcccattatattgctgaggaacatttatgacctgtttagacacttttgatttataggtttaggaaacaagaatatagaaaccattgccaggttttaatttggaaatttctttagctacgtctgtttctgcagaaaagagaaacagaaagctggtaggagaggtgattggagaggtatggtccatactagtgattcacaagaaagagaagcacaagacctgatttgggggtcctgctctgaaatgagcaattggcgtgtcttgtgcatgttgtttatactttctaggcattatttttaaatgctggttctgtgtaacaggtgcctaactctgagtgagttatttaagtttctagacctcagttttctcatctataaaatgtagactgaaaacagaatcttcataggattatgataaagattaagtaagctcgctcatctatgcattcaaaaacctttgtcaatgaagcctctgctgagagccaggcactgtgctgggtgctgagtgaaggtggcaggaggaggcagggccggacctctcttggtacaggtaataagtgggaataacccgacacctggagtgggtgatacatgagaataagccctgacgtgaacaggtcttcttaattgtcaaatagtaacaatagcaccccagtttagatgttgtgaaacattggagtgcacacatttagaaaactgatcacaatatctctcagatgaatatgatccaagaaatttagagataatagaaattgtctgtgtcgagggaggatggggaagagttaatatgctgagatgaagaatgaagatttttttagaacaaagtctcagcaggctgaagttctcaatcaaaatgaaaaaaagatcgttaatgggcatgaatgcaaagcccataccatggtactagtgtagagtgaagagctctaacttaacagcagttcatgtgacaattagtgaggaatgattgtaacaccagtaggagccagttgagacctaggtggggggcaggggcaaagaattcagactgtattaatagaataatgaggagttgggctgctgtcctcctctggactagaggggcagacacctgtcccaccatgctcatttctgcgcactctatttggaggggcgcaggggcaagacagagtgggtggccttgcctgtcacttaccaaatactggctacatgctttaaacaaaaccagaacctatttaggactttagcaggaaggggcaaaaccaaaccgtgagtgggcgtggtaggaagtgggggagttgttatagtgcaggagttccatagcatccactggtgggatgaacttggttcttaagtctgcagttcccagaatccaggtaacgaaagagaagcaaaggtcacactagttcttgtgcttccaaggagaagggttaaagttgccactatttatgactagtggctccaatgaagtctgggctgcagtcttcctgtgggtctttcctcgtcctcctcttttttagctgcatcagtgaagagcctttggaggcaaaacaaaatgaagtggaagctccttgggcaacgttatctagttgcaggatgtgctggtattggtagcagtttagaaaaactgcttttcgtgcccttccagtcttatgtccattcagaaggattcttttcatttaacaaaatttagcaagagaaatgaaaaacagatgattttttaaaaccctggagtagctgtctacctttagtaggtacagttttattagggtaagtcattcaagtttactcacagccataaaatgacatttattatttgtgtaatctctgaatcatggtttgtacccagctttgttttgttttttaattttcgaagagtctaatcattgattgctgtgtacaaatgcactttttgcacgtgatgaggtcactcagtcataaaaatgtcatcaaaagattttagtccctaaacatggcaatatagggatgcttctcactgaatattcatcttacctatagagatgctattatttagcaaggacttagttactttttccttaacactatgtgaaacgcaccacaggtggagaaagaagaaagagcacacaattcatctctcagagcttacagtttagagaaaatatacagaggaggccgggcggggtggttcatgcctgtaatcccagcactttgggaggccaagggaggcggatcacctgaggtcaggagttcgagagcagcctgacagacatggagaaaccctgtctctactaaaaatacaaaattagccaagcgtgatggcgcgtgcctataatcgcagttactcgggaggctgaaacaggagaattgcttgaacccgggaggtggaggttgcggtgagccgagatcatgccattgcactccagcctgggcaacaagagtgaaactccatctcaaaaaaaaaaaaaatatatgcacaggaaacataaatgcttcttaggaggggaggaagtgagaggggagtaaggcaaagaagagaaaatagaaaacattcattcgttggtttattcatttgtttataaattcatgaaatctttgttgacgagtggtatgtacagggttatgtacaacggcatttgatgagctagttcaatatgtaatggaatgatgaagtgactagcacagagagtgaatgctgtaggaagtcggggaagtgggaacaccccaaatttagtgccatggttgggaagatggctaggttggtgacctcttctcctcgtgtgtatgtgcgttcctgttaaaaaggataattttgcctaacagaggaatactttttgtttagacttggctccttttcatgacattcggtttcactgtactataaacaggtctttagctgtctttcccccactccccacttaggtcataaggaacaagtaaataaaaattaacaagagctaccttcacttcagtacagcgaggctgccttaggagagagtgcactaaaaagagacctcagggttcagggattgacaccttgctgcagaatgggagtgacatgtgaaaggtcagtggtagccttgactatgccgtttttgttagagttctatttcctcttctagacatctaagaaggattagcatacaagtccttggtgttttagaagtttgcccctgcttggatgtgagctgtcttcaagctttgttctacttaattgtataataagataactatgtctgatgtgatattatttaaaaacttggtgactgaaatatctaacccatgagcccatgctccataactttatgtgtttccaatccctgtgtgaatgttagattagcccttcaaaaaatccagagacatattagagatccactgactcaaacatctctggcttagaagcttagcaatcacagttgagagtgtgccaggataggagtaaagaacaccaaactctgctaacttggaggaaaactatgtatgtgtgtttgacccagctgaggtcaaggctggatgagatcatgttaatcatggccatgacatggataaagaagaacagagaccatgctcaaaacaggaagaaggagaagaggaagagataagtaaatttttgagataggaaatacaggtgaaattgagaaaaagaagaaaaactattcatctcaaaggaagggagctggagcatgaattataatcaccccagccacaccaaatccttcacattctctggtattctgactcatgttgtctgccatatgaatgttggcacgtgccattccagtagctcagatgcccttcccggtcctgcctgcccatctccctacggcagagcattatcctttcatcttcagcataactcttgtcttattctacaagttcccttttccccctgaggccaaggtaggagcccttcttttctgatgtctgcgtatgtacgtatttgttaattcagcaaatgatcaaatgatcaaatgatggtaagaaaagaaaatagatttccatttcttccttcgagttagttgggtattgggaacttgaaaaataatcttaaagtaggcctgttaaacaatgatgctatttgggtgcaagctgagccctctctggagccagggtggctgggactacattgaaagccagcctttctggagacaggctccaccgtgagtaacaaaacattgaaaaaatataggccgaagattccataaattaggtctcatgttggtcaacctacagttcattgttcttgacacttggggcagagaccccaccttagaatatcccagcagggcctggcacaatggctcactcctgtaatcccagcactttgggaggctaaggcaggaagatcacttgagcccaggagttcgagagcagcctaggcaacatacagagtccccatccctacaaaaaagaaaaataaaaaattagccaggcctggtggttcatacctgtggtcccagctactggggaggctaaggccggaggatcctttgagcccaggaggttgaggctgcagtgagtcataattgtgctactgcactccagtctgggtgacagagttagaccctatttgtttaaaaaaaaaaaacaaaaaaaacccagtgggtccttgagagctcagtgtttagcaaatcaccatactccttcaccacatgcaagtgatgaactggctggggtatgtagcacaccacaacctagagatttaagtgggactgctattttgcctcttgtagatgattcttggtctagtgaccctggttaaaaaacaaccaaatgtcttcttccattgtttggctgaaggatctgccgctgctgagttaaattttggagtgaggatcaacagtacctacagcacaaaaaaataagaagtctaagaaactaaaataaattttggattctgtaatttcattatagcaaaaggaagaaattgaaggaaaagtggtatgtagtaatagtaataatgatacattaggaagcattttaagtgcttactgtgtgccagccactgatctgttttatctcatttaaaccttgtgtgggtgaagtactaagattagttcttttttatagatgaggaaactgaagtctatagaaactagcaatttactaaatgtacagccagagaatagtaccaccaggatcagaaccgatggcagtgtctctccagagtcaccatgctgaattctctccttgccttttatgattagagaccaaataagctccaccaccctgatgtttcatgtttacatctgagacactgtgtattaccaggagaactcaggcactgaggctgctggcctctgcctggtgctcagtcatgtgtcggaaggagatgagagaagatcatcggtgtctgtctgtctgtctctctttccagcagtggagatgggagtataagaaactgcttaatcaaggagaagtaactcaaaaagaatgcatgagcccctggtctcactccctcgatgttcccactcccacatccagccagcccagttgtgggttgtcactgtggattcctgtaagaatcaaagaggacatcagaattttaactttgtgttattttagcttccattcatgctgactaatcggtgacacttggtcacatttattttccatgggagtaagactgaaccagcctctttgttcttccaggcttagttttacccccaagcctagtctccagattggcatatgggattagaagccttgttttggagtcattcaagtctcaacaccccactgaccggcttcaagatactgattaaataatttaagctggccatgtgcagtgactcaacgcctgtaatcccagtactttggaaggcctatgtgggtgaatcacctgagattaggagtttgagaccagcctggccaataggatgaaaccctgtctctactaaaaatacaaaaattagccgggcgtggaggcaggcacctgtagtcccagctactggggaggctgaggcagaagaatcgcttgaacccggaggcagaagttgcagtgagccaagattgcaccactgcactccagcctgcatgagagagcaagattccatttcaaaataataataataataatgtaagctcttagagcctcagtttatctgtctgttaagtgggcacaataatacctacttcatccggttgtttggaggattaagcacttctataggaaatgccaaatgcatcacacattcccataagtactgctgtatttctcagccatcttgttaccaggcaccaagccttccctcattttccctttctttgtcaaatcctgtgccagggtcacagtacgtgcttcccagtttgtgattggtggcttctttagaggatttcctgcacctctctgttcatgagtggctctggtccttgttatcttagcattgtctcaaagttgcccaagctctgtagccagcaaatgaagagggtccctaatgcaagagactgagccctggaggacacagtcacatcccagctcttccattcaccagccaaaggacctcagatgagtcccccagctgtgaacaacattggagggtttgctagacactgtgtgcttgcgatacattggatcaaatattcacaccaatgctctcaaatcaggagacattaatttagaagttgacaccccctcggaaaataataacagaaacatctatctactctgaggcagataatcattcccactttacaaatgaggaaatgcggataatataaacttttgtgactcacctacattgctgatgagtaacaaatactggattcaaactcacatctcttctgcttcaaactccaggtagccttctctatgtgcagtggaggttataggattcttgtttcataggttgtcgtaagaatgttgacagggctttgcagacttcagagataagggggattgctgttgctgctgttaaaatataagccccaaggcaggaagaggtgaggattcacatgaggtatagagaagggtgtaagcagagaacaaagttagagggaagaataagttagtagcccagtgggatgggtgaacggatgaaaaagggtgtcagagaacagttaaccacagcgcgccctgatttcaaagctctggcctgttgggttgtgacattacatagatgtgttctgacccatctcaaaaattggacatcgctgaatttaattaagatcaattagacattcctcctattgttcaaacacacaatgccttatttgtttgaaaagagggaagttctgtatgacctgaaagcttcctgcttcatctactgcttttcctcatgaaggatgaaatgccatttgaaataataaaaaataaataattggcctgcaggctagacgcattttctcaagactttattaaactgttaatacaaaaggggtctgatgtctctgtgagattactctttcttccaaatgtcccttgcaatccagtctaaaccttagctgtggcttcaatctgagatggaaaaggcaccccctatcagtagcagccacctgatgcttaaaactcatttctcctttccaatatgcaaccaacagaagcaagcaagtggtttgggaggctgggttggatattcagaaatcttttttggtgaaagcaggcatggttgaaataaaagaaccaaagtggttaaggaagaggatgaaaaagtcacaagcacaaaaaaacataaatatgtttagaagtcaagttgttttggagtcttcatctgacccccctcaactaaatccaccaagtcttaaagcatgtatgtgacttactgtatgtactacaagttgttgatgtttcatagggcttatgacctagagaatgtcccagtaaacgttttgggttgtttcccaaaaaacatttttttggttgttgttccctgactcactgtagacatgacagtgttcgagattattgagcattgaaatcctatttataattttaatccatatttctggtggttctggtttcattcattcattcattgtagagatggggtctcattcttgttgcccaggctgtggagtacagtgcaatgacgtgatcagggctcactgcaacctcaacctccagggctcaagcgatcctcctgcctcagcctctggagtagctaggactacagatgcatgccatgcctggctaattttttaaaatattttagagacagggtcttgctacattgccctagttggtcttgaactcctggccccaagtgatcctcctctctcggcctcctgagtcagtgggattacaggcatgagtcactgcacccagccctatttctggtagttttacataggatcctaattgtaagcaggaaatacctagagattagtcctttgctaatgtaaaatgtgcacttggtacatgataggtgtaaggataccagtaatgatagctgttgttgttgtcgttgttgttgttgttgttaaactacagaggctgggcgcagtggctcacgcctgtaatcccagcaccttgggaggctgaagcaggccgatcacctgaggtgtcgggagtttgagaccagtctgggcaacatggtgaaacaccgtctctactaaaaatacaaaaattagccaggcgtggtggcaggtgcctgtaatcccagctatttgggaggctgaggcaggataatcgcttgaacacagggggcggaggttgcagtgagccaagatgcgccattgcactccaggctgggtgacaagagcgagactccatctcaaaaaagaaaaaaagaaattatagagagatctcatccatcttcctctttgtttagctgaaatgtgcaggcgcagagaggtgacgtgacttgcccacaatcacactattattcctgacaaagtcattaatagaatcctaagtcatatgtagtactcctgtactatctcagagttaaacagcctgcttgaggcctctgtggactagaaaagatgtgctgaccgcttcagcggcctgtagatgagccccagtacttggagctgtctggaaactacatgaaccgtcaaagactggaaagtggagacacccagggttgctcacctggatgcctgtgtcagattccattcctgagttcttaaacacaccctctgttctcaacctccctctcccacccgctccccactagaactggccttacaacctttttttctagaaaaggagacaaaccttgagacttttatgtggtcactcttaaagacagggtgtgagtgtctgtgtaattggtgactattagggaaagaaaagcaagccatagcgagcgcagagccccggaaaatgttttctgtgtagcagcttctatgccacacagtgtggaaggcaattatcttggaggggattccacagccctgtgccggcttccccggtgtaagatttattgtcggctggattgggtgttctttataagaccatttactcggcatctaaagcgctgtcaagagtgctacttcctgaatgcttttgaggttgcaactgctaagcttcattttcccgtcttggagatatatttttgaaatggtatgcagggatttgtacaggccttgtgcttcccattgacactgacaggagttgcactgttaaaccccagcacgctgctgcagaaatttaccccctaatgcccagagccctccttcagctgggagtctggcccacacgtgcgcggagggttcccgtagcaggggagagggcccgagagtgcccttgttttgtgtaagtcctaccagctaatcagtctcaaagttgactgttttcttactgaaacaaaggataagcaagtactcttcttttgctttttctcttccgttttttggatcttaggaatgccagaagaaaactcgaactgcgagtcagccaaatatactgtatcgtgaaaccttagggaccactgaaatgggaacagtggcccattactgctaagaaggtgttttattgaaaatgcgccgacatgctctccccggagagtgagcaaaagaaggcaagatgcccaacagtaatacaggttgttctcttaggtgagctaaaatatcgagtttggcactcccctgctgtgagcgaggaggcaatagagtagacgaatgtgcatttttacattaaaagtgccatatttcactaggggtgtccccctttctccccccattttgtttaaatgtcttaatttatatattccagttaatagttcattacatgtcctttctctgtctggctttaaaagttgtcttttgaataagttgaagtagtcaaaatttcctaatcctggcaggcttgccagcagagggcaggcgtaaagaaggttttgacatgagggtgtgtcaacctagggtcagaggagggtggtgttgcatgggaggaagatgtgtgagcattgttctgagggcaggatgggacacgctccctttgcctctttgcaggcctgctgcacaccacagatctctggaaaagctgactgtactaaataaaggtggtcagttgcctttatctgatattcagcgatttctacataagtaaacgttaaaaaaattaaaatgtaatttcattccccaagagccgtcttttctttccccttcagtgccccatttctggttatgcttaaaaatcgagggtttgcctgtgggtgggccaaaaatactgtcactcttcgggagggaaataacaaattacacttggtggtggtggtggcagtgatgttttccccccgatatctgaagggtacagcactttgggacatgctctactgccccaaaacatgtaccttttcaagaactttgcacacttcagtgtaatctgttctaaccccatggcagaagcagtccattaacaaattttacattatgttaaaacaggggattatagtttcatcataaatgagagagggtaatttattactgtcaaatgcagagttaggaaaggatgttgtcatttttcttttctgtcatgattttgtttacctctgatgcttatgaatgcttttagagtaagggatttgtttttaggttgatgttttccatagctcatcatacttacaagtcacctgaatgttgacatgtcacactgtgtatatacaaattaaccagaagcaatggctttataaaatgttgcattacatgaaaatgcaaatggcaatttggaagatgcattaaggggaatttaaactcctatggaacagtgagaactcagtgttttcccttggccaaacttgcaggcacagaagaaaaacaacataattagcttcattgtcaacatacgcataacagtgacataaacaatatcaatatggagctaactgccttagctccctgtagatggatgatgtattaatttatatttttaagtaaaagcactgcttaaatcaagacagaatggtggttccttggagacaaatccccagatctcaggaatggggcattgctgttgcaatttagtaactctaattggctgccccattgccattctttggagaaatacttaaagcagtcctccttctggggaggcgcgctttcctgagtaggccatcaggcatgttactgggcttacattttgtattcctgttgctttagctttctctctccggaattggaatcagttggttgaatctctttaagttctgtcatttcagaatatgtcctggatactccattaaattaattggaaaggggaaagaaaatgtgtgttgtgttaacacaagtgttgttcagaagaagacagcaaacttgaattaaggttttggcctctgatcacacagttgatttttcaccccatgctcgtatcctttctctagttatttccaagcagcttctggcaaagcaggcctttcgttggaactgaggaccacgtgggccagggaccattgctgtatctgcctcaccacagggccattcatcagtgtatggaataatgtcctgaggagacgctcctcctgactcttcctttaatacatcttatctccattctcagctctgaatgggcagtaaaacctttcactttcttctgtgttcaaagctaaggctcagcagaaccaaatataatacatgattttagtcccaggtgtgttatttggtggttagagtttggtgtgggatcatagtaatctgttcttaagtgcacagccagctgcacaatggactcatttagcaactgacaggtttcttaatatgtggtgtttgaacaagagctgtatctgttgtgggtgttaggatgtgggcatcaaaaatatttttaaagtatggtatttagcatttcctttactcttccttaaacgttggcttacccctcgatatcccctcccccccaccacaggtattcattttatattattatggctttttttttttataattatccagtatctgcttcctcttggaagcctgtagtatatattttttttttattttattttttattttttaagacagtttcttgctctgttgcctaggctggagtgcagtggtgcgatcacagcttgctgcagccttgaacttctggtctccaagtgatcctgccacctcagtctcccaagttgttgggactataggcatgcaccatcacacgtggctaattgtgtgtgtgtgtgtgtgtgtgtgtgtgtgtgtgtgtgtgtgtgtgtatttttggagacggagtcccactgtgttgcccagggtggtctcaaacctcaaagcagtcttcctgccttggcctcccaaagtgctgggattatgagtatgagccactgcacctggccatgtttaattcttgggagaaatcactttgcttttctaagcctcagtttcctcctctgtacaatgagggctggaatttgtgttcagattatgacaactgcatgagactgttaaaacacccacaatccaaaatttttttgttggcctttcttattcagcttttctaaaatgacctggtgctcacagtgattaataaatggttttaacgaagtcttctgagttactattggttttaacattttatattatattccacttatggaagttccagttcttcctgaatcccaaatacagggcaagtacacaggaccacaggagtttagaattaaccaaagtggcctgggcatatgtagtttatccaggtttatcactgatgggacatttccttgcccagaagtagtctctgagtcaccatatcatctgtctgtctggagacagggcgagatgggctccaggtggcttctaagttagtatgccaagccatttccctctctcttttgtcacctcccccttacccaaaccatcagcctttaaatgccacctccccagtgggccttcccagacccctcctcctagtgatctcctccttctttgtggtcccatggtgcttacagccaccaccgtgcaatttagtagttgagtaagcactgcattgcatcactctctaattattttgtttaaggcttgtctccacagctgggtcatgagcgtctgtaatgttgtttgcttgtttattgtttgttttgatgcacctgcagactattagctgataaacactgacctgctaaggagttagtccaccttctgaaagcatgcatgagttttatggatgcctcatgaagaacttagtttctaaaataaaaacacattgcatattcaaagtacatcccagtttttgtttataaacattaaaactcaattttaatactttgggaaaaagaaagtcacttaggcgttttgaaatgattctttccactttctccctgtacattggttggagagcacttcctttatttgtatttcctgccgttggggctctctgccagcccctccggaaagagcaccttttctctttaagagtcagaactctactgatagtcgggggactttctggcagatttaaggtccttctacctcgcaaaagagcccttggttctctgttgaatattcatgagagggtggggtcacattttgtgacctgaaaaaatcccattaataaatttggtatctgacacaaaaacactttagggtgaagagcgatctgcgctgtgcccatttaacatctgatcatactttgatggtcacttcgcgcttgtctcttttacagccagagtaaagagggaattgtctgctccccgctgaccctgttgaaattcaggcatttgcttgattggaaatattaccaatattctttctggtctgtagtaacctgcatttaatacacttcacatcaaaatgtactttcaagtaaaattcctgggattactgggtcagattttgttgcctttttttttttttttttttgaaggcaaataggtattcattgatgtcacactactccttttcctctaatattttgagaaaaagaataaaaatgtgtgtggggattttgtgtgtgtgtctttaaaaaatatacaggccaggaagtttttctccaagtttgaaggtggtaaataggtgatttttttagagtcgccgaaatggactagattaacctgacgcttaagtcgtgtcagttgagccaacaaagtttagcacattgttgactttttaaaaaaacactatactcagctttcaatagcctgaaagagcagtgactatttctaatagagaaggtcatcctaaagtgcttattgagagtagcttttgttgttgctattgttgtataaataagaaaggaatttaaagaattatttcttagcaaacgtgtggcagatgctttcttcggcagctgtcgttctagaggggaagtcgcctggttcagcgacgaggcacgtttggttgttatttatttccaccccgcgtcggcttagttttcctcggtgcgcactggcacactttggcgagaccgactctgggaaagaaaggggtgtggggaggccaaggctctgtgaaacccccgacgtgaagcgaaagttctcctcccagggaggttttcgaggaaaagcgcttttctgcgctgcctaggagacctgcgtaccctcccgaagccgaacagttgctcggagcagtcggcttggcgccgcgagcgccgggtgcccctcttcggcctcccgggtttctcggaaaggttaggacaactctttgtcagtctcaaagacgaaacaaacacgccgccccgccggcagccccggccccgcagagccccggccagagggagcggtgcgcgccgagcccggccgacccagacgtcagccggaggcgggtcaccgggttaacagctattaagtggagttgctctccagacaaaagcagggtggcacccgagcgtgatttcacctgccgcgcggagggggccggggcgcgcgggcgcggggcgcgggccgcggagcccattgtgtggggcgcggcgcggcgcggcgcggcgcggggtgtttagaggcgggttgtgattggtggagcagggcggggcgggtgggcgcggcgcggcgcgtcttgtcagcccgcgagccggagcgcccctgcgcgcgtgcagtccgcctgcacgccgaggccgccggaccccacgcccggcccgcgcgggcgccccgagcccggctccgcgcgcctggcggctacatggagagtgtcaggttggtccttctgattgatctttgccggtttcgctctccttcccccggctccgcggcgcccgcttcctgggggcctcgctggggaaggcaggagagcccgagggttctgaagttgagtcttttaaaaaatcatcctcatcctcgctgtttaccaagttgggtaggagttgcgctctggaagtggaggcggggagggagtggaggggcaagaaaaaggagctgcaggcctgtgggtcctggagagagatacccccccaccccccttgctctttggctcacactctcgctctctttttttaaatgttcatgggtggggtgtagttgagagttggaggaagtcctgcttgtgtgtttctctctctctctttttcgtttgcgattcattttctgccggtctggccttcacgcagccactttggtgaagccctcgccatcactccgttcgggggacgtatctggggtgtgatttctgtcactttcagagcgtgtgaaatatacaaggagccttccatctcagtgtaacccatgtggatgtttctttgcttctgatagtttgtttctatatctgtctaggctattttcagcttagctgttcaaattcgacgagttcacacacagtaaagggggagggagaggcacagagccccacaccggagcaggcgagcgagcgaatggaacactctggcaggttggggattctaagcctctgttgcattacttggctggttaattaagtagtgagcggggtttgggtttggacgtgcagcagactgaggaattgccacggggtactcccagctgaaccggctctgaatgtagctaactcaactgtcagaactgcatgaaggacggtcagtggaaacgggactttttacccctctcctccccaagtacggtgttgggaaggagaggacctttaggaagtgggtggtaaagttttagagcaaagtacatatagactcttcctctttgggattaactccttcaagtcctggcagttacaagtaaaatatctagtaattttatatttttgtccaaacaaaccaaatgttctaatcaaaccaattttaaaatgcaaatcacctcatttccatagattccagcattctaaaagtgacacatgtgggggaaaaattaagcctgataacaggaaatgtgaatcatactatcaatgactaatctgcttaagaaaaaaaataagttacatttattttatcattaggaagtcagtgttaagccagattttttaaagtttaaagcaagtggcatttttattttaaaagcggccctgttttgctgtttttgtttttatataacgagttttccaagaggaatgtatagatgcaatcagaggtggtttatgtggtaaagagcgcaagctagcatgtcactgccaaagagctggaacatgatcacattaagattctagtttagggtttgatgtgtgtgtgttgctgttactgttgtttaaaagaatacaaagcttccttggttattaagattgaccactaagtaaatcaattgaagacagaagcacgttgtcctaattgatgccctgtgcataaattgagaaaaggtctatatctgttttatgtgattctttgtagctgcctgacacatttcagtgaaaagtgtgtaaaaatgaaaccaaaatacagactgcctacccagagacactggctgacttactgtaggatgtgatagagctgaactgagaacgcattcggctgacacttgataatcaaagttgatttattgttcattagtactgcattagccctttcaggcaagacagttatttgtgtagttgcctgtcaagagtgagactgcaagcacctgtcatttctaaggcatgagataagcaaccaaatattaagaagatgcaaataaaaatacatttgactaggtaaaggggcacatagtaatacatttttttctttaaaaaaatagtatgggtcaataccagcgtctaagaaagaaatctattgaggattattttttaaccctaagaacgacttatagaaggaaagtaatgggctttatattcacccgtttgccttaagaactttgtttcctgcccaaatgtgcagcttgtctgacgaaaagttggttagttaaggaaatgagaggtataacatgtcaattatctaatccgagtaatttaggtaaggtaggctttctgtttgtgttgtgttattaaacattttattaaaggaaacttgtaagcatgggttgattacatgaaaatgtgatggcatcatggctaagctatgataatgtcggctaataatgtcaagtgcattttctgcaacatgtatcactctcgatttttttcttctttctctggaagggaatgatctcatgacatgtaatagaaaacaacctaagtgtcaaaagaaaacaaaattagcgaacttttgtctgcagccatagaaacgcggattaactcatatttttccagggatggaatggaaacattctgcacgaggatatatagtgtattgtcttctctgaattttcatttgacagggattttagaggctgtgatcttaattaaatctcaactagctgaaataatgcatctaaaggcatgcagtgttgcgtaaccctgctcagttggtaaaccataaatcatcagaaagcttatgataggaatggttgaatttttttttgttgtttgtagtttaatgtaccttaaaaaacaaaaccctcaccgtcactgccttgcatttacacgttgtcaggacctgtcacttgaaagataaactcttttatgacactgaccagttctacaacttttcagccaacctccacacaattggaagatacggtgaaattaaaatctagattaattaaaaacaatgaaagttcaggtttgtcttggttaatgtggcagaaacgttgtttgagttactatgtttctgagacaatcaggagagaatgttgtgactagcttctcagtctgtactaacatttgagtaaaatttgaattggcaaaaacgaaggttggaggaatttattttattatgtggtttagttgtagatgaacatcactaaagagaacctgaaaaccatgttcttggtaactaggcaaatgtagtggtcagttagattccacttcaggtagttcatcattccttgatttgcaaacaagggataatgtagcaacagttgatcgagaaggttagagtaaataaatacataaattgtgtctatatgtgtgttacattttaaaatatgcattcagtgacaaggaattattaaacagctttattaactgtcaaggtataataaattataacgcttgcaaatattaggttacttttagtgcctcaaatagatagttttaactgctgcagtttttgatttatatatatgcttgagtagaaggaactgcctacataaaaaagttgagaatgctgtcttgtgatagcttgatttcatgtatctttgcacgtaacatttcatgtaagactgcaagttacattggtgatgagctgtagctctcttggggcaaaagggtagctttatgtgtatctgtatggctagatttggggatagtcttaacactgtaagctaaatttgttgtttgataaaaggtttgttttcttggaagcagcgtatttctggactcttgttttagtcctttcagagcgtgcaatacttccctcccacccccaccaagtgacattttgcattcagccttattttctttcgtttaaaaaagaaaactcaggtatctcttagctaaacaagcctttgcagattgtggagacttgaattatctgagaagagctaatctgggcctctacttttggattgtaggaatgctcttcattgagtccctcttccaacctgtgagttgtttgaggagaaattaatttcgaatgagaaaaatgaatactgaacacatacattgtgcctcattttcaaatccggttaaaagcaactaatcaatgaagatgcaggctaaatgttatggtgagctttttagaataccttggtatcatgttttaatttctaagctttatcttgcccttaaatctgaaacatcattgttcaaataactgagaacaaggtaaatcaacaacatcaaaaaggtcggcttctgtgatttctcaagggcttgttattttgtacttcccaattctatttgatgtcttgacaaaacaagatgacacaggggagaatacattaaattttgatttttttcatctaacctgttacagttgtggcagcttaatttcttttactttttcctgaagatggctttttgtacaattactctaattgtcacaccacttcatgaggcgggtctgcacgggtttcccatttgccttgattttactaggcatttttgaacatattttgacctttaacttatgggaagcttttggttgggctttgtcttcattataaataaatcagtgaatggtgagattgtcaaagaagcaagtgatgttttctcattagaatctcatttgcaccctttagcttaactgtgatgtataaggtgaaggtgttggaaataggcatgagaaactacaatttgagaaagttgagttgtaattctttctaaagagtgattgcaccctaagtaaggccttataaaacttcggaaatggtctaattttggcctacctatgtgttgaaattcaattatagtcccttctccctttcagtaatatgggaaaaaaaatacatatttgcagttaagctccctatgaaattttctatgctgattaaatcatgagaaagcagagctacaaatttaattcttagtgttagaaaaatcttctttagacagaagatagacattatgtttttcttcatttaacagtaactgttgatctaaaactgtatccacaagttatcttttatttattttaatcatgtatgtgtctcaggtaggatggaaacagttgctgtctctttcattatttttgagtaatacttcaatttaagagaacttatttagccaaggcctcttccttttccctttaagaactaaagatctgtggatagaatcttttctggggtaccttcttggaatagtcctcccctcctcccatttgcagcacttaaacatgatttttgttgttgttgttaatataaaatgccattagcatgtttaattcacatgccctaaattgttttccatcccagctacaggagaaagtggttgaagtaggaaagagaaggcattttcttgatttaaataataataatagttgctaggttgaaagaatcagtgcttattgagtgattattttcatgtgtagcttccattgtttcctgtatttaacaattgctaatgggagaagcgatttaatttatgtaaactttacatttttatgcaaatgaagctgatatttattagagctaaaacaattatactggcacttagtggagtaaccttgtgtgcctgggaaatgttagaggagagcagttgatgttccactaatacctctgctgtaaacaaatatgcatttatgccactttttagaatttaaagacaaaaagaagagctcggagagcattgctggagattgcttattagggttgataacctgaaataactcctgattggcaggcgagccttggccttacaatttttttgtgaaagaaagatagcctttcttgatagaatgtaataaacaaaatgataaaaaatgaaatgctaattgcattttaaagaggtcttttgaaaaaaaatttttaatagttggttgtattgttactgagagaactgttatgctaatgactgactacctagatgattttgcattaatataataaccattacctgccttagtgctttgtacagtattgtggcaaaatagctaagcctaaaggagttatacaaaaagcagaattccataatgaaacagaattttactttccacataaatagcatgcttttttttttttatttttttaagaccgaaatattatatcagaagtgtgttttctttcctgtatgatagttacttgcatggtacctggttggttcattttgttttgtttttttaataccatggagaaatagaagctttctaacttttctgtttgccaatacatctgttgtatccattgacttgttaattatgaaaacttgttttccacagggggccagaggtgatgatgtttaattttcttctatacaggctagcttgtatatggtcataaaaaacttggcatagtttttttttttttttctcctctctctcttttaatggagctattttctctgtttggttttgttgtgacattctggagccttctaatttaatttgttttgctcctgctatttgattaaccaggtgacactgccaaacctggtcagttatcacccaaatacagcctgaaggctagaacggaagtgaatttcctgggacatacatgtggtgaatgatcagagggtaaaaagagtttctaaattattaaccaaattaataaaaatgaaacagtgtttagcattttttatcttctctttttattatttgtatacacagtaattatgagatgatacccaacgtgcaaaatttatgtgtatgtgtactaggtagtatttacttgtagttgactggagtgtaaactgaagagagaagaaaatgataacatgttattttcagtatttatattgtgtcttctcccctcccacccaattccttcaattgtctcctagattagaaataagtattgtttctctgagtgtttttatttgtttgtttgctttttagatttttcccttcccatcatctacgtttccccattgggcgttaaaggaaataatatggcatattattttaatagtctttcagcattcagatgatagagagtcattttgaagaaaaaaccgtatcaggcagaatttacacagcagtgtgtatgggcttttagcagcagttgttagtgctaacaccgttttcccagttgctggtattaaggtagcagcaggcccatactagcagagctgtgatggcccaagcacagctgtatttctgccattcccgcaggtttgggtgcacctgggatcgaccacacccagttggtatcagtcaacagtgtatcatgccgtgtgtttttttaattcatgatttcctcttgaaactccactgaggagtgttaactgtgtgcgtttttttaaattcagttttgtatgctagcattctttaaatgtctgccagaagtttaatttgaatttctgatccctgaaggcagctagacagaatcattctagttcttcataaattgccttctatgattcattgttaactcataaaacatactcatttctatatactcaaacagttaaggtagttacagtatcggaaattttttttttttttttgccttatatttaaatcgtcttttgagaaagaaatcaagaattagcttgaactcccagttaaggcatgaaccctgtagcacagaaaacatcagaaatgaatgttgttatctcaaggaggttaaggtagaaggcatgaaatctgaaaaaaaaaaaaaaaaaaaaaaaaaaaaaaaaaaggtttcgtttttactgaatacttttaaagaggggcccataaatattagagagctgtagttaaaaactcacatgactgttttaaatactattgatttaaaccactggctagattttatgaatcaaagtgtaattttgaagctttggccatatttctcagtgctaaagcactctctcttgtgtgcctttagccgctttccagacattcaacacaggattaaatgatagtagttacagtgatcaataggttaagactgctacaatcactcttgccgctaatgacctcagtagtaatgggcaataaagtgtgggctgtaatagcctctcgctggtactgcatgccctttgattcctagtgttagtagggactagctacatgaaaaagttggacgttgggaattaagggagtggatatataggctataattcttaactatttaaagccttaaaaactgctcagattttttttttttaatttcttttctaccccaccatagtttctggtctatttgaatatgtttgttaaagcttttccataacctcttttcatgatatgttagaacagaaacgttggggaaatcttggttttataacatttgtaaatgaagctggagcccactttggaggcccagagctaactggcatgaaaacgtggtttcagatagtaaaagcgaagttaaggccatcaggatataatagcccacttctgattattcagaagtgatcagcccgtttggaggattactcaggcctcttgcttccttccctcctttggcagtgcctgctgctgtaaagcatattattactcatcagcacctccatcaaaatgtccaaaaggaaaaagaaggggagactcaagttcattatcctgttccgtaactgcaaaaaaatgaataaatgattatgggaaaaggagatttaagccactggtttgatgtcagcctttaaaaattgtctgtacaggtatatgtcagtcctttccatgattcccccttttattattgacagttaagggacaatgttgtttctcctttaagaagatgcttctagttttacctgagttaaggggaaaaagtattttaggagacatatgtaacttttaaaatcagttttattgagggatgatttacgtgcgctcaaatatactgattttcagtgtctagttggaagagttttgacgattgtatacacgtgtgtgagcaccacctcactcgagatatggacatttccatcgcccccaaaagttcacctgtgcccctttctagtataaggtttctatagctcttttaaaaacgatgaccaggaggttatttctatcatgatttctgctctaactctgttaagttcatgttcatcaccagtttagattttacaccaccctattcctgtctgttttcctgttcatcaccatcagaatttggctcaagaatatttatattgtacatcatccaagaaacgcagaggaaaaaagaaaccttaaacatggttcttttgtttgcttaatcaaacctccccgtatgatgatgcaactctcaaggaaaagtaaacttctattgtgatacgctggctttagcagctcaaaggataccgattggcacccaaaagatacttaaaaatccgaaaagtttcttctgtatgaagacaaagtagactaactggaattaatttgtagatggttagatgttttgataatgtcttcctggtgtttgccctaaactgaatgcgagttcactgttccaatcgttggtgatatttcgtgctacaaattatctttttaaaagggtaatttatccattcatatacatctgtcccattttgcatatgaaaatattcagacatgcccatctgttttaaattacagtgtatctacatctacacttaaaaggccactggaataggaagaattcatggatgaccttccagagctgggttaatgaaatttttcgaatgttctaactagtgttttccaaacacacgacactggcacatcaacatccccacacatgaaacaagcccacaacaacagtggagaacattcgctgtgcatgaatctgaccttcaggaaccatttttagttcatcaaaattagtgatgctgagaaatcgggacatcagtgcataatgactgtgaaattaggaatgagagctcgctatgcaaatgacaggacaaatcatgtgaaaaagtcaggataaactgcatattaagacattatgttacataaaattaatactgcatttctgccttttgcttactgctcccctgaaagattttttaattcttttatcttctgatcagctattgtctgccggatttttttttttaagtagcacacaggcaaagtgcaaaacatgttattaccttttattgtaatacatgagatgacagcatatcctttttaacaaagtatatcctttactgcttctagcttcttgctgtcacatgtttgattagaaaccaaagaaaagtaagatgcttaaatattacggttagaagacatacaggttttgtcttttctttcattgttttttctttccttatctttttatttggggcggggggtgatttttcatgaaatagtcttcttgcattacggggactgacaaaatgggtctcatgtagtctgcaaattaaacacaagtgcagtgattattttgaatagctaaattacattctagaaagcttgcagaattcatagcattgtcattaggtatccgcttgaatacaatttgtgtaaccttggccaagacagcctgtcattttaatgtcagtgttttatctgaacaagacatcatcctttcagatacagtgtgcaggttccttgcaaagatgcccgtgcagaaacgtgttaacagttgcaaatatgaaatgctatcaagttcatcactgtagctgtttgtcactgaaatgtcatggaaagcgggttttaatggtattgcacataatatgaaagaattgagacatctgtgtgctgggtgaataaggaagagtaaaaggcatcatgcgaagggtctgtgtttaagttcggaaggtgtgtccaaggttcccttcccagcaagtataagcattgattggttgttcttaaaatcactgtccacagagcaagtgtgctcatatgggctccacctgcaaaggtgctggttaccatttgtcttctctcaaacaaaattcaagtctgggttaacttcccacagatggttttgaccaaaaactcactctcaataagcaattgagaactgtcgtatcttaactccagttagcatttattaagtttgtcctttttgtgtgcttgcaaggctgcctggaacccccatcagtactgcaagattttacttttctttctttaaaataaactccatgatagattaaataggatctgttgctgcatcccctctggataaatacatgttgcatgggaaattggtcaactctttaagcaggctgatggcagtcagctgctgaacctgggaggctgcgtgcttctgatttcctggcttcctatttatccttcattaacattctaggttcccgtgtcagtggctatgatgacacctcaagttatcactccccagcaaatgcagcagatcctccagcaacaagtgctgagccctcagcagctccaggttctcctccagcagcagcaggccctcatgcttcaacaggtaattgtccttcctccacctccagcctgtctcccccagaacccaggggcccccatcactccattcgcaatctcccctccaccagagcagctcctttgctcagtgaagagtaaagcagcgtgggtggggcaggacacagaccactccctgaataatcgatgtgcttttgcatgcccaaaagagaggagccctgccatggtgactagtgtttgggcctggagagtacccgatggactgagatcagggctgtaattggacttggtagcagtaagatcttttaggtttacatggctcctaaatggtgtgaatcaaagcaaaatgaggagcacgttgggagtggtttaaatatgacagctcttgatgtccccatttcgactcagaagcttacagattttttttctttaaacataaagaagcattctagaatttgctaattttaaggtccagagttgattttacttcttccacatacgatgttgctgaaatgaacttctggttgtcattgcactatggggacctaatattcagacttcacagccacctgaaccaaatagatgagattcggaactacagcgttgggagtcactggcctggggtggtggggacaggatgcagcggaagctcccaggctgtccatgcacacactgaataacactgcatagtgcccagccctgtcatttagaaagcatgcagaagagattcaccagactctctcagcaagggcatttcagctttgttgtacaatcaaaggtcattctttgccttattttaattagtttgtgtagaaaatggtatgtttttcatcagttcattttggagattacttttcaaacaataatgccaagaatagtcagtgtgcgctgaatttattgtcgagtttcaaactaaaggtcaggccattacagataaaaggatgctatttttcaaatcacagtttgtgtatggcaccaaaagggacagtggattggcgctaccctctgttacttaccgtcctctctttcctttgtagcagcagcttcaagagttttataaaaaacaacaggaacagttgcagcttcaacttttacaacaacaacatgctggaaaacagcctaaagaggtaccgacaatacatattttactttcaaaccacagatcccagaggactatctagtggctattaaactgtcattcatcttttaaatgattgcacaactgagctgactctatcggttctcagctttcagactgagaattattgtcctgttttcactcagatttttctgggttccatttgcttgctgccacatattttataacaccactgcacgtgtacctgtgtgaggagcaggagaggcatcgttgacagagtcttcaggttactttttgcaacctggtaacaactgagggccaggatggagctgggagaagtgaagtgctttcaggaaaattttacttggatgcacacttaattttttttttttttccccagctcacagagcttgggtgtgtggtgatggccttttccattggaagaataaccccttgtgaggttggataaacaaacaaaaatgttagaacaagattaaacatccacatcttttgtttaacttcttcctgcaagttgtacataatgtaattgctaaaggcatgtgccagagagcatgagttgaagttagagaagactccagcttgggttgtgttttcttgggcagggtggagaaaagtatatcataatagcttctatatgcaccacgcttggtagtgtccataacttatcacattatgccacaccatgaaggttgacagcattcgtcccataaatgataaggcctttctttccagggagttaccagttcaccttctattcagttctgcgtgggtgagactcagttgtgggagtatccgtgtgcatgtgtgcgttattatgacatctttctacccattccagagttatccaatttaacttgcctcctcatatttttacagtggactgaaaattctttttgtttaagtgttctccttgggatgacacaatttataattctatatacagcacctcatccactttaacagcttcttcaccagccctaagcaggtggccacttttgttcttttgcagggagtcttaccaggtgactcgacgtccctgtccctcacctaagtgaggatgctgggctgtgctaattttacaccctgggagtgacccagacattctccctttgctgcctcctcccttgacacaaattggggacgttttccatgtcctgccaagttttcaccctggagtcctgttgagcagccggatgtaaacccctgcagagtaggggcagttttggggtgaaggggaggaggtgttttaatgaaaatgctgacacaaccttaagtacagtggcgctctaccgggtgctgctataataaaaaagggaacagattaaaaagtgtctaaaatgtaaatctaaaggactaacagtaattaaaatggaaatggcacagggagggaaggcatgtaattgtgagatatcactgtgcagaaggctctcagctttgttttgctggctgtttttctaattcagcagggcttactcatcagtggcagttcaatgcgcgttaatgactctgggattgcaggcatcactctggacaaagaaatgattattgtgcggtcaaaagaagttcaaagacaagaagggaatttcagttttttccttagagatccacattcaagagcatataaattaagccaaatgttaaaaaccacagtctgaaagctgacttcaaagtcacaactctctaattaatgaactgcgagcttcagtttggacaagttgtggtttgatgcgcccataaatcaacatgacaggcctgtttcacagtctcagacagtgcttgtcattgagtcacatcagatgtaaacacagcagaaaaaagaaggggtatgaaggaggtgcaattgatcaacagaattggtaaaaacccacttttgaagcacattatgcatgatcacaggaaatggttacagcctcaagaggtttccccttctgctgttgcttttttgaatcagattgctaacagccttcaaaagggagaataagaattatggagtttctcccctgtggcttgcaggcaataaccccctgttgttattttgtgcttctttcttttcaaaggcatcaaaatttagttttttaaagatctttaactctatatttgaagacaaacaaaaaagggctgccactgtcattcttatcagttaccagggattgcgtttttcctttctgttgccacttcttattaacctcttatttggtctgtgagacatagtttggaatgcacgtctgcatgctgggagaacatgaaagttcagatgagctcagagggcacataaagaaatgggaaggggaaagttacacagcagaaagaaggataaaagttacctctcccaaattgctgttgtcagaaaggaaagcatctcagagcacaaagatgatagtggtccctgagtttgggaagggagtggcagggggtggggagtgtaggggagaaggagaacactttgtgtctaaacaaggagaaagcaagacattgtaggaacattcttgcatctccaggtcgctaggtttgctgtggtccatgctttgtcatccacttcccaggcaaaggtgacccaggagataggttgctttgaatatcctttgaggtaggcagaccagtggatgggtctccttggattcatggtgccagtggatttgtctgagacccagggtaacaatgcttaggagatctgtagtttcctgaggtagggaccagtctcctggaattatcatgcaggtggtggtccttttgtgctaaaatgagatggagtcacacggtagcattttcatgatgtggactggtggttatgattttaacaaggtttgaacttggttgttgacagatggaacaagtatgttaatttactgagtccccagtcattagcggctcataattttatattgtcaggctccccccaccccctttttttcctgttttgattacctctgcaataagacacctgatctttggccagaacgatgtacctttgctcttttttttttccttccctcctaaagttgccttgagatgtttccttgggaaagtttggctccatattgggttggaccaagacaggaccttccttaagaagatacgtgctcttaggtaggggaggaagagaggatgtaggcccaatacagctattgaagtgactgctcatgaatattggacagaagtggtgaggaaaatagacagcagaattcattttaaatcgagctacaaaaaaagattccatcctgtgcgggtgaggtaggctaagttgattgttttaaaagggccgtttgtcccgggcagttatgacagtttatgttaggcagtagggagtagccgaagaaaggaaaacagacctttgactgcagctctagggaggggatccgaaactcgaggtttatcagggcattttagcattttaacactgactactgacctgccgaggggactgcacggagaccttttttgtatgcattcaattgtgagaagtaaacaaatggacccgtatcctgtgtttggtaactgggtggggagcgcagtttggcaaccggtgttgcttttaaattctttctttggacaatgggccttgtatacttttatatcctggcttttcaaacgtagacagctttcatgagctttttcctagggatggccacagagacaacagaaaaggcatcagtcattttacataaatacaaaatttttaaacatttcatttacagtaaggcaggaaacaccctcccccacctccagctgtaccccccccattatagtctgctttcagaaaagctaattccctgatcttttattgtgtcaatgttgtttttttctcttcccttttttttgtaatgttgtgagttaatatctgttgaagaagtgaaaaaatcgttttgacatgaatataactatcactgggttttacattaatgtgataacttgggaaggggtgaaaacaattggatcattttatgcatgctgttcttaaaatgaaaacactggcttttcatttaaatttatttaaatttttgttgttagtggtatagaatttgttttttggagtgaaactcaattaactttctcagtggcatggtagtaagtctgaaattggttgctaatatgagaatgatggtttttactgtaaaataaactacatgaagaccgaaaggaaaccaccatttttctctttctttgaactttgcatcagaaggtcttgatatacataccattttatggatgtatcagatcaaggtcatgtgttaggttaagtgaatgcagttgtttgtaaagtatagttattagccagaacatgtaagctctgaaagggcttggatagtccttttagttgtaaaagtctctctgatcttttgaatcatactcagaattaggaacactgatcttgttcttttcttgaagaaacttttcttttttttttgctacagtttgggaagggttagttttccttttataattgttagccataatgtggctaagacctccacctcgatacgattgctagcagattaaggatattagataatttccttctatttattgtactactgcactgtattatctttctatcactcagataattactgaggaaatctacattaatttttttggctgaagcaaggcctgctaaacacaggaatgatgtattgatgttttacacaacaaaagttttcctcctgtcattgtccaatcaacaaaaagatatttatcatatcgtaaagccccttcttttcaagaacaaagcagatgggggaagcaggacaagccaccagacctgggagtttctgagactaaagccatgttaaggcatctgaagcttagactgtcgttcatgttaaactcacagtcgagtacgatgttgtttgctaaattatgaatgtgtgtaattaaaatctagtggctgtttctgtgaaagatttacaatgttatttcatcgtttgtcatggctaattaacaatattagatgaagtttttcttcttcaaaggtctgattttttctcatttatttatgtcagaagtgataaacagagtagttaaaagcttctgccggtgcaggcagggagggaggcaacttgttcttttacacctcaaaggttcggggttcagaccccttcagactagagtgatgcagtcttctctctagtgtgcataattaaaaatttcaaagtctaaaagtttacatcttgatgacaaaactcagacctttcaaactggggggaaagctggcttgatggacgaattatgtgtttatgggagcgggcagtagaaagataacacgctcatctccccacccctcctcagaggaggtatgctttgtcccttttaaaccttgacacggagccctccactgagctccagtgaccattctcagcatttgatgatgatggtgagttttgaagtgtccatacttttaaccttccttgggaagtggccatctcattttttcttcctgatttcttacagcaacagcaggtggctacccagcagttggcttttcagcagcagcttttacagatgcagcagttacagcagcagcacctcctgtctttgcagcgccaaggccttctgacaattcagcccgggcagcctgcccttccccttcaacctcttgctcaaggtatgcgttgattttacagaaggcatagctctgtgaagactttgggtggaggtggtgggttgtctcttggtatatttgttaaggacattgtccatcaaaacatgcacatagattcttttaagaaaagtggagtgggataatgatggacccatgtagaaggtgaaatgcttgttgatgccaaaatgaagtctcagggtggtctgaaggcttagctgtaacagagcaatcccactgttggacactcttggagtaagagaatgaggcgctacttttcacttactgagcattttaatggactcttgcagtgtttctgtttggaaccacaaaggaattttcctgagggcttttattattcatttaagacattttataccatgtaacatgtgctattttaaatcttagtaatgctttataaatgccatgttttaatatctagggataaattcaggtttatttttctgtaaacgatagaaatcaaccactttctcttataaaaaggaaaactttgtttagtttcctttttttttctttttgcattcatctgttgatttttgagcaaattagttctacactcatcagaacaggtaccacttccatctccagttcctcaacaactgagatcacatgaaaagtaagattttatacatttagtaaatttcttttacaaagcccactgacattttatcccaagggtgatggacatcagaaacaaatgggaactctaggtgtttttaggacatcctcttggtttaagcaactctgactttcacatatgtaatgtgaaagcagatggattattcagaactagaaaggaaggtgggagggaaggaggaagggatgtcaagagggagggagggcggacaggcaggcaggaaggaaagagaaagtagaaagtgccatgcctgtgttttgaaacacaattcctccatctatgcatggtagggcagatttgagttgcctcctcaagggcagcagttctttgaactctagtagatttggatgttggtttatatgtaccttaaaggctgatagctaaagccactgctgtcttggattcagttgccttctaaagaaggttaaaaatgtggaaactccttcgtgttgcttaaagcatggccatttgtttggtaacttttggtgtcaagtgaagtcagggaagcatgtctgcatttgaatcttttcccttgagtccaccacacccaacttctgtcccttatgaggctgattttgtttttagtatcgagaccagggctttttcctcttaacttctctcttgcccctccactcctttctgccatgactgctcagctgcttgatacatactcagcatctccattgtcaaaatagaagatgtcgtaactgagcaatacaaggagaaaagaaagaatatatatatgtacatcagttaatgcatttttgtgcttgcagaatgtcatagcgtgtgttaattacacctttgggtttattgttggaaatatggcaggctgttctgacacacctaccggacttgagctccaacctctctcatcaagtttgctcactaaggttcattgttatagtacatcagttaagctgtccaaaagagggcaattgggcagtgacaagacaagctcatgtgtaatgtgaaagaaatgaatgtggtgatgcatgaagtgtaatctctgcagtaacatatcagagacactggtaggtaattcactagtcatggcattgattgataggcttagcagtctgctataactattagcccctgcagcattaggaagaagcatatttgaaatctaaggggtgcctctgtgtgtgcccaagatggcataaatgtaaatataaatatttctggtgtcaggttcttgcagtaaagtgaactaccagtgttatttccatctctctgaatcaggaggttggttttgtccccccactccctcacctcaagtggctagagaattcagtcatgttggactagaacacaatttttttttatcagagagatgatggcttaaaactgatgtcattatgaggtttaaatcaactttctgcttgcttgaacatggtcacctgggtatggatgtacaaggacaaaaaaaggttgatcaactctgtttgtctttgagccagtgatacctggggttgtaaaattgagttccatgaacagtaatctgtcatctgtccccacaacatacattttttaaacctgtgcctgcattttcttttataatgaaggggccagttgtcctggaaaaagaaatgttgcaagacttgggggttatctgttaaaaatactggtaatgcccacttcataatgaaatcatcaagattattttacatacctgttcatggccttgccgagttaaccttaaacatgtaaatgtcaagtataggaatagatagagaattaatattttgaaggcctttttttccctgaaggttttataataggaaatggagggatattttgtgttgtttttaaggttattgtagggtcttctttctgttttacataattagcctatctgcttttcaccctggtctctttaatcatctcatcctccctagcaccagtaatttcatatagaaatattctttcagtcttattctgaccttttaatttttaaaatgtaaactctaggtagcagaaaattacatgcttggctatgtacctgctaatggatttgtttaacttcgtactattattcttagtctaccattttggaagaaatacatactttctggaaatttgttatccatttagtctgatgagtgactgggttaccttttatctgtctaacatgagatcttagctgtcaaataacaacaccctttggtaggtagcgctcattgaactaacagtttaacatcactaacgatatatggcattgatggaggaaagcgatttgactgcttctgtgttaagtgtgatgagaatgttcttaaaagtaattatcacattgcagtttgacccagaagtatcgctgttgtcacttaatgagttactatttttatttaccatttttctctatggataatggaactgattgccagcccattggaatagatgggagagtagagtaacattaatgcaccctgtaggtataacaagtggtaaatacatttgtctttgtctttatttgctggataaacagcttacttttaaaacagcatcaaagttctgcttttcttcgagagaaagcgggagttaacacagttgttaggaccctgtcctagtcttcccacctcccatgcagctgacccagaaatcatttagtttgagttgagaaataggtggcttgttcttttcatgtgtttactctctagaaaataaaaatagatgttgacttgtgtggttttatatcagtatgccatcatcaacagacaagcctattaactattgtttccattgagtaaacagtggtctgagggtcacccatgttcacaggtaattgttggtgtgcagacaacagtagcgggcctgctagctacaaacgcatcccacctgtcacttcgaaaggtgttggaaaataatagttcagatgcagcaaaaccggacatggggttgtggagtgacctttcccctttgtttaatttgcctctgaggcttaatttcaggggacaagtaataattgactatgcctaataactaaatgctcatttgggacaaaatccatcaaaatataattggcatttgatttttatgaagggagaagaaaaccgacttgtctgtcgaggatgcctcctaagaatatctgaccacttaatgtatcatttgaagcctcctttataatatatattaattgcaaatgcttgagcatttgaacattttcgtggagaaccgttaggagggaccaactgtttttgttaacgctcctctcagaaaggcggggaaggttattggtctgctgtgcaataatttactcctctttgatatgcaaacgatccacggtgaatataaaaaaatcctatcagactcatttcacagttcttaaccactcggattctctggagtccatcgcctcattagaccagtgctctccaatgctagcataattaaaatctttaacagtttagcaaagtaaagatgtttggctgatcacgttgagatgattatctatccattgtattctaaatgacaaaaataaattaaatttagaccttggcattttttattatgtgtttcaaatgaatataatgcacacagccttcttttttaattcgataccttaggtttggtaagaaacatgcctgtttcagctgctgctatatagtcagaaaatggcaggctttctgggatggctgtgttacacttgattgaaacaatgaactgcaatccagacgtccacttctaatgtggtattgccttaggatgtgcagggtttatgttttcttttcggtgttcctccaaaggaagttttgttgcttgttgtcgttgttgttgtttttgttagttgtcatctagaatatctttattctgtgcatgtgtgggctagaatatgcattgaggtgggatttggaaacctgggctacagaggcatgccagcaggataaagacgaagaggcccacaatagtgagattggcatactgattgtatctcttcttgggggaaaatactggattcactccttaaaacccatgtccatttagatcccctttaaaaaaacaagagaacttcattactgtaagtttattttacgtttgcattttattctgcaatggttcattaccattgatctaagaaatgacagtaataatagtgttacttgtataaaaagttacacagtttttcagtagacacatccatcaattaagcatgtggtactagaaaccaaaattaatgaggaagataggtgtgttaatgaaataatcatagtataatcaatttgactgttaaaagttgaaaagcatttcaggaagacgatatgaattcataatttatgtctaaaagtgattaataaaaactatatttaataacaaagctatttgtcatcatttaagacttaagcacaaaaattattcattttgtagttcatgttgtcataatagtatagttgaacaaatttattttgagcccttctttgtgtctaaaactaaggtaacatctatctacttttcatcaaaattgagaaataacacttgggatggttagaggcatactgttgtggcaaagtaactgtgttttgagtcactttcacctgagtcttttatgtgcgatgagggcaacttccactcagttgctcggtaagaggacacactttttactaccgcatctgccgtagttgggaggggaaaaaaaactgcacacaccgaaaaacccccctaacactaggctttgtttactgactctttgatttaattgctgtttgaagaggacggaattagctgttaattgatttaattatccaatttgtttgtttcaggcatgattccaacagaactgcagcagctctggaaagaagtgacaagtgctcatactgcagaagaaaccacaggcaacaatcacagcagtttggatctgaccacgacatgtgtctcctcctctgcaccttccaagacctccttaataatgaacccacatgcctctaccaatggacagctctcagtccacactcccaaaagggaaaggtaggaaccagccactgagatgggtccaaaactgcctttaacatgagaggggtgggtggccctgcctcgtcatatctcagtgatccctaattggatccatgtgacttgaatgtgcatataattactgaggaatgtattcagtatggtttgggtgtgaagcatctaattattttcaccttttcaacatggaattagcacttatgtagatctactctcagcttaggaacccgggcagaagtcgtgtagtttctcattggatgggttggatttccaggcttccaggcctactccttctgccaagtgctcactccgtacaagctgaattccttggctggaagtgccttctaagggaatagtagtgtctgctgtgggcaattttgaattatggtttgagaaaacatagaacttatgttactctacattgctccccttgaaggctgggcgcccatgtttttcatcattgtgccctggagcacatggtctttcccgtatgtattctgagtgaaggtttggaggatggagagacagaagaggtagtggtggtggtggctggtggaggtgggggatctgttgtatatactcacataaacagacacagcacactttctcttcattgtgggatatagtgtagtattgtctcagcagctgtattcctatttagaagttaagacattttatttttgaattgccctgggctttacatgaatgttacttgaagctgagcttgttttagagatccagaatatgccatgttagcatgcagttctaagaaaataaagctgttaattcatgttatggtattcttagtacccagaagcattaataccactgttgaagtgcttttcaagaatagaaaatacaatgcccctaaaattgaaaactttttgtttgctattcctaaactgttttctatatatttcataggcagagcttccacacacagaggtaaagaaaccgtaaaagtagtatgtgacagtaaatgccatttctctcaggagaaagcaaattctgtattgtgttttttaataaaaatggctcagtgaaaaaacatttaattatatatttcagttatgcaattacaaatgtaatttcatatatttctcaaaatattgagtatttaagaagcctactgtttaattagatgtgtatctttataccagaaaaatattatctgaacacacacacacacacagatacacacacacacacagagatacatacatacacacacacacacacacacacaccatgttcaagtgtaaaaccatgagtggttaccagagttgaggataatacatatgttttaactaaaattttcaactatccttccaaggtcattttggaatttctgaggcagacaccgaagaactaaaagatgcattaagcatgttggtttggaagagtttgaagaatagatagaggaatagaatggtggacactgacaatctttggagccattgagggaaatgtggcttctgttgtttctggcaaggatagatatgtatgtctggaagccaatcttagctcttgctttacaatctcttatgatgtcttcttttttttttttttttcaagaaagaaaaccttagagagcattaaagaaaaggttctaggctgttgtcctttgctatacttggttttgatgccctaaggttgatgcgtccatttgctgcagagcgattgaattacatctttatccataggcagagcaggaggccatacactgaaaaacgccgactgatgcacttaaggtatttgtggcaatctcatcggctgttgtggagcctgcacagatttcctgtgacatagaaaactcttcttgtttagatgcgctgtgctcagtttcattttctaaaaggttatgtatctgcagtcaggtgatagattagcaaggaggcaagtgggagaagaatagcccttttcatgtcttaaggcacatttgaaagtaagtggatctgagagacagtctaattctgggagactaagtttgtttgaatttttttttatggtccttatttgtctgcacaaaagttgtgcttaatcttcatcatactacacaccagaattagaatatggatcagaaaagaattcagattccaatgagccttaatctggatgtaaaagcaggctgagttttccaattgtacatgcaaaaaagaagcaactatgaaattatatgccactacttaatctcttgaatctctcagtttgtattatctagtaggttcctaaacgtggctggattaaaagaaaattccagtcagcacattttaactgaatgtagccatcaagacaaatgagcaccttcagttaaagatagttcagtttaagcttgtggaattgataattaaaaaatcaattaggcctggtacagtggttcatgcctgtaatctcagcactttgtgaggccgaggcaggaggattgcttgaggccaggagttcaagactagcctggacaacatagagggaccccaatttccattaaacttttttttaattagcctgccatggtggcatgcacctgaagtcccagttacttgagaggctgaggtgggaggatcatttgagcccaagagtttgaggctgcagtgagccatgatcacaccattgcactccagcctgggcaacaaagcaagatcctgtctcttaattaaaaaaaaaaaaaagcaatgattagttagccagcttcgtatacatataaatacttcaaatgcatattatgtagcattaccttattaggcttaatttaaaaatcacgtgtgataaccagttaaataccaaaacaaagctgtcactataaaggtatggtctcactgtacactgatgtgccagttgtctcaggagtctcttgtcactgccttggataagttttctctcttactcatcaatgcatttgtgaaatacgtgtccttccaagctcttctttgatttctgtgtaatattcttttccctccattctgatgggcaaggaaagagtctctgccacactgaataactatctgaccccatgaccttgatcgtgggttagcagctttaagatttctttctgacatgatctgggggtgctcgatgggaaaatttgctggaaaaaggtagtgttgtgagagttactgttgttttcaaagtagtgagatggctaatgatctcaactgagttgcatatgtatttccatgccatttggaaaactccttctcccccactcttgcccccgtgcattttgctggctcctgtgagcagccactgcagtagcagcagctctggggtttggtgagctgcaatctgttaaggagataaataatgtgcttggcacgacactcctactctcctctttaatttgtcttacacaaggaaaattataattaaatcattcagggtaaacccttgagtgtagagaagggaaaaaacacactttggtaaagattgccaatagaaacccacttccctgttgcgcagggtagagacatttatcaatattcagcactattacgggaggagcggcccatgtgatttgtgaggcggatgccagcgttcaaatcaaggcttgttaagatcctgtccctgtgtaatcatggacattcagcatcattagaattcagtactggcaccatgcttcgtgctttgattttctccgacaatttaataatgtttattgtgctgattgtatataaattcattggtgcaataaacatgcctgtgttgtcagtgcctgagaaaagtgtggtggggatcaagttcaatggcgcagctaagggggagcagcaagaggaagcaggtgcattcaagcctcttgctgtcattttattccatagggacagagagtctcgacttcttagggaaacagacaaaactcaggcctgggataccggtacatatgaagatactgtcttgtttccctgtctaattgtcttgctttagaaaattccaggttttggtgtgggtaaacagaatcaacagaatgcaaatgaaacatctattaaaatgctaaatttagtaaagccctttgagcttcttggatcaaagcagctatgtaaatactaatagcaattactacttaagtaattgcctaaattaaaatttgaaatatcacattacattatggtgcactagggaaagggacaagaactcacatttaatcagttccttctctgtgccaagcactggctagacttttgcatatggagtgatgtctcattttatccacctgaccactcaggaagcagtaaggatgattatacccattttacagatgaggaaatcgaataatagaaattaaataactaacccagggtcatagaactggtggttagtggcatatccaagatccaaattcagatctgtgttttagtctgcaaaatagtacttaaagttttcattcagcatagaagtgaatactaaattacgataaaatgagtgtccctaaaagatactttaaatttaattgaaattcaatttgacaaaacacgtattaagttaacctactgtgtgcaaatcactgcgtttaaaagaaaataccagagttttctcttttatggtgtatattcatatttaccaggcctttcatgaagcgggataggtgggatttacaagctataaatcattttggtctgaaacagcacataaagaacataaatgaacctcatgggggatttacacacaggcagatccaaaataacgtatccccacttttttcctgccttataaatcctgtgtttcctcaatgaacacatcatatgctttttatttcatttcagctgtcctctatagtccaaatcagaaatattcccttttttctcatcccagcttttttgctttcagttcagccaccatcattagatgttttataactcgagtatttctcggattcatagctgttctaagtatttgttccaaggtgtccttaagcatttggtcaaagatgtttccttaaaccctgatcagatggtggttgggcagtctctgcttttttgaggtatcatattagaaacaggggacgcacactgggcgctttactctatgaggtttaacctatgctctcttcagtcacgatagtccttgcctcgttctcatcatttattgacggagccctgtgtattactgtcgcttgcattttctccactccacagttggcagttgccttcaaataacccctgaaggtttccgcctggctagtgtacttatagacagtttcacttgatacacagtctctgtttttgatttgtggcctcttgacatgttgccatgtatttgactatgtaacaataacatttgtgtttacaggccttgttattttcaaaaggcaaggaactttgaaacatgtacatgtctagtgttgcatttttttttcttttttaaactaaattctgtgtttgtgaataaatgtcagtgctcttggtttacttgctaaaattctagaagttagttttcagaactgttccagatacacaagcctttaactggtgcatgttctgtgatatgtaggacctgttgaaatttaagcagtaaactctagctcccattattttgaagagtttttcctcatttcagtttttttttttccccaaaaatcagaggacaatttgtatttattttgatttgaaatactgagcaagctagttattttaaatctttcttccccgttagagcattttggagaacctgtggtcaaattccaccaaattgtcttcaaaattgttaactgctacttcctgccaacatgagtcaaggcatttaaacaatctataacactataacagagctcggcaaattatggtcagcctgccaaatccagcccactgcttccttttgtaaataaagttttattgggacacagtcacattcatttacgtattgtctacggctactttgacactacaatggcaagcttgagtagtggcagcagaaaccatataggctacgaaaactgaaatatttactatctgaccatttacagaaacagttgctgacccctgaccttcaccattagcctggtgtttctcagattccctgatgatattttcatagggtatttgttaaacacacagcttcctaggcctttcttctgaaacctggactttcttggtctgagatggggtgcaggaatttgcatttgccctacataccctggagtcttgctactcagaggctgcagaccagcagctctgctgtgacctggaagcttgttagaaactcagtctctggccctgccccagacctgcatcaggatctgcattgtaacaagagcctcaggggtttggaatacatgttcaagtttgagaagcaatggaagctgtgtgtttatcactgaggttttgacacttggaaagaacaggacttttctccagacacttgattcacatcccagacaggttctcatcaaaagtcagggctgtagttaaggtggtctggggagcagcccactggggagccaccagacaggttcagtcctcaaaactagtgacttgccattcttacgtgagccaacagagtagaaatcatatgactgaagggaccagaccccatttgcttcctttccttaggagctaccacgagaccttgacttgagacccactccttggctctgtgatcacaggcaagagacacaaatttaaggttctgttttgctcttgtcaaggatgaaaggacctgacatgtgatggtggtgatgagaatgcagctaacatttatgtaactcttactgtgtgccagacacaatgctcaacagacttgacatagggcttgatactatactgattttcctatttttaattttttttattttttatttttattttttgattttcctatttaatcctcatagtaaccttatggggtattctcccctttgtacagagggtgcagctggggcccagaatgatgttatcgcttgcacacgtcacatagctagttagtgaccatacagggactagacctgagatttccctgaccctcagggacttgcagtgactgccagattctggtggctcccagtgggctgctccccagaccaccttcactacagcccagacttttgatgagaattggactacagagtgggttaagctccggatcaagtccagatggtagcctccactggttgtagcttggggccagacctatcttttcagcagtaatttagaagaagcccccaggaaaatccccgttgccagtttcctttgcacccacctcatctttttgctggcagggaagtcaggaggttagaaaccagtgacgcacagtggagaatatagagggcgtgctgggcatgtcttgtcaggtgtaggggaccggaaagaggaccaggtgtggctaactgcagaggcctaagatacaggtacttatttttgctccaaagcagactcttggcagcatcacctgtcccatgtctatctgtcggggaggtaacctacttagggcaaaagctgttcctgctgaggtcagacagaagcaccctgggggcgaatcagcattttgtaccctaaacatgctgcctgttgtttggcagccatcgtgctttgaagaactgtgatgtgtctgattgcttaaaaccaatcacttttgggacttagaagtgggagaaaggattctctcagggccatgtggcatggtgccgtatcaccgcctgtcattcacacatgcagggagggcaccgggagaaaatctttaaaatattggcatgccataagggaagggtttatgggttgttttttttttttttttttttttttgactgttcactttgtggggtgattaaacaaaaaaacctcagccattattctctaacagctgttgtgccttacctcaataaagtgccttttaccataacacagcatctttagactctataaatctctttctatttattgggtttaaatgataaatgctttccaataaaatgacatcatgggtctggagagtgatgttcattttctgagttactcttaaatttggttgatttgaatttttttattaggatgttgtataatatgaatctcagccacaggctattccgtgtctaatgtgccagatttcccacccaaaaccatctttggaccccccatttctttcaccttgtaaggtagacattcttttttgatgcgccgctgccgctgatacaggttctctgccaaattcctttgttggcacccaggcattttgcaagtatttgcgcttgagtggaaaggcctgtgtcccctcctcccaattgtgtcttagctttccttaacatttattccacaccaggggtgtgagggaaagcatgtggcaggagaagagtgagaaccagccttttggaaactctgatggtattgtccatggtactcggttttactcttttacctataaaaagttgttgttgaattgcacaccttcaccacttaaattagacagaagattttctttgatggatattgaaaccaaccaaaagtgcaaagggaagtcaagggccttccctttgagaggaaaaggggcttggaaaagtcctattcttataataaatgacagctgggagtcttatgctcttaagccaatactggagccagatgaaggggggacctatgctggagacttaagcggatgtcatgttccttttcaagatttgcaaagatgcttttttgtgcagttattctgttttattgctgtgttcgcaccagtgttaccccgtggcctggctccataggtctttccgagggagctacctctctgccgactggctcactggggcaatgcaaatgagtgcgttagatatgtacagcattcctgaagttctttattccatacccctttgtaatcagtcaaggcctaagtatattataaactatattctcctcattaaaacaatagtggaagctcacaaagggaaattgttaatatgtgttccagcttgtcacttctgcctgtgtgaataaagaagataaccgttcctttgggaaactatttcgggaattgagcaacagatacgctagccagagaattctcttaactgtaattttcctttttgtgtgtactctaaaataacatcctgttgggctcctcagtgccactgcacagacagagcacaattgccacagcccaggtggtgttaatatgggacaatccccccgggcacatgtcgccaagagttttacagcttgttcagtgtcttcatccatatggcaatctgtcccattcacaggaaggcatcggggctgcgccgggcgggtactgcggtcaatgtagtgtgaagagcaggcctccactcaggcagcctctgttgtgcagtttgttttattgtagatctgagttatgacgcacacacactcacatgtactctctcaaccaagaagagatgcgaaaatagccttgctggcttcctttcctccccctttattttttgaagcacgtggttaactcagcaggtacaattctagtgcatgaaacacacttggttcatagaaagtcagttaaaaacacacatccacatggacctttctggctgggtggttgtgtgttaacataaggactccatacttgtactaggattcttctagaaattagtgggttttgttgttcttgctctctcttccccacctctttttttgttttttgtttgtttgtttgtttgtttagcattttccattgtgaaaactattttggttgtccagtttggattgttggtctaatatttgtggtttctaagtcttaaaatgaaagaagagaaagaaaaaagaaaatcattatccgcctcagaaatctgagagtaaaacattggctggaggtgtgagaagtgcaaagaatcaagaaaacagagatttcccagtgcacagggtgaaaaatagggactttttaaaaagacactttggaaaattcaccaggaggcaaaaagccttctccatttatatacccaaggcttgttctgcttttgtgtaactatttgtgttcttgtttggtaaacaaacagaccccatagcaactgtagctgatgatatttatactacctgtaagacttccctaaacaaatagacagacttttatgaccttcaaatttcattccttttatagtcttcaaggaaatcagtctaatggcaagccgatctctctctttctctccattgctttttttacagtactttgagatatgtctttgaaggagcttttgtgtattgtgtattttacatcttggctgtgaatgttgagtgtttgaagatgtactatggcagaaggaaagaggaaacctgaagtgtttgtgcaaatgatgtgatatttgctttcaaaggagtcattttagtaatcagtggaattctgggtcatacatccaaaaagcgaacactccaccgaaatcatgaccatagacctgagaatcaggcggatatctatgtctgtgactctactttcatgtctgaaatattgatagaaacattgtggtacatatgagcccctatattcaacttaaatttttccatatgagtcagatttatgacaagaacaagatgtctcgtgttaaagatcagtgtgagagaaaaatggcagtttactttaattagaaaaaaattgacaccaagagctggaataatccagtggcgtttgaataaattagaggactgtacagacagaaataaaaagaaactcaacaaggataaatgggaagttgtccaaagtgcaagaaaaaatgtgttcctcagtgggacagaagtcacaggacacttccaaggtatatccattcaaccaaacttaccaagctcaaaccacaggccaggtgtggtcctagtgtgggaatgtagctgtgagctccacagcctgtcctcagggagctgacactgcagtagaagggaaatagaacaaacaaatcatttacacaagaacggttaagttctggaaacagaaaaagtaggaaagggagtaagtattatttgtggggctgaggttactgttggggtaagttggtctggcaaagcctgtaggtggccctggaacaaacgtgaataagaaagggaagaccccctccaatctaagggcacatcagaagcaaaggccctgaagcagaggcaggcatagaagatatttggctgcgttatggaccatactggtttcatgtcaggccactgtgttgtttggtggtatttagcctcctatcagaacccaacatgattatcacaaagtaggtgtttaataaaatctgctgaattaaaggtagagaagggtttaacctagttaacccagtttaacctcaaagactggactgaagaatgcaggctgctctacttaagttacttgagcttggtgtgcctcagtttcccacccctgaatcgggtatgctaccagcccttacctcgtcttagatcaaattgtgaggattaaatgagttaatatatgttttagttgctgagcacatagtaggtcctcaataaatattaacttattgttaattattattaaagctatttattcattcataccacacgtattgagcatgtattatataataactctgtagattctgggaattaaaagatgaccacaatgtagttcttccccttcaggaactcacagctaatcagaaaaacaaacatagaaacagacacttgaaagtcaatgtattattaataactatggtgatagaagtatatgcaaaacgtaacagagggcatgacttgttaaaaatgggcccagcgtggtggctgatgcctacaatcccagcactttgggaggccgaggcgggtggatcacttgaggccaggagtttgagaccagcctgggcaatatagtgagaccctgtctctacaaaaaatataaaaattagctgagcatgatggtgcatgcctataatcccagctactcaggagactgaggcacaagaatcacttgaacccgggaggtagaggttgcagtgagccgagatcacaccactgcactccagcctgggtgacagagcaagactctgtctcaaaaaaataaaaaaaaaagagcactagtggaacatcatagtgtgtgtatgttccccctacatctgcctcacatgagattttctaacacaatgaatgctgtaagggaaaggttttaactctcttgtccattgccacatccccatcacccagcacaagccagcctggcatatagtaggccctaaatttcattgcagagactacatgaaatgttcagaagaaagtgaactaatgagatgtcaaaggtcaagaacccattaagagtacttctatacttgccactctttggccacaggtgctgtaagacaggggtccccaaaccccagttcacagactggtactggtctatggtctgttaggaattagggcacacggcaggaggtgaggcacgtgagtgagtgaagttccatctgtatttacagccgctccccatcgctcacattaccacctgagcttcgcctcctatcagatcagcgaggcattagattctcacaggagcgtgaatcctattgtgaaccacacatgcaaggaatctaggttgtgtgctccttatgagaatctaatgcccaatgatctgtcactgtctcccattacccccacatgggactgtctatatttgtaggaaaataagctcggggctcccaactgattctacgttagggtgagttgtaaaattatttcattatatgttacaatgtaataataatagaaataaatgcatgataaatattatgtgcttgaatcatcccgaaactattccctgccccccagttcctggaaaaattgtcttccatgaaaccagtccctggtgccaaaaaggttggcgagcacttctgtaagagaacctggttagctgttgtcgatacctgtagctgctccaaaccatgagaaaacttaagtttctgctacaagtacatctcaatctttagcttgcctcagaatccccctggaggaatggctaaaatacaggctactgggccccacccttagtgtttctgattcagtaaattggggtggggcccccacatttgcatcttttacaagttccagacccgtactctgagaaccactgccttacaacgtccccacctggtatccttatggtgtggcattctaccgaagttcaaagtgacggataagtgatctggattaccattacttaggaaaatacaggtttcagagccaagactcaacatttcagagagaaaaattctcaagactgtggcccaatataagctattttatggagcaaaatttaaaaaaaaaatttcaattttggccttaatttcattcatcagggctctggttttgtcttcctagattttttgtgtgtgtgcttcggttctctgctctcactctattcctttcatcacctgagctcctactgatacgttaaggcccagatcaaatgttacagtactttatgttccagccatctgttcagttatcactgtctccccaactagagaattgggtagaactctttccgaggatgagaacttacttaaagttgcagtcaatgccagtgaccaccaaacttgattttttacccatcagtataaaagtgttgaatgtgtacccctactaagtatgtttattaattatatacatgtttctaatatatattccttatgttataaaaattggtggctaagagggtgagaaatgtatatatacattttcaagttctaatattaatatgtgtatacagaaatcttaatattgtgactcatatatgtaatatcaaatcttaaatatatgatgtaggtcatatgcatcccagttttggagactgatctaagaacctaacatgattatcacaaagtaggtgtttaattaaatctgctgaattaaatgtagagaagaatttaacccagtgaatgttaatgaggcatcttgtgctatagagaaataaatgtaattacataaagtagggagtaattctaaggaaatacataagcaagtgcctgatagttttgagccattttgtatctttggctaacttgtcccttcatctcctgctttctggtctggcccttgtgtatggttctgcttttgaagtatgatgtaactcttagaaatcttttgctgacttccatagcatactggggaggggaagaaaataagaattaatattggaactttgtttacggtcgttggtttttttgggtgtcattggttcctctaacatatggacaaggttccacatagaccttgtgactcaccagtgcaaacacacttgcattgacataatgagaatgcctgcctaatggtgttaataacttttggattagtgatccctatgtctgtattgacacagttgctcacaccactttttggaaagcattctgttttcttaacgagatcccagtgttaatactgccagtggtaaacttttagttacaaactcagaatagcccttactggtgtcagaaacaaaagatggacctctgcctcttgttgttcttttcctttatttattccttcactcatcaccttgcaaatacaggcattttgtgcttgtcatcacctgctctgtttgcgattgcattgtgatccaagcacaccaaccagcctccagtactacagctctgattctctgctccgttctcctgctatgccacataaatactcctggcatctgggaatcaagatggcacattttgcccagtgtggctggaaaggggggagataggggagattggtgacatggttagtgatgaaaataactgccagacttactacctttcgtggcacctagcctcaggttcttaccattggtaaagcagccagttgctggtcacatagatagcttacaaatgagatgcccttaaatctggaggaagaagctctagtcctaaaagcatcagacacactacactgtgctgttggggcctttgtgggtctttgacccctaagtccagaacgaccgtgaggctctgccatcccctgtgaaaattcaaattaaagtacgtcttcagagacttgctactttgtcagtgtcaacctgcgaagttaacccagctacagactggatcctcaaggactactttatgagcttttacttttccaaacttgagtcgtttgaatatgcgccccattgttgtgaggtttgccctgtctgcttatgtgattatttgtattattttctttaaatcaagtcatttcttaaataaaatgagcctcattctaagaaatgatatctgtgaaatcagaagttggagacactagatatattttagtccattacaaattaagatacatctgcaaatcttcaaagtatgctttcttgctccatttgacattgtgtggaccccactgagtgtgtgcatattatgagttggtatgttttcataggtttttctcatttttcagagggaagggaccttgactgaatatggtactgtgccaagtgcatggaaaccctgccttcctagtataccctaatttcttagaaaaattcaagactgtcacttaaccttcctaaaaagttgattgtgactctgcttttcctcacatacatcctcagggatatgaaccaggcttagaagatacttaaagcagacctagagtttggggactgtgaagttttcaaactcattgattcagtagtttactctgggataatcttgatcagtgtaatatctggtaaacattaatcactgaccatatcacccaacagatctgtgctgatgtaaaattggtgtttgttaaacagaaacagaaagtgaccttttccctgtgctaacttccttcagccttacctgttttgttacgtttaaaaaacaaaaaagaaatacagccttgcattaatttttaaataattttgagccagcaagcatttctgtgagtttgcaacaattacttggggaggttgcccagtgccacccccttacatatttatctatgtccatccatcttgttataaagagggcatccttgtgactgtttctttaagcatagacatttttaggtcagatacagatcagggaacacccaagatccttggtactcatgttatggtccatggcccagcagctctgggggcttactccacatgcatagtcgtgcgccaccccaccacccagaaccaccgaatcggatttatatctgtaataaagttcgagaagcactactctaggaatagcaatgggaaaggaaggttgtatgcccttttccccagacacagtttttatagtcccttagggcccagtcaacattctttgagtcattctcctgccattctccatttttggcttgtctgcatatacttattactactatctacttcatatttttcataaatcgtctcgtttaaataggttgtataaaaagtaactactgagaaatcatgtttctgatgtactcataaaaactttatccaacgcagatgaatataagtccagaactatggaagtgagggtataccatgcaaacccacccagcacaccactggccatgagccatgccctgaggaccactatagaaaaataactctcttatttctcccagcataatttgcaaatcaagaaagaaggggggaacaaaaactaagtctggacataaatggttaatagcttgtatttcagatgtaaagttagttaaggtagtcctcacatctcagagcacaatattgagagcagataataacaataatctccatcattgtttaaaatcacaaatctggcacttaatagactaattcacagtcactccaattgcaagttttactcatgaatatcgtatcacatgggaatgtgaaatcctctaattaaacatgatttgaaaagcagcagaaaattgagatgatgagcgttctggggaaggagagtcaaggattccctgcgtgagagagaaagggagaagcatgtgtgtttgttacagtttgtagagaactccatccttattcactctagggtaggccctttaataggctttaataaaacacccttctctttgtgggaggattacaggacccattgtcaacttacttttggaaaactgattaataaacatgtagggtggtgtttttctgcagtgagtgagaagtgaaaattaaggcagtgtgctagaaatgcagtgtctaagttgtctcccaactcttcggtgtgaaataagaagcccatctgcttctcaaagtgttttcagtgacagttgaaggagaaaggtcatttttacaaagctgccagggaaacgcatgcggcccttgcatcgtcgtttctcctgttcccacgtttcatctgctcgtctttgggcaggtgtaagaccttttcctccgatgctacagtatggaatgtgaagaaactttacctgtcgttctgttttctgcaagagattgtgatttcttttccagctgatttccagctgatttcgaggggatatacaacagtatgaaaaacgccagaagaatacactgtaaagtggaaagtggtgctaagtatttaaggaatcatctctttgagattgtgaatctaccttgctcttcttagaaaaggtcgttgcgatcaagtttcaaggccagctcgtctagtttggtatcattttgtgtgactgagcatatttcattcgagctaatgatcaaatatttcacaaatatttgatagcaattagtttttgtaaatttagtaatttcaaatcagaagtctgattatattttcagataggacctcatcactagaatattctcggatcaaattcgtattcccatcttcaaacctaagaagtacatgatatggttcggtacaatctcattgaaagtaagctatgataacagagtcacaggcagggaaatgtgataagaactaaaaagtgaagagagaaaagggaaagtaggatcattttgtataagctgtcattgaagaatcagcaaataaatctgaaagctttaaaatagtagtggcttccatcgatgcctgccattgtagcgtaagtgtagcttaagacactctttattagtagatagggctaaaattgtatatgaagagaacagctttctagaaacccaaggtgtctgatttaatgtaatgttttggctgggaataagcagtctcttaccgtgcagacaaaaatcacaggctgggatggacctgaaaaaggaggattctgtggcttacagtgttgttaggttgacataaagttgtgcacatggacatgagaccaaataatttggaaggataacagacaaagagagacatggaagtcttttgtcaacaaagcagccttactgatgagtatgctcggtgcctgtctcagggtcggagttcataaatgttggctggacggatgaaagtcctaaatggtgggaatgaagaaggtggccagtgggggaagggagggaggcagaacagcttttaagtcaaaggaggtgggaaaggggatgcatagtgccttttggtttgtgtatttgctgtgggtcagggatgagtgagaggggaatagcaaccagccccctgctccacagccatgatgaagacaccgatactccttcctgaggggcttcattcattcctttaatggatttccattcagcacctactccttattcatcttgtcaataccaggatgtgccattggtgcctgttccctatgccatctgcatatccttggtggaagtttggtggaggttttaccactgggaggagctcttgtgtgattctcttcagctttcaaatgagggaattggagggcagagcagtgaaaggactcgcaggattcctggttacaagcagagctatcatgacaaatgaggcctcccaacactatgctcccaaccattcctatagggaaatagtgctggccctcagtaaaaggaacagttacactccatttacatgttaagcagagaaagccacatagcacattcattctgcaaaggtttttcagtacacaaaggatcaacaggatctgggaaacaaagttgcccttaggcacttattcttcaaaaagttcagctgctatggttttatttttattaaaaacctatctctccccctacccgtcaaacctcaaaagttattttatagcttaatgtaatttcaaaagttgttatataattttaactataaattcttttgaaaacatgagcagtatgttggggaaaaagaaatctaagaaaagtgaaatttaaaaaatgccaacgcttacatttacgttcattttgacaaaagtaatggtttgatacttttatcaaaccattcattggggatagagtagtgtttttatcaaatggtgctgggacaacattaaaaaaaatgaacttggacccctgactcatatcatatgcaaaaattaacttaaaacagaccataggcttaaatgtgaaagctaaagctataaagttctttaaagcaaagctagaagtaactctttgttaccttgagtttaggcaatggtttctgagatgtaacaccaaaaacagaaggagccaaagaaaaaatatataaattggacctcatcagaattcaaaatgtttgtgctttaaagcacaccgtaaagaaagtaaaaagataacccacaaaacaggagtaaatatttgcaaaaaacagcccaattaaaaaataggcaaaggctcgtaatagacattttgctgtagaagatacacacatagcagtaagcacatgaaaatatgtgcagcctcattaatcattagggaaattcaatcaaaagcacaataaggtaccatttcctagctgtgaggatggctggaataaagatacgtaacaagtattggcaaggacgtggagaaattagaaccctcacacagtgctggtgagaatataaagtgctttggaaagcggtctcaaagttcctccaaatgtcaaccgtagagttaccataggacccagcaattcaacttctaggtagatatcccctaaaattgaaaacagatacttagagtacatgtacatacaccttcataccagcactactcgcaatagccaaaatgtggaaatagcccaaatgttcatcaacagatgaatggataaatgtgctatgtatgtacaatggaatactattcagctacaaaaaggaataaagtactagtaaatgctacagtgtaaacgaatgaaactccgaggattatgggaagtgaaagaagccaggcataaaagaacatatactgtatgattcccttgatgtgaaatgtccaaaatagacacacctctagagacagaaagattagggattggcaagggctgggagttgggaggaaatggggaatgactgctaatgggtacaggatttcttttgagggatgataaaaatgttccaaaattagttggtgatgatggttacacaactccgtgaatattgaattatgcactttaagtgagtgaattgtatgatatgtaaactataactcagtaaaacttgaaaaatgtatttccacaattttgagtgagtggagaacaaccaacatagtcttctgtaatttaatttatcaaataacatgccagtgaaataaaatacagtttataatttaggcaggatttcgtttttttggtgtttgtggggaggcataaaccgtaatgggcacagatgtacgtagccttttgctgcagatgaatcagaaatttggagaggaggaaaacaaggcaaatttggaaagaggcagatttggaaaagggaagaaaaattaaggggatacttaaaagacagatgagaacttgggtcagtgcacaggaaaagctcggaatctgccttcaggtgaagggaaaactggcatttcagttggcaggaaatggcttggcagatagcaaggtcactctttgcttcatctccttcagaaattcttccctcttagttaccacaggggaaattagcttacaggactaacagtgtaaggatcactaaagactgcagacagcagagttgagaagttgtccttatttagcaggtggatttagtaattccagtttgaagctttggttaagtagtgaccttgggaatataaccatgaaatgtcataaggaaccataaccattatataaaattgtctcaaaaactaaggtcagtgttgaagtgaagaccttgggtggtatactttgatgcagaaaaaaataaatagaacaaaatatcctacttaactgtcattgaaaatgacacccttatatcctactgaatatatactggatttggtatcatttaatgtcagaaattattacatatttatatgtaattatacttttcatgcaagttggttctttctaatctgaaatgctatcactatttttgtgttaaaattatatttaatttttacatatcaaggattatcaagagaaatttaaattaactggcttttctcaaatgcatactatctgtgttttatatattcagaataaaattaaataatagaaagtgtcataacgatagtttctcatgtagctttgcataattctggtctttacctacaagacatttttaaaaaggccaacaccagttgaatgtatagccacacagaaatgaaatagaacaatatatttactgtctgttcattcataaatccacctaacattcatcaagcccgtggttttatgttttgttttgttttgttttgttttgttttttttgggggggggaccgtgtctcgctctgtcatctgtcgcccaggctggagtgcagtggtgcaatcgggctcactgcaacctctgcctcccaggttcaagcgattctcctgcctcagactcctgagtagctgggattataggtgcccaccaccacacctgactaatttttgtattttttagtagagacagggtttcaccatgttggccaggcaggtctcaaactcctcaccttaaatgatccacacactgcggcctcccaaagtgctggaattacaggcgtgagccaccgcccccgaactcaaacctatgttctgtcggaggtactgagtatatggagccgaaaaagtgatccctgcccctaggaatattcaacctgggagtttgtggtaaaatacaccttattaaacaattgaccctaaagttttagaagtctaattttgacaaacatgtttaaatcttttaaaaagaaaatgtatctattttcatcactgaccctgacagcttttcagaaatgatactttacacattggtgagtttacccttgaataatttatctaaatgattaggctcactgctttatttaccatcagatgcccaaatcatccttttcccaccatgtttcatcctgtaaatgtagctctaaattaattcaagataaaaacattattctcctcatttttatttcccttcttgtcttttttggcacgacccaaaaggcagtaagaatataaatgcttgttccacttttttgagaaaacagaaaagctcccattcagaggtgcagctggtgttgtccaatgatgcttcatacagaacgactgcaaagctagaagcgagtcccagccacacatgcagcgggtgtgtggtattcattgtgccactgttagagcactcagcagactggaaatcaagtcctgcatagcacttgattctttttctactacatacatatatgcaaacacacatatgtgtgcaaaaaaattaacaattgcacagcaacagttcctacaatgtgcaaaattaaaacttcaaaagatgtaagaagtatggtgaaaactgagtttccctgctactcctgactccctgtacccctccccagaggcaacagttgttccagtttcttaggtatctttccaaaaagatgctatcgaggcacctctgccagcttgttctctctccttccaaagccaaacactttatttcagacaattgtgtatttaaaagtatccagttatatattaaatatgaaaagcaaatgacaacagtgtgtacaggatgtttccatgttttaaaataataatgtgttagaaatgcaatataaacccgaatggtaaatgatgcctaggttggggtgtgggggtgcacttccttcgggaaccactgcagtttaatatgtgaacttgtgaaaacaagagcatgtaattttttcataataaagaaatttttttaactaagagacaaattcacaagcggtcttctgaatgtgtaattgtacccgtgtgtgacgagtatgagtttctttagacttcaggtataactgattgcgttctaaggccctagtgtgtcgttatctgtcctttgaagtatagggataacaagttgaactaaaagtaaattcttagatgtgaatagttttattcagatcttggatccttcacaagtcagttaactacaaacaggaaggggaacagcaaacatcgtgttaaattctacacatttcgagtccaaaaccctgctagtgaatgcatattattattttctctcatgttattattttcagaacactcccagcttaacccaggaagcacagccgtttaaccacttacagttcttaactagtaatattaatttttcatcctaactagttcaggttcctggtttccaaattgaaaaaatcacacaaaatatgtatactggctaagagtgtgctcggcatgtagcatttttcaagagcaacttgatagaatattcacagtgttaaattttggtactcattaattgagtgattctatttctctgaatgtatcttctggtagcagtcagttgtgataatattggcatgtttaagctggtaaattttatttctaacattatctacaaatataacaaacatgaagagaaactcaatgtccaaaatagaggaatggttaaattttggcatataactagagttaagttgatacgtgatagactattacccatcagtaaataaggttcttgaagatgagttgagaacatgagaaagtatttacaaaattatgttaaatataaaagaatgatataaatattcgtgccttatcaagtgtgtatgtatttgaaggtaggttttttttttcttttcaggattttcaagttttctacaataacaatatattactcttttaaagttataagaatagttaaatcttaataaaattgctaaagaaaataattattaaagttggaatatttttcttttctttttaagctgtggattaaaagttttctttttaaattattttcttccctcttagaatatctgagaattctactactgttgaagtattctttcatttgtaatactgttagtaaattcttaaaattctatttttgcatttctattttattcattcacagatctgaagatgaacacaaataggtagtaattctttccttgagtccaatgcagttttaccctgttaactgcttagagaatatccttttattgtttggcttcataaatctcactatagctacttgagttcccttgttttattcctttcttgtatgaggggcacctttctgtatttttacaagttgtttttctacctttttttctttttcttttcctttttttttattctaagacctattttctgtggtagggcaaaatagcttgttattatctttaaattatattagatttccagcaaaattattcagaagtcatagggagacgtaatgatctttgatcaggtgtagttctgtgtgtctgtgtgtttactttttatgctccttggtttgtgttcataatacacttactgtgggttgtgttataagtcagggacaaatggcatttgtgtacatatgctctatgaatgtaaattgataaaatacatgaatatacatcctgatggcaatatgaaatgaaatacaggcctcttgtgtgtatgcatgtgtgtgtgtgtgtgtgtgtgtgtgtgtgtgtgttcttgtaatcatcattcattgtgcttgaagttcaaagtcaggcagagacagtcgagtaagttgcaaaatagcccttcccgggaagggaatgcacttgagtacgaaacagaactctcaatgttagctttacatttctatctgatggaatttaaggttatggaaacaactgtaaaaataatttgtctgaaagaagtctggatgcagaaatataatagagaaaatatttgagaatatggttcatcggtgagtgcaacagatactcttccccgagcaccacatggtgcggatcaaagcatcccatgacttggatccgtgtggccagatcattacgtattgattggaaccccactggaggattaaccccttcgtgttcatgccaaattttctctcactgttggtgttaggaattttaggaatataatcttcttgccattattagcttttttaaaaaaaacacgaatcatctgcttggatacatttgtcttcctaaattattttggtattattccaaattatttaattgtactcctctttgctggataaaattaacttgggaaaaaatatgtgattatatgaaagcagtttctgggggaagggaagaggagaaaatggataatattccttgtagatgtagcaagaaaatctcaaaatcaagtacagattttataattttcattatgtagattaaataagttctagctttttaaagactccttcgcagtctgagtaaagagctttgcatctaacaaaagcctgtcaaacactttttcatacatagatgtacatttctaacatttgactaaatacacttaggtacaatttaactcttgcttttaggcaacaatgcagaattaattagtcaattacatgggatgggggaaatcacagatttgtcttgtccacatttggccatgtgggctcctcctgccttttttatcctcgtctggtggaatggttcttggcagcaaattcattctctggtcttctgtgtgttttctttcagtttgtcccatgaggagcacccccatagccatcctctctatggacatggtgtatgcaagtggccaggctgtgaagcagtgtgcgaagatttccaatcatttctaaagtaagaatgattttattttgttttcttcttttacatagccaacacctcccaccgttcatgctttgctcataaaatgcctttttgatggagagtttcacctcacccctttgagagtggactctaaatcacaaggtctagtgcactgtcataggaatagttacaaaatctattgagggttgtactacaatgggaaaaaggcttacattcaaaggcgtaagtcttagtaagagcccatatttacccatttttcagagtgacaaggattaaataaaacgattccagtattaaacttgcagttttttagcgtttacttttattcatgtccttacatatcaaatcaatgacatatacactataattttgttgttgttgttgttgttgttggaggtgtcatcttctttttttttttaaattatactttaagttctagggtacgtgtgcacaacatgcaggtttgttacatatgtatacatgtgccatgttggtgtgctgcacccattcctcatttacattaagtgtatctcctaatgctgtcccctcccctctccccccaccccacgacaggccctgatgtgtgatgttccccaccctgtgtccaagtgttctcatcgttcaattcccacctatgtgtgagaacatgcggtgtttggttttctgtccttgcgatagtttgctcagaattatggtttccagcttcatctgtgtccctacagaggacatgaactcatccttttttatggctgcatagtattccatggtgtatatgtgccacattttcgtaatccagtctatcattgatggacatttgggttggttccaagtattactattgtgaatagtgccgcaataaacatacatgtgcatgtgtctttatagcagcatgaattataaacctttgggtatatacccagtaatgggatggctgggtcaaatggtatttctagttttagatcctcgaggaatcgccacactttcttccacaatggttgtactagtttacactcccaccagcactgtaaaagtgttcctatttctccacatcctctccagcacctgttgtttcccgactttttaatgattgccattctaactggtgtgagatggtatctcattgcggttttgatttgcgtttctctgatggccagtgatgatgagcattttttcatgtgtctgttggctgcataaatgtcttcttttgagaagtgtctgttcatatccttcgcccactttttgatggggttgtttgatttttttcttgtaaattaagttctttgtagattagccctttgtcagatgagtagattgcaaaaattttctcccattctgtaggttgcctgttcactctgatggtagtttcttttgctgtgcagaagctttttagtttaattagatcccatttgtcaattttggcttttgttgccattgcttttgctgttttagtcatgaagtccttgcccatgcctatgccctgaatggtattgcctaggttttctttttctagggattttatggtttttaggtctaacgtttaagtctttaatccatcttgaattaatttttgtataaggtgtaaggaagggatccagtttcagctttctccatatggctagccagttttcccagcaccatttattaaatagggaatcctttccccatttcttgtttttgtcaggtttgtcaaagatcaggtggttgtagatgtgtggtattatttctgagggctctgttctgttcccttggtctatatccctgttgtagtaccagtaccatgctgttttggttactgtagccttgtagtatagtttgaagtcaggtagtgtgatgcctccagctttgttctttttgcttaggattatcttggcaatgtgggctcttttttggttccatatgaactttaaagtagttctttccaattctgtgaagaaagtcattggtagcttgatggcgatggcattgaatctataaattaccttgggcaatgtggccattttcacgatactgattcttcctatccatgagcatggaatgttcttccatttgtttgtatcctcttttatttcattgagcagtggtttgtagttctccttgaagaggtccttcacttcccttgcaagttgggttcctaggtattttattctctttgaagcaattgcatatgcactttatttttataaaattggtgacaattactggccaattgcagctgggtgattggacccattctttgttatacaattgactttataaatgtagaaagcagatggcgaggaaagctaccaatttggttcttaactttctatattggtattgacttttgttcaggttcttgtccttatagggaaagtggagtaacaatttctactgttaaagtatgactaagacctgggttggcccatttgaagctataacacctataaagcatctctgtaaggaaataatattaatctcatagctgaagtgaaatgcttctatgctattccttacttgtgttaccttgtcagttaaaaataaaatttagaccaaactgccctccatttttgtatcatataaatatattcataatatcactgaatcattaacctatgaattgaatataatgttacatgatattatagacatgtaatcaaacatatgcacatgtatacctataacataggcacatgtataactataacatatgcccatgtatacatctgggtgcttgatggtttacaaattgggtgttggggaccatctccttctagcttttctctctcattcaagccccagggaaacagaggtgagctgatttatgtgcaggtctccagttttgtgtggtctttatattgttagaacagtctctgtatctatctttatggacccgatacaaatattgtaataaagccatccttagagagataccttgtgttacctgcaagcagttttggtgaatataaatttttggttaatgaatggaagcctgtgaatctatttcatagctttcttgcctcaggattatactctgagagcattatgtagtcattgaaaacttaagtacttaaaaatattttaaaagagatgtccaaaattgcttctagatgtgaacaatcacgatcagcaatgctttattttaaattaagcaacagccgtttacaattattatcattcagagtagtgatattgggttttgttttgtttagaaatcactcactatagaatcttagttttgttctttcctgatcatttgcctaatcatatttatataatgagagaaaaagaacttggcagagccacttttaaattctgagttttttcttctacaccagtgctaggtttgataaataccttggtaccgatttcttccatctgtagaatggctgataaacatctgtaaatatgatttattgttataaagtctctagaactataaaattgctatccataagctcagggacatatatcagtttcagagtcagaaagggaaatgacagtttctagacccattttaaacattttgttaatggctaacttatgcctaccgtaaaaaatcctcaaatcataggttcatttgttatgtgagctgacaattaggttatatttattagaagattatcccaaaaaggagagagaataattttcgtattaaagaaaataaagatcattagaattggggcctagactcaattcctataaaagagcccatttctcttctaaagatattagaagtctggcacttgtataggaaaccacctatcaattatttattgtggttttgcacatgacacgacatgttctcagttcctgtttgctcagtggaattggaatgcccactatcaacctgcaactgttgcttggttatttcctggtacttatttattgacttatatttgtaagacgacttttgtttgtaagttacagaaacccaacttaaattggctgaagcgaaaaaaataaataaataaatgagggatgataattggcccctattgctaggaagtccagtggtacagctggcttcaagcatggctagatcctgatatttaaccaaggctgttggagtattgattgtccattagctctgtttttctatgttgtcttcatctgggggctctttccaagtggaactgaagaggacaggtttattaatcccacagagtatctctttccatgtagccccagaaaaagccataggcagactgtcattggcccagattgagtcatgtgttctagctttgagccaatcaccatgatgtgccctggcttgcattacatgctgcctccagaacagagggagatgttcaccccacgtgaaccacatgggggctggggatgagaaagttgcttcaagaatgtaaaaatgaatattgtaaagtagcaaaggagagcaaatgctgagtaagaagaaactcccctagatgctttcctgagttacgcattgactggtcatatgtaacaaattcaggatttcagttttcctctacaacatgattttaactcttggaaattcagagttgtcttcaggtatcaggatcttgcctagtgcagtggaaaataagttagtcttcttgtagattcacatttcccacttctctgttcagtctaaagggaaatcaaattgactttgatgaaaccaactttgttttccattgaaccgaactgaaagaagctagcaaacttctgtggttcaagtaaaaaccacctggcttctttgaatgatctcactgggtggggggggagggggggttattgtcatcagagagtgatgcatcaagtactttgctcagattgctggattcatagatcctgaaagcatcttcatttgcttcagtggacccaaaattctctagtctacgcttctcttcagttgtccctttcttttttagaagggatttcttatggtttaggcaaattgatagcagtgttgcttgaattctccttggtattcttacttaataaaggtaacattgctttgaccttgatttaagtgttacttcatagattattttcacctattttctgttcccttgattttacactcccctagtaatagtttataattaaatagtactgaaccttaaaacaggcatagtcccgaaatgcttcacatatattaactcatttaatcctcacaaacagtttatgctagtattgtagtagtattcccagcatagagttaaggaaactaatgcccagagaggttaaatgatttacccaaggtcacacagctaataagaggtggagtcaaggtccaaacccaggcagtctggcttcagaagacttattcttaactgctgcattatacagcctggttagaggcagcacttcttattgacagtttgctttctgcttggcagtggatgtaaagaaagttttggagaaagcctgactgggtagtgaggacattattaatatgttctttgaactagccacatgtcatctgagcctcagtatcagcacatgtgatttgggatgttaaccactttttacggttgttagaattaaaaggtacaccaggcaagacacaggtggtttacccctgtaatcccaatgcatttggaggctaaggtggaaggatttcttgaggccaagagtttgagaccagccaggtcaacatagcaagaccctatctctgccaaaaaaaaaaaaaaaaaaattcagctgggtgtcgtggcatgtgcccatagtcttagttaattgggaagctaaggtgggaggctcacttgagcccagaagttcgaggccgcagtgagctatgataatgccactgtactgtagcctaggtagcaaagcaaaaccttgtctctaaaaattaaataaatgaatgagtaaataaaaagtacatcatataaactgcctagcccatactaggcactctttaaaagcgttagaacttcttaacctacttagatatatttatttttcaaggatgagtaattttaaatatccaaaaatttccaaccttctacctaggaaaaggagttgtgactatgcaaagcattgatatatccgaagaaattgttctgtaatagaatgttttaatcagaaacctctggtaaaaagtcccacacagaggggagggcatggcaaattttttccataaaggggtagacagtaaatattttcagcattgcaggccatacagtgtctgtcacagcaactcgacttagctctgccattggggtacaaaagcagccgttgaccatgcgtaaggaacaaggaacgagtatggctgtgtcccttggaccacagtttgctgtaccatttttggtgtcaccaacatatttttagctgaggaatgcttttgtggccccggacatagctatccagggttatgttagcttggattcacagaaccctcaagttagtcatatttgaggggagatatccacgtgtgtcatgcgcccccccccccccgcccccatgatttcattgaccaaccatggttgctgtacttccttgatcttgggttcttccacccagtttttagggttcagactaagggagaggaagtgactttgccaggtaacagctttctggtcttctgcagctccagattaataagctgtaactgttacagaggccaagcttggttcttcaggataaaaatcccatctgtcaatactgtgccactgttaacagagagaggggttcagaaaaaagagaggtgggggggactcacaggtctaaaactgaagcatatttttttttccctcctgaggaagaaatatcataactgttggtaaatcaaaaccagagatttgacacttttctgtgatcattctgcagcatttgttcccaaggtgaggtataccacagggcccttgatttcaaagataaatactgtacaaataaccatcctgttgtctttccctcaccgccaacagagggacgctttatcagaatcagcagatacccagtctattgtatgcatttatttccctgtttcttctgaaaacaacttgcagttttagtgttgatttttttttaatctatcaaccatgagttatcatgtgactgttgcatttgttagtgctaactgatagcagcaggtgctcctgctaactctaatgaaatcgtccagccctgcattgcttggcatcctccgataacagaaaaacaaaaacaagtcccgtatcatccagagtggtgtgaagctcatcggcgttcttccatcttctccccacttgagtcctttcttttttcttcttttcaaaccaggtgaaagacacaatcttcactagtaaaaacgtggatttgtaattcttccctttcctccccctccctttttttaatgctcatgtaatgcattggcaaaatgaggagtagatttgaaggttaaatcctgaccacatttccctgtttttaacttagaaggtaaaatcaaatgcaggcccatagtttcacaaacaccaggtactcttatgtgcttgggggaaaatgtttccatttctcctagtttttcttttaagtgaccacttgtataacgtctactaaaagtatcatttgtatccttgcttagtatcctatttgaaaagaattttttttcttttggtgatttctcagggagaaaaacttcatgcagaacaaaacaaaaattcccttgcttgttagatgtatgtaatttatgaaagccaaaataaactgtatatgtgctgtaatggaagacagagaaatgttgaagaaaatgcccagaaatggaactttgacccttcccgaaaggtcgagggctgtagacagtagaggacatttcattggtaacttgctttttaaaatttttttctgtgaattttacttttcaaaactgtgaagagttttgtgtgaaagaaactactaagtgtgctctgtaatgttttcacaagtgtttttatcatggtaacatcttgtttactttagttccctgcctaaaactacttggaacatgttaagaaaacacttcaagaaagcctcgacaaagaggcttttgtttaacagccaccatgaggcagcgtggatcacaaaggtgttaactttcagccccttaagcacttccacatgaaattccagcaactatgtttgtggttttggaaaaacaaagtgtatgttaaagaaaccaggtatatgctaatacatgtcgaaggaggccggatatcataaattgtttcaaacccatttgtggctctcggcttgcacgcctgaatgttctgcagtgaaattacctctagttagtgtaggagacttcagccatgtagagggaatagctgtctataattgtggatgtatgcaaatcaaattccagcctcacaatttaaatctcgagaagatgaggatgaaaattttccccatcagatctgaggtgacaagtctttgagtattgcaaaatgagctgtatatttttatgaatttgacttttctacttatcatgcattttttattggttttagaaaaataaaaatagggtgttaccaaaaaaaattttttcccccttttaatgtcttttttaacctttctgacattgcttaggagttcaagacctttcttagtactcgaagaggtcaaagtggcctaaataccacagtgccctctagtgatatatagaatattagatagaaaagtttagacaagtttgccaaagataacaggcccagtgccacctctttgctcaaaaggaagcaaataacatttgaacgcattttttttcaacaaacagattttagttagaaatgcaaattaaatttaaatttttcttgtaggctttgaaaacattggaaaattttttgaatgtctacttatgcaattaattctacatataactgcatatgtgcatgcggtacatctatatcactgtagatgcattgttgagtgttcttatattttaagagccattagttagcttaggtatttcatgtgatcatttccggcatgtaattagaaggcattacttaaaagacagggatcatctttgctccatacttttattgacactgtctaccatattatggccatgtctaaatggtaaaatttattattagcaatagtgtcacaaaagtctgagacagcgattttcctttcaataaaagtagttaaaaaccttttagaaaatccataattttgattgctggtacttcataaacgtataactggtactttttagctgtctctttagggaaaaatgagttttatcacctgcggtacctgggttaatgaaattgtgtgttggaatttagccaggatgaaagatgagatcattccaagacactaatattggcaacaggtctcataaaaagctctgactcttgagtgaagtatcattagatttttttattattattattttatttaaattgagagattaagttagttgtcattttcaaagcttctgtactagcgagattctcatttggcattacgttcaaaacccagtgacctaaaaacctgtacggagccaagagaaacagagaagtgtccatcagtgcctagtacaagaatttccttgcttcaaatttcaactccagttcctgttcagccctttacaaatcacgactctcagctcaaatttgaaataatgctgcctttttcccccgtgttcctcctgtgtttgattgtttgtggatattagctgtccaggaaatcccatacttacagatataaatccagaatgatcttgtttttccgcagccagcccaggatgtattagacagttatgatgatttgttaatttttgtgacctgtatttattttatgtgtgctgtatacttcgaggctggaatcagctgttgaaatgctctccgtctctcacaggcagaaaggaagcgctctacttttccttttctgctttggattttcttgctttatttttggaaggttttttaaatctcttcacgtctgctttttatgcgcttcttccatatggtgataaacaagaggtacattgtgtttgatagacttaaactcaatcctatcaagggtgggtctttggagatgcatgaacagggtcacattctttccaaatgtgttttccatccatgatgtgtcttgactgtgtaattctattctcgtttttatggtgatatacatttcccccaaataatatattaatcctcagatttaatatgtgtttcagtagaattctgcctattacagataagaaaattatattatagtcttgaagaagaataaaaatcaactgaagttagcattattttttttctcttatacccgtcttcataaagggcactccttatgattctgggtttttttttttttttttttttttttttaaatcaggtatttgtttctctccacctctgattcagtttctattcacagagacccactactgctcctgagtctcagtgtcagctcactggctaagagatgctgccagtttttgatgtctcaacttaggatggttatagaataatggaaactagggcagtctaccaaaaaattaaagaaaaagtaataaaaattcaatcctaccaaacaatctatatttatagtagcctgttgtttttatagctgtattttagcaagattttatatttgcatcaatttcggtctggaaaaatgacacatgccaacgttcataaccgttcctgatgtctccacattttccatagccctttttatttcaacagcatttcactgggctgcattagaggccatttgaatatttcatttcctattaattatgcactgtgactctcagtgtcattataaaaaagagccctaatgtaacaaaggatgaaaagaaccatcaagcagtgtgaccaaaagaaaatattccaaagcttgtcacgtatgaccggcttaacatctctaatttgaaatccattgcattcatcttaaattaaagcttaaggaatctacctttaccttgtttcttttgctgcatgttttaggtgactgaatttttagttaaaatattaatggattctgaaggtagaaagtctttcttttttaagtcgtcaaaatgtgcacaacgttaagtatttagttatatctgtaatttttgcatttcacctttaaaccctggttaaagacatagctgttaatgaaaactgtgcacttcagttaataggttaatagccattaactattcagctaataattcttaactattaatcactacaactctcttttcattttattggtgttacggaagaaaatatagtgtaggtgttaatttatcaaaaagaacaggattatcagaatttcatattacatttctagctttcagaaagatcatcatcatcgtgattaaataaggcaaaatcattttttttttactaatctccttgattataacaggctcatgtaatatttttttttcccagagctatttctgctgaccaaattatccagtgtatggtagccgtgatcattttaaaaacaaaacaaaatacagtggcatttttaacaaaacaaatgtttgtctaacatttgaattctccattcttgcagaaacaattgttttgctttaattttctgaacttggggggggatgtagggttccacttaaagtccacaatgctgtgttttctttatgttggttagataaaggaaactttaaactatagtaaataaccaaaaaaaaaaagtgaaattcccaaagtcagcttgggcaacatttgctgaactcccaagttgagcacggaagcatgcctagtgacagtgacctacatggtcactgaagatgtgatataatttatgatatatataatatattggatccattagcgagcataatgaagtagtgaaatgaaagggtatttgtgaaatcagttcaaacatcctgctaggattatgattaaatgattaatgaaatgctcctgcataagcattttcaaacagtaattcatgcagaggctgataaaaatcctccaatcatatttccttcagtcgtgaaccttatctcgaccattttatataaatcatgaaatacgttgtctgccggcaagctacttatttagattagttataaatgtgcagaaaaagggaacatctttgcagtataaaataatcacgcataattatattcataattcaagcttgtgacagattccatctttcttattcttgttgtcctttgccttccttctggcttcatttgatttctcttatcttgatgacataattaactgctgaagctatgggaaaaaaaaaaaataaggagtcttagggaatccaaaaggggtttattcatttatatatacacaacagcagtgcaaaatcaccatatgtgttaatccacaaatactgtgtttaaacatcattaaggacataactgtgtcctgcaaaagagacacagaaccaggctctcactgcgtttcattatcttcaaccccttgtagatccactgctagcggagtaatcaagtaagtgaaggccttgctttttgtccgtttggatcttttatcagtttggcgagggtgactttgaagagcgatggtgcagcctggaggaatttcttgagggcagtgatgcccagcttccagtagcatctggcatgtcgtttgggttcttagcaaatgttaaacagatgaatccagctccttccaatgaatgtattttataagtgggtttagtactatttccttaccaaagtccctcaacactcagggagtccactgggtcctggtctgtggtcttgtttcattggtgacagcttattagaatgaaagcctctttctttacttccagtgaagcaaacagtgtcatcgagtggatggaatcctaggtgagacaagagactaattgcaagggttggggcactgattacccacgtggtttgaggcaagtctcttgggatctcttgaacctcgatttctgaatttgtaaaatgaggaattgaactaactcccgagttctgacactttgaggatcgtgggctcttttgcaaatctcttgacagttgcagaccctccctggccccaaaacataggctaaaacttttgcatgcagtttcaagaagtggaatgatcccagtttaagaacacctgaactaggccattttctcaattacaacatgcttctttaaaagcaagttgtaaaatattattcaccccaggtgagtgagcagcatgtgaaactgcttagctcgggcttccttgtgtggtcttctattgtttgttcatttactctttaaacagaatacaccatagtcattattctggcctaagattggaggtaataccttgaaggtgcatcactgttgttcaccataatgtctcctctttactgcttttttggaggggagcgaggatgagatgaataagtatgaagaacagcagaatttgtatccgttttgtttttaaggtaaaagtcattacaagtagttttaggacatgaaataactacattttgagggctgttaaacaagaggggatgcattaacaaaggagtgagctttaattgtacctagtcaagtaccagaggtgaacatttgttttacttagttgtttcaaagggttacagacctgggttttaaatctctgattcaaaccacatttggaacaaaaacctgaaatagggtagcacccagaagccttaaaaatcagctgtccctgttgttgttgttgttattgaagtattcaactatttttatcttacatccaaattgtaatgtggcctaaatatcatgacagtcttgttcatagaatttgaggcaaatatcccattacagaatcaggtctgctgtatcactagtaagaaaggactgagtaatgtagagacatgaatttttattttcaagactttaggctttgattcagccctctgattaccagagctcctgcgtatgctaaaactgattgaaatttcaatttgttagccttttccctgttggaaagtctaataaatagtaaaaggaccacaagacaggcatactcagcatgtggcctgaatcatccgtaaactggatatctagaccatcaacaatcaagaacccaggcagagttttccttttaaataattgtctgcatttctctcccccaccccccaccattggtacataatttgcatgtgtaggctcatgtttcaggtttcatatgtttaaagttgcttttctaccctttgccatttctgacattcacgtgaatgcatttcagtatatggatgtatcatcagttatatgaagtcagttttcctgtggtcagacgatcctgttccaacccatacaaattagactcttccgaaatacctagcaggccctgtctctgattgctgcccattaaggtggtcttgaaatgccaccctggctgaatttcttacttatttatgtgtaaatggttatctccagacgccctgcagaacttctccctggaaggcttttctttgggtgataacagtgtgtgccacattatacataatgacagcattaaagggtggggatggaaaggacaggccaccccctggactactatctcctgggagctagacccgctgcctagtttatgcttaaacatcctggtaacttatattttcctttttgtttctccatttcacttaatgattttctatgtattgttgcagacatctcaacagtgagcatgcgctggacgatagaagtacagcccaatgtagagtacaaatgcaggttgtacagcagttagagctacaggtaaaaccacatttatttttaatattaacctcagtatgcctcaaattccagatttctgtagtgttctgtaatgagttcctgtgtactcattattgaatggaaggtccaaaacctgtcattgtcctttattttattttattttattttattttattttattttattttattttattttttacctctttgggcaggttcagccccagttcactctttggaactgctgctcagaggtttccaaattctgggcacctgtgtgtatgcagccaactctcagcggccactttgaatgtttccatctctctctcactttccctctcttctcacttctcctttgcattttctggttatctgttgtcagtgtaagtcctcgacgttgctcatatgattaaactggagctaggaagacaagcttggggaaagagagtttgagagaatgaatgtgaatgaagagagaaagagcgagcgagaccaagacggcaaggcagtgcacccaaaaccgtgttttcccaagtcgcaatggaagttatatgtgggtttatttctcattttgcattgtccttttttctctccaccactaagaataactgagagttcaccgtgcacatcttaaacacacatgcacataatcagatatattaatgtagagtgtatatatatatatatatataaaatctagtatttagaaacccattgggctatgttgaatgtgctttatgactagggaaaataaagtttgcagattttcctgggaatcacagtgtgagagatggggcctttttttttaaatgtgagttctacttccgggtataacttgataaactaccatattttaacaataattccattcttggtataattaatagaaaattagtttctaaaagtaaaaattaggtcagaaaaggagattattaaaatgtacaattgcaacagcctgaccctgcaaaccccatttatgcagccgagttccaaaatgcttttgagtgcttgatgactcacagtggcttcttcctctggctggtctagtgtaggcaagaggttagccgactaggggaaattaaaacaatattgtacattatattgttaccagccatcgaaaagcctattttgtatgcaagacagcgatgctgagatatatggagagccctaggctaagtacagaagataattacatttggaattttactgagttaagtcatttacagcttcaaatagttgcagagaaaaatcagccaaaatacacttaaactttttgttgtgacttttcaggatagaaaggatttttttttaattagttatcatcttatatgaccaattacatttttttagtaggatttgtctcaaaagttatttttgttagccagttaatatttttccattcaaactctggatataaacttattagaacagtaagatatttatacaagaaaagggcacatcataaaatctcaacattttaaaataagtctttggaaacatctttaaattaacatgtttattgagaagaaaaaaacagtagtagatgtaacccacccacagagttcttttatgattaagacacagcccttgacaaactggattcaaaagaataaactggaagatctggcctataatcacagccctttgggaggccaaggcgggtggatcacaaggtcaggagttcgagaccagcctggccaatatggtgaaaccccgtctctactaaaaatacaaaaattagccaggtgtggtggcgggcacctgtaatcccagctcctcgggaggctgaggcaaaagaattgcttgaacccgggaggtagaggttgcagtgagccaaggtcgcgccactgcactccagcctgggcgacagagtgagactccatctcaaaaaaaaagagaaagaataaactaccttcctaccagaatttgtacatattggtggtacttataaagtgataggagctcctgcatttatttatatgataacattaaattcttaatgatgggctaaaataaatcgttgactagaattgtcatggtttgtcgggtagccgtttctagactacagattagagtgttcagccattgttaattactcaagaagtgagcatttattttatgaattattcttcgctctccacaaaaagaggtcaggagaaggaaaagatttagaccatcatcagtaaattaagtgtttatttcctggcagctttcatgttgttttttggtgggtgtggcctagaagtagtacaaacatacaaggattctttgattatttatagatttcatttatttctagatttccttttatccttcagctataaatcaaactgaaggcagatttttcagctttgatagacatcaaagatgatctggccagaagttagtacaatgtggtcgttacctgtgatgttcctcgtaatgtttttgtcggggagtttgccgtaatggaagaagggacaggctaattctgacgtgttccatttctgcaaagcttgagggaattatcagagtgatgacatagacctcgttgagagcaggggttagcaacccacagaccccaggccaaatctcacaagctaaggaatgtttttatattttaaatggttgagggaaaaatctgaagaacattatttcgtgactggtgaaaagtctaggaaattccaatttcagtgtccatgcgtaaaattatatgagaacacagccatactcatgcccattcatctactgattacctattgctgcttttgcactacagtaggagagtcaagtaattgaaactgaaatctacatggcctgcaaagctgaaaatatttatgatctggctcttacagaagtttgccaggcacccctggtcaagaggatcagaaaaacaatttatattatagtattagcaacttgtccccttaggttctggctgcctaagctctgctcacccgcttttatctctttcttcttagccagggtgtataaaaccagtctagtctccacatgggtcaattttccctactagctcttcacatggcaagtgcctgccagttttggaggtcatggaaagctggacgagggatagtaattcattctttcatccatgcatccatccatccattcatccacccagacatccattcatccatccacttatttagcaagcatatttcgaacctatcagatagcaggaatcttgctggagctactgcagagtacaatgattaaaacagataaagctgccctccaagttcttacactctagaaggaagaatagactacaaaataatttgctagtgcgactgtccattcattgggcagtgctagctgacattaacaggttcttgagaacaccagaaatttattcaaaagagagtttcagtgctagaaaggggccaagccaaagcaggttatatccattagttatcactcaatcagatgaaatagataagaaaatgttagcaatttttagtatttaaagaacccttgccctgagacacagttaagagaagccttaaccaaggattcgattgagagtctttgagttgcagacctaccacatatgggggcatttgggacacagtacagttatactcgaatctattctttataggcttcctccttctccgcagttcagcattgctaggtttgtgctgttgcatttgccacttaacataccagtgtctagaaacatactttttaacttacttgactaccagtcattgtgcccatagaacctgaattattggggcaatcaggtccctccagcagcaggaacacttaaagagatgtgcttgtcgtcaaacagcctatttccgttttctgttggcatcgtccctcccttgttctctcagccactgactggtgcatcacctcctttagaggggattacctgcacattactgacccaaagcctatttcgtatttcttaaagcatttatcagtccaggaaaaacctgaacctccaagtatctcagtgtgttacaaaattatcattgattagcttgaacttgaaaaacatttgtcccacgtagcactacaggaaagagcagttaagttttcatcaatttccaaagggggatgatcactgtattagagtaggaggacaaatctcccctgccactcagactcacaagacctctctcttcagcatggtacgtaagtgttcacatgtggtagagatagaccacacatgtgccccatcgtaaaagcaaacccagtaagctcagattgaatcttaccatatacatcgatggaggttcaggatgtctaacctagagggtcatcataaaaggattccacaggacaattcagagggcacagtagctgtagaagcaaccaaagctggtgaaggtcacttaagtgctgtgtacctagacagcctccttgaatctaaaccccagaaaactttcacccaaaatggaaggcccttgtgtctctgatctatcagacaaacctccctaaagaaaaagatgcaatttttccaaaataactactgttagccataggggatagtggctggagatgttccccttcacagagctatctgtacaataccaaacttgaattaaactgaaaagctttcaaggctgtactggtgagatttcaggaagctgggcagaaataaagacaatgggttgtggagactgatttagactgtctaatcagcactgtgcatgacagctgtcctgtccctgtgtatttaaaatatgacttgaggccgggcaggcgtggtggctcacgcctgtaataccagcactttggaaggctgaggcgggcagatcacctaaggtcgggagttcgagaccagcctgaccaacatggagattaccccatctctaaaaacacaaaattagccaggcacagtgatacatgcctgtaatcccagctacacaggcggctgaggcaggagaattgcttgaacctgggaggtggaggttgcagtgacccgagattgcgccattgcattgcagcctgggcaataagagcaaaactccatctcaagaaaattaataatcataaaataaaatatgacttgatttacgaaaccacagtttcaatagaaataccaattacaaaaggcaaggtacatctatgtttgttaaattattgttgaaagatgtaaaaatatatggtgaatgttttcttagcggtagaaagaatgtttatgtagagcttgttaacagggaagggttggttaattccattctcttgttgcaaccttctactggtcttatttggagaagagtcaagaagacatctcagtgggccttctgagccttttcaaacatttcctactgcatttcattattgcaaagacagttataatttttaaacattttaccagtggaccccagctattaactgggatctaaaagtgtaaaccctgagaggtgtgtgagttccttatactatacacatagacacctaacagtgagacagacaccataaaaatcatttgggtcgatgacatacatggctttttgaaatcagggaatgcagtaagatttcatctgttcttttttgacagattcttttggaatgatgtacagatgagatgagttagaaatggaatggagcaaagttcccataatcagtatacataatcttatacaggttatgaaatgtgcagtcttccctccacccccaccatgacagagggacagagacacaggaactagaaagttgttgaggataagaactccccactgagaaatgccatggccaggattgtaaggaaacacttgaagcttccgcgatattgggcccccactgtccaccggccgtgggcctagggatttaaattcatatgaatccagattacttgggtcctcttaggtgggacattcatatgaactcttccagcctctaagctaaagaagagatgtcacaaaaagttgcagtggtggttggattttaattccgtttggggaaaaggggaaaccatctgatttcacagacagaaaaaaaaaaaatacaaaaaacatctgacagaattgacttcacttaggaagctgagacagtggtacagatacatatttctgatcacatgtagtggttttaatttgttctgtgatcatgtgacattgctaaactgctgtatattttttctgatggatgaagatgtcctgatgttttcatcatgtgtcatcggggcaggttcaggacaggctccctacaacccctcagcctctaggccctttaaaatgaatattgaaagcaggcaagggaaaaaggaatcaaccaaaccaaggttgatctgcctggcaggcgacgggggtggaggtgtgtgtaccttgtattctttaatgattttattccattcagtcactacttaccaagcacctattatatagggagcactggatacagatagtaaggtggtgtggcctcttcccgtaatacacaacctagtagggtaagaccaggatgcctttaacttccctgccaggcagagtttctaaaagcaaggggtgagggattggggaaggtgacagtggaaagggttgttggcaaggacattccaggccaagggagccatggaagacgttgcctagattgtaggataaggaagaaaggatagtggaaggatatattgctcttaaaattaatctgtctgtttaacacgaaatagggtgaccaactgtcccagtttactttcttggactgaagggattcctgggagttgggattttcagtttcaaaactggaagagtcctgggcaagctgggaggagttgggtcaccctactccactagctgtgggagagagctattgaatgccccatcttctgcttgtaattatttcatctggcttggaaaccatttgactggccagctgttgagctcctgctgtatgccagggcactgtcctaggtgccttatgtcccgaatttcttggaatccccacagtccctctgtgagtacacaccaccctatttccttgattctaagagtcacttttttttctttttctttttctttttctttttctttttcttcttttgagacggagttttgctctgttgcccaggctggagtgtaggtggcaggatctcggctcactgcaacttccacctcccgggttcaagcgattctcctgactcagtctcccaagtagctgggactataggcatgtgccaccatgccctgctaatttttgtatttttagtagagacaggtttcatcatgttggccagcatgatctcaaattcctgagctcaagggatccgcctgcctcggcctcccagagtgctgggattacaggccagtgtgcccaggtaggagtcactttttaaaagaaaaatataacatttggaaatcaatatatgtcttacatttaatgagtgtgtttaatgtaatgtttcttctcattctttgagaaggtattactaaatccatggttattttaactatcactggcctcttagagtcaaagaaataatttgcagggatccctcccagatgaggaaactgaagtttaggaggtctgattaacttgtttaatgccaatggcgaataagggcagagcccaggaggttaacccagcctttgtagcctgtgctccttttattgtgggatcctgccttaacgcttccacccagaggatcattgtggcccagctgggctctacgcaggaactggttttaaaacccggctttgggggccatgccactctgccttgcggagctctgtcctgggcattccatggtagcaaggcaaggctggagtccggtgacactgggatcactccaacatctcccaaatcatctacaccaggaattgtaagctctaagaaaatgtcagcagggagaaaagtgcacaagtttcagtagcagagggagacattaatcctaacacaaatcaattaccgtacgaactttacatgtgattactgtaccattagtggtgctatttgtaatcacaccagcctcctagactttagcaaatttattatctgtaatgtatccccctttggccctgtctaaccctgtttgaggcaatactcaggacagttcctatactagcggcctcacagagcctcctgatatgccctgcacaagccctgagcacgtcggggaaagagaggtcctaacagcacggtagttccatattgccagtgctttgtaactggagccaagaaaaagaagagagagagtctctgggtttctcacttccatgtccttctgtgaaaaccacgacacttatttttcataatttaaaatcctgccttactctgggagcattagaattcctagactatgacttagtattagtgtgcgtctgctttaaatgtcaagagagtctttaataataacatgtaaggaacgttaagatggtgacagagtacaataaaagtagggaaattcttcgattggggtgcaatgagccatatattgcccaccacctgaatgcggtagttggtgtgaaagaactcatttaaaagtttttcactggtactaagttctgaagccatagtttgacaaggtgggtcaaaaataattgataaatgctcagtttggtagagtaatttgagttctgctccttctagtcactgctttttctcccccttgtttttcttcttttcatcatatgtacgtcagagacctgtgttattggatataccctgcctaagtaactggatataccctgcctaagtaactggatatgcttgggccacatcgggttaatctctttggatcatcattgtatacgaaactactgaggaaacgtatacagccactgtttaaggccttctcagtccgtggcagaaagtagtgtctctcacttaacttgattaaacttggacacttggggtccttatttaaaaatacctacttccaagcctcactgttggagtgttggctccagcatgtttaggtgagaccgcagtcgtttcacttggagatcatcattgtatgggataatctgaactcatgcattcatttaggtgcctcttaaaactccatgtgccccccttccatggagattctttgaaaagacaccttcttttcataatttaaaatcccgtctaactctaggaacagtagttcagcatgagagcagggagggagactaagacctatgatttgagttattgtcccaggtgattcttagaatcacactagtgtgggaaactcagaccaagcatcatacaactgggaccctagtcttatttctgccccttcccagttccctgacctcagatatgtttaccttgcaaacctcagtttccccaattataaaacagaataggattaatggatttgaaatagccacagtagcctttacctctgttaaatcaaaggagtgtcttggccctttcttctcatctgtcctcaagaagtctagcatttttacacatacaaagcccttcatttatttcagcagagttttgtttctcacgagtgagaactgccaaattggccttaaaatgattagtcctcctgacaacatagaaaatggtgatgttaaatgaaccccaaaccgtgttcccttttctctgttaaaataatgagtttaagattaatcttagtttgtatctttgaggatgttgaatggaactcctagcctttggcagttatcagtggctcgggtgcaatacacaaattctgatctttcacagcccagactgtcttaaacctaatttgaggccatggctaatagaagaggagatgacctatttcggccaaagggtagaaaaatatttgcccaagatgaggggaagatacagtaagaacctgagacaaattgataggaagtgggcttcatctttcctttgctttctgttccattctttaaacgatcaaaattatttcccttcccagttagcccaactgcaaactccattgaacccctgttaggcagatccagatttcaaacatatactcagccagtagtttaaatacactggaccgatttcacttttcttaaaaaaaaaaaaaaaaaattagaaagttgttgagcattcataaagcactagtcattttgctaagcttgttatgtgcaagacctcatctgatcttcagaacaccccttcagagttcagagatgatcattccgtatttagaaggagaaacttggtaattaaaaaggttacataatgtgctgagtcactgagccaggatttgaacacagcacagtgtgattgttgtgtccacatccttaaccgttttcaccctgccatcgttctacagaatggttgaacaaattcagtagattaaaatgacccctgcacaagcagctccctctaatgtttaggccgttgtcatttcctttatgctagatactcattccatacccactgggaaagtcttttagagagtaattctcttctctgatatttcaacacaaattttctctttaatttgccaaccaaattttagtgggccttcggattgaatgtctcaacctccttttctttgcttttcatggaattcatagtttaagaggaaatgctggaatatgcttgctaatattaaatgtttgtatcctcatattttaataatgaaaggatgccgtgaaaattgatggggatggtgagctcatgggatgatggcataaaaagtaataaagaatgtgaaagcttttggaaggagcagttagtattataaatgcaagacagacattgtagacaggatgtggtttcaataggtgtgaatgtttagcctttttgcctaaaaaaaagaaaaactgaatttggcgggtttctttctgtaattgttaaaacagtttgtgttagagctgtaattgatttaaagtctaaaactcattcaagagtatgatactacacattagttttcactaaccaaacaaaaccaaaaagttagatttttgcctttttgtgtaaccttgtccatcttttagaaaagcagaactagggtggtacaattgaggttcctggataactctcagaattgacgatgaattctaagcaatgtgctcatggaaaaatatgaaaatgtttccgatggcagttacttccagggtttatgaaagtggctgtgtatacaaattctaggtatgtgtttgcaatgtagtgttgctacctttggctgaccagtaaaagatcagtttggtagacatttggatggaaatatggagaagatgtttcctttaaatgcccaggatttggattttccttataccacacttagtggtacaaggtataattgctacatcaacaacgtttacccccaaattaagtcacaattaatattcagcagacttcagtaaatatcacctctcaccctttaatttgtattgttcagcatgacagactactgcttgtttttaagaaaaatacaactgatttcttaattccttctggcctttgataactttaaaacaaaacatttcttaaaaagtctgagtatttgacatcaaaaagcttaggatacttacattttaaaaaaaataataataatggcagaaaaatagcattcccaacattttaattgttctaagcctctttggaaaactaaattcctttagcattatgtgttcagagaatcttttagtttggctgttcaataacttactaaagaacagaggaggaataccatcaagtggctcctaatatggtatcattttcatttcctgtttgttgaaagataaatgctaacactgtacggctgtttttttctttctttcttaatttattcctccctgaaccacaagggaataaaaagaaaaaaaaaatcaaatgtgatatggctggagactgagtcatccagtagggataagctgaaagctttttcccttctcccttttgtacggtttcccttttctccatctttccacaatccccgacccctgtcccccttcttccttagaaaataactgtatttaaatagataaactatatttgtttttttatttgggaataatttgactttaaaaaactttatttttaaaggatttaaggttaattatgtgacagaactaatgagtccctccttaaatctaaggcattattttggacaaatgatgtaccaaagtattgaaattaaactgtattctctccctctctcctctctctctctcatattaatctcttctccatcttccctaaatgccacagctgttctcttgactatccctttatctttaggggatatatttcccacttcttttacagaagtaatcgttatgtgtcccctatgcccaactgtcttgaactattgaaaatatcgagttaaagcagtccaagcgaagcataaaggatgtagcttccaatcagtagtatttgagtgcctactatgtatatccaattagaaacttgtgtgacttcagaagatctttttttatagaataaggagacttaaattattaagatgagactagcacatagcaggtactcaaatcttgagtaaattgaatgagcaagcttgttctacactcgtttgaaaatgggaacctgtcatcccttggagcctgctcctggcctgctaatatcatttgccagcactgtcttaatctatgcctacctgttaagaaagatgaagctaattttgcataaatgtatccatctgtctaggagtttttccacaaccacaacagatgaatttatgggttttagctacctagctcactttcccttggcttttctcatgaataaggttggttaataggcatgattcacatttgtcttttagctgtctgtgttccatgggactgcgtggtgccagcaggtctagaacttcccagttaaagtctaatgcatcttgtgttgagaaatctcacaccaacacctccggttacttcgagtttggcaatggtcatgtagatttcaaaaacaagcaatgaaaatgattttatcatgtgctgtggtgccatagcgtaatttgtaatatgtatcatttttggtgttaagagccatgcatctttattcagagaaataacaaagcattttcttcttgccagcttgcaaaagacaaagaacgcctgcaagccatgatgacccacctgcatgtgaagtctacagaacccaaagccgcccctcagcccgtaagtattgatccccaccaaggggaaaaaaacaaaactcacagtattccttttctacttccccaccccaaatggaggaaggaggaccagcctactttggtggagctttgagttttgagggccttagattcatgcgactgtttctggttatcctttatgatgaaggtcatatgctaggcatttggggagatacaggatgattcagatatggtccttgcccataagactcaagcacccagctcttctttaaaggcagaatgattggtgcccaagcaaggtactgaaatacattatgagagctccctggaaaaagaaaatctttctgaatggtaggaacgcagagaagacagctaaaccatgacagcaaagcaaagaggcatttcagctcgggtaagctgagagacagtggtgtgtaggaaaaagagcagggagtagtagtccagtctaactcttaacagaggaaagacataggaaacctagtgttggaatagtcagaggctaaattatggagaggctctaatggttactaaggagtttgaaatgaaaattattccttcacagttaggagaccaaacacagtatactgaaattacatttaatttgtaagaatctcctctttcttgccttattcccttttactggaccttgaagggtgtcatcccagcacaggctgttaataccgaagcagaaggatcgtgtctgaacctaaaagtttgtcttggacctccttccttgtaataaatcgatctctttaacggtcatattcctcttacgtttctaaaattctcctagtagctttaactgattattcaaaatggagacagtgctttgcttcttgattttaagatttgtaaaatttaaaggtacactgcctttatttgattttgcttggagtcactgtgtgaaaattaattgagcgttgacaatctatagttagtaccagcgattttaatcaatatgcaatgatgcagcgtaatggcaaagtattggtttatctgttttgactgatttttttctataaataaagcaaacatacacccatatatgtatgatttatggtgatagaaataaaacggagtcagactattaacccagcaaatatggtagcctgccaagatgcagttggcaggcaaaattaatgtctgaaacagaacacattactgagataaaggacataaaattattaaacacttcgtgcatccatttttaccaggaaggagtccttagtttccgtgtattattttacagtaaatggctataggactagatgtgtaggctaccaaaaagaaaggaaaaaaaagaaccaggtcattcactgttgtggcatcagtagtcagctgtgctatttctagcaacccctccttctagaacccagctaagcaaaatggtgagcctctgagacaacttggctgaagtcatctcgaagaagcatagccaattgcacagggcattcactgccttggaactttttgaaagtcttcagatggctttagtgaaatggttttcccagattgaagggttcaaatctttgcacctagcagcaagcgagagaatgagattatctctgtcttcctccacggattaaaaacagtgataggataatggttggacccagcactgtaggcctggatcttggggcttcttgggaagaggaaggatacaattaaagataaggaactacaaaaccccgtagggcgcttggcgagtgaccgggctgggtgttggcagagagcaccatgtgtgtaagcccctgtgggccacaaaaggaccattgggattcttcacgtggaccagtgttaagcagctggtaaacagggaaaagcatggggggaagtgaacagggatggaaggtttgtcttgattagtattaaaaaaaaatgttttactttctagaaaattgtaactttgaaggggacctcctactaaatttatttttaactgctctattgaaaattctctaccactagtcaacattatctcttagtagctcagcacagtatttctttattagaagaaatcggcacgaatatttttgactgaaaaattaatagcttttgaattcatacacagcaggttttcttttgcaaagaagtccaatatcgctgcacagcacttctataaccatttatttagagtccaagtcaaacctttgacagctagagcagcgctacaagccaatataaagaactccaagatgtaaaccaacaataggccgtctgtgtgaggtttgccattgtcaaatacatagattgtttggattagtttatgtaaatgtactgttgtattaccctttgaaaaaaaaaaagatcacatttgtgtatgaaaagtggttcccttcacaggcagcattataaattccttatcctttaacttacatgtaagaagtaaaaattggtgcctgacaagcagatattgtgtgacactctgttgtcggagtgaacctgccttcttttcatttattggaaaatagaaaattttattaaagataccatcttataaatcaggaattattaaaatatgtataggtgaggcattgggaaattaattataaaaggtagacgtgtaatgttttgcataaattttcacttctttgccaaaaagaaaaaaaaaagggcacacacatacagcaaacccttgatgctttcaactttaagggcccagagctatctggtgactgattctcatgtgcaaaatattccctgcagtctgtaattaatttattccgccctaaataatagaatgcatggcgtttgtttgaatgagtatccttctagaatctttaatttgaaacaggcagtcaccaggattcaaatctaaccatagatggggactttcatgttacaaccttgccagtaagttcatgaagctttttcttttttccatttctgtgtagaagaaacctcgtgtttattttaaaattcttagtcactaagtgatagaatgctttgctgtaaatgttgcttttcactaaatgccatttgggtgttaagtgtcatttgctgtatccaatcatccaaccagtcctcatttcattgcatcaaagaaactgctaaaacgttcttagattgtttttacatcagctcatagacgcattttctggatcttattgtgggactcatcagatttggatagttagaggatacgctcatctcgggaaggtgcccaagtttttggacatggatctgaggaagaaagcttatgggtgaactggggcaggagctcacgggcttcccatccctcagactccttcgacggcctttcttcctgcttgctatcacatctctttaaacctaagtaaaatcttcctttcagaacaaaaccaaagactcaaggtgcaggttggttatggaaagggaatttctgcatttaaaatcaaactattccatcaacaaatatttcttgagcatgtgacatacgtgacaagtagtcagtcacatgagcaaggcccatccctgccatggaggtgttcagagtctggtaaaagaaataacagataaactacatacatactcacacagtctcactttccgtgaattgcactacctgtaagtagaacagctgacccagaatggtaaagtcaggggagattgctgggagaaatgatgtctaagctgaaacctacaagatgagcaggaagaaatggtaagaggtcagccttgtgaacctttccttaggttaagagtgggtgcccagatcggtccctctgattggtgagtatcagtgtagaggaagaaaaggaatagccaacatcagttaagacaagcttttcaaacttttaattttataaagactggaccctgcgtggacgtatgtagtatgtgtaagttgaccagagcagccctaagctctagctctcaggtacatagagccgaaaagcagttcttacatttagaatggccacatttcttgttattttaaaagattctattcttttctatggaaagaaaagcaaaaacaaacaatagtaaactgccctaatgaaaatgattgatattcttttgttccagactcagtaaacattctcaaagtaaacacccaaatgtcttgcttggaggttaatttctccgtgcttactctgtggagaatttgccaagatacttcatttgggggagggagtgaaaaactaagaggacaaaacaaaaacaaaaagaaacatgtctgtgatatgatgactttattaaattactacggatttcttaaaaagacttttcacactctgtcattatgtcaggaaaacactgtaaatcgtattttataatactgagtacatgagaagaacgctttgctttagggtattcctgcacatcagagaacaacttctgctcctggagaaaccacattcttttagatttggtgggcacgtaattacagtgtaggtggtatattcttcttgacgaaaatcttataaagcacttacaggaacttggatatttgtaatgaaatatagtattagattttcatttttatacattttcttttcctctaaccatagccattaggactgttttgaaagagtttttagctcctataaaaacaaagtgcccccccgaaaagaaagggtcttttaactcttcaaggatcatttgggctgcctgggtccttgctttagagttggagaaataatattaagcagtcataaaaagggattcttaggcacaatacacaaaagctgttttatatactgtttttcattaagtgccccacccccaccaacctttcaactagaatttttttgtttttgcttttagtatccctgccagtaccaccaccttctaagtaagtcataaccttccacgagttcgcttctctaaaacagggccaggctgagatggtaaaggaaaggaaaggaaaggcttgtaacaaaggctgccacccattgtcctgccctccgcacggcctggtaacgtccctccagcctcagaaaggccgtctctgaactcagtgattcatgcccagaaatgacactgccatgcagttaaagcaggacttgagctggctcaggccagtaaaacaagagcagaaaaacaagttctgtgagcccgaaagtccctactacgcagttgtgtcccttggtgtttgggtttcaggtttgtcttttgttctcagaatctgttttcatgtgaggcaagagcacaaacaaaaataaaaatgagttcttatgggaatacttacaagtctgtttctgtcaggggtttacatcagcagtttatttttttaatgtgagtgactcatcatctttaaacaggaggggagattactgttaaaaactaaagaaagattaattaattaaaaaaaaaaagggactaagcagaatagtgggtagccaaccaagtttgaatagtttcgatggctaaaagaaaagctgatgcctgagagtacaaataaatttaaaaaataaaaccctacagcaattttaaatgacataagaatttaacttttggccagagtttcaaagagattatctttgctgaaatcatcacatgatggaaacttgccatgtagaaaatatcagagttactgacttttctaaacatagcaacttcttttaaatagaaaaggaacacaataagaaaaataggctttccatcaggaaaagaaaccctcccagtccattcccttcctgccccatgccccagaaaaaattatcttttaaaacctgaactgcaatcagaaacacaaagcacatatgctttcatttctaattgatgattacattaagatttaatagtttacaattaagatgaatatttcaagattacagcaaaaacacacaccattccccatttgctcttctgttctaagtctgtaattaattttttttgggggggcactcttttttcaaagaggccttaattaagagagcaggtttggtttgaacacagagcctgctttgagtctttcttctccattctttctctctcaaccttccctttcgaagatggtttctcctccagacaagcatgtgatcatcaaacagaagtttaaaagttaagaaacttctgtaccagttgacaaggttgacatttcattaacttgttggttcagccttcaaatgattttgtgtggcaaagcaccctgtgtttggagtgtacagctttttcttcttccttccctcacgggctagtcatgtttaatttggaatctgggctcctttggcaaattagcaattagaacaattttgtgggaatatgtatatgtgtcattagttttcctgcaaattaatagcaagggcagaggtcaggcagaaattttccacttgactgcagctcctctattgagacttggcacttggttttggaatggccacagctgctctcagccaccctcttcctctaggaactgtcttttaattagtttacctcatagccatcattacaaatattactgcctcccctcctcgaaataaaattactgtttctacaaaatattccagtgacatcttgcaccactgcacattgatggtggggtcagtcgaatgcagcatttaatcattagatcacctccatccgcgtctcctaattagagtccttacaatacatttttatctggtaattagctgagattggctgcttcctctgtggcttattagagacagcccagcagtgggtgtgaatcacggtgtcatttgtcaagcctggtaagccccctctctgctctcttctggctcagtatttattcccacttgctaatgttcaaaagcctccagaaaattctaccttcatctcttcctttgtggattgtgctaacttggagggattttatttttcgctgttgctttttttttttttttttttttttttttggtagaaagagtcctagtggtgcgatcttggtaatagctacaaggctcacatcctttcggcattttgatgacattttactgtgggatttgtctattcttcgtagctgtgaacacccaaaaagatgggcttgcacttgctgaatgagttttgatttctgacaatgaaactggaactcagttaacttggtgatcttcctcccaaaactgaaagggagcaggcatgaaggacatttgtgtttgtaattttcattgcatctttcagaaagccacagtgtttagggaaaagttcttaaactgaaaagagaagccgagaagtatagtcagtcctcagaactgctttgtggttactgtgtacctttgccctttgactgacgtatgtgtttgatggtaagcgcttcaagggcagcaattagctgttttcttcctgtttttgtcattgtaggagtaactgccttatatttgctcagttacacgtgttgattgtcatgcataagcagggataaaatgctctgcacggaatcttttccaaaaatgagcatacagaaaaatgaaactggttagtgttcatttttgctattaactaggcataagatgattatacaaaggatctagaatcatacaagtgtgtggtttgaccttgggtctgggttgggaatatgggcaaattatttaatctctccaagcctcagtttgcttatctgtaaagtatgagtaataacatctcagatattagtggtggtatgagaattgaaggagaccacacagtggcaggtggttttaaaacatgatttttacaaatgttacccatgactttccaaagcgctctgagattcttaggcttagcagcgtctgaattataaaagctgtatatttatgagcattagcctttcatgcactaatttccttgaccctttgcttgggctgatgcttatacatactgttcctggacttggtcagtgattaaggcccgaggtgaagaagaggtcagccccaactcttccccccttggcttctcagctctgccccatcctgcggctgctactctgaactgttcacacttagtttgcaaatgtgtgtcagaaagccaggtttccaacattatagagaaaaacccgctcatggcatctgctcagcttgctggggcatttgtaagggcagtgccatctccagagcttgctcttcgcaggcattgtctcttgctcaccgagacaacattctacgctgaaaataaaaaggaaagcacaactcaaagctcacaacattctgtttccagcgccatgtttacatttttccattagtatttcttcatgatatttgatctttcttttcttcaggttcattgcttttttatgaaactctcctgaaacatattagagaggattctcaggcccccctccctttttttttttttttaactagagtgtgagtaaaggtcgagtcttcccaacatattggaactctcttttaataagttctttgattatgatctcagaggaatctcatttttaataccttccacaaatactgccttgtacttaagactgactatagcaatggtgaattagacttggtgaaatagacttactatggtaagtgatttgaaatctggtttgagaaaatattaccaagtaagcctactttgctgaagtttattggattttagggtgggtctgtgtatctgagacagcacataaacagtaatacatacgctgaaaacaaccaaattcttcagcattgccagacgtaaaataatatttctgttgcaacaaattttggggaagggttatgccttttagtatttgtaagaacagtactttaaggtgaagataagaaagataaattgaaacagtgctcattaatttatttttttctttttttttttttttttttttttttttttttttttttttttgaggtagagtctcactctatcacccaggctggaatgcagtggtgatctcagctcactgcaacctctgcctcccagactcaagctatcttcccacctcagcctcctaggtagctgggactacaggcatgtgccaccacacatggctaatttgtgtgtgtgtgtatgtgtgtgcgttaatggagacagagtttcaccatgttgtccagcctggtttcaaactcctggcctcaagagatcctcccacctcagcctcccaaggtgctgggattacaggtgtgagccaccatgcccggcctattttattctcttctacttcaaataagtaatattcatttcctaacttgaagcagattatttcccattttatagaacattcaaaacttgaaggaaaaaaatcaaaaacctcagttgcagatctcccgtattctgtaaaagaatgtcacaataaaaaaaattaacagatcccaagcctgtatttgatagatttaataaaggttattcataatgctgttaaggattattttctgccaactgattgattgattgatagaaacaaatgacagctggtggggtcaggcccattgtgtttaatatgagtaataaataggccacacatatttgcaggagttctcgtcatccacgaagctgcatgagggagctcagtaggctcttcctgggctgtctagtatggtagctactagccacatggggctctttccatttacatttattaaagtttaattttaataaaaatcaagtaaaaacagctctttggttgtgctagcatattgcagaaattctgctggacacttcttcagatctacaccagcgtatcccaactggtgtcacctaaaatactcagcttcactggtattgctaaggacttctctccctctttgaggttgacaaggcctgatgggcgatcaaagcctataggtgagacatcacaatgaaataaatgtcttgactcagggtttctcacactccctcaggtaggtaacccctttttgagcctgtaaacacccatgtagcagcctttggaaaagagaccgctgccagagatatcttacactgcatcctaagtgaattcacgcaggactcaccgtgtgtttcggttcatggtaaacataccatctacatagaggaagaaacggtgcccacgcatcctctgtgttactcctgctagatgtggttcctgggttgctctggttttctgaaggtcttctaagacgttgtttttttccttgcagttgaatctggtatcaagtgtcactctctccaagtccgcatcggaggcttctccacagagcttacctcatactccaacgaccccaaccgcccccctgactcccgtcacccaaggcccctctgtcatcacaaccaccagcatgcacacggtgggacccatccgcaggcggtactcagacaaatacaacgtgcccatttcgtcaggtagatactccaccttttgcctcacgtagagttgtaatctgcaattcttgtagaccagccccttttgaaaaagtgataattaataggacaatgattcttattcagcagatattgcgcagaaccaagaattttataagaacgcagaagttagaccaccatttacatatgcatctttaattaggcaggtaagtaaataacacagtatatgaaattctgtcagaaggtatatgtgtacatggatatatattgatgaagtagatttaaaaaccgtttagtatgcaagcatgctgaaaccttttctataaggttttttaaaactgcaatatataacataattgcttttgattaagtattacaatacgatgtgattattaggaaattcatttcacacaacagtgaaaatgagcctgtttaaagatggcaagtcaattatcacaagctacagtaatctctgatccctagaattaatctgagctctaaataattactgagctttaatcagctagtgaaatgttttgcatttctctttgattctgctttatgaatgactaataaattaatatttctgtacggaaacagaaataaaaactcaaaacaattagataattccattttgaattttgctattgaactgttaaatacaaccattaatcttagatcattttgtaaaacctttctcaggatttagctctgaatcacagtgattttatattttcgagaaactgtggaatgacgactctgctgatttggtcataaattatcttctgttacattctgcttcacaggccattctcgaatctccagaaaagcagctaacactaaatgagatctataactggttcacacgaatgtttgcttacttccgacgcaacgcggccacgtggaaggtaagctttctcaggcctgtttattcttggatcttgacgttcatagaacagtttgttgttgataaaatgcagttgtgctataaggaagctacatttatattgttttgatactcttaaagtgtccaatctctaggtgtatttgattgggaaaatagtgccattgtggttgaaatgctctgatggaagactcccattataccagcatcagcagtgtggaggggccagccagtaaagtgatctctctctggttggaatatgtagagaaaaggagacaacaccgtcgcccagaagtggaggttgccatattacttgcacaaacctcatgccgttaggtcttcagccacagccgatatttgcagagatgtatctccagcgatctatctccagagatggaacctggagaaatgaccaaacttgacacagccttcaatggttggataaatagctcattaacccaattagtagagaaagctgtgcaatccaagcactagcactgtttgtaggagttattaatggagaacacaatgtattattaaggggcaggggtttttgtttttctttttttggttttaagtcaagagattgtcggccaggcacagtggctcatgcctataatcccagcactttgggaggctaaggcaagaggatcacttgagctcaggagttagagaccagcctgggcaacgtagcgagaccctgtctctacaaaaaaaattcaatgaattagccaggcatggtggcatgcacctgtggtcaacagctactccagaggcagaggtgggacgattgcttgaggcaaggaggttgaggctgcagtgagccctgttcatgccactgcactccagcctgggcaacagagcaagaccctgtctcaaaaaaaaaaaaaaaaaaggagattgtccctcatagatatactaaggaagaaaagtagatttcgaacttcattatattcattataatactatttgctgtaaaaacaagtcaaattgcatagctctttattggatgcccccagtagtgcttggggtcatatatggcttacctcattcccaggtcagcagctggctcaaagattccactggtatttactcccttatattagattgatccctcacatatttttgggctttcccatttttgatttcttggtgtctaatattcttgcttatagaaggggacaggtacactctgtcatttgtatttttgcattttttactacctggaattcttgtaatccctgaaatccaaaacatttagagacatgtgataacaaacatttgaggctatttttacatgccattaatctaaatatgataaggatgtgttataggacacaaggaaaacttccttcgcctgaaataaatgccttccttgctaattccttaattttataccggagaaaaaccaaagcaaaagacagaaaaatacatttcctctgttaagttcctgataaattagcattttaaaagaaaacgaatataaccatagaattaattcatcaactttacagagctgtgaatatccattatggcccaaattatcctttcatttccattaagacacatgggcactgaagggaacctatgttcaaaatcttaccctctttgcctcagcctgccttggaagataaaatatgaaaggatctttagccatgaatgctttaaaaaatttaggaagtcgaagcatgaggcagacattttcttcagattgccttttataaatagaaatgatgaaatttaaaaataattaccagttgtgaatataatatttaagcttagatcttcagattgcactttttcgttttgcaaactgcaggaaaaagtgtcattaatataaacagccttagatgaaatagtgactcataaatacgtataattttctgtacgtgtccttgtttgtaccatgatcttagacaaaagatgaaatgcccagttaaggttatgactgaaaagagcttacacatcttttttttgaaaactcttgacttctcgtcgctttctgcttagatgtgcagttttggaaaacagaactgaagttttggctttgtgtctttactcacatggttatattgctcaacctgatctacagaaattattttgtcaaaagtagctttaagacctttcatttctgtacattttgatacttattttaaagcatcaagcagtgattaggattaggagcaatgttgacttcttttcaagttatatctcttacatgtgtcatgccctgtctggatttttaaaggaaattggctctgtccgtttatttataccacctcaattttgttccagtaagtaacagtagaccttctattgtatgcctttgggcaatatatttttttaaaatgcagccaaatgcagtggctcctgcctgtgatcccggcacttcaggaggctggaggatcacttgagcccaggagttcaagatcagcctgggcaacatagcaagaccccatctctacaaaaaatttttaaaattagctgggtgtggtgacacatgtctctagtcccaactactcaggaggctaaggcaggagactcgcttgagcccaggaatacaaggcttcagtgagccataattgaaccactgcactgcagtcaggcaacagagcaagacctagtttcaaaaaaagaaaaaaaaaaactgcttatttagactagactgcagtttatatgcatagaaaattgtcctatcaagtgtatgacatgccaaatgttttcggtttagagatttttatttttaagcaaatccttcttccaacttttttgaatcaggagtgtcctttcatagtcacctgggtatcttgaaccgacctcaattatgctgacattactcaaaaactttttgggaatttatcctgtgaattctcctttcaagcaattcatcacaccatgcattaaaaaacttgtctcattatcttctaaatattccatatcagaaaagaaaaatcattatgtagcttgaatcctcacagccaccaattgtgattgtccaaaaactgaagcacctctcagagtatcaagattcaccaccgttaaggataattcaggaaggaaatactccaggtggcagaatgggatgtgttggggggtgggggggggggggcggtgtgcaaaacgcttgtgcaatagcagtgttgctggaattgagtgaggactttacccagtgtgatgtatgtatcaacttctcaagccccaattgagtcacctactattgagtcatctacttactctgaataagaagaaaattttaagtaaatgacctgaatctctttagaatgtcttcatgtccagcgttgagtctggatccgtaagtttaaccaggcgggactaaagaaatgaagccttgcttgttactgtacccagtaagggttggggattcttctgaaacccaaaggaaagatgagatattaaaagctcttcacccttgagttgagatcctcctttttgataaattatcgatgttaagggtctcagcttaggaatggccagaaaggacttttaaccataagcaagatatgtctgcagaaaccatcaactgtaggaatatagtcattttgccattgagagttccactcgtgttcctttggcatttactcagttaaaatacttgccgatagttagggccaactctcatattctggaaggtgagacataacatgatagctactgatctcttgaccggggcggggcggggcgggggcggggggtccgttcaccaccccccgatcctttgactatacaaggcgatactctcaacggtaaaatccactttagaattcttcataggacctctggaagttttaaaagccagaagccatcaagaacaaaactgtatttagcagtattaaccaagtgttcctctttcgtggtttgaaaaaaataccccctttttatgggaggtaggtgggcttaaaaagggcagtttcatactttgcatgtgttgttttgaagtcacagtaacattttcagatttgtactctggaacctattttgggcttgtatgcatattaaaaaatatttctgctggtcagttattaccagagactagacgaaaatgccaaagtacgattaatttataattttggtttatttttgcttttggaaaagacatccttaaccatgagaaggtcctccacgggggtggtagctacagctcttggggatggttttacaaatgtggactgttaggctgaatttactgctgtttttggagtcttttcttatagaaaatgtaaatgttctctcttttatacttgctgcagaatgcagtgcgtcataatcttagtcttcacaagtgttttgtgcgagtagaaaacgttaaaggggcagtatggacagtggatgaagtagaattccaaaaacgaaggccacaaaagatcagtgggtacgtccaccatgtttgaacttcttagcctagcttggattgtgctaacaagtataacgtagaggctttggctgctagatggtgttagaccaaagaactggtttcacgttgtctcagttaagggaagcaaaaaagcatttcatccctcctgttttgtatacccaccagtccccctgccctgcttgctggtctttgttgcatcacatgctagtagcttttaggtggcaatgcatattaaccctcacaaaccatttgcttatgcttattgcattttattttctttttcctgttccctgtattggatgtctgttctgcccccaaccccgtctccttttgttgccactccatctcctttgctgctgctcctatcccagggtgccattcgcaccaacctctcactgcataagtgctttatcagagtagaggatgagtttgggtccttttggacagttgatgatgaagagtttaaacgtggccgccatattcaacgaggccgtcctcgcaaatactgccccgatgaaaactttgacgagcttgtcgcacagtaagagcctttacttgcttttgttttttttttctgctgttgctttggctttgcatggttgactcatcccatgtagttttgcatttcaccaatagcagtgccacagctttctgcaacgaaactaaattgtgtgatttgtacatgtattgctctcgtttctctttggaacaccagtgccttgaataatgcttttttgacgtctttaatgcaaatattcgttctattttgattcagcagcttacggggaccctagaactaaatacttgtgcttaacccataatcccccctctctccccaccccaagtaaaaagggaatttttggttagttaaaatgtgtgtatatactattggggtagatttcttatttgttcactcactataataatacaaatgtaatgaagtgaatgactaaaatgttccaagcatagtaaagaaataggtcatattgcatacacttcctttaaagaccactgataaatgtaggtaattgcctactgggaggcacccttttccctcagtatgccctatgtaattttttaatatttttatccttacgaggctagagattttctgacaacagtatgttagtttcatttggtccgtgaatggagatggcagcaaatattctcagaccctcccagatctggctaagacatccccttatttaggaacgaccctcccctggcataccctactctccatcgcctgttggcaataaacgtgccttgtggatattccttaaaagccttcctgccatccctctagcagtcactgtaaagttcaaatctcaaagatgcttaggagccaagattctctctgctcgtgcccagcagcccctgctgtgagctcactgccttccccagcacgacctcctaggctgctgccttcctttctgttggagtctggagtcaggctaactcctaaaaatctgcagagaggtctctggagggaggacccaagcctgttactacctaagccagaattttacacctagtttccttgaatagagaagtccaaccccagaggtgtgcacacacacccgccctgcaaatcagtgacggggagaaagcctgacttttcttgggttttgctagtgggggaaattgctcatttggaagggcaccagcaagcttaaaacaaaacttagctaggaactcagcagtcgactgtgtttaactttgagtttttatgtttttcttacacagtaacccttcccttattaaaaacatgcagagcagccacgcctactgcacacctctcaatgcagctttacaggtaagattaacggccgtcccgaatatgcagcagaggcacaggtctcccctactcatttcaaaatatattagccttgctctaattagatattaaattttaattccgttaaacttttttcttaagtgcacaaagcatcatactccctggaggcaaacacatcgggctgcttcagcgttagcgggatgcttagcattttgaatattgtggcaaaaaaattaaaagttcacttattaatatttatcagcagtatcataatttccatcctcttatttcagaatttcacttgaggcaaaaataccacaagtgtaattactctagcacagctattaatgtgctggatgataggccactgcgtcacatgaccttctattgttcatgggtttaaagagaaagcagggctttgtatttctttttcttcttttaaagtcgactgtagcatcttggcttttgtctggggtggggaggatctggggtctggttcactttgtaaaagtaaaccatgtctgtttaaacaatagaggtgtttaagaagactctttagttttcctgcagattgttcaagattacatgataatcacacggagtatttatttcctactgacaaaccaagtacttgttacatcaccaatggtaccaggagatgaagacgcgggttttgagcaggagcgagattaccacccaaaaaggagctacctgaggcagcccagcttctagcaaactttttacatgttgcacatttcagttcttaaatgaaggctactccagtgtcatttcattaaagtacctgggtgtagtactcaagtcccccctcaagagttcataagtaagcagtatccttttggccagtggtcctgtttttgcccctacccagactgttcgagaagcatattctatagataaatctgacatttgtcatccaataccattgcagtcctctgcagcatacattctcaatgggggctgtatcacccctagattggttctgagatactgcaatgtcttgtgtccttccaaaggaccataatacttgagcaaatatgaacatttcttggggtgagggcagaaagagagaaacaaaagtctaaaaagggacaataatgaaaaaacagttgagacctttagtatgatgggaacaggatgaggaaggaggagatactgacaggagccctgggtcttgctctgcattaaacagatatttatggacattaaacagatatttatggagcacgactctgtaccctacaggcccagaatagtcttaaggctcctgggaattgatgataggccatttacccagtttcagtttagaggcagattcactggccttagcatttcagtaattatatttatttatttttagcctgaaccagatttaataggagaaactactttctgcgtttcttttaattacttgtagtttacacagtaactttagaagagtaaatgaaagcatgcttcgatgctgccactgtaaataccattcattagtaacttattttccctggagtcttgtgaagtgtgaatttaaagcctgctctatctggaatatggaatagtattaagattacaagcacattttatattcatgagccggaaaggcaaaaaaaaaaaaaaagtgatcctccatcctctgaattctcttaactatgtgactaatttcaattagtatgctttgtcattacagaactgttcaggtttcatctctgaacatttgcttttggcatcttcttcagtagcccaaaactgtcctgccgttttccaagaacactttccgtccataatgaggcaaggggaataaattgatacaaattcatgatttgagaagtggattgtttccctctcttctacgagtttggatccctgatcagtagacagacacataagacaactttctactgtgcaaattaaataaggattctgccagcaggccttcctttccattaccgcctatttccatttttcaagacaagtaaaaataatagtggaacaatatcttcaaaaaaattactagagcaacataatgcatgatatacaatatataaaataggacagcagaatccactacagaaataaaacatgggacttgggacagattgcattatgctctgaaaagtgaagtaactaagggtaaccgtaaagcttcgtatttatagactgcctttcccctgaggatctcagagtggttaatgttccaggagcgagggtgcttatggacttctgcaccattacttaagcaacttcattttttggcagaggtgccagcttgatatgaaaccacatgctgtgcaaggaccatttatataattaactccatttttgtaacacacctgcttctaagtggacatcaactaccaaaaaaaaaaaaaaaaaaacactttgttaggcagaagcagttagtgaaaatttatctaaccttgggtgggttgctctgatcacttgcttaacagagagcgtgttcaagaagctctcttgcggatcaggcactgggatctctctgcagcccatttgatcattttttcaagggacaaggctggttttcatcacttacatcgttcttgcctgagaacccagggatcagtataagtgcttgcctttgtatgcgtttcactactgtggctgttgggtctcagcccatgttctatgatccaatcccaatcagcaatggccttgacctagaatactttgagagccaaagagaataaatactcatcccaagaaagttgccttctctagaggatgacaaactcatcccaatgaacacgttcatatcagcatttcaattttgtcttcacagtttttgaccagggaagctgctaaaataattaagctagcagcagccccacttttgccacattctgaccttggaatagtgaaattgtcttatgagagcttatcttatggtatttccagtggaaagacactcagcagaatttctgtgactgagacaacagtggtcacacctctctcagataaaagcagttaagatgcttgtccaactgcagtttgcaaaaaaaaaaaaaaaaaacaaaaaaaaacaaaaaaaaaaaacaaataatagtagttctggcaactgctctgccaaaaaaaaaacaaaaagaaagaaagaaaaaaagctttatcgcaattataaaagagctgttggaaaaagtacttgatgcaaattatttgacacactgtaggagagtgtggaatgttcacatttgctgttcatcaaaatgagttcaccacatttggaaataaacacaggattttccccctactttttaaaagaaggcagttatacacatttacaagtagaaggaaggaaaagctgtgggcttacatagggccgagctttgaaacagtccattatccaatgctgtgtttggtgagtgtgcacaggacttctaacacagggcttgtacctagaaagccctggctttgcggtttgtacagtgagtgaggctgcgattgtcatactagccagacagatttctgcagcccagctttgcactcttttggcttttactttctttctagagccaggatttctagaatagttcggactcttgtatgactggccagtggaagtcactatgccagatcatcttgtgaaaagaagtacatctaatgtacttttcttctcattaggatggaaaagcaggcatagtctagtctgcaggaggacagttgtgataaatcttggtttaattacagctgccagtttttgaaagtgtcctctttaatgaaatgaaaagtcagtgggtcgtaatcaccacctggatgaaacaaatttttgggtaccttacttagtccagtggtatatgtaactagcgtctgcatttcagacttggtgtcccttttattcaaatgcagtataacaggaagtgaataatatcctacctatcctaaataaagtttaggatttcttctttttcatttcctcacttttttgctgacactcacgtggagtaactttgtaacctttaatattgatgtactttggcaccaaaaataaatatgagttagagcttccctttgccagagttctttagtcctaaaatcctaggcaattggtcggactctgaaacactacgtggtgtttccttcaaccagttatctcaaactgcactaaacagattcaaaaatcattaaaacagaaatgatgggaggagataaaaaattgattccaattctataatctcttccttttctataggatctaagaggtaaatgtttatggaagttctcataagtttgagcggtgcggccaggataatctgatcaaaatctctaatatccaatactggagtcatcaaaatggataaagaaataaaaattctattatatttcactgtgatctggaaatattcagctcctcttaaaaacgcatccgacataaacctcatattcgaaagcccgtctaaaccatgtgactaccaagcaggaccaaattgagtccttcctacccacaggcacttggtcccccctggcccccagttagctcttcaaaaccaagcttgggacaggtgccacgagtcgtttttaaagcaaaatctttcaacacctcttagaaacttgtatttgccagccatgctacaattaactcaaactgaagattatcgagtacacccataattagtagtttccttgtcttacataccctgtgtcttcataaattttctcttggttgatgacaggcttcaatggctgagaatagtatacctctatacactaccgcttccatgggaaatcccactctgggcaacttagccagcgcaatacgggaagagctgaacggggcaatggagcataccaacagcaacgagagtgacagcagtccaggcagatctcctatgcaagccgtgtgagtattgtccacccaacaggtctttgctatctgaccctagtctccctaggtacacgcagggagacagccctttctctgggctttatataccttttctgtaatttctgatttcccagaaccaagctagaagtttgtacttcaagaaatgttcagcttggttagtgcataaaaggactatttgctaactttcccataaaagcaattcacagcaataaaatgagaaacaggtttgctttttttccctctgctttatcacatcccaggccattatttaagccacactactttttcctcctcaaactaatatgcattcctatgaaaaagtttgcagtttgttcaactttcgggcatgttgaacctagccgagagaaaaagatgcttgtttacttggtggtgcactaaggttcaccacgaacacgccgccgcagcattattaccaaccattaatgatggcacaaatgaaaggcggcatgatttatagattgctcttaaaatatcaaaaggaaaattaataggagcattatagcagcagacggcagtataatgagtgcacatataactgaatgaagtgatgggcgatggctgcccatgctgaatgtgaatggaaccaggactgcaaaccacaggaaaggcggaggccaggagactgtgatgcccctgtgagtgggtgatgggagagaacttggtgtaactataacaccctctctcccaggaaaagttttcaaacagagcgaagaaaccacattattccaaatgattggctttgcaggagatgctgtgggatgacagtctctcccttttagtgaggttcttcaaaactgttgcccactttaaggtactaacccatttcgtgtttgcagtactgtcagttcctagaataggctgcttgtctacacattacttctgaattactgaccaacatcttattttaagataatttaagtgatcggaatggaaattatgacctgtaacaattaggagcatatggaattggcatctaatgacaaagaaaaaagtgttatctgccagcataatttggagggtacgtggaaatctgaaatttgattttctagcatttgagtttcatctccacagcacttcagaaaggatctttactatcctttctggatatggaaataatcatttttaatttatatgaacagtatcttagcatttgcttcacagcattttaagagtgtgtttatctttcacactgatgctgctatatttcatcctttccaaagcaacttagtgtttccgattttcctgttaccacatttgtattcatcttaaatcattgtcatgacacgagtatttacttagatactaacgaagttcagagcaaacgtaaattggtataagctactgcaagaaatactcagaacaaaaatgtctggttattgaatggaagtgatgctatttctcataatctgtacaaactccaagtttttgttgacatatattcctattagtataaagaatcactaaaacaaagagatacttggatacaagccacaggcaccagttcagagtgatgctgattttgctgtacgaaagaaagtcactgcagggttaatttgtttaacaaatttgaattaaccccagtattacccaaaccatgttttacaatagtctttgtaatttttgatgaaatgaaggtttcaactattttttacaagaaaccctacacaaaaatgtcaacatgcgttgctcaaatctcacaggtttgtgctgtttgctaaatgtaattatatgtcaacagcagattccctgcgcctgctatctgtgtaatagactgttactctttttgacctcatatttccattaagagaattctgtagtgacaagagtttccattcttgtccaatatgcattaccctgctatgatgcaaattgtttttcaactgttccagtctattggaataaatcaagccataaactttacggcacggcttgaaggaccttgttaggaaggcggcctagctaatattgagtgttgaaacagaactcttcattcttaccctttctgtgacagtcagataccactacgtttcgttcgtcctttgaaacactagaaagtggtcacataattatggctttggggcattctacttttatcctgataggcgctaaaggagctacaaagcaaaatactccatgctgtgcagacacccccagaacacaatgcctttaaacgccagtcagctttattttaaaactcttgtgttcccagagtggctaaacaaaggaattactcagatgtaaggagaagggaaatgtgtggttttgcacacagttattcagcggtagccctttcggaagtaggagttggagagaaagggtgggggcagtgtctgcaaggagaggaaggtgcatcatacacagccctaacttccaggagacacggtgagtgtatgtgaagtgtagtgtcttcagtagtctgcatctcatctcaaatgtatctttcgtggaatcccatcctcttttgttctttgaagtgctgtgtgcttgtgctacacgtttgccacaccccaggggtatctgccggcatcaagaaatgtcccgaaatcggatttcacttctctaaagtttcgaaaccttactgtctaacctggttgtgtcatcaggtggtcacacagtagatctagccagttaacatttgttggggacccactctgcatccactctgcatgaggcactgggagtcgagcctacaggcatgacaggatcattacctctgtcttgtggatagtaaataatcctcatgaattttggctaccaatttagggggaaaacgtgttttgtttatttgttttttcacttctacagcttttaaaattgatacctcgtaactacatattttgggggtacatgtgttattttgatacatgtatacaatgtgtaatgatcaaatgaggataattaggtaaacgaaatattctctgatgttgtgaactgtgttttgtggggctttacatgcacctgattttttggataaggttagcaaaatattggtcaaagtctaaaattatacagcaagaacttcattaagatggagatggatggttctatttcttctaggggtcctcatcctccttccccctccccaaggtcttgtatgatcttacattcttctatcattcaattctgggttataaacatgaaaagattgatagacctgatagttaagaaagtaggaaaatgttgatttggaaaacaacatttgaacctcaatcagcatatagctaaaacataaatttcagtaatttatgaagttgcagttctcaacaatgaaagtttgaaacaaacattaggaaatgttcaccattgtcagtaatctgagaaacacaatttaaggtaacctgagcttaccttgtacctgctaagcaacaaaatatttttcacaaataatgcttgctgctgatgagattgagtttaaattgatagcccctttggaagttaatatcacaataaatcataggaaccataaagatgttttggcctttgctctaacaattccattcttagaaatttatcctaaggaggtaaatcaacagaaatagagtagaaagattaatggataaaagtggtcattgtattatacaaacagtaaaagagaaagagaaagatgatcctcaaatgcctagtattcagaaactgacatatgtcaacacagtggaatctcatctagccataaacattataaattgtaaagctaggaaaatttaaaaaatagcattcctgctgaatttacaatatttaaaaatatgacctcaaatggaaacagattggcaaaaataagaaaactggccttaactaagggtttgtgttttttaaaggaatcatcatcagcataactaattcttcctaaaagaatgtagggtattttagcagagctggttcacaggtgtgtgacatgcagtcacataggatctcatgcctaaaaggacactgcacttgattttatgtgcttttattacctttttatttagagataggggtcttactgtatcacccaggctggactcgaactcctgggctcaagtgatcatcctaccttagcctcccaagtaacttggactacaggcacacaccaccatgcctggcatgtacttgctttaatgccatttttgtcttgaaattttaatttttgagccaaagaccccagattgtcattttgcactgggcttccaaaattatgcagccagtcctaattcttactgctgaaacactaatacagccattaaaaaaaaaaatccccatccgtaatgcttaatacagactgctgggagggtgactccccatgcagccttccttgcactgatgtacaactgttccttttaaataaaaatatccggcgagccatggtgtctcacgcctgtaatcccagcagtttgggaggccaaggcgggtggatcacttgaggtcaggagttcaagaccagcctcaccaatatggtgaaacctcatctgtactaaaaatacaaaaattagccaggtgtggtggtgggcccctgtaatctcagctacttgggaggctgagccagaagaattacttgagcctgggggttggaggttgcagtgagccgagatcctgccactgcactccagcctgggtgacagagcacgactatgtctcaataaataaataaataaataaaatagctggagagccatacataaaatgtaatgtaatgcaactttgctacattttgttttgcaaagtttttaagaataaagaaattatttttttagcagccgggcgcagtggctcacgcctgtaatcccagcactttgggaggccaaggcgggcggatcacgaggtcaggagatcgagaccacggtgaaacctcttctctactaaaaatacaaaaaaatttagccgggcgcggtggcaggtgcctatagtcccagcttactcaggaggctgaggcaggagaatggcgtgaacccgggaggcggagcttgcagtgagccaagatcacgccactgcactccagcctgggcgacagagcaagactccgtctcaaaaaaaaaaaaaaaaaattatttttttaaaggtaacatctagcccccctaaatgctctctaggctgtgctaattttagagtcaattgattctgaaggttcctgtcttcaagggcagtccaaagcactcctctgtttgtttttaaatggttcaaggggcctttggggtttgcatacagcatcaattatttaggaagccaaccatccccattaccacctcttattactaatacttgataacgtcaatttaaaaatcttcccttctgcagcctgtcccagagatgggaccattttaactcaaatggttcttttacatatcaaaagcccctgcaacagaaagtcatttgtatatgcaaaggatcagttgtaaatatgatttacgaacaacatttctcaatagttatccgagcggttttgtgtgatcaccccagtcccctttgggtgaaccatgcgctggtccataatgagaaagttggcagacctcatcgcaaccacgctcatcccagtggctgctaccagccgggcctcatgttttgccttgtttacagctgacagcgttattattctgattggggctctgctttcttatcatattgttgtgttgagcgagccttttcctctacgtttgtgtttcctggcagggcttttcttgccttattgacagtttgtaaaaatatgcattaatttggagtttcaagcatgtatatcatggtgtctctttgctgtgtttgcttgaagttgattaatgatagaacctcgcttggggtcgtcctctggagagttctttcacaggttctgcatgttaactagcaaagcagaacacacagcaagccatgattagcccagcctcctctgctcagtggtccccacaaactgccgttgcattacagattcttatttcgtgtaattatttgaagatgggtattcatccacccaggatgccactacgggacctgttatctggtactcagtgtggttctaggaccaccggcatcacttgggggcttgttagagatgcagagtctcaggccccaccccagacctgaatcacacactgcatttcaacaaggcccacaggtgactgcagcgtgtgttaaagtatgagaaatgccaccagggaggagaggcccacaccagtccagagactagtgattcagagcatcactacccaagagaactttacgcagtgatgcaaatgttccgtctgtctctgtgctggccagaattaaccgctagtcacatggggcctttgaacataaatgtggctagcacaactcagaaactgaatattaaatgtagtaagatttcgttcatttcaatttaaagagccacgtgtggctaatggtaacaatactggacagagttctagttctagagtgcggcttttctgttgccccaaacttttcagtgcacctgagctgcaatgggctgggaagtaccctcactgaacctctgcatattttttccaggcatcctgtacacgtcaaagaagagcccctcgatccagaggaagctgaagggcccctgtccttagtgacaacagccaaccacagtccagattttgaccatgacagagattacgaagatgaaccagtaaacgaggacatggagtgactatcggggcgggccaaccccgagaatgaagattggaaaaaggaaaaaaaaaaaaacacgtcaaaagttagcagtgaaattgttctccatttgttgtacagtctggaggattttcactacgttttgacaactctgaaatgtgttaactcttagtgccatcaagaaccccatttgggagtatttttgatttttctactttttgttgaaaaaaggaatttgtactctgtgcattggatggacttgtttggtacttgggattttcctctcttaaccgtcaacatcagtgttgtaaatttgctaaactgattcacttttagcagcagactttgaactgcagtcctgccaacgttggacactgaggacgcccgacagagcttgtgcacctaagctgcagaccaagcctttgcccagaatttaaggattccaatggacgacctatttgcacagtactgcatgttgattatcactgcctttactccttttttttttttttttttttttttttttttgcttccagttgggatggggaaggcctttgtgtgtgtattggggggaggggttaaaaaataattatcccaaactttttaatgtattgctttttttttttttttttttccttctactataccattttaagttctgacctcaggcctccatttgggccgatggcctcttggaggcttaaagttttctgtaccttgtgatgaatgttaataggtgtttttattatacaaagctgaatgtcatttctcgtttgtagctttctgtcactcattccatcttccttcagacatcaccacgtttctctaaagtcagaaaacattccgttttggtctttttcaaaaaggtcccaaatgctgcactctacacatgaaggccctctcacacagacgtgacgtcctgccagaaagagaatgaatgacagaaaaaaaaaagagagacaaactctaggaacaatgccgattcattccacgcagcagtattgggggtggttcgggggaggggtgtttcggattttctttttttcttttcttttctttttttttttttgcagcaaccattaataaatgccaccacattctaccagcacaaggaaacataggcagcactgaaaaaaaaaaaaaagctcatattaattagactgacaatatggccttggaaggctctcccttgtggaaccaagttgccatgggccttgggtgctctgcgataacgggtgtgggttggttttgtttgcaaaatggccaaaaaaaaaaaccggcttccccgagcagctgccctgaaagtaggggtggcggcggcggcgctgagtttatacattagttcagacctacttggtggcattaaactgtttgaatgcaaattcgatttcagattgaacttgttaagggagttaacgagggctgagttcagcaaatgctaaagtgttaatttcaaatatgcaaatttggtactgcagtttgttatgcaatattatatcaccaacccagtatcacaaaaactcatagaagatatcatgtaggccctgggctttgggggggtcccaaacatggtatgcagaaatgtgatggttacaggtcagtacaacctcagtccttagaacccctccacacttcagctctgcacccactttcctgtcatttatttatataggactgtagttttttttagttcgagagcctttcgaagcttaatttatattctttctttgtaccttttttctaaaattaccaaagatattacacaaaggtaaattatgttctctgttttatgctttatctgatgaagccaaatatcctcttattgttgatcaaaggaggcaaaagaatttagaggcaaatgacaagcgataggctattgcaacctgagaaagagaactgctccttcatcgtaaatttagaagaccaagtagataatggaaccaaagttgttacttttttctagtagttatttttcctttttctttttgtgtacctctacagagaccaaaactcattctcttaaagagattttatggggctactgcagataaaaataggacacaatattaaaggagctacagaaggaagggagtcccatctcaaaaaaaaaatgaatgtatgccactgcaattagagtatccaataaaggagacagtttagagtcaggacagaaaagcttccataattgaactagattacataatagtatttctagaaaaagagatatttttagattgtatgccacttttgtttaagaactgtgctgtgatcactgtattaattttggtttatcttggcatatatccttcagtttgtttttatttttaatttttcctttttttccgattaggctttggtcagcatttttcatttaaagaaaagtaacactcccatccactcataagcttggtacaaaaacttctctggcagttacttttgaagcttcactctgctttctgtataaagggcagtctgtggtcacgcaagactttaaaaaaaaaaaaaaaaaaaaaaaaaaaaaaaaaaaaaaacttttccaggcagcttcatgatgtgcaggcagtagccagacagggtcatgggaagggggccctgtgcttctaaactgagtggttgctggttagtttggtattcaaaagaggataaaaatctggtagattagttcattctcagcatgtgtagctagacatgagtaaagataacagcatgagaaactgttagtacgcatacctcagttcaaacctttagggaatgattaaaatttaaaaaaaaaacatttcactcagttgcacttagtcgtatgtcttgcatgcttagtctaaagactgtagcaaaaaaaaaaaaaaaagaaaaattagattttacatatctttgcaggtatcacagccttgcagaagaaccaactgaaaaaaaaattctcaggctttacagcaagcaaacttcactatgatttttacaattctgattctgtatcccctgggggttatcccagttgcttctttaggatggggtttattacgttgtacatatatcccgatgtgtctgtgtgaatctttgtcttttttgggggagggcagagggcggttctttttttagatattgttcctaaaaaggaataaatgcatacacctgtttgtcaaaacacctttgctttttgtgcaactgctttatattaacgatactaaaaaaaaatagctttggaaaaaaaactactgtatgtaacggaattgcagaatatgctgcacatgtattttatttagttatccttgctttaagaatattggatgacatttcctgacatgtgggagggagaaactccctaactttttttttctgcttttaaactgtaacatagttgaagatttcttttttctgttctcattgattggagcattttgtacaggttttgtgtgtgtgtgtgtgtgtgtgtgcgcgcgtgcgtgtgtgttaatctgttttttgatacattcctatcccttgtgtttatcctaccactgccttcctggctatcttaaacaagttcatacatttgaaaagaaaaaaaaatgttgtttaaaaaatgttttctcctgctgcagtaaatattttgcatgatgaaattccagggtcacacttttccaagtttatcagtgaagtagtgattaacaatggggagtgtcaaaactattgaacttttgtataaaaaaaaaaaaactttacaaggtgccaagatgtaaagaaaatctgttactttttttttctcaaagaaaagcatacattagggaggtagtcccgtgtgtcagacaaatgcactgtcaggaatgaggatccaacctacctgtccctagagtccgtcttgtaagatgagttaggctgccccttggaccagccacaaaatggaatatcaaggcttatgtacatacgtgaagagttaccaccagtcctgccacctttggacagctctaacaccatccccagcatccagtcagacctagtaaagaaaaccttggattcttaacccaagataggctgtaaatcactagcttttttttcctcatgaaaaaaaatagagttaaaaaatatttcctctcttttccatattccagctgaactccgtttccaaaggcacaaagaagagtgtgcttattcagattttgaatctttttggtaccttttggttaatgacatagcctcctgaaattctggatgtcttcaaagtcagttttgcttctttatcctgaaaatcagatttacaatgctgaaggcatttcttgggcccagtgtagctcacgcaatctctgctacccataagccttgatgaagatgatacagtccggactgtgagcatggtgcttcatgtatatgtgctgccagtaacaagaatttttttgttttgttttgttttgttttgataaggcataaaagaaactcattccttgacatcaactgtaattccatcattccatgtctgcggatacagacaataaaaaaaatgttgtgtagtcagtactaattactgacattataagcattctcaaatgcaataaaaatgctggttgttcacgctggtagtaaaagttgccacagcctaagtttgtttccctttctgacctgctgatattgtatgttaggcatatgccttaggtttatcaccagctgcttccaatgcagaattaaaatcaatcttaaagctttcatgatcagggaaggctgaagctcttatcctcaggatttccaagtgaaagtatccacttagagaattgggaagtaaaaaaaaaagagcaagagatgttatcttttctcttgaggaagcacactcttatttttttcatcaaattttataaagaaaaacaaaatgtttaataactagcattaagagcaaactaaaatttcagaggaaagcaatttcatgaataattcattaaaatttcacatctgcaagattagtcatccaaataaaatgctaatgtcaaaaacatgcaccgtctataatattctcatcaagaaatctttttgcatataatgataaatgcttagattagaacaaatgattttataaaaatattctatcaaaagtatgctagataattgcattcattgaagaaaacagaacttcagtacctaaatattccagaaaaaccatcttaattttgagattttaaaaaaataattagatgcatttaggaaatgtgctgtttctttttaatattactctatagtatatattctagggattaatgaatttgagcatcacctttcaataaaaaattaaattgccaatatgaaagcagtattttaagtggccaaaccgtggtaacataaaaccattacatatataattcagagcacataattcagggcaaaggatgacttgaaaattaacctcccagtctttattctgcaaaacacccaccgatgctgaggatacaagtgaacattctttcccagcattgttttgaaaagcccatattagcaaagttgtgtgtgtgtgtctgtgtgtgtgtttttaacaagtagattttgctattaagttgcaaactagtgtcctctttgaattaacaattatgccctatctagaaaccccttagtctcaataattagcaaaacatttgaacctttaattctcacctggctactgagactataatcttagggttaattcaaattcctgtaattaccaggcttaaacctaaatactgcttacagcctatacattagtaaaatttaaaaatgtacagatacttcttttaataaactggaggacctaaaccaagtatgacgatatgttagtgaagattttgctggttgaggcatagtacattttaacttatatttcaggaattgttctcaagcaggaacactcttttacatatttatttcaggcttgtcactctcataaacgaggcagcaaacccaaaatattggctcttcttataaataggcgcctttatataaagaacataaaactcttaagactaatttcacaccaacacaggcagcttcataatagtaaccacctctccctccccactaaaaaagataaaaacaaagtataattagtctttcttattagatttttgtctttgatgatattacgtatttatgtgtagggtagtaatcacaatttatccttcatcttcattgtagttgaatcaaataaaagtattctttattcaaataatgtgaagttgggtgtctcaaaccttcatttaatgaattgatgaaaggtttaagacaaaattcacgttggagggaaattaagttacatacaaaaacactggttttaactgtgggacaatatttggattagaaaaccatctctagatataacctacttatatttatttttaaatggtattttattttttaaaataacaaaacccaatgttgtcttatttccactttgattgtaaaatgacattcaatgcttaataccaaaatatatatatatatacacatttgaaattatcaacggtcctttttttttggtttatattgaaaatattgtgaagggaaaaagacaagcttcaagttataatgttaatttgaaggtaaccggcctttcaagaattaatttcagccaaagcaataatcattatttaccagcgtgtgacatttttatcactcatcatattagcaaatttccattgaaaatgctaaaatggttcgtcataaggcagataactgctcgagctgtaaaaatgaccaacacaagtgccggtactcaaacattaaattatactgtaattaataaagacagttaaactgtctactagcaacagcaatttaggtaaccacatttgatcggctataaattgtaactacattaaaattccagaaatattagcaatatggattacttgatggaagtcagtgctgatcaccaactctttctttctttctttctttcttttttaaacaacggaagcacaggtcatgttgaccacaaatccgtgggcgaagatcaggccttagcacttttaatcttgtgaaacaagcaattacaaatagttgcatcgatttgttaaaaagctttaggtgacataaattgtttcctgtttagcttactgctctgatacataaatgtcaccaagcccagtattaattagggccatagaacagcagagggtggccgatatggcatccaatcaagaatttgtcagtcctttgtgaaagttctgaagggctgctctcactggctcatttctcattagtgacagagagagaaaaggaaaactattttgttatgcgaagtctttaataccagcttgattttgggttttaaactaaatcgcaggatttcagacttgctttcttactattggacataaaacgccacattttaaaactatcttctaaacagaataatatttacaaggcatttcagcccctgaaaagctaaccctttttccccttttcaatatagggtactatacatgtttccttgggtttatatttctacacttaaaatacaattttaaatggcttttgcacgctattgacttaacatcaatcaaatgtatcatatatactttctttaggttggcatgccacttagaaaaatatgtgagattctggaggaaaaaagtctggagaaaatttattaaacagaagtttttactgtaatagaatattaatgtaagccaatgctcttttgccattaagctgatcctttttttttttttcaaacatacacatgctttttattattttgcactcaagcaaaaattccacattcaaagactttccatctagtcgggaatgtctctggcaagaaacatgtcaagaaatcctgacctcccgaaagacatcagacatcattcacactgcgcattcaccccactgggcagggaacacaagcccactttccccaaaacgtaacgtagatgctggtcaccagtggggaagagggggaacaattactctttaaatccttcctcactgctactccaccagtgcacagatgaaaaatgtttgatttgcaacataaaagattcattaattaccacttgaatatttaaagctattttgcagtctaacagagatagataaagcagtgaattaaaacctctaataaaattgtaaaaatagttcggtaagtttacccgtgttatgatttagggagagattcaagcattctcgcagaatagattttagcatttttcaagcgtgtatttgaaggaaggagctaagtgtttggggaataatttgtttcacattttcaaatgtttactaataatttcttttcaaatcaagcttgctactttaggactctatggatagaaaaaaaaaaatctgccaaacaggtcggagcattatttgtctgaccagaaatttaaattctttagaagtattcagctggctgtgtaagaaaactgcacatgtaccccctgaatctaaaaaacaaaaataattttttaaagtgttcagctgggctgaagggtttagtagccatatacataaagtactgatttccttcccacaaaatgcatcacatctaaaaacactcacctcaagaacacagcctagcagtccctcccacccctgcacagctccttccttcagtagatccatgatccattcagtgtttggatcctgggatcctagaagtagaccgtgcccagcacactctgaaatcaaacgctagagaatccacataccaggctaccagttccagccctaaccaaaagaaactgggtgacgttagcaaagttccttcatctctttggtcctcagcttcctctgttaattgacatttaactaaatgatgaaaagggtttcttccaattttaaagttctaaagttttaataacatattctcccttggggacttctcttgatgaaatccatagtctcagcataaaagagtagtgtggcacttcatatttcaaccaatattctgaaatagtcttatcaaatcctgccttgtaacttgccctgtcggaaggaaatttcactagcatacatgtttctatccactcatctattcatccatccatctactcacccacaaagaagctttaaaggcgttaaacgacctacagctcagaataagatagacacaggcttggcctcattgtacctaatggttcacagggaggagttgcagtgcacgcagtgccaatgagagggcaagtacaggaatacacaggaagaccgcctgcttccactggggaccatcagggaagcttcctggaacatgcaaggtttaactgaaacccaaaagatggctaaggctctgccggctagagggagggagggaatgttctaagcaaagggaatagcgctctggcaggatctggggtatgagaggtatgagactttccaagcagagggaggcaaaaaacattaaaaaaaaaatacactaagtcatcattgcagttaccatctaacaataattaataccatccagtgcttcatgtggtctagctcagtcattcctcaggaggtgttactgaaatcagttctttcagattgggaaactgaggcacagcgaggtcaagagacctgcccagcccctcaagatctcttcttctctggccacactggtcgtcttgccattgtgagctgatgaatttggaggcctgaacccaccaagcatgctctgcctcagggcgggaagttgctcttccctttgccaggaatgctctctccctggctgtctctgtggttcacaccctccttctccctgcaggtcccctactgcaatgttccagcagagaagcctttcccaaccgtgcagggtaaatggcactcgcatggcccactctactccccactccatgccccatcccccggccttctttattgtttccattgcacttaacccctctcaacattgtatattcatttgtgtctttgcttactcacatctcccttccaactacaagggcagagactttgcccttgtggttccctgctgcattcccagcatgaagaccaggaatcaatgctcacgtttgttgaatgaatgagtgaacaaacatgctgctaggaagagtagaggtaggatttgaacccttgcaatcagataacagagcctgcctgtgtaaactatttcattgtatttcatagccaaccaaaaccaaatatcatttctcaaactttcacactgaatctgcaaggtggggaatggtcaccagcattttactgatgaggatgctggggtctttctttttttttttttttttttttgagagacagtgtcttgctctgtctcccaggctggagtagggtggcccaatttcagctcactgcaacctccacctcccgggttcaagtggttctcctgcctcagcctcccaagtagctgggattacaggcatgtgccaccatgcccagctaatttttgtattttttagtagagacagggtttcactatatgttggccaggctgatctcgaactcctgacctcaggtgatctgccggccttggcctcccaaagttctgggattacaggtgtgagccaccacacccggcccgacgctggagtcttctacgtgacatgctcaaggttgcatggagaagaacccggggagttgatatttacctccataactgattccacagccctgtctattagccctggtcctgccaccacctccagagagcctcttaacaaaataaagggttttatacaaaggtaccaaatatgctcacataataatatagctttaaaacaaagccattgacgtcaatttttaagatgttatgaagttatcaggcggggcacagtggctcacacctgtaatcgcagcacttggggaggctgagacaagtggatcacctgaggtcagaagttcgaaaccagcctggccaacatggggaaaccccatctatactaaaaatacaaaaattagtcgggcatggtagcacacacctgtaatcccagctactcaggaggctgaggcaggagaatcacttgaacccaggaggcagagattgcagtgagccaagatcatatccactccagcctgggtgactccgtatcactccagcctgggtgactgagaccccgtctaaaaaaaaaaaaagatgttatgaagttatcaaataatgtggagaaaaaccatctaaatgtgagccctatataggctgtcatgcccacagttaaatagtgtgtcaggagaaccatgccccagcatggaacaagactgaattgtaggctctgtctattgggtatctactggggtatcatggtgtcttcatggcttgcctcacctcaaagacgaatatttctagtcctgactgcaatggtgaatagccctccaacttccttgagtctgtttaatgtaataaggtacatacattagaagtcttactaataggtagagaaaaacatttatatctagaatttcatgccttagctgggatccagcatccctggaggaacacagagagcaaccatgagctccttgatgacaagactcactctgtcccattcatggtggagccaccctgagcatgcctggcagagaaacacagaagctggggctgggagagacaggcctggaactggagccagacaagtggaatgcagtctccctgacctcttgatgactgcgcaacttttggcaatttacttacacctctctgagcttcagccaaaattctgacattacaagagcatgataatgattaaatgagatagtatatatatgtaaagagtaggccatagaatacattctcaataaatggggtagaattttgggggggggtgtggcatcaaccagcctgtctttgtgtgttttacagtctagctgggagccaggcattaatcagtttcacagagaaatatgaaagtccatgtgttacaagaagttgcagtacgcagagctatgctctgacaaggaggaatcagggaatatgtttaagatgtgaaagatgagtaagaatcagctaggtggatttcaatgacttatgttaccctgcattcattcccattttcttcaattatagcacccttatttttcatttgaggagctactcttcttctatctgtcagtattgcttcaataggattgtcaccgttagcctgactgctcagatctaatcccatgacttttactaaaattgttgtaataaatactcttcctgaaaagattgatagactaggacatggtcctggagctataatatgggaaaggtagaccccaatgaaaggaaaaagaggaaaacagaaatgaaagagaaagaaacaaaggtggaagctaagaacaagatttagatctgagaccaagaccaagatggaaagccaagaagggagactaaaccccaagttggaaacaagaaacagaggtacctacacaccaaatactgatcaattacttgagtccctggatctggccattcctgaagctagagatacatgcctggattttcaattatgtgagtcagtaaattctcttgtatatgccaatttgagttgattttctgtctcttataatcaaagagtcctaatgaatatactctggggtggggggcatttcacaaaggcaaccacgtgcattaaggccttatagcaggaggagacattacaagttccaggacctgaaagggggcctatatggctggagctccaaatgtcagagacaacatagggtagttgatgttcaaggcaaaagcaacggctagaacactcattatcacggcttcctgagaaagaaccatgcaacacactaaatatatgttctaaattatacttctctcattttgcagataaaactaagactaccaaatacactggtatcagggctaagaatgacacctctttggggctagaacagaagtaaaatgactgttttgtgctttaacaaaattcaacataatcaaaaatgccaaaaagggatagttgatccaggtcatggaaaaatgacttggatgaattttatatcacttctctcacagcttgatcagagggaacttggcttgaggcatcactagatgcagggctcaaatgcataatcacagctaagcagagcgagcgggggtcactacacctaaacacagcctccaaaagtggtgtgttttttttttttttttttcaaaaaaatgtctttctggtattaaataaacatgtcaattaagaatatgacaacgccaggtgcagtggctcacacctgtaattccagcactttgggaggccaaggcaggtggatcacctgaggtcaggagttcgagaccagcctggacaacatgacaaaaccctgtctctactaaaaatgcagaatttagctgggcctggtgatgcatgcctgtagttccaaatacttgggaggctgaggcagcagaatcacttgaacctgggaggcggcagttgcagtgagccaagatcacaccacttcactctagcctgggcgacagagtgagactccatctcaaaaaaaaaaaaagaatattacacaaaatatgctaaagagcaagacaatgagacacacagagaatgaacccaaaggtggcacatattttatgtgcttccttccccgctaatgaaatattctccatctctctcccccccacccatcctactcacaaacactgcctgtgtctgtgtaaaagcctcacactctcccaccacaggtgtgtttccatggctgaaactcagtttgtacacacctatatggggatatcattgtctaattctgactgattgctgcccatgccatacaagctgttgaatgttttgaatattgtccctggtttcctctacgaagaaaagaagatggccacaggtagtgccttgtcctgtggacccaaagtcaatgtctcccgttttcaccattggaaaagtctagagaaggactatgattgacccaacctggatcatgcattgcactcttagacaatcacaatgaccaacaacagtggggaagggtgtgtcttccaagtggccatgcctgtgagacatatatttgccagccttaccagaatcacattgagtgcgggtaaaactgttcccctaaaaagcagtattaccagggaggtcaaaacaatagttgtccactacccctgtaatgttaagcattgtgttgcttataatgtttaacaccatcgaaagacttaagtcatggccctcaaatggctataatctagtgataccttagactattgatttaacaaacagttatattgaatgcctactgtatgtcagacaccttgttaggctctggggattcagtaaacaaagcagaaaaaaatcccttccttctgaaacttactttctagagaggggaaacagacaacagtaaattagatgatgataagtggttggtagaaaaataaagcagggaaggggaacagaaagcattggggagtgggctggtagagtagttgccatggtaaaggcctcaatggggaagtgacttttgaacaaggacttctgaaggaagcaaactaggtggatatcatggaaaagaacgtcctaggcagaaagaacaaagaggcaaaaattctgagattggagcaaaaagagtgtggaagagggtcataggaggttatggggagcaggtggcaccatgtagcaatggccccattgcgaggacactggattttcctctgggtagatgaaagc

SEQ ID NO: 227 - DNA, 6795 bp, Homo sapiens
taccttcagtccttcctcacactgccgccagcctgggagccctgagagccagcaggcttccaagcgcctgtagtttctcccttacaaactctcaactttcttccgttgtgtgaaaattgcctctcccgccccaaagctttgcctcctcaccatgaacggggtaagacgtgaccttttgaggtgactataactgaagattgctttacagaagccaaaaaaggtttttgagtcatgatgcaagaatctgggactgagacaaaaagtaacggttcagccatccagaatgggtcgggcggcagcaaccacttactagagtgcggcggtcttcgggaggggcggtccaacggagagacgccggccgtggacatcggggcagctgacctcgcccacgcccagcagcagcagcaacaggcacttcaggtggcaagacagctccttcttcagcagcaacagcagcagcaagttagtggattaaaatctcccaagaggaatgacaaacaaccagctcttcaggttcccgtgtcagtggctatgatgacacctcaagttatcactccccagcaaatgcagcagatcctccagcaacaagtgctgagccctcagcagctccaggttctcctccagcagcagcaggccctcatgcttcaacagcagcagcttcaagagttttataaaaaacaacaggaacagttgcagcttcaacttttacaacaacaacatgctggaaaacagcctaaagagcaacagcaggtggctacccagcagttggcttttcagcagcagcttttacagatgcagcagttacagcagcagcacctcctgtctttgcagcgccaaggccttctgacaattcagcccgggcagcctgcccttccccttcaacctcttgctcaaggcatgattccaacagaactgcagcagctctggaaagaagtgacaagtgctcatactgcagaagaaaccacaggcaacaatcacagcagtttggatctgaccacgacatgtgtctcctcctctgcaccttccaagacctccttaataatgaacccacatgcctctaccaatggacagctctcagtccacactcccaaaagggaaagtttgtcccatgaggagcacccccatagccatcctctctatggacatggtgtatgcaagtggccaggctgtgaagcagtgtgcgaagatttccaatcatttctaaaacatctcaacagtgagcatgcgctggacgatagaagtacagcccaatgtagagtacaaatgcaggttgtacagcagttagagctacagcttgcaaaagacaaagaacgcctgcaagccatgatgacccacctgcatgtgaagtctacagaacccaaagccgcccctcagcccttgaatctggtatcaagtgtcactctctccaagtccgcatcggaggcttctccacagagcttacctcatactccaacgaccccaaccgcccccctgactcccgtcacccaaggcccctctgtcatcacaaccaccagcatgcacacggtgggacccatccgcaggcggtactcagacaaatacaacgtgcccatttcgtcagcagatattgcgcagaaccaagaattttataagaacgcagaagttagaccaccatttacatatgcatctttaattaggcaggccattctcgaatctccagaaaagcagctaacactaaatgagatctataactggttcacacgaatgtttgcttacttccgacgcaacgcggccacgtggaagaatgcagtgcgtcataatcttagtcttcacaagtgttttgtgcgagtagaaaacgttaaaggggcagtatggacagtggatgaagtagaattccaaaaacgaaggccacaaaagatcagtggtaacccttcccttattaaaaacatgcagagcagccacgcctactgcacacctctcaatgcagctttacaggcttcaatggctgagaatagtatacctctatacactaccgcttccatgggaaatcccactctgggcaacttagccagcgcaatacgggaagagctgaacggggcaatggagcataccaacagcaacgagagtgacagcagtccaggcagatctcctatgcaagccgtgcatcctgtacacgtcaaagaagagcccctcgatccagaggaagctgaagggcccctgtccttagtgacaacagccaaccacagtccagattttgaccatgacagagattacgaagatgaaccagtaaacgaggacatggagtgactatcggggcgggccaaccccgagaatgaagattggaaaaaggaaaaaaaaaaaaacacgtcaaaagttagcagtgaaattgttctccatttgttgtacagtctggaggattttcactacgttttgacaactctgaaatgtgttaactcttagtgccatcaagaaccccatttgggagtatttttgatttttctactttttgttgaaaaaaggaatttgtactctgtgcattggatggacttgtttggtacttgggattttcctctcttaaccgtcaacatcagtgttgtaaatttgctaaactgattcacttttagcagcagactttgaactgcagtcctgccaacgttggacactgaggacgcccgacagagcttgtgcacctaagctgcagaccaagcctttgcccagaatttaaggattccaatggacgacctatttgcacagtactgcatgttgattatcactgcctttactccttttttttttttttttttttttttttttttgcttccagttgggatggggaaggcctttgtgtgtgtattggggggaggggttaaaaaataattatcccaaactttttaatgtattgctttttttttttttttttttccttctactataccattttaagttctgacctcaggcctccatttgggccgatggcctcttggaggcttaaagttttctgtaccttgtgatgaatgttaataggtgtttttattatacaaagctgaatgtcatttctcgtttgtagctttctgtcactcattccatcttccttcagacatcaccacgtttctctaaagtcagaaaacattccgttttggtctttttcaaaaaggtcccaaatgctgcactctacacatgaaggccctctcacacagacgtgacgtcctgccagaaagagaatgaatgacagaaaaaaaaaagagagacaaactctaggaacaatgccgattcattccacgcagcagtattgggggtggttcgggggaggggtgtttcggattttctttttttcttttcttttctttttttttttttgcagcaaccattaataaatgccaccacattctaccagcacaaggaaacataggcagcactgaaaaaaaaaaaaaagctcatattaattagactgacaatatggccttggaaggctctcccttgtggaaccaagttgccatgggccttgggtgctctgcgataacgggtgtgggttggttttgtttgcaaaatggccaaaaaaaaaaaccggcttccccgagcagctgccctgaaagtaggggtggcggcggcggcgctgagtttatacattagttcagacctacttggtggcattaaactgtttgaatgcaaattcgatttcagattgaacttgttaagggagttaacgagggctgagttcagcaaatgctaaagtgttaatttcaaatatgcaaatttggtactgcagtttgttatgcaatattatatcaccaacccagtatcacaaaaactcatagaagatatcatgtaggccctgggctttgggggggtcccaaacatggtatgcagaaatgtgatggttacaggtcagtacaacctcagtccttagaacccctccacacttcagctctgcacccactttcctgtcatttatttatataggactgtagttttttttagttcgagagcctttcgaagcttaatttatattctttctttgtaccttttttctaaaattaccaaagatattacacaaaggtaaattatgttctctgttttatgctttatctgatgaagccaaatatcctcttattgttgatcaaaggaggcaaaagaatttagaggcaaatgacaagcgataggctattgcaacctgagaaagagaactgctccttcatcgtaaatttagaagaccaagtagataatggaaccaaagttgttacttttttctagtagttatttttcctttttctttttgtgtacctctacagagaccaaaactcattctcttaaagagattttatggggctactgcagataaaaataggacacaatattaaaggagctacagaaggaagggagtcccatctcaaaaaaaaaatgaatgtatgccactgcaattagagtatccaataaaggagacagtttagagtcaggacagaaaagcttccataattgaactagattacataatagtatttctagaaaaagagatatttttagattgtatgccacttttgtttaagaactgtgctgtgatcactgtattaattttggtttatcttggcatatatccttcagtttgtttttatttttaatttttcctttttttccgattaggctttggtcagcatttttcatttaaagaaaagtaacactcccatccactcataagcttggtacaaaaacttctctggcagttacttttgaagcttcactctgctttctgtataaagggcagtctgtggtcacgcaagactttaaaaaaaaaaaaaaaaaaaaaaaaaaaaaaaaaaaaaaacttttccaggcagcttcatgatgtgcaggcagtagccagacagggtcatgggaagggggccctgtgcttctaaactgagtggttgctggttagtttggtattcaaaagaggataaaaatctggtagattagttcattctcagcatgtgtagctagacatgagtaaagataacagcatgagaaactgttagtacgcatacctcagttcaaacctttagggaatgattaaaatttaaaaaaaaaacatttcactcagttgcacttagtcgtatgtcttgcatgcttagtctaaagactgtagcaaaaaaaaaaaaaaaagaaaaattagattttacatatctttgcaggtatcacagccttgcagaagaaccaactgaaaaaaaaattctcaggctttacagcaagcaaacttcactatgatttttacaattctgattctgtatcccctgggggttatcccagttgcttctttaggatggggtttattacgttgtacatatatcccgatgtgtctgtgtgaatctttgtcttttttgggggagggcagagggcggttctttttttagatattgttcctaaaaaggaataaatgcatacacctgtttgtcaaaacacctttgctttttgtgcaactgctttatattaacgatactaaaaaaaaatagctttggaaaaaaaactactgtatgtaacggaattgcagaatatgctgcacatgtattttatttagttatccttgctttaagaatattggatgacatttcctgacatgtgggagggagaaactccctaactttttttttctgcttttaaactgtaacatagttgaagatttcttttttctgttctcattgattggagcattttgtacaggttttgtgtgtgtgtgtgtgtgtgtgtgcgcgcgtgcgtgtgtgttaatctgttttttgatacattcctatcccttgtgtttatcctaccactgccttcctggctatcttaaacaagttcatacatttgaaaagaaaaaaaaatgttgtttaaaaaatgttttctcctgctgcagtaaatattttgcatgatgaaattccagggtcacacttttccaagtttatcagtgaagtagtgattaacaatggggagtgtcaaaactattgaacttttgtataaaaaaaaaaaaactttacaaggtgccaagatgtaaagaaaatctgttactttttttttctcaaagaaaagcatacattagggaggtagtcccgtgtgtcagacaaatgcactgtcaggaatgaggatccaacctacctgtccctagagtccgtcttgtaagatgagttaggctgccccttggaccagccacaaaatggaatatcaaggcttatgtacatacgtgaagagttaccaccagtcctgccacctttggacagctctaacaccatccccagcatccagtcagacctagtaaagaaaaccttggattcttaacccaagataggctgtaaatcactagcttttttttcctcatgaaaaaaaatagagttaaaaaatatttcctctcttttccatattccagctgaactccgtttccaaaggcacaaagaagagtgtgcttattcagattttgaatctttttggtaccttttggttaatgacatagcctcctgaaattctggatgtcttcaaagtcagttttgcttctttatcctgaaaatcagatttacaatgctgaaggcatttcttgggcccagtgtagctcacgcaatctctgctacccataagccttgatgaagatgatacagtccggactgtgagcatggtgcttcatgtatatgtgctgccagtaacaagaatttttttgttttgttttgttttgttttgataaggcataaaagaaactcattccttgacatcaactgtaattccatcattccatgtctgcggatacagacaataaaaaaaatgttgtgtagtcagtactaattactgacattataagcattctcaaatgcaataaaaatgctggttgttcacgctggt

SEQ ID NO: 228 - protein, 677 aa, Homo sapiens
MMQESGTETKSNGSAIQNGSGGSNHLLECGGLREGRSNGETPAVDIGAADLAHAQQQQQQALQVARQLLLQQQQQQQVSGLKSPKRNDKQPALQVPVSVAMMTPQVITPQQMQQILQQQVLSPQQLQVLLQQQQALMLQQQQLQEFYKKQQEQLQLQLLQQQHAGKQPKEQQQVATQQLAFQQQLLQMQQLQQQHLLSLQRQGLLTIQPGQPALPLQPLAQGMIPTELQQLWKEVTSAHTAEETTGNNHSSLDLTTTCVSSSAPSKTSLIMNPHASTNGQLSVHTPKRESLSHEEHPHSHPLYGHGVCKWPGCEAVCEDFQSFLKHLNSEHALDDRSTAQCRVQMQVVQQLELQLAKDKERLQAMMTHLHVKSTEPKAAPQPLNLVSSVTLSKSASEASPQSLPHTPTTPTAPLTPVTQGPSVITTTSMHTVGPIRRRYSDKYNVPISSADIAQNQEFYKNAEVRPPFTYASLIRQAILESPEKQLTLNEIYNWFTRMFAYFRRNAATWKNAVRHNLSLHKCFVRVENVKGAVWTVDEVEFQKRRPQKISGNPSLIKNMQSSHAYCTPLNAALQASMAENSIPLYTTASMGNPTLGNLASAIREELNGAMEHTNSNESDSSPGRSPMQAVHPVHVKEEPLDPEEAEGPLSLVTTANHSPDFDHDRDYEDEPVNEDME

SEQ ID NO: 229 - DNA, 90026 bp, Mus musculus
  misc_feature (1)...(90026): n = A,T,C or G
ttacagaggaggaaactgacatatgagaacggtaagacacttgcaaggtggtgtggatggcacatgacagggctgtgatttgaaccaggcagtctgagcagatagcactgtgcagttcttgagtctgaatcattcctgcgtggcagccagtatgtcatgcttagtgtgttcattaaaactgtgctgttagagattataaatcatccttatccaataagatacacattttcatgcatttatcttgactttcagtagaatacaaaaggtcttcatgacagcctttcttatccctatgcttttccttcttgtactgccttgtagttcatactagtggtggtttgtttttccttccactgtattttcagctggttgttgttggcatattaaaaagttattatttttttggtttaagtcacatgtgtttaccagttttctaaatgctaatatttatttagtcctatttttctgaattttttagaaatattttactacctacaaataataaatttctcttgcttatttcagtataatttttcatttattctttttaaaaatttactgttttagaacattgttaataaaaacaaggattttatctcgtaaatatttctaatgcataaataaatcacatgataaagctcactttattactgcatcttgtgtgaaagtgtttgtgtgttggattgtgacgtgtgcatggtgtgtgaaggttcaagagccttacatatagagaggccagaggatgatgtcagtgtctggccctgtcactctccttattcctttgagacagcgtctctcagtggacctagagctgagctggcagccagccacccattctctgccctcatctgcctcttcagtgcaggcatcactggctatcgctgtcatgcccagctttgcttaggttctaggatccaaactcagggcttgtgtgtgttgagcacctgagcagctgtctctccaggcctagtgtggttcctatacagatatcggcaaggaatgataagttattcttccaaatgccttctcaactccatagaagtcattctttctgttctgtgttaataaagtctctcatctgattcctggtgttgagcagtgtttgccttattctttcagtaaattcatgatggttttcgttttcttgagctgtgactgtgaactgaagctcatttgaaggggagatgcctgagaacccttttcagagctgagcccacagtttgctgcctcagagaagagttgaggtgctgctgtgtattctgtcaacaagcacagggattatcggtctcagaagaaagcctagggaaggctctggaaatttggacatggttagtcagcttttttggcaatgtcccagtttgattctaatgtgtcttcatgtgctatctcctctgtaaaacaaactgtagctatctatcttttcctatagagaattttcatctacagtattaatcatacttgcttggacttttgaaaatatcaataaattttctttataattacagttactttaatttcatttgctttttaaattaacttttattcatgagtgtttctgtctgtggttgctggacccacacatgctaggtaagcactcttgtactgaattgtatctccagccactgcattttaatatttaacaagtgtgtttcttattttttctcagcagtctagtaggctggtggttacttgtattatttgattcttaaagacagaattttgcatagatttgtcaggacatgtcctatagttttgctttaattagtctattttatttttaattggctcatacttgggtttgtcacactattgttttataagttaaagttcatataccgtaaaaaaatcacaaagattctattaaaaattatgaagataccatttatctatggaggttaagcaaagatcagcataagggttgagatgactgaagataaattctgtgacttcctagcatttattctgtagagacaaggaaaaaataaaagctaggatttcacaggtgatggcagccacttgccttgcctgtcagtttttattctattaatagcttcataggaagacagtgaaaaccaccaggcctctgcagaggagggctcgcaatcacaggctttcattggagttatattggaatacataaaaacattttatgattactgattaattggagtatgtacctttgactaaagacattatctacaggaataatnnnnnnnnnnnnnnnnnnnnacctacaactagttttatgcccgcttttgttttatttttaaacttaaataattatgttacctatatctgacattaagtgtgtatactattaccacatatagtgaaatgtgtgtagataataaattagtgttatctatcattgaggttgaaagccaggtcaagtcatattttcaatgtgcaccaagtatagtaggtatgtccatctttttcctagaatactgtcatgtgcagaacttggtctaacccatgagttttcaaatgttctctccttttctttctgtgtatttctttctatttatctattgtgtctgtttggtgggagcgccttcacccctttttatggaattgccaataacatttacttatattgtctagtttcttcactgagaaaagtgtgcccccatattgaacctgcaaaggtgtctgtgcctattgtacagaaggcagaatcctaggtaccatcttcacaatgtcagacatacacacgtatgtgcacacatgcgtatgtgtacgtatttgtgtatgtgtgtgtcatatctatataaatggtattcatccctactagtagaagttcacattcaatttctgcacctttctcttcctggtatacacacactgaactttatattgttctcagcatcattataacacaagtgaagtatctccgtgagataagacatagggcctccatgtcttatctcaagaccaaacagttagatgcaatctttatttgtactaagactttcctaagtaagattttatctttcttctatgctgttacatgtaattttaaaatcaaactatcaccttagacaaggagttgtgaccatgctatcagcccctcctagctcccttttgttcctcccagcttagctccatcaagccaccagcactgacccggcttctttttcctacccacctttactcctagaggtgttgcattaccagtcctacccgagacctttgaatccatggataaaaaaaacacacactcagccttatgattttagaactcacctgctagcacaattgctgaacacaaatacccccggcctggaaatgtgtgcccttaacaaatttttatctctatctctctttctgctcctgtcagacatctctggcaacctacccgaagcggagccacaggctccagctgccccaacatcgtatatgattgctgcatgatgctccttccaaagcatggcagaaaaaccgttctttttccctgcatttgccttttcctcctgggacctggaagtcccacttgtaccttccattcagcaattggctcctggcctcctttattgacaaaatcaagaaccaattaggaaactagaccaagtatcatcacctccccttacatctcaccttttctgtccaataaaataaataaacaaaaaaacttctactagatataaattgaacaaaaccatgacaactaagtaaattaaattatacaatatgaggtataaatgatatctagtctatcaatttgtcagttagacaaagtactatatttcctaactgaaagaattatgatgttatccttggattatgtttagagtctagttgtaatgtcatctgaaagccatgtcatccattctataaactctctcaatgttaaacaacttgaatttgaatatgagatttttgtcagtgaaggaggccaggagccagttgttgggcagaaggtacaggagggacttcagggtctgaggagaaaaagacagatgcagggagagagagatggcttttcctgcaatgcttcggaatgagaacaaagcaggccttggggcagttagggcctacagcctctgccagcagcagtggtcgaggaagttagccggggctagttgataagtttggggaagggggagaaatagagataataatagatgaggacatgtctttcaggcaggaaattctgtgcccagcagttgtgctagccagcatgttctaaaataataaaactgtgtcctttatccggggattcaaaggtcccaggagtgggtgggcaatgccgctgatcccggagcaaaggcagattgaaaagagaagccataaaggattggccatccagagactgccccacctggggatccatcccatatatagttgccaaaccctgatgctattacaaatcctggaaagttcttaacaggagcctgagatggctgtgaaaggctctgccagagcttgaggcagatgcttgcagccaaccattggactgattgctgggtcttcgatggaggaattggagaagggactgaagaagcttaaggggtttgcagccccatggggggaacaacagtgtcaacctccagacccccagatggaccaccaaccaaagaatacacatggagggactcatggctccagctgcagaagatggccttgttggagatcagtgggaggaacagcccttggtcctgaaggggtttcattccccagtagaggaatgccaggactagaaggtggaagtgggcaggtagatggaggagcaccctcatagaggcagggggaagggagatggggtagggggtttttggaagggggacttggaaaagggataacatttgaaatgtaaataaagaaaatatccaataaaaagaaaaaaggaaaaaaaagaaaagaaaagaaaagagaagtcatgtcagaactggcggcttggtggagctaagccaggaggaacaagagagagccaagaggggctggtagtgcagacaccactccctggaaaggcagtagcatgattttaaaactactcacaatactatgtggataagtattttaaggggttaaataggaatggataagatgtagttaaagacaaattaatatcttcacacaatgaagaacctccagaaaggaaagcctttgcataccaaggcatatgttaaaacaggcttgtttcatatatcatctgacaaaacctacaaagtcaatctttcttctcctacctccatagtgtcttcctctgtgtgcgataagtgctgttactatccacagtgaaccatttcagtgagattctttgtttctgaagcacagagatgattgtacagtgactgaggctgcagttatcttcttcattctgaaaccataggcgtgtaatctattgagtgttttcattatcaccatatatcactatatcacttaaagaaaagatttatagagaattttaattggtttaattaaaacaaaggcatgttcaagaaattaaataacttaggaaatatttgaaaggattattggctttatcgatgatgatattactcaatagtataccgttattgtgcaatcttgtggttacattcttttgtcatttgaaaatgttttcaatagcaagttgttcagtgtgtaaatgaggagccctagagcaaagaagacacaactatatttaacagtaatcactatgcaatactcttcaggcaggaggctttgcatatagtaaggtctgcaatgtttgagtccagctctgcattgcagaattgcctaacctgatgcagctctcccatcttctttaaacattagtagaccataaggaaatgcagagtgcctgcttcttgtagttgcactaaagactcagggaggagggtaagggctgaagccgcagcaaacacaagattctttaataccaccaagaactatctgtaagccagtggtcgttaagcacatacgatgataagaaagcattagacactccatttcttactgaaagccatgttatatattgtaagtcatattaaaatatttttattattttattatgtagatgttttacctacatatgtatgtctgttcactatgtgtatgcagtgcccagggagaggagtctaggagagggctttggattcccagttactgttgtggacagttttaagccactacgtgggtgctaggagtctaccccaggtcctctggaagagcaggcagtacctttaaccactgaatcatctctctaagaccatcgggaaatctgttctatctcaagccaaagatcatttaccatttatatcatcaactcaaatcagcaactcaaatggcagttttaaaaatcaaatagctcagcacaatccaaagatgatactagattgctgcttacatgctgaggagtaatagtattttgtttctgtatgggcaagaaacattgtgatactctgaatggtcattagtctcaaaattgagctgaggggcttcaggtggggtttgtccacattgtgtacaatgcgtgcttgctgttgtatatctagaacaaatactgtgtgcaagtcatgacacagcttgtgcaagaactttccatagcaccttggactcactctgcattccactgtaaagcatgtttgtggttgctctgggttcagagccctttactgttatcaggtctttggagacaccactattaatacacacagttcatgaagtgaggctgtaagtgactgttttgcatctgtatcacacagaagtataaaagaaatgttcctttcaccaagctgtatgttactttgatcaaagattaaaagagattacatgcgcagaagactgaaatgctggactctccctgtggtctctggactctgctatggcctgtgcacttcagtggttctttaaggaaatgctctgtccaagtccccatggtctaaaaggacagattcagaaaatggagagacttgatttctcttgcctgagtgcctgaggggtttttctagttttatgctacatatcaaaatatgctctgtaattttacatgtatgttgtttttgttttggctgttcagcatatatttcatatcacaatggcagatcaaaatggagaacaggaaagccatagaaagtgatagatgatttttggaacaccctgcagtgtaggtaaaaagggagtctgaaaaatagaagctatgaaaacaaatattaaaatataatgcacttgggctctaaagccaaatttagaggaaatttctaagtataaagcattctgtttataatgcattaaacatataatcaaaagttacccaaaccacccacagctaacaaatctaaggatgataacgctaagtatagtactacttcatcaaaagtaagaacactaccactctgacccagtggccaatttggattccccaaaatgtgccagcacttcccttcaacaagtagtaggaaactgagttgtcagtgtgtatgctctcattgtacacaagcatggtgagaattctgcagttggctcatctctcctgaatagccagggattattggaattgagaactcgttgagccttagtcaaagccagctggtttagctagctatgaaatgcctctaacaagccatgttgaaggttactgataaggaagccttgatagtcaaaatgaaagttaataggatggtttgtcatttgccaagcccccattctgcacatgcacataacgtggctgcaccttactactggttaggtgcccatcgtgagagccatgggccagttttgagaatcaccttcctaccttctcacactcttcattctgcttgtctaaagttgtatatagtatagagtttggcccagctatatgtgttggcttctcacaaagagttcccccatgctttcatctatattaaagaaaacttttcttattgatatattgaacaggcattctcaggtaatagctcagcaatggtaaaaagtcactttgaagagtgacatatgaacactatctaccgagcagtttactcctgacccacaaacggtgataaatctgttatatctgcatgcttttgtgtcactttggcaacatccctgacaaaaactactttaaggaggaaaaacgtttgactcagtattttggaacactcagttactggttggccttgtggatctaagcaaacagtccagcagcagcagcagtatctgcagtgttctaccctttctggtgtacaggaagccaagagctcaagaagacataaggaatgacccatcccctccagccatatccagagctttcaaatgaatgccaccaatgtctagccttccagtccacaggcccttggggatgattcatagcaagaccacaccagcaaagaagcgctattttgatgttagcccctggaaacgaattttctcaataactatgggaaaaattgtacctgcacaatggaatgctgtttggccagcaccaggggaaaattgggtttcaggtacatatacatggaaaattctcaaccacacactataaagtagccaaacagtagcttatggtgctgtgtgtgtgtgtagtgtatatcaggcacaagcaataaaggatctttattatagttgactaagataaaggatgtgataacaataagtatcatgcatgcccagtgcattgaagcaatatacttggctgtgttttcaatctttataatgtatattgaggggaaatgggtgcttttccttattttgagttttaataagatgggcatgtattttataatgagagaaaaccatttgttcttaggaaaagatctagataaatgtatttatgctaaaatattaacacaataattatttctttgtattcaaaatgtgaaaaaaattcctgatataagtgtacaacaccttaagtactttgtaaatactgggtcttcctacagcctacaaagcaattttgggagttttactaatattctctcacctttaaaagcacctatccatgctttcatttttatcttcatgttatcagtagcatgtgtacatctggttagttgagtgtggtgtatggagcacacacccacaagtgtgcacatgtgcttattggggagagggctatggctgcctgtcatctaagcatttgggtggttactctctctctcaataatgactagctgactaagagtcaaggggaagaataatgagcagtaactcagaagaattatggactaaaatcttttcttcccttcctctcaagtgtggcaaatagtgatctttgtgcaaatagttgaaacaaggtctttcaatgacttgatcctgttaggtaccaatcatgccaccagcatgatccttgtacacttcaaagggaaacctcacctgtactagattgcttaaaatgtctcattgtcagctgtatttcacaggctctacaaagtatggcaattgttcaaaacaactgctcataattctgatattaagttcattaaaattcgttagatattttataacatacaaatttgaccaaattagttgaaacattccaaagtcactgtgggattaatatgcactgcatatggctgcacagtgtatatttcttggagtaactttcacgatgatgtatttttattaggaaagatgacccctgtaaagacttgaagcctaattgtacatggcagcattgttcacaatgagctcagtacagatgaagagtatgtgtaacataatttgagagcacagaacatagatagactgttgggttcccaatcctggctcccgtgactggctggctgcaggccagaaatactacctctctcttcctggctttcttacatgtagaatcggaatataagcaatatctggagagctctgtgttataggtttggttttttttttaattataagaactaaatgtattaatatttgcaaagcatttatacattatgtgagttttcaataagtgtggacactgatgtttgtcactgttgaccatctggatctagatgtgttaccaagtgttaccaattatgtatggtcttacaactattaaatctgtttttaagttaatttgcattttaactatccattcctttgtattgcagttacaaattataatactgtggtagaagcaaattcagattccgatgatgaagacaaactccatattgtggaagaagaaagtattacagatgcagctgactgtgaaggtggcatgccagatgatgaactgccagcagaccagacagtattaccaggaggcagtgacagggggggcggtgccaagaactgctggcaagacaacggtgagtgaagctctttataaagtcttcttctctgtactttgtactaaacaaaaagacaaactgggtaaaagttttaaataaacagtaaaattacttgtatattagtcaatattagatgtcttacttgttttttaaagtagattttgagtcagaataatgttgttttgatagtttgcagagtacctaaaatacatggaatttaatagaactttctaaacccagctgagctttcttcatattgttgaaatgcttgtatttatctttcatttcatattggaatatctaaattaacaataaatttataaagtaataaatgatatcctaatgtaataaaataatccagtatgcaaacatctggaacaaatatgtattatgggggtctctttagtataaccattaactgaaaacaagcaccggtactgtctgtgtgcctgccaaagttagcaaattaaacttggccaggcatctgggaagtgcaggactctctgagaagtggctcccatactcactcctgtgcattcattgaagccccagttcacactgctgagttgcaacctaaagcatcttaagccatgtttgaatttaaagtataggcattacaagaatctgtagctattaagcacaccctttatcctaatgctacagaaatctcccagtaatttagtaaacagacaagaacatcagaaagaacaacaacaacaacaacaaaaaagtaaagaagcaaaaatctaactcatattattttgattataaaatgctctgtcttgtttaaaaaaaacaatttggaaattaactacaaatataatgaattattagctccaagctcatggccatacagttagccctggttgatnnnnnnnnnnnnnnnnnnnnttgtgggcatgagggaagattaataggaatgttagagaattggggtccagtagtgtatgtatgtattgcatacatgtacaaaattatctaaaatcaaatttagaaaatgtaatatgttaaaaacaatataatttccaaaattataataaagtggtaagaacccaaaatgaatttaacagcaagtttaacagagttaaagaataaataaggtagagaaaattacacacaatgtgaaatttaaacagacatatatagaacaggttaggagacactgtagtctgatatatttatgaattccagggaattagagaatatacaacagtaacatctgaagcaggaaaatccaagagtttttcagagctgatgacccatccaagtacaaccaagttatgattccaggcagacagagggaagaatacacacaccctgctgcatttgcccctcagtgaacagaacacagttccaagagaccgagctgtcaaaacagaagccaaacacagcaagaatgctgatagctccaaaagaaaaatgactcgctacacataagggaaactactaaacaagtccgtaaaatttctaagcagaaacttttttttaaaaaggcaaggataaactgtgataatataccacaagtgctgaaagagaagcactaccagtcaagatactatacccagcaaaactatcctttacaaacaaagacataaaaatttccccaaacattataagaaatatggtattcacaaagaaagaaacttagaaaagatatatgaaacaaaacatcaaaatactgtcaggatgaaaacaccaaacaacagacagaaggaacaaaggaaccacagacccacaaaagtggttaaagaaatagcatcatctatcagtgattccatgtgcctgagatcaactctgatcagaagtcacagggtgactatactgacgttttaaattccaactacaaaagactccccttagctctgaggacagggactcaaagagtggtgttgagaattagagaacgtgaatgagacactgttaccacagacagagtcaccacttaatgatagatcacatttgcaaaaatgtgctggtatagtcagcaagatggcctgaccctaaggtcaagaagccacagaacttaagagaccaactccagagaatgtcttctaatttccacacaaactggcacatgtgcaaatgcacactcactaaataaataaagtagttttaaagcttggaaaatacattaacaaatatctcaagtgaggaatagccttgaaggaagaaacaacaatacaataatgcataggcctccaacatagcactctcaacagggctatgtcatttatgtagaaaatcaaccagctgaggaaacaacccccacagggctcagccgcataccagcacatcttccacggaaaatcagggtgacagctaaattaaatatcaaaaacccaccatctttcacaggtggaaggtaaggaaactgttgtgtggcccggaacattatggtataataaaggtcaaaccattggcacaggcagatctcaagagcattgtcttgaatggaagcagtctgtttccaaagttacattttgtaatgattgcatttgacatttctaatagggaaaccttttagtaaataacaatccattgtttatgaggacctaggagagagtatgatcattgttgactagccctcaggacatgaaacaatgacagaactgttttatatcctgttgctaacgtccttacatgagcctctgtatgcattaaagtggatagacttgaacatcaaataacagtaaggttttatatatgttagtatgtgcttcctacatggaacctatagcatcattgatggacatatcatcagtgagttctattaaatatccaaggtcataaatattctagtcttagacaaatactttgaagttaaatatgtgaaggatgatcacccactttattaaatatactgccatatctagaaccaaataaaatactcagtccaaatacagatgccaaaaacccagactaaatattagctatacaataaaatgtgcaaatgtgcataaaaattgaataattttacaagtgttcaaaatgagaaaaaatgtgtgtgtacatatgtagaatgctgtatcaggataacattggagatagtttttatttgtcactgtaacagactgcagagtaatcaaatactctcttaagaaaaaggaatatatttagtaaaatttattggatttcataaaagcaagcatcgtgagaatagtgagcacttccttactgacaagagaacatttctgtgaccaaaaacaatttaagaatgactgttgtcattactcagtcagccatctgttgtaacattcccactaaagaagaagaaagttgatcaggagaagtgagaatttgagaggaaaaagctgtcatttataaacaattcagttgtacacttaacagtgaaatctatagacaaatagatattagaatgagtaatgagtaaagtaatctttcaagttttctgaatacagtatagtaaagtactgggcataatggtagaggacttgggagaccctaggttcaattcccaaattgtaaaacaaataaactaaatagtaaactggtttatagtaatccccatatatagtaagagctagaaagtaagattaggtgtgcatgactagtggaaaattacagactttagtggtggggtacgagaggacaccacagtgtgtaaggaccttcacactcagaaaacagaagagttttaagtacctctagactttcaagttttactgatgttccaggctccttctgtgtgtcacttcgcctgtagtttctgtgcccttcatctcctctgttgagagaagagctcaatcacccctttctccccacaactgacagtgctgcggtgaactcgtcagatatcttgtagagaatccttattttgagtctgatttttcttgtaattagagcagggacatggagtttgggagataacataatagtaaagaatctttctgtgacttcatatcagcaatgcaagatagccttgagctatcactgtcatctctggtctgttgtgataggacatccagaggctaagaagcagaaagagattaaaggcaatgaagcctgagtggtaacatgtgaagatcttacaatcattgggagcccttttgtttgtattggaagagggtggtgcaggagtgcagataggataggactttcacttgtctgaaggtaggaaagaaggcagcagcatagagacggatcgagagccgtagttcagtcaggaggagagaatagagagggcaagaagtatggagttcccaagtaggttttcagagtgagcacttactcataggaagttttgaaagatgtgatctggagtcagagacacaagcttgagaggagcccattgtcatctgttactgacatttgaaggaaatgagtggtggtgtccattaccctcagtcatgttgaaatcaaaggtacatagctttgttcttttatttttcatgtatgtgatcgtgcatatgtgcacatgtatgtgcagatactcacacaaatgtgtggcacacatgtggaagacagaaatgggtatctggtatcttcctttactctccccaccctatcatttgggactgtgtctcaccaaagctagagcttgctggtgtgttggactggttgaccagggagctggggaccttccagtctgcccacttctccttgcccatcgaatgctgggattagatgcagattggccacagcatgtagctcttacatgggagctgagggtccccatacttgtacactgtttatttctgcaccatcttagccatctttgcttttgttttcctgagcctgtcattcatcatgactagttccttcatgtcttccagaataattgctgaaggaaaccaaggatgaagctggggcctggctttagctttcttttacagactatttttttgtgacgctgtgtcaagtcagtagttgctaggtggtggagtgttgtgtttaacagtgatgggaactgaacctgcagcatcatgcatgagtgccagtttctgcactgagctcccggcctggccctggcactactttttaatacatttattccactattttgtgatccatctgtgtcttcacatgttaaataaccagttatactagagttaaccagttttcctacccattctggaagaatgttaccaaaaatggatatgagaccagtttatggttaatttcctatttgttagtaaagagaccctggctgctagtgattaggggttttttggagggggtgaggggtggtttgggtttttttgttttgtttcttagggttttttttggtatttttattttttgtttaattgcttgtatttgttattaacttatcgcataaaaattatctgggtagaaataaaatgtttttatctgtagtttacagaaggaaatcagaagtagacatatatagtggatggcattttcctgtctatgagttctcactgttccaaaaagatcatagacacctgcacttaaatgacagtgatnnnnnnnnnnnnnnnnnnnnctgcacttaaatgacagtgatgtggcctctgtggtaaaaatgccttaacaactatgaacatggattgaaaatcgaaaaacaagagagccgtgttttgtggggggccttgttgcccagagcatgggtgtcttcctggaagagatgagaactcaccctgcagctcctggctgcctatggatttgagtgcagatactagcaccttacagccaccgccccaccttatagcactcttgtccttccttcttctttcccctctgactctcctgtgtcctgctccctctgcctgcagtgagcacctcctttcctttttctgtcacgtacttttaaacctgaactccctcatcccgtggacatgtgtcacctgtcagtgtccatagctactctgggactggattcttgattgttccactaaacaacttgtgaaaggtagagactgtgatgtgctgagatctgtatctctccactgatacccagtacacactacatgctcaagaagtgtctataatcgataccttaggacagtttccctcgaaattctgacttagcattgacctcaagaaaaaaaatttgcctttctttggttttcctttcattttgaaagcattagttctttgttgtttttatatagcactgtttggacattgtttaaattgctatattcatctttaattatatgtcattctgtgtgacccttgtaacacacacaatatgagctatgtaaaagctacctctgcaatgtttatctttccttaaagcatgaatagaatgcagccgcttaaaaaaatattaagtattattaacccatgcataaaatatctcagacctagtaaagcaagataatcattatcagctatttttgaaaaactatagcaatctctgcatctagaagaatggaatagacgttttccctgttcctcttactaaggactagtatccgtgtgcgtgtatgtgtgtgggtgtgtgtgtgcactacatacaaaagaagccagataatgacagtgcagtggagtcctcaggttctctgttcactgtttctctctcctagatgagactgtgtgctagggaagccagcgtccaaaacctcagcaggtgtgcacatgacacaatggctcaagcccgcagcctatattcaggaaagcaacagccttgtgagacagcagacctttgcacagtaactgttcaactatagctaaataccacagagagagctacagtttcctcagtaggaagctctgtcttctaccctcagtgaagactcctctcagtctcctcccacagtgtgggagacaaaagcaagtgactacaaagctttccaccatcctgctgagtagggcagaggagcctcctggagagtcaagatttcaagagcattcactcaaacaagtttcagtagaagctctcagaggcaggaatgaagccttcctgcccagggtgatgtaggaagctgagtgcaggggagtggggagcctgagttcatccctgctttgcagttaggatcagccttcttcctgtcagggaacagatgctgagtgctgagtgacggttctggaaggcattttcctttgcctctctgctgcttacttaaatgagagctgctgtgtgtctccttaaatgatgactaaaggcatccatgtttcctttaaaaatgacttgtgaccattaagaagggactttgaatacaaaagcagtagacactcagaacttagtgacgctagtgttagacattctgagcagaaattaagccagcatagtaacaatcaacagttatgagcatggctgtaacccaaacctagaaagccccacccagtcaaagcagggaggatagaaagaactaaatgacgcgttataattgaaaatatggcaactagaacataagaaaaagtggcaaagaaagaacagtaaacagtagttgagagtgtaggtaggacaaacatctcagctttctggaaagcagggaggagagagagcatctgtgcctttggatttgatgtttatggcatcagctctccagcaaaagaggagaaagagggcagggctggaaaaatgttcaaagaaatgacttaaatattctaatatttggcaaaagatataaagctatgccctgaatagaataagcccagagaagcctatatcacaaaacagcaaagtcaaacttacaaaaactcaagacaggaacagtgacagagacaaatacttgagactgtggctgtagggagaggccagactgagtgacagctgccccttagaaaccattctgaaggccagcagggtgtagctcgcttcttaaatactgaccactgtttgcataaggctctgggtccagagaaagtaacttaggagctaaaggcgttttcagataaaggaaacttccctacatcaagtccaagaagatgtctgaacagaagaggattgtggtggctattcttggttgtcaacttgactacatctgaaattaactaaaacccaagcagcagaatactcctttgagagatttttttccataattaaatcatttgaagcaagaagaaacacttttaatccagatcttttgggaagatttacctttaatctttcccacacttgctgtcagcctacataaaaaaacatggaagaaagaagatttttgttatccacctgcttgttctcactctcaatggagagccaatttcttcaccagcactagagcctactttgggattccagggtgtactgaagaccagctgattctgggactttttttagtagacatccattgttggacttgctctaataaatcctcatgagaaccttgactaataccaagataacaaagacggtgaaggagataggaaagaagaggtatggacagctgtgcagttacacgtcctcttcctgcagtttcctcagttatacatgaagactaaagcaaacacactacaaatatggatacatgaaattagcaaaggcagcctagagataaagttttcatttgtagtatataagctacctaaaaatatatattcaacacaatcctacaatttgtaagtcacaggatgtagagagagttgtacattcatcctatataactattattggcccactgttattgtgtaccatgttatagataataatagataatattctcaaggacttaaaatttctagaaacaaagtaattccacagttatgtaataaaatatttctaatctatgtaaagtgagaatactcacttaatttcaaaaattaaagatttgtgtttattccacaatgctatagacagtcttgcccaactgaaagccaaaacacatttaaaatacaattctgagtccctttgatagacagtgtggccacatgaaatatcagtaccagcatcagcgactggcagcttaacccacagcagtgtgggcgctgtgcttattactacaccttctttgccatggcaagagttcctgtatctgtgtgatagaggtgcagtgcagatgtgagcaccacccactgagccagggcagcccagacttctcaatatagcactggcataatccttagcaagcccttcttaattctaaatgcaaggctgggcacaccttgtgattcattcagttggttattactaaagtttaggcaatgaggcttcctatccttaaattgactaggggctctgcaaaactattcttatgaaatttgaaatgttagtctaccagtttagatgtagctgatctaatcaccttgtttctgaaacatcaacagaatttgagtcaccacaaaaggagcatgatttacagactagcatctgccctgcccagcaagcattgctacaggcaggctcttctcctggaccagagctgcctgttgtcctgtctgagtgttcttcacttacagcaggtctcaggtcaccctgatttctagaggacatgatgcgatcacactgcggtgttaaagagatcggtgtgctttgctgataaggtaaagaagatgtacaagtgttcacagacaatggagaaagccagctgctcagtgaagttttctggatttctagtttcttgtcaatgcaagggccaaattcttagtgaaaatgaagcctatggtcagttggaattataattatcatcagtatgaacttatattccagaataatgttaaaataaatacaaaaactcagctgaagcatatacatagatattactatacctatgtttcccagctctgctgaaaatacattggtgttcatttgaatggatgataaatagacttatcaaaggaacttggatccaatataaaggagtttccaaaactcgatctagagcaatatttgcagaaaaataataacactggaaatatgaatgtatccatgtggatagaaacaataaataaagatgggagaaatgcccagctctttgtggtagaattctaattacatattaataagtaaagaaataggcagattccatgttgataattgcttcaatcaagaaccaaaatgggataaactgaaaaaaaaaattagtaagaaaaaggtattttcatatctaaaagaacttcttctattccattactaattaattatgaagaaacacatcatcataattagtttgaagaaagctggcagacatcttagccagccagataaccaagctcttaggatcagcaatgatgagagatggggacatgccacacatgggatgcatgggccagggcacagcactgcttcgcaggagtttctcttagagtgtgaagtatcaacatactcattcgagaggttcaagtggttcttgctgcatgctacaaaataagtgtccagtgttctccaaaagtgtcagaaacatagcttcaagtcttgaagatgcttgtcacagtctaaaaggttgagttatagatattggagtagattgtaatcaggacatctgaatgcagcataagatactaaagtggtttctgaaccaggaagcctataaaagtcatagaagcctgcaggttagccatgctcttgagtaatggtaatgtcctatttactatagtgcttgttaatgggctctgatgacaggaagctgagtaaaaggtagacaaaaacccgaaacagtttctaactaaaggcctttaaacttgctgctcaaaataaagcataagatgttgtttttttaggttctgtttctctgacaaaaataaaattttcaactttttaaaaaaaaataaactaatgggatagaaggagaatattgaaagctagcaattcagcttatacatacaatgttcgaggaacaattgttctcagacctgtgacctttgactcttcctgatctgcttctatgtttagggtcacctcaaaagacttgaaattgggggtcaatataaatcaagcttttcttagtttccttaggactttgtatcaggtctggctgaattttaagaaacacatcatcatttacctaaaacattgaagaactgggaaggctatgaggtacggatattcagttccaatgctgagtgttgtgaacagctgtatcatcaatcactttactcagtacataattcattctatccttacaataggtctgcatgataactcttatcattaactaactggaagaccaagagtcaagccaagtctctatagtaccaaagcattctatcttctttttctactaaatccaacaggaaatacatgcattaaatatgcctttcataaagggagctagcaatgggtaggtggttagatcatccatccttgcccatccataaagaaacatcttgagagcagttactatgtccagtgctctctgtattttccatggcctccaagaatcactagctttcagattccatgtctggaaaaactaaagcagcaaaatggagaaaaggcaaaacctttcctgtagccagcagcaaatggctcttctcctcattcctgtctccctgctctaacagtgtttaatccattgtgtgttttctatgctgccaggacaaatcaccacacatttgatggctcaaactatacaagtcagttaccttaagccattacattctcagcaggataaagcctacacatacttcctctagaagttcacagtgaggacctttcttttttctctcccctgagatgttggcagaaatgccctcctgtttggttgtaaaaggactttatctcctttctggttcaggcctactctggcctccagagggtacttgtattccttggctcatgacctatgccatagattctttcctgttgctgtgataaactactctgacaaaagcaacttattggagaaagagtttattctggctcagacttcaaggtacagccattccatcaagaatggaaagccaaggtgacaggagcctaaagcatctagattggtagggagagagtggtctagtccctgattttagtgggattgcttcgagtttctcaccatttagtttgatgttggctactggtttgctgcatattgcttttcttatgtttaggtatggtccttgaattcctgatctttccaagacttttatgatgaacaggtgttggacttggtctaatgctttctcagcatctaaagagatgatcgtgtggtttttgtctttgagtttgtttatatagtagattacgttggtggatttccatatagtgaacaatctttgcatctctgggatgaagcctacttggtcatgatggatgatcattttgatgtgttcttggatttggtttttgagaattgtattgggtattttttcatcaatattcataagggaaattggtctgaagttctttttctttgttgggtctttgtgtggtttcggtatcagagtaattgtggcttcatagaaggaattgggtagtattccttctgtttctatttgtggaatagtttgagaattggaattagatcttctttgaaggtctgatagaactctgcactaaacccatctggtactgggcttttttttttttttttttttttggttgggagactattaatgactgcttctatttctttagggaatatgagactgcttagatcattaatctgatcctgatttaactttggtacctggtatctgtctagaaaattgtccatttcatccaggttttccagtttttgagtataggcttttgtagtagaatctgatgatgttttggatttcctcatgttctgttgttatgtctcccttttcatttctgattttgttgattaggatacatgtacgctctacttgtctagcttatctatcttgttgattttctcaaagaaccagctcctggtttggttgattctttgtatagttctttttgtttccacttggttgatttcagtcctgagtttgattatttcctgccatctactcctcttgggtgaatttgcttcctttagttctagagcttctaggtgtgctgtcaggctgctagtgtatgctctctctagtttctttttggaggcactcagtgctatgagtttttctcttagaactgccttcattgtgtcccataactttgggtatgttgtgccttcatttcattaaactctaaaaagtctttaatttctttctttactcccatccttaaccaagggatcattgaaaagagtgttgttcagtttcccatgtgaatgttggctttctattatttatgttgttattgaagatcagccttagttcgtggtgatctaataggatgcatgggataatttcaatatttttgtatctgttgaggcctgttttgtgaccaattatatgatcaattttggaggaggtaccatgaggtgctgagaagaaggtatattcttttcttttatgataaaatgttctgtagatatctaataaatctatttgtttcataacttctgttagtgtccatgtgtctctgtttagtttctgtttccaggatctgtccattgatgagagtgggaagttgaagtcttccactattattgtgtaaggtgcaatgtgtgctttgagttttagcaaagtttctttaatgaatgtggctgctcttgcatttggagtatagatgtttagaattgaaagttcatattggtaaaatttacctttgatgaataagaagtgtccctccttatcttttttgagaactttaggttgaaaatcgattttatttgatattagaatggctactccaacttgtttcttgggaccatttgcttggaaaattgttttctagtcttttattctaaggtagtgtctgtctttgaccctgaggtgggtttcctatatgcagcaaaaagttaagtcctgttcacaaaactagtctgttagtctatgtctttttattgggggattgagttcattgatattaagagatactaaggaaaagctgttgttgcttcctgttatttttgttgttagagttggaattctgttcaagtggctatcttctttaggtttgttgaaagattactttgttgccttttttcgagcttagtttccccctttgttagagttttccctttattatcctttgaagggctggatttgtggaaagatattgtgtaaatttggttttgtcatggaatactttggtttctccatctatggtaattgagagttttgctgggtatagtagcttgggctggcatttgtgttctcataggatctgtatgatatctgccctgatcttctggctttcctagtctctggtgagaattctggtgtaattctgataggtctgcctgtatatgttacttgaccttttcccttacttcttttaatattctttttttgttttgtgcatttggtgttttgattattatgtgatgagcggaatttcttttctgttccaaactatttggagttctgtaggcttcttgtatgctcatgggaatctctttctttaggttggggaagttttcttctataattttgttgaagatacttactggccctttaagttggaaatcttcttctcgtctatacctattatccttttttttctttttttctttttgggctttgttttgtttttgttgtttttatttgtttgtttgtttgtttttcgagacagggtttctctgaatagccctgcctgtcctgaatctcactcagtagaccaggctggcctggaactcagaaatcctcctgcttttgtcttcttgtgtcctggatttcctggatgtttggggttaggatctttttgtatttcacattttctttcactgttgtttcaatgttttctatggtatcttctgtatctcttctctctcttgtattctgttggttatgcttgcatcaatggctcttgactttttcctaggttttctgtttccagagtggtctccctttttgatttctttattgtttctacttccatttttagatcctggatgattttgttgaattctttcacctgtttggatgtgttctcctgtatttctttaggggagttttttatttccttcttatagccctccatcatcatcaggagaagtgactttagatccatatcttgcttttctggtatgatggtgtatccaggatttgctatgatgggagagtttagttctgatgatgccaagtaaccttggtttctgttgcttctattcttatccttgcctcctgccatctgattatctcatgtgctcgctgccatcaatatatctgattggagcctgtctttcctgtaatcctggttgtgtcagaactcctcagagtccagctttctctgtgatcatgtgattccaagctcctgtaaacccgagattctgggtgtgtcagagttcttgacagtcaagcttcctctgagatcctgttttcctgggagcctggaatcctaagatcctgggcgtgttacagtgcctggaagtggtacctcctctgaggacaatggggctgtctgctgtattcgaaactaagttagactagtgctgaccagaaggaacccaagcttctgatcaggcagggctcctgttctttcgctcctgctgtcacaggcctctcacgattgttttgggacagatgttgcattccactcaccagtgatcctaagatcctgggtgtgctagggtgcctgggatgtggagagtcctctgaggatcatgggaccatctgccaagtttgtacccaaggtgtccctaacctggtgccgaccaaaaggggcccttctacctcttaaagtctctgttgagaagtctgatatacttctgatatgtctgcctttgtatgtttcctaacttttttctcttgcttcttttaatatttttcttcgttctatagatgttgtgttttgattattaaattgaagattttcttttcttgtccagtctattaacattaataattgtagtgtactgttattgtatgctttgtgttctgtgtgccaatgttctaaactgtgtctgactttcatatagtgaaacaggtaaaatccttgctttgtagatgaaagaattgatataaaagtggactctttttcaagattcactgttgtatgtgcaggacgtgaagtcaactgttctgaatttagaggtttatgctattagcctctatatagccatagagcattcatgtgaattgggaaatctggtattttatttaatctgtggtttgtttttttttaaagtggtaaacagcttgtatataggcaggtagtttatcttaactcttttagctcacaataaggaagcatagcaaagaaacatggatggctggaaatgaacggagcttagctgatgttattcaccatttcaagtgtatcagatgccagtgtctgtcaagtcaaccctttgggacaacttcaatagcaataaacaagtaattatataatgttgtgcagtccaatgacatcctgttgcagcatctctttcatttaacaatactctctcctttaaactgttccttgaggttaataataaagtctttgcaatttcaggttctaacacctagcagaatttcacgttcattgtaaactctcaaataatgagcatgagaatagaatagttagttcattaaatcattcctataactgtcagtccatttgaccctgctcttagagttgaatgaattaatttgaggtcacaatgttttggacaatgatctccaaattgtacccatagtgagggtaatcgtctccaaacaattctgtgtcttcttaagatccattacagcagccataacttactgagaagttgctgcatgctaggcattagggtgaacatttcatatatattctcattcagactctaggcaactctagtacgttataccctagttttatagcaattaagatttgagactcctgatgttttccttaagtaaaggtaaaatttaataacctgtatgtgtaggtatgttatatatttattagtagtcttttaagcatgtagtgtttcttcctttctggctttcactcttacctgtggcgtccttatttcttagtctaaaagtacccacaggctttctgggttccattccatttgctgtttgtttcatgtttttgaaaaagagtctcattatacaacccacagtctccctaaactgaccatgtagttctgactggtctcaaacttggtaaccatcctcctacctcagtctcccgaagtgctaagatcacacatgtgaacacaagtttgattttacttttatttattaattaaataaaatctattgcagaatataactatcaattggtgaaaagaaacttttttaaattagatacactataattcgacatttccatttatagaattagaacctataattagaaaattaagtgtttcttgtttttctaaacactaacccaagaatcactttttaaaattaactttttgattgttgatgtacagccctatgcactttaacacacacatagtcaggacaaagttacatcagtaaaactcagaagtgtgattcctctctagtgacatcttcctcccacttacacactggctgacatggtccagagtcttgctactatagtttctctccttggggaatgtcataaaaaatggaaccatctattgtgaaactatttgatattaggcacctttcactaagtatcaatatgttatctcttcttttgaataatattacaatagacaatgtgccagatgcatcctgttgcatgttaaagatacacggactgggtctactttgtagacctgtgtaaagcctcagaacactactgtgcaggactcaggaggctgagaacacacttacagttctgtagactaaatggccagaggtagaatttttgcaacatatattaaatatgcttactattgtagaaagccagcaaactgttcagcagagtggctgtgtgacctggcagatgtaggagcagtttctctgcagcactttgctgcttggtcttgttgtttctgtgctgctgctgttttcattgctcttgtacatgctcagtcgtacttggtcactgactgatacccccagccctgcaatagcttttacttttctctgaccttaaatgtgtgtattcatgataagtgtggtttgacttgtatttccttagtacctacgaagctgaacatggttggtgtttccttatatctgtcctcagtgaaccatctgttgttctgagttgttttattacagatttgagttctaaatacatctaaattacagataaacagttgtaaaatcattcctttctgatgctggggattggtcagtgtctcagcacctgctacacacgtaccatgccacccctgagcagcacccctgacccttagtaatactttccagccctcatgttgtcttctcattctcttggcctagacttttcccaggacaaacattttagttgttaaggctgaatcactaagtttttctttttataaaccatgttttcagtgtcatataagggctcatttagttaagatttttaagatgtgaagtcacgggtcatttcgtgattgatatagatgtctagttgtttcaacactttgttggaaagactgactttttgtattaaactggctttgtgttgtcagtaattagtcttctttatttaggtggaactgttcctgcactatgctcagttctcttggtcagttcagcctttgccagcactgcacaaacctgatggctgtagtttaacagatgttctcaaattgggaactattttcctttgcttttcgtctttctaaagttgtcttgtttgctaaaatttctattttgctcagagtttacctcataagtagtggtttttttcattactttgtttcatgttagttaaattatgaggttttgtggctttagcccattgagatggtgggttgtattttaatgaatgttcaaatattgaaacaaccctgattccctggaaagcccaatgtggacattttgtacattattgaatttacaggcaatattctgtggaatcttttgagtgggtgttaggaaggacactggtttgcagctttctttctgaccagtcacgtggctgttgatatcagaagaatagtgggatcctggaatgggttataaaaggtttcttacaaacattttttttaattagatactttcttcatttacatttcaaatgctatcccaaaagtcccccattaccaccctcccactcccctacccacccactcccacttcttggccccggtgtcctgtactgagggatataaagtttgcaggaccaagaggcctctcttcccaataaaggccaactaggtcatcttctgtgacatatgcagctagagacactagctgcgggaaagtactggttagttcatattgttgttccacctatagggttgcagatccctttagctccttgggtactttctctagctcttccattgcaggccctgtgatccatccaatagctgactgtgagcatccacttatgtatttgctagggcccggcatagtctcacaagagacagctatatctgggtcctttcagcaaaatcttgctagagtatggaatggtgtcagcatttggaggctgattatgggatggatccccaggtgtggcagtctctagatgctccatccttttgtctcagctccaaactttgtctctgtaactccttccatgggtgtgttattcccagttctaagaaggggcaaagtgtccacactttggtcttcattcttcttgagtttcatgtgttttgcaaattgtaacttatatcttgggtattctaagtttctgggctaatatccacttatcagttagtatatatcatgtgaattcttttatgattgggttacaacactcaggatgataccctccaggtccatccatttgcccaggaatttcataaattcattctttttaatagctgactactactccattgtgtaaatataccacattttttgtatccattcctctgttgagggacatctggattctttccagtttccagcttctggctattataaataaggctgctatgaacatagtggaacatgtgtacttattaccagttggaacatcttctgggtatatgcccaggagaggtattgctggaactttgagtagtactatatctaattttctgaggaaccccctcagaaagactgacttccagagtggttgtacaagcttgcaatcccaccaccaatggaggagtgtccctctttctccacatcctcgccagcatctgctgtcacctgaacttttgatctgagccattctgactggtgtgaggtggaatcttaggattgttttgatttgcatttccttagtgattaaggatgttgaacattttttcaggtgctcctcagccattcagtattcctcagttgagaattctttgtgtagctctgtaccccatttttaatggggttatttggttttctggggtctaacttcttgagatctttctatgtagtggatattagccctctatcagatttaggattggtaaagatcttttcccaatcagttggtgggctttttgtcttattgacagtgtcttttgcatacagaagctttgcaattttatgaggtaccatttgtcaattcttgatcttacagcacaagccattgctgttctgtttagtaatttttcccctgtgcccatatctttgaggcttttccccactttctcctctataaatttcagtgtctctggttttatgtggagttctttgatccatttagacttgagatttgtacacggagataagaatggatcaattcaccttcctgtccccaccagcaccggggtagcctggacgcggagtctgcagacacccccaagctacccacaagaccctccaagggatctaaagaactctggtgagtggaacacagctgttgctgctccaatccaatctcgagggagctgagactgcattaattagggaagcagaaaaccctgtctgatcagggacttaccttgggggcagagtctgcagatacccacaaggtactcaaaggaccctccacgggatcttaagacctctgtgagtgaatcccaacttctaccaggaggcaggttcgaagaccaggtatctgggcaccttccctgcaagaagagagcttgcctgcagagagtactcagaacactgaaattcaggagagagctagtctcccaaatctgctgatagaggctaacataaacacctgaggaacaagctctaaccagagacaactacaacaactaactccagagattaccagatggtgaaaggcaaacgtaagaatcttactaacataaaccaagaccactcaccatcatcagaacgaagcactcccacaccacccagtcctgggcaccccaacacacctgaaaaggtagtccctgatttaaagtatatctcacaatgttcgtagagtacatcaagaaggactttaataactcacttaaagaaatacaggagaacactgctaaacagatagaagaccttaaagaggaagcacaaaaataccttaaagaattgcaggaaaacacgaccaaacaggtgatggaattgaataaaccatccaagacctaaaaagggaagtagacacaataaagaaaacccaaagtgaggcaacactggagaaagaaaacctaggaaagaaatctggaacgattagatgtgagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgaaacaaatggacttaacagatatctacagaacatttttatcctaaaacaaaaggatataccttcttctcagcacctcaggggaccttctccaaaactgaccatataattggtcacaaaacagacctcaacagatacaaaaatattgaaatcttcccatgcattttatcagaccaccatggactaaggctgatgttcaataacaacataaataatggaaagccaacattcacatagaaaatgaacaacactcctctcaatgatactttggtcaaggaaggaataaagaaagaaattaaagactttttagagtttaatgaaaatgaagccacagcatacccaaacttatgggacactatgaaagcatttctgagagggaatctcatagctctgagtgcctcctaaaagaaactagagagagcacacactagcagcttgacaacacacctaaaagatctagaactcaaggtagcaaattcacccaagaggagtagacagcaggaaataatcaaactcagggctgaaatcaaacaagtagaaagaagaactattcaaagaattaactaaaggaggagctggttctttgagaaaatcaacaagatagataaaccctgagccagactcactagagggcacagggacagcatcctaattaacaaaatcagaaatgaaaagggagccataacaacagatcctgaagaaatccaaaacaccatcagatccttctacaaaaggctatactcaacaaaactggaaaacctggatgaaatggacaaatttctagatggatagcaggtactaaagttaaatcaggaccaagttaacaatctaaacagccccatatcccctaaaaatatagaagcagtcgttaatagtctcccaaccaaaaaaagcccaggatcagatgggtttagtgcagagttctatcagaccttcaaagaagatctaattccagttctgcacaaactattccacaaaatagaaacagaaggtactctacccaactcattctatgaagccacaattactctgatacctaaaccacagaaagatccaacaaaggtagagaacttcagaccaatttcccttatgaatatcgatgcaaaaatactcaataaaattatcgctaatcgaatccaagaacacattaaaacaatcatccatcctgaccaagtaggctttattccagggatgcagggatggtttaatatacagaaatctatcaacataatccattatataaacaaactcaaagataaaaaccacatgatcatctcgttagatgctgagaaagcatttgacaaaatccaacacccattcatgataaaagtcttgaaaacatcaggaattcaaggcccatacctaaacatgataaaagcaatctacagcaaaccagtagccaacatcaaagtaaatggtgagaagctgaaagcaatcccactaaaatcagggactagacaaggctgcccactacctattcaacattgtattgaagtcctagccagagcaattcgacaacaaaaggagatcaaggggatacaaattggaaaagaagaagtcaaaatatcactttttgcagatgatatgatagtatatataagtgaccctaaaaattccaccagagaactcctaaacctgataaacagcttcagtgaagtagctgtatatcaaattaactcaaataattcaatggcctttctctacacaaagaataaacaggctgagaaagaaattagagacacaacatccttctcaatagtcacaaataatataaaataccttggcgtgactctaactaaggaagtgaaagatctgtatggtaagaacttcaagtctctgaagaaagaaattaaagaagatttcagaagatggaaagatctcccatgctcatggattgggaggattaacattgtaaaaatatctatcttgccaaaagcaatctacagattcaatgcaatccccattaaaattcaaactcaattcttcaacgaattagaaagagcaatctgcaaattcatctggaataacaaaaaacctaggatagcaaaaactcttctcaaggataaaagaacctctggtggaatcaccatgcctgacctaaagctttactacagagcaattgtgattaaaaaaaaataaaagcatggtactggtatatcgatagacaagtagaccaatggaatagaactgaagacccagaaatgaacccacacacctatggccacttgatcttcaacaagggagctaaaatcatccagtggaaaaaagacagcattttcaacaaatgatgctagcacaactggtggttatcatgtagaagaatgaattgatccatttctatctccttgtactaaggtcaaagctaagtagatcaaggagctccacataaaaccagagacatggaaacttatagaggagaaagtggggaaaagccttgaagatattggcactggggaaaaattcctgaatagaacagcaatgacttgtgctgtaagatcgagaattgacaaatggaacctcatgaaaatgcaaagcttctgcaaagcaaaagacactttcaataagacaaaaaggccacgaacagattggtaaggatctttacctatcctaaatcagataggggactaatatccaatatatataaagaactcaagaaggtagactccagaaaatcaaataaccccattttaaaatggggctctgagctaaacaaagaattctcagctgaggaataccaaatggctaggaaacacctgaaaaaatgttcagcatccttaatcatcagggaaatgcaaatcaaaacaaccctgagattccatctcacaactgtcagaatggctaagatcaaaaatttaggtgacagcagatgctggcaaggatgtagataaagaggaacactcctccacttttgttggggttgcaagattgtacaaccactctggaaatcagtctggcagttcctcagaaaattagacatagtattaccggaggatcctgcaatacctctcctgggcatatatccagaagatgtcccaaccggtaagaaggacacatgctccactatgttcatagcagccttatctataatcgccagaagctggaaagaacccagatgtccctcaacagaggaatggatacaaaaaatgtggtacatttacacattggaatactactcagctattaaaaagaatgaatttatgaaattcctaggcaaatggttggacctggagggcattatcctgagtgaggtagcccaattacaaaagaactcaaatgatatatactcactgataggtagatattagcccagaaacttagaatacccaagatataagttacaatttgcaaaacacatgaaactcaagaagaatgaagaccaaagtgtggacactttgccccttcttataattgggaaaaaacacccatggaaggagttacagagacaaaatttggagctgagacgaaaggatagaccatctagggactgccgttcctggggatcaatcccataatcagcctccaaatgctgacaccattgcatactctagcaagattttgctgaaagggcccagatatagctgtctcttgtgagactatgccggggcatagcaaacacataagtggatgctcacagtcagctcttggacggatcacagggcccccaatggaggagctagagaaagtacccaaggagctaaagggatctgcaatcctgtaggtggaacaacattatgaactaaccaataccccagagctcttgactctagctgcatatgtatcacaagatggcctaattggccatcactggagaggcccattggacttgcaaactttaaatgccccagtacaggggaatgccagggccaaaaagtaggagtgggtgggtaggggagttgcggggagggtatggggtacttttgggatagtattggaaatgtaaatgaggaaaatacctaattaaaaaaaaagaatgcatcaattcccattcttttacatgataaccaccagttgtgccagcactatttgtttaaaatgctctcttttttctactggatggttttagctcccttgtcaaagatcaagtgaccatagtgagtggattaatttctgggtcttcaattctattctattaatgtacctgtttgttgctgtaccagtaccatgcagtttttatcacaattgctctgtagtacagcttgaggttagacatggtgattccaccagaggttcttttatccttgagaatagtttttgctctcctaggttttttattattccaaatgaatttgcatattgccctttctaactcagtgagaaatggagttggaattttgatgagggttccattgaatctgtagattgcttatattaatccggccaatccatgagcatgggagatctttccatcttctgagatcttcttcgatttctttcttcacagacttgaagttcttatcatgcagatgtttcacttacttagtaagagtcacaccaaggtattttatattatttgtgactattgagaagggtgttgtttccctaatttctttctcagcctgtttattctttgtgtagaaaaaggccattgacttgtttgagttaattttatgtccagctactgcactgaagctgtttatcaggtttaggagttctctggtggaatttttagggtcacttatatatacaatcatcatctgcaaatagtgatattttgacttcttcctttccaatttgtatccctgtgatctccttttgttgtcaaattgctctggctagaacttcaagtactatattgaataggtagggagaaagtgggcaggcttatctagtccctgattttagtgggattgctttgagtttctctccatttagtttgatattggctagtagtttgctgtatattgcttttattatgtttaggtatgagccttgaattcctgatctttccatgacttatcatgaagggtgttggattttgtgaaatgctttctcagcatctaacagatgatcatgtggttttcgactttgagtttgtttatataatggattacattgttggatttccctatattaaaccatccctgcatccctgggatgaagcctatttgttcatgatggatgatcattttgacgtgttcttggattcagtttgtgaggattttattgagtatttttgcatcaatattcataagggaaattgatctgaagttctctttctttgttggatatttttgtggtttagcaatctgagtatgtgtggattcatagaatgatttgggtagagtatcttctgtttctattttgtggaatagtttgaggagggtttgaattaggtcttctttgagggtctgacagaactctgcactaaagctgtctggtccagggctttttttggtcgggagactatagatgactgcttttatttctttaggggaaatgggactgtttagatcattattctgatcctgatttaactttggtagctggtatctgtctagaaaattgtccatttcatccaggttttctagttctcttgaatatagcctttagtagtaggatctgatgatgttttggatttcctcaggttctgttgttatgtctccattttcatttctgattttgttaattaggatactgtccctctgctctctagttagtcatgctaaaggtttatctatcttgttgatttaaaaaaaaaagctcctggtttggttgattctttgtatagttctttttatttccacttggttgatttcgtgctgaatttgattatttcctgccatctactcctcttgggtgaatttgcttcctttagttctagagcttctaggtgtgctgttaggctgctagtgtatgctctctctagtttctttttggaggcactcagagctatgagtttttctcttaggactgccttcattgtgtcccataactttgggtatgttgtgccttcatttcattaaactctaaaaagtctttaaattctttctttatttcatccttgaccaaggtatcattgagtagagtgttgttcagtttctacatgaatgttggctttctattacttatgctgtgatcgaagatcagccttagttcatggtgatctaataggatacatgggataatttcaatatttttgtgtctgtggaggcctgttttgtgaccaataatatggtcaattttggaggaggtaccatgaggtgctgagaagaaggtatattcttttgttttaggataaaatgttctgtagatatctattaaatctatttgtttcataagttctgttagtatccatgtgtctctgtttagtttctgtttccaggatctgtctattgacgagagttgcgtgttgaaatctcccactatttttgtgtaaggttcaatgagttctttgagctttactaaagtttctttaatgaatgtggctgcccttgcatttggagcatagatgttcagaattgatagttcatcttgttaaattttacttttgatgagtatgaagtgcccgtccttgtcttttttgataactttgggttggaagttaattttattcgatattagaatggctactccatcttgtttctttggaccgtttgcttggaaaattgttttccagcctttcactctgaggtagtgtctgactttgtccctgaagtaggtttcctgtaagcagcaaagtgttgggtcctgtttgtgtagccaatctattagtctttgtcattttattggggaattgatgttaagagaaattaaagaaaagaaattgatgcttcctgttatttttgttgttaaagttgggattctgttcttgtggctgtcttcttttaggtttgttgaaggattactttcttgctttttctagggtgtagtttccattcttgtgttggtgttttccctttattatcctttgaagggctggatacctggaaagataatgtgtgaatttgattttgtcatggaatactttggtttctccatctatggtaattgagagttttgctgagtatagtagcgtgggctggcatttgtgttctcttagggtctgtataacatctgtccaggatcttctgactttcatagtctctggtgaaaagtctggtgtaattctgttaggttatatgttactttacctttttcccttactgcttttaatattctatcgttatttagtgcatttgttgttctgattattatgtgtcaggaggaatttcttttctggtccagtatatttgaagttctgtaggcttcttgtatgttcatgggcatctctttctttagatttgggaagttttcttctataatattgttgaagatatttgctggaactttaagttgaaagtcttcatcctcatctactcctattatccataggtttggtcttctcattgtgtcctggatttcctggatgttttgagttaggatctttttgcattttgaattttttgattgttctctatgttctccatggaatcttctgcccctgagattctctcttccatctcttgtattctgttgctgatgctcgcatctatggttcctgatttctttcttagggcttctatctccagagttgtctccctttaggttttctttattgtgtctacttccctttttaggtcttggatggttttgttcaattccatcacctctttgtattttcctgtaattctttaagggattttgtgtttcctctttaaggacttctacctgtttagcagtattctcctgtatttctttaagtgagttattaatgcccttcgtaaagtcctctaccagcatcatgagatatgattttaaatccgaatcttgcttttcgggtgtgtttgggtatccaggactggctgagttgggagtgctggattctgatgatggtgaattgccttggtttctgttagtaagattcttatgtttgccttttgccatctggtaatctctggtgttagttgttatagttgtctctggctggagcttgatcctcctgtgattctgttagcctctgtcagcagtcctgggagtacagctctctcctgaatttcagtggtcagagtactctttgcagacaagctctcctcattcagggaaggtgcatgtaggtctggtgctcagacctgcctcctggctgaagatgaaggcctgttgtttctgtagtctgcttgctcaccctccacagtctgagtgctcacctgtgcagactggtctctgagggacctgggacacaagatggctccctcacctgcttgggtggtcagagccttctcaggtgaccacctctcctctgggggttggggggaaggtaccgggatgtcaggagcccaaagcagggtctgttccagaagctctgtagcttctgcagtctgcttgctcaagctccacagtctgtgcgctcacctgtgcaaactgatctccgagggacctaggacaccagtctagctttttcatactggctatgtagctagctacatggcagatgacctgtgtgtgtgtgtgtgtgtgtgtgtgtgtgtgtgtgtgtgtgtgtgtgtagatgatttattgaaattacttgcaggtgcaagcagcagtctagctggtccaagaatgcctggctgtaaacagaacatccaagaatcctgtacttgctcagtccacaaggctggatgtttcagttgatcttcggtatatgctggaatcctgaagaaataggctctaaagccagtgaaaggatagacttcttagaaaggtgagggcaagcaggcaaagaacagaagcttccttcttccatgtccttatataggattccagcagaatgtgtggcccagaatagatctgagttaaaagtgtgtcttcctacctcaaagattcaaattagaaatggatcttttttactttacattaagcaaaaattccttattttttcagacatagccaaattgacaaccaagaatagccatcaagtgattaatttctaaatggaaacaataaccagataataataacacataaacatgatataactatcctacatatactcaaaaatgcattatatatttaactaggtcataactacagctaacatgatatacctatccctcatacaatcataaatgtatttataaacttacaataggtggcaatgtcccttaaaggacattcttttagtatctcaaacttaaatatgatacacattgatattcttttaattgttacatcacatgataaattgaggaaagaaaacacgaatatctgtacaaacacattcttaacaaaatatgacacatactcatggtagttagtagtagtagtacatggtagtactaagagatgccctaaaagatctcctgcaccccagacataatccttagtacctccattgtggagaggcaatccaatttcctccccttgttaatctgtgtcaacatcactcctaacacttattcctttcttactctataggtttaagggcatcagaagcccaaaatgaccaggggaagtctgagctgccagttcaatggaatgtttgttgtggctcctggaaggaccacatcccactctggaaccaaaatttccagaccagcagaacttaaggtcacaggaacaggaagataagactttcctaatggtcatttggagttatagtgaatggaactattgcctttcaccccttgattccaggacccttgagttctggctatggaacagactgtaccatatattagatgttgactgaaagcacatacctccttctcaagaaccctatacaagccctccaggctgttgctacctacttggcactgtaaccgtgcctttaaaaggccattccatatttctatcaggccagctgcttcagatggtagggaacatggtaagaccagtggattccatgagtgtgagccctctgttgcacttctctggctgagaaatgagtttcttggtcagaagcaatactgtatggaataccatgatggcaagataaagcattctgtaagtccacggatggtggttttgacagaaacattacatgcagaaaagacaaatctatgacccaaaataagtgtcttctcaaggacaaagcattgtccttttcacagagggtgtggtccagtatagtcaatctgccaccaccttgggcagtggtgccatatctgggcctcagtgttgctctctgctgttgatagatctggcattcagcagcagctgtagccaggtcagccttggtgagtggaagtccatgttgttgagcccaagcataacccctttctctgccaccatggccactttgttcatgtgctgattgggcagtgacaggaatagctggggaaagaggctgagtctccaaagagcaggtcatcctatctacttgattctgaactccttctcagctgaagtcaccttttgatgagcattcacatgggacacaagtatcttcatgtcctttgcccatttcgagagatctatccatatacttcttgcccagatgtctttattaccattttccattcatgatctttccaagtccctgaccatttagccaatccatttggctacagcgatgagtctgtgaacaatcacacatttgaccatttctcctaatatatatatatatatatatatatatatatatatatatatatataaccatgtgtagtgcctgaagttctactcactgtgaagattttcctttgccagtgtctttggggttctcccagaaagaggctgtgatgcttcagcagtccacttctaaatggtacctacaaaatgtgcagaaccatcagtaagccaggccaagtgttctcagtcaacagaccacaagaataccccataaggatataggtgcatgtgtagcagcagacagcattgtaatgggagtacaagccacaagtgtttgggcaactttttcctgtaacttgtttgtgccttcaggacctgctcaggtctgatcatgtatatatgccattccatttgataataaattgctgctatgcaagttctactttatgacttggtatatcaaataacacccaactcatgatgggcatttcaggtcatatagcagcttggtggctaccatatatattaccaagtgttcagcttccagttagacccaatagcaggccaagagctgtctttcaaaaggagactagtctgcagatgatggtagagccttgcttcaaaatcccaaaggtttcttctgtgtggatcacctataggggcctgccaaagctccaaatagcacccctgactgccactgacatctcaagtaccatagggtttactggaccatatgatgcaaatggtagagcagcctgcatagctgcttccacatggtgaagagccttctgttccatgccccacacaaagctagcagctttccaagtcacttggtatatgactagaatgatacacccaagtgagaagtttagtggctatagggtctaaatagacccaaaatattgtgcttttttcttggtggtgggaggagccaggtaaaataacttatccttcactttagaagaaatatctctgcatgcccccacaccactggactcctaagaatttcactgaagtagacactccttgaattttggttgatttatttctcattctctgacacatatatgtgttacaaatgagaccaaggtagttgctatctcctactcatttggtccaatcagcataatgtcatcaaaatagtgcaccaatgtgttactttggggaagagatagacaatgaagatcctgtcgaaagtgatgacataggcaggagagctaatatatccttcgggcaaaactgtaaaagtatactgctggccttgccaactgaaagcaaattgcttctggtagtccttatggacaggtactgagaagatatttgctagatcaatagctgcatactagaagatgtgttaattttcttaaataaggacaccacatctggcacagcagctgcagtcagagttaccacctgactgagttttcaatagtcacctgtcattctccacaatccatctgtgtcctgcactgaccaaataggagagttaaagggagatgtggtaggaaccgccacccctgcatctttcaaacgctagatggtggcacaaatttatgcaattcctccatggatgtgataatggatgtgattcactattttctttaccaaaggcagttaactgtaaaggcctccttccatttagcccttccaaacattgtttttatttcagacctacttccactggactctgtcgatctcctacaaaagcatttatccttattttttaaagcactttcaaactcagtgccttgaaatgtttaagtgatgaccccagcctctgcctcactgttgtggttttggtatttctttcccttgaaggttgagatttgctggtttcatatgtcagataattctggactgagcttttgcagtagggttagatttctgattttttttttttaacacttggggtttagcaggcagtatacccagttgtatgtaggctgtaagcagtgagccctttgctggaggcttcggtttcctaatcagtcacagtactatttggatctgtcctgtgccaatacccagtgtcagtggaatgggtggtgacctagactgtgtgtcagttctgtggtcagattcagacataaacactttgcgtagagagccaggggctgactaataatctaacgaggtcactttcctgagcatttccattgtcatgaactcaccagaatttgaggttccctggaaattccccttgtcagtcatcaaatcaaaggtctgggactttacttcctccttggctgctgcagtcctgcagctgcattcaaggaatgatgcagaagactgggaggaggactcctgtgttcagtcaggccggagctccccttactcccagtttgcaggtgccttgaccactgtcatcattgtctctacctggaaaccactgcagggctgaacaaaagaacctggaagagaacttgacatttttctcttctttgagcccctttctggtacataaaattaaactggaccatctcatccaggccataggatgccatagttactagggctgctggtgtcaaaggactccaacggtgacggtggtactttggtaccgtctccagaatacctgctggacttaatctccttgcatctacaggtgcctgctctgtcaatctccccgctgtcagcagaaacatgtgataggaatcatggaccagtttgtgccttcttcatcccagttgaaccttgcttcacattccatctttgtccctgttggcatgtcctcacagacatcatgaactacagttgctgaggcttttccagggggttacacagcttgagtgttccttatctgaagtgtttcctatctgtcacttcttcagatcttaagatactagcgtaaaaggaagcagctgagcatacctaagccaaaccataaagcccaaaataccctaatagccaaaacttacttttgcagttttaaattaggcattttcaatctgtgccacagatattggcatattattagaagctaggaagatacaaaaaaaaggcagaatagcctggaaaagtacagagagcaatatcttactctcagttaaagtttcagcactgtgaagtttgaattcaggaatttgctggcgtttgctgtctccatgggttttcctcagcaggtcagtattgttgggaccaggcatggaaaagctgaggcagagccttcactgccccttagagatggctgtaaaagtttccatgaacaatctaaaatgatgagagacagatgcatataaaccttagaatgtgagttttagagttcagcacatatgctaaatagtgacttctgactttgacaagttctgccatccattcacaagcaaaccttttagatttttaaatgacctgtgtttgccatctctgttttccttaccaggaattatcttatggctaaaataatgactctaaatttccaatataatttacctattttaaatgaatattatttttgacataattgcatatctgtagaaatttcacaaagttatagatttataaaatttcagagactttacatgtcctttagatgggttcccccaattctgcaaaatgataattgaagtcacaactaaaatactgacacttgcattcacagtcagggcacagagctctgacttccatgtcaaggctcctcagttactttagccacttgcccctcccccactcttctccatggcatcactagcccccagcgatcattgttgccatcattttaggaatgacacaaataaactgatgaagtaaaaacttgttgattggtctttttcactttccatggtttttggtgattcatctggtcactgtgcatattatagcacagtccctttaactggtcagaagtaatatataacttattatatctgccgttccttggaaagtcttaatctaagaagtttctcttgattatttattcactttggaatttggacaaaaggtctcaggaatactgttagttcccttttctcctcttttcctatttgtccttgtttatcaagcaaggattcaacctttgagccaaacccctagcccatcacattactttataaacatctaggttaaccagtcataaggtatgaacattgttgtcttctagaaaaaaatccatatgcaaatagattttattgtctcattccccttgtatttccagaactaagacgtgagaacctgagggagagttctcatgtgtcacccaggatgcagactagtgaccacactttccattgctgtccctgtgaatctgcccttgtactaagcctgcagaaaacagagaagagaatgttgctaggaatctcttctacagtgaacaattagtgctcacactgtatgtcagcactgcattgtaaactcacactgtatgccagcactgcactgtaagcttgcactgtatgccagtacttcactgtaaactcacactgcaagccagtgctgcactgtaagatcatactgtaagccagcactgcactgtaaactcatactttatgccagacctgcactgtaagttcacactgtttgccagcactgcactgcactctgtgtttattaatcagctattctagttcttcaaccaatattttaaccccaaaatgagggaaagagtagagacttctagatcttaaagcaaaggaaaactagtaggaaaataaacagataaatctttgccaggtataattttgagaaggtattaatgtgtagaatatataaagaactacacaaattaaacacacacacaataaatgtgctaatgaatttaacagattgttctcaaaagaagagatataaatccttagtcatcagaaaaatacaaattcacgtgactttgggattctaagtccctgaagtcagaatagctatcatcatgaaaaaaaaaaataacaaatgttggcaagaatatggataaagaggaggacccatgtactgtcagtgggagtgcaaattggtgcagctactatcgaaatctctggaggctttttttggagaccaaagatagagctaacatatgtctcaactataccagtcctgaatccatggccaaaggactcatctgtatcctacctactacagagatcctgcacatccatgttcattgcatctatagtcatgataagcaaagaaatggagtcaggcttagatgtcctccaacagattaaatggaaatgaaaatatggtatatataccattcatcaataaagaaaatggaggttgatcatcaaaagagcctaggctctcacaccaagaagcgatgaaggagagtaaatgaagagcttacttaattgaattgcaaatggacttttcattagatgtaataactaaaaatagaaaaatcagtaatatcaaacgctaatgttaccggtagcatcagtgttcatattatgttaccaagtggtaactgttttacttgtcagttaaaggaaaacgaaggacatatgcacaataaggagctataaccatttttaaattacagagttggcatattattatgtttgaagtagatgcattaaaaaaggaagaaagccaagaaaaagaacgaaggagggaaggatacttgataaatcctaattgtcattttgccagcagcaagtaccactgaagaattctctctcataactatctactttagacagcttttccatatttatttgaaaagtgtatatattgtaattgcctttcatataatgattatccttaagtatccatgtaaaggttgataaatttttttaaaaatctgctggtcaagcatgggggccatacctataatgtaataccaacatgcacaaggcaaagcagggcgattgctatggattcaagaccagccaagactacagtgtagaaccttgtcctcagaaaacaaaagaaaaaagtgtggagaggagaggacagactcagagaagggaggactgccgggattcccctggcacacagtccccaggcctagagaaggtatgttctcagatgctgctctttttctcagtagtcaaactcaagagaaatgcttgactgacatcttcagtggaattagatcggggtgtaaatagctgctgtttaatataatgttgcgagtattctgaatataattaggaacatactctgttccaattcaaagtaagttcaccatttaacactgtgtctgctgtgaatgcacattcctaaattattataattaaaatggacctgaatataggaagcagaatttttcctgccccaatgtatacattaactctattccacataagatattacaattaactcactctgaatacagaggtggcatgtgagaaaaataaacctctattataattcgtcagtggatatgatattgaaccgagtaaaaggagaaactgcagtgctgtgtgtgtgtgtctcacaacagggtgtggctttgtcctgctcctcgaggagtatgacagtcagaccagcctacgttcagcctctgttccctgttcctgtgtgtctagcaaggcattggtttgaccaggatcggttgcttcgctttttaacttatacagtgggctactgtgaagatcaatagacaggagctgtgaagcatctcacaaagtgcctagagaccagacatgtggcttggagaagaaatgggggaacctctgctatttataagcactgcccctacctataagtaaagctgttctcttgagcctcccaaccttccaggaatgtgttgcattccttatgtaagagatgcaaaattacctctaacaggaaagctcagcggacctcagagctggggatagcccaactgtcctctaagaatattgtagaaaattgtcttagggctttgtgtataggtgtatatggaacaaacatttcatatttagatttggttctgtccaaacgctatctcatttttttacatcagtattgaaaaatctgaaaattaaattatctgttgtccaagaatagtccagataaagtgtactgaacatataattctaaaacaagaatatttccagaattatctgaaactggtctgacttttgtttctttgagacactgtgacagaagaatctgaccaattttatttttataaaaaaagcacactgcccatttttaaaagaaaaatttcaagataaaatataatccaaactcggtttcctttttgcatttcaaaacttacaatacttgtgaatgtggagctgccttaaccccatgttatttgctttggtcaggaaagaaagggcaaggagtcctagagccagaagctcagggaggtggcgcgggtgtgtgtggagacccgtcacttgcctttgatggaggtctttgtgacattagcttttgaatttgtgtatcctgaatttagtgtatttcctcatcttttatcttcccctccttatatggttaagaatttgagcatacaagacactacagaaaaactggatggttgtagtatttaagtataatgtaaaattacaggtttatatgatatagattttccatctatacatgtgaggagtataatctatggatagtctaaaagtcttcaggtgatactttgaatgtacatgacgattttatcaaagttagaaaagtgcagaactcgtgaccatcttgaactgagttagttagtagctgttgtgctttgagttatatatccacagaaatcagaagacagaaaataagcagtgtctcagatgacactgacaagacagatgacaatgttgattgagttgagtgagcatgtcacagaaaacaagaatcagcttttatcttgtgaactcaatgagtgtagacgaaaatgaaaatcagttccaataaacaaagaggcttgctcctagggaccaaaaggacttattcctaagacaggccaccttctgtagtgggcccaagccagttaagaagcaaaggagtctctgtctggtccaggctttgtctctgtaactccttccatggatattttgttcccccttctaagaagtatccacactttggtcttccttcttgagtttcatgtgttttgcaaattgtatcttgggtattctgagcttctggaataatatccacttatcagtgagtacatatcatgtgtgttcttttgtgattgggttaccttactcagaatgatatcctccagatccatccatttgcctaagaatttcataaattcattgttcttaatagctgagtagtactccattgtgtaaatgtaccacattttctgtatccattcctctgttgaaggacatcagggttagttccagcttctggctattataaataaggctgctatgaacatagtggagcatgtgtccttattacaagttggagcatcttctaggtatatgcccaggagaggtattgctggatcctctggtagtactatgttcaattttctgaggaaatccaccaaactgatttccagagtggttgtaccagcttggaatcccaccagcaatggaggagtgtcctttttctccacatcctcgccagcatcttctgtcacctgattttttgatcttagccattctgactggtgtgaggtggaatctcacctgcccccacctgggaatccatcccataaacaaccaccaaacccaaacaatattgcagatgccaacaagagcttgctgacaggagcctgatatagctgtctcctgagaggctatatctccagtgcttggcaaatacagaagtggatgctcatagtcatccattggactggaacacagggtccccaatgaaggagttagaaaaagtgcccaaggagctgaaggggtttgcagccctataggaggaacaacaatatgaactaaccagtaaccccagatctctctgggactaaactgccaatcaaagaaaacacatggtggaactcgtggctctagctacatatgtagcagaggaaggcctagttggttatcaatgggaggagaggcccttggtcctgtgaaggctctgtcccagtataggggaatgcctgggccaggaagcaggagtgggtgggttggggagcagggcaaggagggaggggataagggattttcagagaggaaaataggaaaggggggaacatttgaaatgtaaataaagaaaatatctaatttaaaaaaaaagaaacaaaggaatgagtgggacccttcagtcatctcttacacatgtcagcatcaaacattttcctgtggcctataagttaagcagggccattaagatgcaagccaaaccctcgtagcctcattagtcacagcatggagtagatcctgtcctccagagccagggggagcagggagcatggagccccagtgctgccatacagatcccacagtcgccgttccaaaggaatgttctgcttctcttaaaccttgaattcagaaaaacatctcttccatagtgctatggttaatttaaatgcttagaggcaagaaaccaaggggaaatagatttgtttagaaagcagttttgctgatatgtctagctacaggtgaatacttaatctgctttctaggaaaatgacacaactcaactgaaaggattgtgtgtgtgtgtgtgtgtgtgtgtgtgtgtgtgtgtgtgtgtgtgtgagagagagagagagagagagagaatggaaggaagagagggagggagagaggagggaagagggggagagagagagggagagggaggaaggaagagagagagagggagagagaggaaggaagagagagggagagagatagagaggaaggaagagagagagtgagggagagagaggaaggaagagagagggggagagagggggggaggaggagagagggagggagagagaaagaggaagggagagggagaaagggaaagagagagagagaaggaagagagagggagagagaggggagaaaggagagagagagactcagagccaatgcacaactttaaatgttttgataggtgactgtggtgtgatcagagacaacaaaggtagattttccttgattgatcattaagtgagaaagttctcagctctcccactttgtctgagttgtgcttagtataaaaagatgaagcacagctctgaagcataaggtgctttgggaattccagcatccacagcacttgaatctaaagcaaatgcgttatagattacaaaaataagtagaatacagttttagctttcaggtatgtgccctacagtttcaagaaagatcatatgttctatcatgataaatgaattcttactttgaaaaacgtgaaaaacaattaggtggtaaaatagctttttatagagatgtgtttctctcagtgaaagacaacgagtgtgactcagatgcagaaaatgagcaaaaccatgatccgaatgtggaagaatttctgcagcaacaagacaccgccgtcatttatcctgaggcgcccgaggaagaccagcggcagggcacaccagaagccagcagtcatgatgaaaacggtgagtacagcttagcacgtgatcctcgttctcagggtaaagaaagggttgctgtttctattcctctattatgggagcatatttctactaaagggagcacttaagagaagcagattcttgtgggcactcatgaggagaatcagtacagcatggagttgatggctattcacagacagagtgacaagccaggcgtgtctccagtgcttcggttaccttccactgagatgacagctgctgtcagaagtgaggagtttggcccattctgttttttgattgtcttggtttgtttattgttattgctttagcaagtaaaagatggtaggcttggctgaaagcacacaaacttgggcacagttgattctctggatctgctttagtccaggatgaattccccatgagtaaagaaagggaaaacacaatcaaaatatgtccagaactcctaaacagaagtcagctgccaaagtctcctcccaagaacaggaatcaaatgcagatcacatgtaaatgtccctgtgagtcatcacatgtaaatcacatgtaaatgtccctgtgagtaatttctcttcatattgtactgagactaggaagagacttgaaaatttcaaggatttgaagagttttaacttcttaactttgtctttaattttccagggttcttggttgagtggatagattgagcttaatgttcaaaacaatcagctttggactttttggaggaaattgagaaaagatggtatgagtaaagaaaagagaactgagatgtaaatcagttggtagactcctaagtataagcagaaatacttagaaggcagcttgacagcataaccatttaccaagacagtggtaacaggttccgacctaggacctccacaaccatgagctttgaacctcattaacataattagacatgaattagacatgaacaggcctcaaaaagctttacttatccccagagcagccatgccaccatctctcagctggcgcatccttcctggcaggtcagtactctagcatgtaggttctacagtgataagttgattgacagctttccctaccttccagtatatgaaagctagccagcaggaagtttcccagttactttgagattaatttctctatgtcctgaagcaaaagtgtatggtgtcttcaggattagggtcttaccatcgagttctgatgctcagccaagagtaatgcagcagcctgtgttctggggagctccagaggtcttcccaaccaacagtgcatcagcaccaagcactgtggctcatttaatgtgcatgccttctgagggagcattgtcccccagggcatactactttcatccagagtccttttttaaattataattttattaattagtaaggcttttcatacatctgtggttttaattaattcaccccagctcctcattctatgattctgaaaacaaatttacatttactttttattggttttttgctagtgacctaaaagaataaattcatacctcatgtttaagagaatccagtgtactgatttatgaaaataaatctgtccagatatcatgaccaatctgtatttttcccaactcatgcttcctggttgcaagacaaatcatgaaaacaagccataggaagcagtgagcacacatagctctctggctctgaagtaagagcagtttggttaatggagccacaggatatggccgtgccagtcagggcacagccagagcagaccttgcttcttggcattcaagccacatgaactccctaagacatgatgggcatgctgacaagggagacgttcaaaatgctggcttcccaccatcctgtacaaaatataacatatatgtccgaaactgatccctaaccaaactctctatatcaagtgtacttgcaagctagtagctaaagatgccataatgaaatctggagctctggctatttaattccactcacagattttcaaatatttcaacatgcttgactagtcatttaaagttcgggttttcaatccctcctctgcagactggtctttaaagagagatgtttagtccatgtggacttgaaatccaggacaacactgcatgcttatgatgaagcatctgaagtgttaccaaagtactttaggtcatctattttctaagagttgaaagaaagtagagagtatagctacagtaaaatatcacttatgaactaatttatttgaaaaataaaggcctaagccacagcagcagcggtcgccatcttggtccgggacccgccgaacttaggaaattagtctgaacaggtgagagggtgcgccagagaacctgacagcttctggaacaggcggaagcacagaggcactgaggcagcaccctttgtgggccggggacagccagccaccgtctggaccggaggacaggtgcccgcccggctggggaggcggcctaagccacagcagcagcggtcgccatcttggtccgggacccgccgaacttaggaaattagtctgaacaggtgagagggtgcgccagagaacctgacagcctctggaacaggcagaagcacagaggggctgaggcagcaccctttgtgggccggggacagccagccaccgtccggaccggaggacaggtgcccgcccggctggggaggcggcctaagccacagcagcagcggtcgccatcttggtccgagacccgccgaacttaggaaattagtctgaacaggtgagagggtgcgccagagaacctgacagcttctggaacaggcagaagcacagaggcgctgaggcagcaccctgtgtgggccggggacagccggccaccttccggaccggaggacaggtgcccacccggctggggaggcggcctaagccacagcagcagcggtcgccatcttggtcccgggactccaaggaacttaggaatttagtctgcttaggtgagagtctgtaccacctgggaactgccaaagcaacacactgtctgagaaaggtcctgttttgggccttcttcttcggccaggaggaggtccaaatacaagatatctgcgcaccttccctgtaagagagcttgccagcagagagtgctctgagcactgaaactcagaggagagaatctgtctcccaggtctgctgatagacggtaacagaatcaccagaagaacaatctctaaacagagtcaactataactactaactccagagattaccagatggcgaaaggtaaacggaggaatcttactaacaggaaccaagaccactcaccatcaccagaacccagcacacccacttcgcccagtccagggaaccccaacacacctgagaacctagacctagatttaaaagcatatctcatgatgatggtagaggacatcaagaaggactttaataaatcacttaaagaaatacaggagaacactgctaaagagttacaagtccttaaagaaaaacaggaaaacacaatcaaacaggtagaagtccttacagaaaaagaggaaaaaacatacaaacaggtgatggaaatgaacaaaaccatactagacctaaaaagggaagtagacacaataaagaaaactcaaagcgaggcaacactagagatagaaaccctaggaaagaaatctggaaccatagatttgagcatcagcaacagaatacaagagatggaagagagaatctcaggtgcagaagattccatagagaacatcggcacaacaatcaaagaaaatggaaaatgcaaaaagatcctaactcaaaatatccaggaaatccaggacacaataagaagaccaaacgtacggataataggagtggatgagaatgaagattttcaactcaaaggtccagcaaacatcttcaacaaaattattgaagaaaacttcccaaatctaaagaatgagatgcatatgaacatacaagaagcctacagaactccaaatagactggaccagaaaagaaattcctcccgacacataataatcagaacatcaaatgcactaaataaagatagaatactaaaagcagtaagggaaaaaggtcaagtaacatataaaggcaagcctatcagaattacaccagatttttcaccagagactatgaaagccagaagagcctggacagatgttatacagacactaagagaacacaaactgcagcccaggctactatacccagccaaactctcaattatcatagagggagaaaccaaagtattccacgacaaaaccaaattcacgcattatctctccacgaatccagcccttcaaaggataataacagaaaaaaaccaatacaagaacgggaacaacgccctagaaaaaacaagaaggtaatccctcaacaaacctaaaagaagacagccacaagaacagaatgccacctttaacaactaaaataacaggaagcaacaattacttttccttaatatctcttaacatcaatggtctcaactcgccaataaaaagacatagactaacaaactggctacacaaacaagaccaaacattttgctgcttacaggaaactcatctcagagaaaaagatagacactacctcagaatgaaaggcggaaaacaattttccaagcaaatggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngctggaaaacaattttccaagcaaatggtatgaagaaacaagcaggagtagccatcctaatatctgataagattgacttccaacccaaagtcatcaaaaaagacaaggagggacacttcattctcatcaaaggtaaaatcctccaagaggaactctcaattctgaatatctatgctccaaatacaagagcagccacattcactaaagaaactttagtaaagctcaaagcacacattgcgcctcacacaataatagtgggagacttcaacacaccactttcaccaatggacagatcatggaaacagaaactaaacagggacacactgaaactaacagaagtgatgaaacaaatggatctgacagatatctacagaacattttatcctaaaacaaaaggatataccttcttctcagcacctcatggtaccttctccaaaattgaccacataataggtcacaaatcaggcctcaacagattcaaaaatattgaaattgtcccatgtatcctatcagatcaccatgcactaaggctgatcttcaataacaaaataaataacagaaagccaacattcacatggaaactgaacaacactcttctcaatgataccttggtcaaggaaggaataaagaaagaaattaaagactttttagagtttaatgaaaatgaagccacaacgtacccaaacctttgggacacaatgaaagcatttctaagagggaaactcatagctatgagtgccttcaagaaaaaacgggagagagcacatactagcagcttgacaacacatctaaaagctctagaaaaaaaggaagcaaattcacccaagaggagtagacggcaggaaataatcaaactcaggggtgaaatcaaccaagtggaaacaagaagaactattcaaagaattaaccaaacgaggagttggttctttgagaaaatcaacaagatagataaacccttagctagactcactaaagggcacagggacaaaatcctaattaacaaaatcagaaatgaaaagggagacataacaacagatcctgaagaaatccaaaacaccatcagatccttctacaaaaggctatactcaacaaaactggaaaacctggacgaaatggacaaatttctggacagataccaggtaccaaagttgaatcaggatcaagttgaccttctaaacagtcccatatcccctaaagaaatagaagcagttattaatagtctcccagccaaaaaaagcccaggaccagacgggtttagtgcagagttctatcagaccttcaaagaagatctaactccagttctgcacaaactttttcacaagatagaagtagaaggtattctacccaactcattttatgaagccactattactctgatacctaaaccacagaaagatccaacaaagatagagaacttcagaccaatttctcttatgaacatcgatgcaaaaattcttaataaaattctcgctaaccgaatccaagaacacattaaagcaatcatccatcctgaccaagtaggttttattccagggatgcagggatggtttaatatacgaaaatccatcaatgtaatccattatataaacaaactcaaagacaaaaaccacatgatcatctcgttagatgcagaaaaagcatttgacaagatccaacacccattcatgataaaagttctggaaagatcaggaattcaaggccaatacctaaacatgataaaagcaatctacagcaaaccagtagccaacatcaaagtaaatggagagaagctggaagcaatcccactaaaatcagggactagacaaggctgcccactttctccctaccttttcaacatagtacttgaagtattagccagggcaattcgacaacaaaaggagatcaaggggatacaaattggaaaggaggaagtcaaaatatcactttttgcagatgatatgatagtatatataagtgaccctaaaaattccaccagagaactcctaaacctgataaacagcttcggtgaagtagctggatataaaattaactcaaacaagtcaatggcctttctctacacaaagaataaacaggctgagaaagaaattagggaaacaacacccttctcaatagccacaaataatataaaatatctcggcgtgactctaacgaaggaagtgaaagatctgtatgataaaaacttcaagtccctgaagaaagaaattaaagaagatctcagaagatggaaagatctcccatgctcatggattggcaggaccaacattgtaaaaatggctatcttgccaaaagcaatctacagattcaatgcaatccccattaaaattccaactcaattcttcaacgaattagaaggagcaatttgcaaattcatctggaataacaaaaaaccgaggatagcaaaaactcttctcaaggataaaagaacctctggtggaatcaccatgcctgacctaaagctttactacagagcaattgtgataaaaactgcatggtactggtatagagacagacaagtggaccaatggaatagaattgaagacccagaaatgaacccacacacctatggtcacttgatcttcgacaagggagccaaaaccatccagtggaagaaagacagcattttcaacaattggtgctggcacaactggttgttatcatgtagaagaatgcgaatcgatccatacttatctccttgtactaaggtcaaatctaagtggatcaaggaacttcacataaaaccagagacactgaaacttatagaggagaaagtggggaaaagccttgaagatatgggcacaggggaaaaattcctgaacagaacagcaatggcttgtgctgtaagatcgagaattgacaaatgggacctaatgaaactccaaagtttctgcaaggcaaaagacactgtctataagacaaaaagaccaccaacagactgggaaaggatctttacctatcctaaatcagataggggactaatatccaacatatataaagaactcaagaaggtggacctcagaaaatcaaataacccccttaaaaaatggggctcagaactgaacaaagaattctcacctgaggaataccgaatggcagagaagcacctgaaaaaatgttcaacatccttaatcatcagggaaatgcaaatcaaaacaaccctgagattccacctcacaccagtgagaatggctaagatcaaaaattcaggtgacagcagatgctggcgaggatgtggagaaagaggaacactcctccattgttggtgggattgcaggcttgtacaaccactctggaaatcagtctggcggttcctcagaaaattggacatagtactaccggaggatccagcaatacctctcctgggcatatatccagaagaagccccaactggtaagaaggacacatgctccactatgttcatagcagccttatttataatagccagaaactggaaagaacccagatgcccctcaacagaggaatggatacagaaaatgtggtacatctacacaatggagtactactcagctattaaaaagaatgaatttatgaaattcctagccaaatggatggacctggagagcatcatcctgagtgaggtaacacaatcacaaaggaactcacacaatatgtactcactgataagtggatactagcccaaaacctaggatacccacgatataagatacaatttcctaaacacatgaaactcaagaaaaatgaagactgaagtgtggacactatgcccctccttagaagtgggaacaaaacacccatggaaggagttacagaaacaaagtatggagctgagatgaaaggatggaccatgtagagactgccatatccagggatccaccccataatcagcttccaaatgctgacaccattgcatacactagcaagattttactgaaaggacccagatgtagctgtctcttgtgagactatgccggggcctagcaaacacagaagtggatgctcacagtcagctaatggatggatcacagggctcccaatggaggagctagagaaagtacccaaggagctaaagggatcttcaaccctataggtggaacaacattatgaactaaccagtacccctgagctcttgactctagctgcatatgtatcaaaagatggcctagtcggccatcactggaaagagaggcccattggacacgcagactttgtgtgccccggtacaggggaacgccagggccaaagggggggagtgggtgggtaggggaatgggggtgggtgggtaagggggactttttgggatagcattggaaatgtaaatgagctaaatacctaattaaaaaaaaaaattaattttaaaaaaaaaaaaaaaaaaaaaaaaaaaaaaaaaaaaagaaaaataaataaaatgtgggaaacttctcagagtagtggaaagtggcgaagtattcctatttaggattctcagtcatgctgttccctgagcgcaccgccccctttgtggtgtgaactcaggcatgtggccacacctgacacggggcacttggaaactacttactgtggcagcagtgagaagagtgagtgccaagcaagctctggagttgtcacagctgtgcaggtgtgtggccaatacaggctgtgctcttgtctctgtaactcaatcctaagttacgtgcattctccacctaacttcacaaaagaagggaagaattatgggtcagagatgggagaattagagccatgactggatgccgaattaataatttgcttgctgtgtaacgtttaacctacttagcctgtatttgttgtcacattttctcatgcatacctggaggtgtcatccacccttcatctttggaggcaggtataaagagaggagcactgctgttgcatgtggcccagggattccgtggtaagtgaccatattccttggatgctttcagtaacagtatctcttccttccacaggaacaccagatgcattttcccagttgctcacctgcccgtattgtgatagaggctacaagcgctttacctctttgaaagaacacattaagtaccgccatgagaagaacgaggacaacttcagctgctccctgtgcagttacacctttgcatacagaacccagcttgaacgtcatatgacatcacataagtcaggaagagagcaagtaagtgaaagaagcaggaggctgccaccttcccaggctgggcgggcacgggggtggagcctcagggaggatgggcacctggtgactcagggaagcttcctggtctacagtctgacagataggagaggatggcttgtgagctttctctttcttgtaagccttgccatcctaacgtaattgtttgcataaaccataacaagtatccctcagagtcgctctgtgaggctctgtgaggctcttgggtatatctgttaacatggtctgtgtgggaagataaacagcggctgttaaaccactgccttcagctctaacaaaattatggggaagctttaatgtgtttaattttctaaaggcaaagagttcacttagcgtaagctgctgtgctttatctacagtagtaaggggagctgccgcctctaaagctttaagtttgagatcttttaggctgaggactcaactttgatgccttattttaattctgtatcaccgtgctccttctgtagaagtataaagtgactattctaactgtaaatcacacctaaagtgttgactgtatatttaatgttaaaactagagaaagcacccaaggaactaaagggatctgcaaccctatacgtggaacaacaatatgaactaagcagtaccccggagctcttgactctagctgcatatgtatcaaaagatggcctagtcggccatcactgcaaagagaggcccattggacttgcaaactttatatgccccagtacaggggaatgccagggccaaaaagggggagtgggtgggtaggggagtgggggggtgggtatgggggacttttggtatagcattggaaatgtaaatgagctaaatacctaataaaaatggaaaaaaattaatgttaaaatcaaagggactttcgtaattctccttttttataatgacctggtaggtccgataccagcaagcaagctaataggaatttgacagtgcctttacaaatcaagtaaccatttcccaggaggctgtggcataggccaggcagcttccagcagtggccaactccttatgtcacagggtgaggaacatacacttgaatgtgtgaggactttgtgtaggtgcctaatacaggccacttatcccataaagggtgttagtgcctttgcttaattgatggatactcctagaaaacatcaaaagaaaaagaagcaacagttggcctgtttgctcaggacttttgacatcacttacaaaatgcaagaataagaggtaacagggaatgtggaataaagggagagcccagggctttcatcagcagtaacccaatggggaagtcttagggaccattgagagtgggaggcaagcagaaacaaagggagaagctggcctgacaggagctccaggggacataggcttgcagtgacagcaccatggaacagactgctttagagtttgtgcatccacagcataatgaaggctgagggatagaaatgtccacatgacttctgaaaataggcccactctacacctgctgcctccctcctggctcagttgttgggaccctgctaaagaacagacagatgtcaaagctgaggcaacaccataaaaacagactcttaaaatccacaatgaccatgatggccacttttgtgatgatttttctggtggatgtgaactggaaggagctatgatagggtggcggtgttataaggaagggggggtgagaggtcttggaaaccattatggaatgttggtctttcaggcctttggaaatcatcctgtgccaagggatgagcatttgaatgtcgtgcaaaggtgtgcacttgatctgtatttccactgctggtctatgtcagaaggacacaaaaagtaataagacaaaggccgaacagccggaagcacacacggctgatgcaacagaagtacaatttagaaacaggaaatttacacgagctattcatcctactggggtgggccaggcactgaagtcaggtccttgttctgtagagggcttgccttcttcatctgtaatccacagccatccctaggtcctcataaaatgtacgtctctgcttttgctaagtgtcctctatttatgactgctacagtgtcaggtatgtaacagatcaacattcagttcacctggaatgtcagacataaaatgccagttctttcttgcagagacatgtgacacagtctgggggaaaccgcaagttcaagtgcactgaatgcgggaaggccttcaagtacaaacaccacctgaaagagcacttacggattcacagtggtgagtgtgtgttttccttctgtgtcctgggccaccaggatgtctctgccaatgataaatctgtcattgcaggttctacgtgtgtcagaagttcctgacgcttttcacttaaagaatactagtgtctaatctctaaagtatataataaagcaaattccattttgctatctgaatagaatataagtaaagatagctttacatgagaaaagtaaaagaaaggagatgaacttaataaactcatggtgtggacccagtgagctaaggcagcacaagaacagagttgtagcataaatgagaatgcagaaaaaggggaggtgttcccagaattgtcaccttcctattgctattcctatttaatgacaaaaacttataatgacaacttagcaatcccatatcacattgtaaagtctgttctttttgtgatttaagtaattttagtgacaaagccagcagccaaggaattgagaacttggtgtgtgctgttgttgacctctgacctcctgattggtaaagcactggtgttgcccagcacctggtggttgtctgagtgctggttgctcagggtcttttggaacggcctttctggaagttttactgtatcaaccattgaattaactctcagtgataaatacgtcaaagctgtttcttgaaaatgctcaaaccaggatccttaaagaaaacatttatctaatttcatgtgtttatgtatgtttctggaaagcataggtcatcccctgcagcctacacacagtgtagttcctcggcctctgtgctgccaaacagtaagcactgattagtaagtaatctaccttcgtattagagatgatttgacatgttagctaaaaagagggtttgtaagtatcaaacttagagtcaaaaaacaaaaataaaaaaaaaacttgaataaggtctatgctgtaattttaccagctctcctgatggtacaaagttggaaagtatagcttatttcaaagctgaatactggtctcgaaacagaacattgacatgtaatggagaaattctgcctcgtgatcaaaagctatctcagtcaggaagtgagtttacatgatgagaagacaatgtgttgacacttaccagcacacaccagttgaggccagttcaggtgacacaaactctccactcaagaatttgtttgtcttattcttcaacttctctaatatgagacatgaatacatttaacacagcaagtaaggcaaattcagaaatcttgagtaaatctgggactacccttcctgataactcgttccatggaagatgctccttaaagcatcataaaaaacaaattatgagagatggagagatggctcagaggttaggagcactggctggtctctcagggaacccaggttgaattcccagcacccatatgcaggttacaactgtctggaactcattccagggtatccaacacccacataggcagacatgtaagcaaaacaccaggatacataaaaataactttaaaatttttttaaagaacaaaatatgatttcttacatcatgagaattgtttcaaacactacaggaaaacttggtagggtttctgtgttctaaccagattcttcagtagaggctaccaatgttttaccctagtgtgatttagaaaatgtgtttctgcagggtggccacttggatacagcccaagtacacagctatttgaaagtctgttttatgccaagggaagagtttgaggcagggcttctccaagtggcagccaaggcctagctgcacacgaccagcctcctgccctgctctctccaggagatgacacagaagttgaaactaagcatttgagaaactgttgcatcaggccattgctgtgccattctctgtgtgtgtgacacacatttgcatggatggatggatgtgcatgtgtgtgccactgtaacctgtggaggtcagtgcagggttggagctgtccttccactccatgagcctcgggcatcgaggtcatcatcaggctttgccgaaagaaccatcatccacggagtcatctcactgggtccattttctttaggtttacaaaatttcagatgagattgacttgaaacttaaaaaagaaagaaacctcatactcttccttcaggaggcttggaaagcacttgttcttcatggtgcttagtgacaattgagctgtatgctcttcagagaacatctgtagtgatttttttcatagttttttttccttttagcttttatattttgttgagtattagagtcccaaatgtcctagattgtcactctgttgtcatcgtcataaagctttagctatgagccctgggcagatccatgcatattgataggctgatgggctgtgttagtagctgagctgtgcactggacaatcccatgtttccactcaggtgggacaaagcctgcctgtccgaggtgcagagccatattcatcactgtggcttggaaattcttgagtaagatctgaccacccccaactcaacccttgaaaacctggagtttacctctgtcttagtaatgccactttctgaccgaactccaagataaaccagtaccataaccaaagtagaaggacatgccctgaagttagaaaccaggaatttaccaacacagtagatttgacttagaataatctattctgtatatgtactttctcacagtggtgcagttatcagggtgattctgaatagtaagaaatgataagtaaagtatgctaacattaatctgtaggttctaccccataaagcagattgtatcacacaatgaagacacataggctcccaatgcctctttcacttttccaaagccacttgactagttcatgccatacctgagctttgtcacgacatccaactccaagccatggctttgcccactgtgaaatacatggctgccttcctgctggctaggagaatactcctgtgactcattcaagctaatgccattgtccagtcactaacagtgatgaactgagctgaggaagaacagtcctcttgttaaacagagctgcacttggcacacacccattacctcgtggccactgtacacttgaatgtggtggcgctgagcattgaactctattccagacagcctgtctgcagattcctaatggcatggggagcatgaagaggtaataaacaggacagggtcctgaaaccctgcctgagaaagcttgggaagggtcctggttgtctcagtctgcagggaagtgtgtagtgaacctggaggtctgcttgtaaaaacagttaggcttgcttggggtggtatcagaatggggagaaggaagaaggcatgggcatgagtgacagcacctctggctcagtcctcagcctgtctattggtgaagtgctttttgaagaaaatgctgcagtttgtagggagcatgctgaatgttttgttgtaaatctgatgaccttccataacacccagtgaggaagtgtctgtgctcacatgctagagcaccatagattgaaaagattaaggaagtggtgcgtgatggagccagaatctgaccccagtctgtgggaaagaacctggctgtcttccacaggagtcctgtgggagacgccatgccttgtgctaaacagtttaagcattgactgataatcaaatatgcaaatacgctctactgaaggagctctacggagaggcttcttagatcccttgaaactctaatatctggtccttcaaatagccacactgctgagaaagacagggctcacctttcttcagcctcagggacttgaccctgcggcagcaggcagcaggcagcaggcagcaggcagcaggcagcaggcagcagcagtctcctttggtggtgcttttgtttagctcttgaaagaaaggaacacatcctgctgtaatactcactggagagatcagcacaatcacatgtcctaaggagccaccagtcttcaaaggtgtgacccacactgagtagatgtcagagatagtggctcgtcagactcagagaatcctaccttactggagctgataacctgtaaccataactgggttagaatcaaaattttaaaattaaacttgtgcaacaatatttcctttaaattttaaaaatatttcaaaagtttatcccaaagtctatctgatggccaaggaaaacaaacacctggtgtcctggttagtctagattgcatttcaagggaggccttttttgcaggggtgcctctggcttcacactgtttgttcttcctgccagttcacaccaatgttagaaggaaccgaatgcaatctgaatacaaacacaaggttttaccatgcccactaatatgagaagctaagtcccttcaagtgcctggtcactgaggaaagctggggttacagacacctctaacacaaggcttcctccccaaaagggagccgtacagacatgaaaatatttatcaatcaaaggcacacctgcttgttaagtctaaaaggagattacatttgtttttcttgcctctaacattaatttctatagatgcttgagtggaaattcaacattacccagactgacaaagtgggataagggaaagttactcgagaatagactagttcttttaacatttgagcattattggagtaccagtgcacagtggatgctgtgtgtgtgtgtgctaagaagggtccctgcatgctctcaatatttttgtagctttgtacttgaaatgataactgtaaataaaacaatgtcatgggcatacagaggagtcatgctttttttttaattgctatttctcttgtaggccgtgtgaaaatgtactgattcagtgatgctgttttgttgttgtttaggagagaagccatacgaatgcccgaactgcaagaaacggttttcccattctggctcctatagctcacatataagcagtaagaagtgtattagcttgatgcctgtgaatggcaggcctagatcaggactcaagacatctcagtgttcctcgccatctctttcgacatcaccaggcagtcccacacgcccacagatacgacagaagatagagaataaaccccttcaagaaccgctttctgtaaaccaaatcaaaactgaacctgtggattatgagttcaaacccatagtggttgcttcaggaatcaactgttcaacccctttacaaaatggggtttttagcagtggtggccaattgcaggcaaccagttctcctcagggtgtggtgcaagccgttgttctgccaacagttggtttggtatctcccataagtatcaacttaagtgacattcagaatgtacttaaagtggctgtagatggtaacgtaatacgacaagtcttggagactaatcaagccagtcttgcatccaaagagcaagaagcagtgagtgcttcgcccatccagcagggtggccattctgtcatttctgccatcagtcttcctttagttgatcaggatggaacaaccaaaatcatcatcaactacagtcttgagcagcccagtcaacttcaggttgttccccagaatttaaagaaagaaatcccagcccctacaaacagctgcaaaagtgagaagttaccagaagaccttactgtcaaatcagaaacggacaaaagctttgagggggccagggatgatagcacttgccttctgtgtgaggactgcccaggggacctcaatgcacttccagaactaaagcactatgacccagagtgccctgctcagcctccaccccctgccccagccaccgagaagccagagtcctctgcttcatcagctggaaacggagatttgtctcccagtcagccacctttaaagaaccttctgtcactcttgaaagcctactatgctctgaacgcgcagccaagcacagaagagctctcaaagatcgccgattctgtgaacctaccgctggatggagttaaaaagtggtttgaaaagatgcaagctggacagattccaggacagtctcctgaccccccttctcctggaaccgggtcagtaaacatacctacaaaaaccgatgagcagcctcaacctgcggatggaaatgagccccaggaagacagcacacgcggacagagtcctgtcaagataaggagctctccggttttacctgtaggatcagccatgaacggttccagaagctgcacatcatccccatcccctctaaacctttgctcagccaggaacccgcagggttactcttgtgtggcagagggtgcccaggaggagccccaagtagaacctcttgatctctcactaccaaagcaacagggagagttactggaaaggtcgacagtcagtagcgtttaccagaacagtgtttattctgtccaggaagaacccttgaacttgtcttgtgcaaaaaaggaaccacaaaaggacagctgtgttacagactcagaaccagttgtaaatgtagtcccaccaagtgccaaccccataaacattgctattcctacagtcactgcccagttacccacaatcgtggccattgctgaccagaacagtgttccatgtttaagagcactggccgccaacaagcagactattctgattccccaagtggcatatacatattcagctactgtgagccctgccgtgcaggagccgccagtgaaggtgatccagccaaacggaaaccaggttagtaaagcattaacctaagtttttttagtgaagaaatctctgtctctgtagaatcaaccagattgttacagctgccatgtttaaatggaacttatgggtttgctttccttgcatggcaggataccttccttcccttgctactcagctgccttagggcatcaaccacagttgagagtgtattctctgaaaaccagtgcatgaactcagctggagacctgactgagcttagaagcataagacaaaatgtgttactcattagttagagtggtggttttctagttaaattttcagattggtgagtttcttctttgcttatgatcactattaaacaaccatgttcccattcaccataaagccaagaaagggtttgctggtacttcgtgtgccaactcctttgttaggagttaggttaacctttggttaaacagagtattctggaactcagatacagtgtttggttgtaggtactcatgaggtgtgcctgtggccaaggagtgccacacctcatgaggcctggctttgtttggttctgggtagaactctgctgtattgctatttgtttctcactgtctatccagaatcttcccatgacactaggcttgatatcgccactttttcatcagtccctttaattggatcaaatgccagagatggctgtttgatcttactgcaggcacagctacagttgctctgtgtcctgctcaggtttgccctgtggcctcctgtgactgccactcactcattggcatctccagaattgtagtaactcataaagaaaccatgcccatgactaatggcactagatttctggggtgtgtgtgtgtgtgtgtgtgtgtgtgtgtgtgtgtgtgtgtgtgatgtatacttgtgtatggacaggtgtgttcacccatgagtgtgcatgtagaggccagagattgacagtgactgtcttcctaatcactctaatattttggggacagggtctctccctgaacctggagcctaccattttgtctagactggctggccccactatctgccatcttcccagcccttcttgatacctttgaatttaaagaaaacagagcttttaccatttcaagtgacttggactatatcaagagctataaagtagagtcacttctacactggcagctagtgataaatgactggctttgcttgtcatatcgagctttcaaaagaacagagtctatgagactctaggaaagacccaaaggtcataggtgacctaagtcttcaagaggctctctgcaggactattccattgagaaaagcgccttttctgaaagtgacttctctgagaccatcttgaggttctatgtcatgtcttgtgtattttatgaaaattgtaagggttctcttttacagacagctactcctatttaaaaatctcagcccctctcacacttttcctcctcattccagggaaagtatggaccaaagcaaatccctcttcgccagaccaagggagctggtacaaaggcctccaggatgaaggacacactttaaagacattgtctaaactatgtctcaattcttagtgaaacgcagaatttttatgaaaagcacagtaagggctggtgagatggctcagtgggtaagagcacccaactgctcttccgaaggtccggagttcaaatcccagcaaccacatggtgactcacaaccatccataacgagatctgactcccttttctggagtgtctgaagacagctacagtgtacttacatataataaataaataaatcttaaaaaaaaaagaaaaaaagaaaagcatagtaaatgatgaattggaaatgagtggtgaattatcaagctcattgattaaacctttctgcaaagccactctaaaatcataatttgccagaataaagtaaatatggctgctgtccatctgatgtcttcttctggtggcctctctttttggtacagttgaagaatgttttcactatacccttttctgtgttgttcccagcctcacttgtgtctctctgggcctgtttgtagtaagtactagtgccccgggagctgtccgtagccactgtagtgtgtgctcgctgggctcaggtggagggcttcacatctaacatgaaatttctctcttgtgcatctcttgactttcctacatttattgacttattggcagtgggtgctttgtgtgccagctctcacacgtggaggtccgaggacaacttgtgggagtcagttctctcctttcaccgtgtagatcccagggattcaactctgctcatctttctttgtggcaaatagctttgtctgctgagccatctcagtgaccttatctcttgggaatctttttctttgacatttaatcttctttttccacttaggatgaaagacaagacactagctcagaaggagtctccactgtggaggaccagaatgactctgactccacgccacccaaaaagaaaactcggaagacagagaatggaatgtatgcatgtgacctgtgtgacaagatatttcagaagagcagctcactgttgagacacaaatatgagcacacaggtgtgtgggggacctgggcacgaggttctaaaggtgcctgtggcccagtgcacatgaaacatgcccatagtgtgtgacgttctcagctctgctccgtggtctccacttttcacatattcctactgcggagcagtggcttggctgtctgctgcctagactcccgtttcgcctttaatgccttggtgtctatgctgacagagcacttgctctgcataccttcattccttgcatctcagcttctgctgcacacaaggtgctgaagtgtcaggaagaggactcagctccagaaagcagccagtgagcaccagctctcctggtgcaaggcttgcctcctggtcacccaaaggttttaaaaggaaagacctttgctttgttagaaagaacttctgcataagaaactgaacttgattttaagatcacttcagcccaaagattctataattctccccaaaatacacaggccttaggctgatctaggaccaacaaacaatgtcttgcaaaccaaacaaggcttcacttagctctctgatgcttatgagccgagactagacttttacattttttgtgattgaaaaggatttttttaaagataaaagtcaaactttggcatcctaaatgatgttttattctgcccagtcatccctcacttgcctgttgctgattacagtggggataaaggccagctggtcccaagacactttactagtgagggcttttacgaaagatgtttgctgatgtgcccctcccaattccctctctccatagccatgctggtctattctaatttgtgtgtctttatggcctgggaagtccagataagaagtatgtaccaacccctgtccatgactgacctcaagcctgaacagctttcaaacaactccagaattcccatagtttagcaacaggctcctagctgataagagctgcatagccaaccagtttctctccaacaagatggctagatgaaagactggtttcatcgtaactaatccccaggatcttttccctggcccttaccagccacttacctacagttgaagtagcaacacacagaccctcagcctctcaccaacaatggtaactcattcccctggtgagaagacacgcagagaagcgggacacttgggtggctgctgaggttgaaagctgtacctctctaataaaagcttgggaccacagccctctacttatattcactgagataattaggaaatctcctaattctttaaaaagagttaaatactggtaatatcaaaattaaaatgacatcctagctgtaaaaaaattttcaaaagtaatttctggatttttaagtgttgactggctcatagcactgtagttggtaatagccagtcctgattatgccagctgtcctctgtgtatccactgttgctcaggccacacccactcatgaggggcaagattgcagccttgtggggcaaaagctattttagatgttataaagaatttccacatcagctctacatttgtgaaaatttgcccataagtagaaagagctgtgagacatcaaaatgccgtggaagcccctcttcctgagattgtcaccctggctcatgggagcctcacttataaatgttctgccatgtggtcctgatgtatgaatttttggcatttccaccttttataattagcactggcctcatctgcaaagcagtgtataaccttgaattttcacatagaaaaaaatgaaccatagtattatcgtacaattgggaacctgccagtttcttgaccatggaactgtgaccctccccttgcacaatctgaatgtcccttcattctcccaagcactctgtttatttctgccagtgttctgtttcatagctgcgttcttaccttgcaggtaagaggcctcacgagtgtggaatctgtagaaaggcatttaaacacaagcatcatttgattgagcacatgcggctgcactctggggaaaagccctatcaatgtgacaagtgtggcaagcgcttctcacactccggctcctactctcaacacatgaatcaccgctactcctactgcaagagaggagctgaagacagagatgctatggagcaggaagacgctgggcccgaagtcctgccggaagtcctggcgactgagcatgttggtgcccgggcgtctccctcacaggctgactcggacgagagagaaagtctgacaagggaagaagatgaagacagtgaaaaggaggaggaggaggaagataaagagatggaagaattacaggaaggaaaggaatgtgagaacccacagggggaggaggaggaggaggaggaggaggaagaggaggaagaagaggaggaagaggaggaagtggaagcggatgaagccgagcatgaggcagcagccaagactgatggtacagtggaggttggagctgcacagcaggcaggcagcttagagcagaaggccagcgagagcgagatggagagcgaaagcgagagtgagcagctgtctgaagagaagacaaatgaagcttaggagttcttctaaaaggaaattctacttggtaatgaaatttgctctatattacccacgcttttcatggaaacatggctccatggctcctgtgctatggttcctgctcactactgtgtaatgtcagaactgaaaaaaaaaaaattccgggtgtgcctgaacctcaaacctagtaatttttcatgcagttttcaaagttaggaacaaatttataacatgaagcagcttagaaaacattaatgactcagaaaacaaaggtttctcagcaggttacaggaggctggatgggcgtccggcatggctagcagtattatcactcttacgttggctcattcttaagctctacaatgggagaaattttataatttttttattggtaaacatatgctaaatccgcttcagtattttattatgttttttaaaatgtgagaacttctgcactacagaattcccttcacagagcagtagaaagcagttcaaaccgtgctggctacctgctgctacccagtcagtcaggagataggacctctgacgttagatgccgtgttgccatctaacatgtattgctagccttaaggaagcagccagagaagagctggagtttcttactcgtgtgatttttaaatggagttcaaaggttgtcgttgagtcctgactccagggacgaccagtgttgatgtggcaaggccggcagaggcggcagaatcagtgttcgtgattgtttgcgtacgttagcaaccatgaaggatctataggaagcaagcgctgtgtccctttggccttaagcaagacctgtgctctaagtgccattctcagtattgcaaggctctgacagccttcccgcagtgtggcctatattaactagcagttgttgattcgtttgttgtgtcaaaattcccaaacaaaactcaaaaccactgactgtgagagaagctgaagcactggggcatctcacacttttgttcctcagtagtcatttcatgttgattgactctcagaagtctctacagaaataaaagggaaattctccaaactacttaatccatgtacttgcgtgtcaggcatggatacgctattggtttttggttcacagccgttttccaaatgttagttattacggacccaggtgatgaacaacagcagctgatttttacctaccagtattattttatttcttttagtttatagatctgtgcaacatttttgtactgtatgtctttaagcctggcagtattaatacccttcttactgacacgtacttttagttttagaaaacttttatatttatgtgtcttatttttatatttctttatttattacacagtgtagtgtataatactgtagtttgtattaatacaataatatattttagtatgaaattttggaaagttgctaagatttacagtagagatgcagttggttcccgtgcgttgagatttgatttaacagtgttctgttaacatttatacttgcctccgactgtagaccagcctttaaatgggaaggtattagttttacaactacaatcaagtcattctccctttccccagtttttaataggaaactcttacactttgacactcactgtgtgcgactcatagcatgccgctctgcagtcttctgttaagagttggcccagccataactcattcccttagcaagccaaattagaattgccttctgtaaacagtgttgggaacaatgtttaacatgtgccaatttgttcctgtatccatgtatgtaagctaccaatctgactcttccttttaagttccttgttacaccatggtcattttctagttttttaccagactccccagctcacaataaacgcatcaacaaacctgacctgctgtcgttctttggatcatcaaatttcctttggaaaattgtctatgaagtgggcattacatcctagagcttcattcatcttgagctgagtttgttgacacaaagtatttgagacacttagcacaaagaatgccttttcctgtgggggaaattccctgaggaagccctctgcacaggttgtcccttcttccaaaacccacagagcaagagccttcccctcagggaacatcagggctgtgcaagcttaagatgctttttgcttgtactctgccactctttgaacccttctcattcagctcaaggactgtcactgatgttcctccccatgtcatggtcatgcctcatgtgccccctgcccatgaactgcctctcaacagacattcattgaatgaacacagaaactgcacatttgcagagcttagctgtgctcactgttttgcctctaatctgaaagttcataaggtaaatgattcccataatgtgccggtggtcttgtttgagtcttataggcacttaccataggagatgtaataaatgactgccttggaagctgctctgttgttgtgatgtgtggagagcttatttctaggtgtctttcgggtgctcaagtttatggtacggggtacaggcattgaaagctcagggagggactacctcgaaaatacttgatagacctggttctgacagagttaggacacacatcctatgccaggaccccacattcttacaatcttgtgtgctccccatcttcccacaccacagcccttacttcccctgtgtccactgtcagcagactgcctaatttcctgtccctaacaccagctataccaaaaaaaaaatgtactgtaaaggttatgagatgctaaagtaccattcttaggggatgtccactactcatgaaagtaaatcttggagaagatggtgcctcatccgtgagcctagaaggctaatgaaactaaccacattatcagggagcaggtctttccagtgccccctcacaccaggaaagagtggcattggtgtcctgagatgcatctgccttgctgcttttatcaagattatgtttcagagagccttaaaactacctgggaaagccatatggccatagccacatgaagaagacgtagaatggggctctgcacacagacctgtctgactccaaggacatgtctctgtccagcctgcatcacatgtcatgttgaggtggattctcctggcctagccctaggcaagaggaatagaaaatacccctgagagcagcatgcatcctggcagaggaaggtggagacttgggattgttctcagtttccagtgcaaacttgaaagatagcctaagggagggaaaggggttaaactcacagagaaatctaatcctggattccacctgagatcaccgggaagctatattaaagcaaccatgtattaattctacctctgacagaacttcagacctacagacacacctctgcccagtaaagacaaattcacccagaacacacatttatttacctcaataactcctgggtcatttacagggaaaaaacatagggcataacagaattctcacttttgagatggaaaccagcctaactactcagtggttaaaaaaaaaacacccagaatgcctgacgacctgagttccatccctagcactccagaatcccagaacccacagtggaaggagaagaccaactctaatattgtcctcagaccagcatttgcatgccattcatgcacacacataaactaatcataaaattgttttaaaacacccatagatcagtaataaatacatttttaaatcatctaaattattacaaagccatatcaagttgttcctgatgaaaaatatgactcacaatgatggcatcttatgtcaaaaattgtagtataaagttaagtgatatgtacaagagaaggcacagtgttaaatgctgacaacaggagagaacaaaggactcatacaagcctccacctcaaactgtacaagtaaaacacaaaacaggagagagccgataataaggaaaagagaaaaccgtgacataaaaaagccatgtaaaccaagtcaacctctgaaaaggtagatttctagccatacagtccgaggtagatagaagagacaaattgccaatcttgacagaaacaaagaaaagccatctacagaccctacagagtaagatacagaaggaataactgcatgtccatgtttctgacagcttggggaaaagtgccacattgcttggaaggccataattaccaaagctcatgcagaaataacctaagtgcaatcaaaactaaattgattgccaaaagcgtcctacaaaagaggattcacagcaggtgttgctactggtgatttttttgtttcatacatttgaaaaagttgtaccaattctacacaaatcatctccttctccaattgcctgtgaagctcagatcaacaagggcatttcaatacaagagctacagacttaaattcctcaagaaaatagatggaaagaccttcaactgaatattaggacattactttgaacactttatcaacaggaaaaatgaatcatgattacgtgtgatttttccctaaaacttcaagattcatggagcatccccaaaagtcaagtagtgttactcccactaacagtgtacttaagagtgcttggagattctgattatctcagaagtgaaagagaaacaatcaataaataaatcagtaaaaccttcaacagcaagccagaaattaccagcagtctaaaagtaggaggtgatctctgtaataattgtcatcttcaaaacctctacaagtaaaacaccagtgtgaaaggcccacaccttcctccagatgaggagcaagaccagaaggttacactggctaaaccttaggctgggtcctttaaggacagactgcagcagtatgttacctgcagtcagcctagttgtctacagaggaaacaaggaatttttaaggaaaggtcaagaagttatgagaattcagtcactttctcccaaataattctagatgtgggaatttacacatagacacagttccattaaaaatgaaaatatttggtgatactttaaaagattcaaacaagacctgtgcactgaaagctccaaaatattactgaaataaattaaaaatgcaaagaaaataaaattccatgtttgtgaatcagatgaagacagtattaagaaaagttttaccaaggtaactattgacacaatgagataactactgacacaatgacataactactgacacaatgatgtaactactgacacaatgatgtaactactgacacaatgatgtaactactgacacaatgatgtaattactgacacaatgacataactactgtcacaatgacataactactgtcacaatgacgtaactactgacacaatgatgtaactactgacagaatgctgttctaatcaaaatgtcaactacatattgaagttttgtggaagaacaaaggactttaagaaaataattttgaaaaggaacaactttggaggagttggaatgtgtagttttatgatgccacaatagtcacaataatttactgagtgtgagaatagccatagatgaagaatatgaaatcaacagctaggacccacacacactgtcaactgatttttgtcaggggtgccaagactacagtgataaagtattattcaaaatgtgatgctaggcctcatggtatatgatctactcctgcaatcccagcactcaggaggctaaggaatgaggaacatgagtttgagaccagtcaagccactatcaaacacacaaaacaaaacaaaaacaaaacggtgattctggttaaattctcagaaaacaaatgtgctcctcacagcatgtacagaaatggacagacattagtgagaagcctgagtatattaggcagctaatctgagataaaaatcataataaaagcactggtggggtaatttaccaaaatttaaaatttctgcccttaaatgacataaagtaaactaaaaataaaattggtataagatatttatagaccacacatgtatattctttttgaacatatttttattgaatattgtctttatttacacacatatatattctatatacccttaagaagccaaaacacatccacacaataacctcttgtgcgtagtcgtgtgcacatgtgctaagtatagaggagaatagcaacaacaccattttttaaacaagtaaataaggtaaggctaaccacaatatgctacactgtacacacaacaaaatgttaacacatgaatgttaacagtatagttgtagctaaaagttggcagtaaaaccaagtcaactggctaacaaaatatgtaaatacaataaaatattatttgaccatgaaaagagatgaaattgtagctcatacaataggctggataaatcttgaaactgttgtgctgaatgatgagcatcactgaccaaagactacatgctttgcctccatgtatgacatatccaaagtaagcacatctatacagagaggaagattaccagctgcctcggggaaatgatgatgaattcttgtggatacaggtttccttggggaataagaagtgttctagattgtggtgctatttgggcaaccctgtactaacccgtgtaaccacattctaaatggttcactgtgctctatgaactgtattaataagtctgctaaaatgtgtgcgtgcgtgtgtgtgtgtgtgtgtgtgtgtgtgtgtgtgcatgcactaagtacaaaggagaatagcaacaccatcatgttttaaacactaaaataaacaaggttaagctaaccacaatatacactatacacccaacaaaatccccacactatttgcatgtggctggtgggaatttaaaatgccatgtcctcttggaaaattacccatctagagaagttcagccccactccttgaggcctagccaagataaatgaaaacacaggtcttcctgaagaactgtatgtattatgatacactggagtcaggatagcctgtccagagttattccaaatgtctgtggcctatgatggagtaagcaggtccacccatggtagtgggtttcactcagtagaaagcacaatgtaaaagaagatgaaaatcagagtgggtagagcagaatgcagagactacacaagggcaatgcgttttccaaacccctgaactattttaagtttgaactaggtgagtttgtcataagcaaataacaataactcaataaggctgattctttttaagcaggtatggaccacaggcacaagggaaaccccatctcacataaaagatgcagccactccttgtgcaagtaacattgaatattctaccccaaaccatctgttcttattggtttgaaaggaaataaatcaattatactaaaattaatccttggggaaatttttcaacttaatgctggcttccatgattatctcttttagttgcagcacagttcagtatccatttgaaatacatcattgctgaaagccttatgagtataattttgtgaagcttgattttgactaaaataggctctctccacctgctgttagatgtttttaagctaaggtaactgaagatcaacacttaatatttcaactgcaggaatgagtgccacttttcggaataatagtattatgttggagactagattgcgtttggggatgtcagcttcacataacccttatttcctccattaattgcaaacagacccaaagcagactttgtatctgaacatagcagcacaaagcctggctgaggggttgatggaattgcttttgttcagaacaccatttctgtcatgaaatgagtgatatttttctttcagcctttcagccagaaggtgggaaaagaaagcagtgtcctctcttttggtgtgttctaggctgactacagctgcattctctttcatctagatatccagaaaatgttatcctgttgctgaaacccagaccttggctttggcccagattgcagatctcatctgcacagtgggtaggcagctcagtcatgtctccattccaaagatgacctaaagacactggactgtcatactccagaccagcatggacaactaacttgcccatcacttcctgcagccatcccagcccagagccaagttctagaaccatcttctagagtgaacacctctaagttctaagtttctaagcctgctctcaggccaggctgcccaggcacacacagtctgctttctctgtgtctgagatggccatgaactaagacaggattttagaatccgggtcattttataaaatgcttcccctaagaatccagtcaattttagggataatagtatgcaatacaattcaacctaataaagctactgttttatactcttcaaaataagtaactaggaagtgttcaggaccaccagtaaaaaaaaaatcattagagttcttgtgtggatcattacagctaatgagcattcccaatgaaaacaaatgatggcacttgagctattttaagttagcatggtttgtggttactggttatctatcactaactaaaacccttaatctagctgacagtatgacacagaacctatggcaccatgctagactattggaaaggagtggctctagaactatagccttaaggtatgtgcatgtatgtacacatgtgttcatgcatgcatgtaaatatgcatgcatgtgtgcctatgtgtgtatatgtgtgtgcatctgtgtgtatggtttgtgttcatcatgtgagggcatgtgtatatacatgtatgtgtatatgcatgcatgtgtgcttatgtgtggaagtgtgtgtgcatgtacaggagaaggtgtgcagctttctatggcctacctcaatcctaagtgtgtacctcttccacctgcctggtcctgaattgtatcctttctaataatctagtcaaacctaaagagttttctttaatcctgaaattatttgtaaataaccatgcacatgagtttttatgtatggtatgaccacaaatttatggtcaccagggcaggaaccacagagtaaattcacacagcaacaaccacccaattggcctccaaactcagtcctgtaatgtctgccttgaagtatcacactctccacgggatgttcccaggagtctggggacagctctgacactggctttgccttagtgactccaagaagcctgaagaaccttcttcagcttttggtggcccactctgtcacgagccttttcatgttctcattgtaattcatgtttggatggtggggctccatgggcttctccagggccagcacctcctacattttcccttgcaaaggcattcagttctgtgcctcctgggatgtcccatcacatcaacatatcccttgaatgagcatgccttccctctcctgagccttcttggtgccatatgggtacctccctgataatgtcatggaaggaagcttaatgaatcctcatactgttgagattcacagctggacttgaaacgtctctcagtgctcaagtgttgaagttgggttgtattttcctttcttacatcttgtgggtggctaacaattatgtagtgagttaatagatgaattaaaaggatgaagaagagggatgtgagtgcagcaggggaggttgctttcacgttttccctgcagttactgggtgcagtaaagggggaaataagtggccagatacagttaggaactgctggagtaagcacaagggaacaggtgacttataggaagtttcccagtgccccaggttgttttgctctttactcttgtagactcttaggacaggcatgtcttgtttcttctgcttttcagatttatttgtatgtacatgggtatgcttctatatgtggtatgtgcatatgaggatgccagaggtgtccaattccccctgaatatagacttacaagcagctgtaagatacaagacatggatactaggaaccaaactctggtcctccaaaagagcagtatgtgctcttaagcccagagctgtctctccaatctatggacttttctctctagcccctagaatgtatctagaggaacttgatttgagttaatgtaattaggcaaggcagaggagctttcagaagcaaggttcatcttgtcgtggcacattttggagaactgccaaggttgggaacatgaaggtgactctcacagcagtataccatgagtgacagaggtagaaaggaacaaaacaggcagaaaacacatagactgttggtctacatggtccccccatgacacttagggatactgagaccaagaaggaaatcacaaaagtaccagggagggaaccccaaacctggagcactcttgagacacctaaatagacagaagaactgagtatagcctatgctaaatggctaagtggagattgtttcttttagtccatactccactccttccccgattagggacagtgccactggacaaggttcctcaaggtctcacagtaagatgggtcatcaggctcaaccagaattcccagacacttctcagaggctcaccctggtctcagctaacaagcaaagcctaaaactgctacaaaaagtcaaacaaacaaacaaataaataagaaatacttgtaactaaggagagttcaccaatattagaaggtgaaataacaactcacaaaaatgatagtattgttcttggcctttgaaagcctaagaatacaacagaaaaaagatacaagtttatgacaattataatttttaaaactgtaaagtacctaatcaatgggaaaaaaatggaaaagtgcccatgtttttaactgatgtaacacaaaaggcctgaaatgataagccacattgaagtgggaacttatggtttctttggaaagtcattttagtcagatggcgttttgctggggcaaacaggtggaaggagtgttttcctgaagtggacacaggtgaaaggatgttttgttaaagtaagcatgagaaaggacatgtgatgaaggattctttgctaatgacacccatgtattggtttgccttacatttcattgttgagactctgtttgtcatgactccatagagagaaatgcaccaaaaaaatttctgggggtgtactgcagtttcttgccaactccacaagaaatggagatggaattggcagaatgatgtcagttgagacagactcatgtggagttttgctaagacagactcaacatgctgaggcaagacacatcataggacaagaccagtggagggcacatgatgtttggagggaggataaataggactcgatgaactgtgagagaggcttgcttgcagagctagctttacaacactacttggtcttgagtctttgctgatcttcactttgttgagagaggcacagctgagaacttctccaggcatccctgctggtcctggtagctccttatcactcgtacccattcggctgaggcctggctagttccgtgaggttgtgacacagctgactcttgtttgctatcccaacacttcggaactggacggctggtgtatctgagagtggatcgagttgccactgctgaatcctgtgaactgaactgttgatttcctgacagatgggattgctctgaagaaaaatttctaaaaatgtccacttcccctatatcctagtaacctttcttttctactccctctggtgggtagtgggctagaagacaagttaaaccatttaagaaccattattaaaaggagggtgagaaaaaattaaaattacaccatgctgtggtcatagacggagaactaacacctgggagtcagttagtttcttcttactctgtagcttaatgtgatgccttacagagcccccactgcatagttcagaggttcaaactgtacaatgatttttggagaagtatgagtccacaatttgaaaagtcaagtttgaggagccagcaggatgttgaagcggaacactggagatcatattcttgatagcaaaactcttcaaagccagaggaacacaaacctagaaaacaccatcaggccaaggcacagaagggacaa

SEQ ID NO: 230 - DNA, 5142 bp, Mus musculus
gttacaaattataatactgtggtagaagcaaattcagattccgatgatgaagacaaactccatattgtggaagaagaaagtattacagatgcagctgactgtgaaggtggcatgccagatgatgaactgccagcagaccagacagtattaccaggaggcagtgacagggggggcggtgccaagaactgctggcaagacaacgtgaaagacaacgagtgtgactcagatgcagaaaatgagcaaaaccatgatccgaatgtggaagaatttctgcagcaacaagacaccgccgtcatttatcctgaggcgcccgaggaagaccagcggcagggcacaccagaagccagcagtcatgatgaaaacggaacaccagatgcattttcccagttgctcacctgcccgtattgtgatagaggctacaagcgctttacctctttgaaagaacacattaagtaccgccatgagaagaacgaggacaacttcagctgctccctgtgcagttacacctttgcatacagaacccagcttgaacgtcatatgacatcacataagtcaggaagagagcaaagacatgtgacacagtctgggggaaaccgcaagttcaagtgcactgaatgcgggaaggccttcaagtacaaacaccacctgaaagagcacttacggattcacagtggagagaagccatacgaatgcccgaactgcaagaaacggttttcccattctggctcctatagctcacatataagcagtaagaagtgtattagcttgatgcctgtgaatggcaggcctagatcaggactcaagacatctcagtgttcctcgccatctctttcgacatcaccaggcagtcccacacgcccacagatacgacagaagatagagaataaaccccttcaagaaccgctttctgtaaaccaaatcaaaactgaacctgtggattatgagttcaaacccatagtggttgcttcaggaatcaactgttcaacccctttacaaaatggggtttttagcagtggtggccaattgcaggcaaccagttctcctcagggtgtggtgcaagccgttgttctgccaacagttggtttggtatctcccataagtatcaacttaagtgacattcagaatgtacttaaagtggctgtagatggtaacgtaatacgacaagtcttggagactaatcaagccagtcttgcatccaaagagcaagaagcagtgagtgcttcgcccatccagcagggtggccattctgtcatttctgccatcagtcttcctttagttgatcaggatggaacaaccaaaatcatcatcaactacagtcttgagcagcccagtcaacttcaggttgttccccagaatttaaagaaagaaatcccagcccctacaaacagctgcaaaagtgagaagttaccagaagaccttactgtcaaatcagaaacggacaaaagctttgagggggccagggatgatagcacttgccttctgtgtgaggactgcccaggggacctcaatgcacttccagaactaaagcactatgacccagagtgccctgctcagcctccaccccctgccccagccaccgagaagccagagtcctctgcttcatcagctggaaacggagatttgtctcccagtcagccacctttaaagaaccttctgtcactcttgaaagcctactatgctctgaacgcgcagccaagcacagaagagctctcaaagatcgccgattctgtgaacctaccgctggatggagttaaaaagtggtttgaaaagatgcaagctggacagattccaggacagtctcctgaccccccttctcctggaaccgggtcagtaaacatacctacaaaaaccgatgagcagcctcaacctgcggatggaaatgagccccaggaagacagcacacgcggacagagtcctgtcaagataaggagctctccggttttacctgtaggatcagccatgaacggttccagaagctgcacatcatccccatcccctctaaacctttgctcagccaggaacccgcagggttactcttgtgtggcagagggtgcccaggaggagccccaagtagaacctcttgatctctcactaccaaagcaacagggagagttactggaaaggtcgacagtcagtagcgtttaccagaacagtgtttattctgtccaggaagaacccttgaacttgtcttgtgcaaaaaaggaaccacaaaaggacagctgtgttacagactcagaaccagttgtaaatgtagtcccaccaagtgccaaccccataaacattgctattcctacagtcactgcccagttacccacaatcgtggccattgctgaccagaacagtgttccatgtttaagagcactggccgccaacaagcagactattctgattccccaagtggcatatacatattcagctactgtgagccctgccgtgcaggagccgccagtgaaggtgatccagccaaacggaaaccaggatgaaagacaagacactagctcagaaggagtctccactgtggaggaccagaatgactctgactccacgccacccaaaaagaaaactcggaagacagagaatggaatgtatgcatgtgacctgtgtgacaagatatttcagaagagcagctcactgttgagacacaaatatgagcacacaggtaagaggcctcacgagtgtggaatctgtagaaaggcatttaaacacaagcatcatttgattgagcacatgcggctgcactctggggaaaagccctatcaatgtgacaagtgtggcaagcgcttctcacactccggctcctactctcaacacatgaatcaccgctactcctactgcaagagaggagctgaagacagagatgctatggagcaggaagacgctgggcccgaagtcctgccggaagtcctggcgactgagcatgttggtgcccgggcgtctccctcacaggctgactcggacgagagagaaagtctgacaagggaagaagatgaagacagtgaaaaggaggaggaggaggaagataaagagatggaagaattacaggaaggaaaggaatgtgagaacccacagggggaggaggaggaggaggaggaggaggaagaggaggaagaagaggaggaagaggaggaagtggaagcggatgaagccgagcatgaggcagcagccaagactgatggtacagtggaggttggagctgcacagcaggcaggcagcttagagcagaaggccagcgagagcgagatggagagcgaaagcgagagtgagcagctgtctgaagagaagacaaatgaagcttaggagttcttctaaaaggaaattctacttggtaatgaaatttgctctatattacccacgcttttcatggaaacatggctccatggctcctgtgctatggttcctgctcactactgtgtaatgtcagaactgaaaaaaaaaaaattccgggtgtgcctgaacctcaaacctagtaatttttcatgcagttttcaaagttaggaacaaatttataacatgaagcagcttagaaaacattaatgactcagaaaacaaaggtttctcagcaggttacaggaggctggatgggcgtccggcatggctagcagtattatcactcttacgttggctcattcttaagctctacaatgggagaaattttataatttttttattggtaaacatatgctaaatccgcttcagtattttattatgttttttaaaatgtgagaacttctgcactacagaattcccttcacagagcagtagaaagcagttcaaaccgtgctggctacctgctgctacccagtcagtcaggagataggacctctgacgttagatgccgtgttgccatctaacatgtattgctagccttaaggaagcagccagagaagagctggagtttcttactcgtgtgatttttaaatggagttcaaaggttgtcgttgagtcctgactccagggacgaccagtgttgatgtggcaaggccggcagaggcggcagaatcagtgttcgtgattgtttgcgtacgttagcaaccatgaaggatctataggaagcaagcgctgtgtccctttggccttaagcaagacctgtgctctaagtgccattctcagtattgcaaggctctgacagccttcccgcagtgtggcctatattaactagcagttgttgattcgtttgttgtgtcaaaattcccaaacaaaactcaaaaccactgactgtgagagaagctgaagcactggggcatctcacacttttgttcctcagtagtcatttcatgttgattgactctcagaagtctctacagaaataaaagggaaattctccaaactacttaatccatgtacttgcgtgtcaggcatggatacgctattggtttttggttcacagccgttttccaaatgttagttattacggacccaggtgatgaacaacagcagctgatttttacctaccagtattattttatttcttttagtttatagatctgtgcaacatttttgtactgtatgtctttaagcctggcagtattaatacccttcttactgacacgtacttttagttttagaaaacttttatatttatgtgtcttatttttatatttctttatttattacacagtgtagtgtataatactgtagtttgtattaatacaataatatattttagtatgaaattttggaaagttgctaagatttacagtagagatgcagttggttcccgtgcgttgagatttgatttaacagtgttctgttaacatttatacttgcctccgactgtagaccagcctttaaatgggaaggtattagttttacaactacaatcaagtcattctccctttccccagtttttaataggaaactcttacactttgacactcactgtgtgcgactcatagcatgccgctctgcagtcttctgttaagagttggcccagccataactcattcccttagcaagccaaattagaattgccttctgtaaacagtgttgggaacaatgtttaacatgtgccaatttgttcctgtatccatgtatgtaagctaccaatctgactcttccttttaagttccttgttacaccatggtcattttctagttttttaccagactccccagctcacaataaacgcatcaacaaacctga

SEQ ID NO: 231 - protein, 1098 aa, Mus musculus
VTNYNTVVEANSDSDDEDKLHIVEEESITDAADCEGGMPDDELPADQTVLPGGSDRGGGAKNCWQDNVKDNECDSDAENEQNHDPNVEEFLQQQDTAVIYPEAPEEDQRQGTPEASSHDENGTPDAFSQLLTCPYCDRGYKRFTSLKEHIKYRHEKNEDNFSCSLCSYTFAYRTQLERHMTSHKSGREQRHVTQSGGNRKFKCTECGKAFKYKHHLKEHLRIHSGEKPYECPNCKKRFSHSGSYSSHISSKKCISLMPVNGRPRSGLKTSQCSSPSLSTSPGSPTRPQIRQKIENKPLQEPLSVNQIKTEPVDYEFKPIVVASGINCSTPLQNGVFSSGGQLQATSSPQGVVQAVVLPTVGLVSPISINLSDIQNVLKVAVDGNVIRQVLETNQASLASKEQEAVSASPIQQGGHSVISAISLPLVDQDGTTKIIINYSLEQPSQLQVVPQNLKKEIPAPTNSCKSEKLPEDLTVKSETDKSFEGARDDSTCLLCEDCPGDLNALPELKHYDPECPAQPPPPAPATEKPESSASSAGNGDLSPSQPPLKNLLSLLKAYYALNAQPSTEELSKIADSVNLPLDGVKKWFEKMQAGQIPGQSPDPPSPGTGSVNIPTKTDEQPQPADGNEPQEDSTRGQSPVKIRSSPVLPVGSAMNGSRSCTSSPSPLNLCSARNPQGYSCVAEGAQEEPQVEPLDLSLPKQQGELLERSTVSSVYQNSVYSVQEEPLNLSCAKKEPQKDSCVTDSEPVVNVVPPSANPINIAIPTVTAQLPTIVAIADQNSVPCLRALAANKQTILIPQVAYTYSATVSPAVQEPPVKVIQPNGNQDERQDTSSEGVSTVEDQNDSDSTPPKKKTRKTENGMYACDLCDKIFQKSSSLLRHKYEHTGKRPHECGICRKAFKHKHHLIEHMRLHSGEKPYQCDKCGKRFSHSGSYSQHMNHRYSYCKRGAEDRDAMEQEDAGPEVLPEVLATEHVGARASPSQADSDERESLTREEDEDSEKEEEEEDKEMEELQEGKECENPQGEEEEEEEEEEEEEEEEEEEVEADEAEHEAAAKTDGTVEVGAAQQAGSLEQKASESEMESESESEQLSEEKTNEA

SEQ ID NO: 232 - DNA, 228139 bp, Homo sapiens
acacaacaggccccggtgtgtgatgttccccttcctgtgaccaagtgttctcattgttcaatcccacctatgagtgaaatatctcttctttttgctctttaggttagaattaatccaactatgcctgaagtgacatttttagggatacaaatgatcttacctttaagccttgaacagaaagtcactgtgtagaaatctagtggattatgcccttactatctgactctaatctttcctgagagtctgctttgctgtttttgttacctttcatatactgtttaccatgtgccagatcctacataaaacacttcacatacactgtcccatttgcccttcataaaacttctggaccagaatgttttaccaactgcagaagctttccctcttttctacaattattgagtgtacttcccatcagacaatgctttccatatcagaaatgcaaaaatgaaagctcagactaggagacagatgttaaaaaaaaaagtagtaaaagtgataaatgtggctgggcgcggtgactcacgcctgtaatcccagcactttgggaggccgaggcaggcggatcatgaggtcaggagttcgagaccagcctggccaacatggtgaaaccccgtctctactaaaaatacaaaaattagccaggcatggtggcacgcacctgtaatcccagctactcgggaggctgaggcaggagaatcgcttgaacctgggaggcagacgttgcagtgagctgagatcgtgccattgcactccagcctgggcaataagagcaaaactctgtctaaaaacaaaaacaaacaaaaataaaaataaaatgaaaaaacaaaagtgataaacaccacagtagtgatatgtacaaagtacccggatgtatgtgagggaattactagctattctgggtattcttgggtattctaagtccataccaggatgtggttgtctaatccccaagaattctgatacacctggagaaatgctgaggtaatctgaaatcgagggaaagaaaactaatttgccttctcagaaatatgtcaggtaatctagaagatgcagaatctgaatgacaggacattagtatatgttaggctgcagtaaatataataatgaaaaaatagcaagtattaaaaaatacgttggggactcttttttatattaattcatatatcatataattttgagggcatgccttgtactaaggcagtattaggacctggaaagaccactgtaaaaaggtatcacctggaacaactttattaatattgtaaacatgggaaatattaattatgctttatattgctgaacttttagcagcagtgcagcactacttgttaaaataatctaggctgcataggggggcccattcctgtaatctcagcagtttgggaggctaaagtgtgaggatcatttgagcccaggagttctagaccagcctgggcaacatggcgaaaccccgtatctacaaaaagtacaaaaaattagccaggcatggtggtgcacgcctgtagtcccaggtacttgggaggatgagatgggaagatcgcttaagcctaggaggtcgaggcttcagtgagtcatgatcgcaccactgcactccagcctgggcaacagagcaggaccctgtctcaaaaaaaaaaaaaaaaagataatctgcaaatattattgtttatgtgtgcttaatttgcaaagtcacatcttatttttgtgttgcttttccttgcagaattattccttcttacatgattattcaaaattaatgcaaggacagaaaaatacaaataccacatgttctcactgacaaataggagctaagcatggagtacacgtggacataaacatgggaacaacaggtactgcagactactagagagagggaggggtgtgggttgaaaaactacctaccaggtactatgccgactacccgggtgcaatatatccatataacaaacctacacatgtatcccctgtgtctaaaataacaactgaaattttttaaaaagttaagttctcttgatgctgtcctgctcactttttcgtttccctcacagaacactaattcacatcttctatacggtagacgctgttaacttcaaggcccttcatggcctacaggtgctttcagtgcaacatcccacgtccttggcacctttgtacggcttggctcctgcttactgacctctgaggcctcatctggaactatgagcccattttattcaatgctttgatgctattggatttgtaccacaaagcactatactttcattttgagatttctgcatatgctgtaacttctgcctttaatactctcttctcctactcttctgacaacactattacttctccaagaaagatttccttgactctgggtttgtttagatctttctcttaggtaaaccatatttccttgacatttgtgtcagccttttaatatatgtttctcccacaaacctgtaagcttcttgaggtcagggaccatattaggcatttacagttccatgcagtgtctgccacatataatatgctcaagaatgttagacatgtaattccagcactttgagaggccaaggcgggtggatcacctgaggtcaggagttcgagaccagccgggccaatatggtaaaaccccgtctctaccaaaaatacaaaaaattggctgagcacggtgatgcatgcctgtaatcccagctactcagaagactgaggtaggagaatcgcttgaacccggaaggcagaggttgcagtgagccaagatcctgccactgcactccagcctgggtgacagagggagactctgtctcaaaaaaaaaaaaaaagaatattagttgaataaatgaactaatgaacaattaaaacttctacatggcacaatgtaaatgttatatacagagtaatgaccaattagcataatgctataaatctgcaaattaaagatgaacaaataaaacatatttctcaatcatgaaatacaaaacttgcatactgtgagtggtggaatagtggctcccaacgatgtccacgtcctaatcccccaaacctgggaaaaggtttggttatatggcaaaggggaatttacattgtagatggaattaagcatgctaatcagctgacctttaaatgaagagatattttgaattatctgggtgggcccagtttagtcactaaggcccttataactggaagagggaggcagaatagaggaacgagtgagctggcaagatgcaaaggactctgttggatgttgctgactttgaggacggaggaagaggctcaaaaccaaggaatgtgagcagcatctagaagctgaaacaggccaggaaatggagtctcccctaggcccttctgaaggaactcaattctgacaaaaccttgatttgagtcttgtgagacctgctttggacttctcacttccaaaatagtaagataatacatttacttttcttttaattaaaacaatttttttttggagacaggtctctgttgcccaaactggaatgcagtggtgcaaacatggctcactgcagcctccacctcctgggctcaagtcatcttcccacctcagcctcccaggtagctggaattacaggcctgtgccaccatgctcagctaatttttgtaccttttgtagagatagggtttcaccatgttgcctggctggtctcgaactattgagctcaagcgatccgccaacctcggcctcccaaagtgctgggattaaaggtgtgagccactgagcctggccgatttatgttgttttaatccactaagtttgtggtaatttttaacagcagcaataggaaacaaatacacattcccacatggaacaggattaactttggctgcatatgacagaaaacctaagagaatggcagctgaagcaagaggtatatttgtttctttctaagagaaagagaaatctggaggaggaagtccagggctggtaatggtattccatagtgtcaaggactcaggctccttcagtctttttgctctgcataacttaaggagctctagacagctctgcccaagttgagaaaatctagcaggatttcaatccacaggaggaagggaaaggatggtgaagcatctgtttttgaagatctttgtcaatgttgtgcacaccacttacatctctttggccagaactaagtagcatagtgagacctagatacatacaagaagagaaacagaaccattttttttttcctagaggcaggtctcactctgttgccctggctgaagtgcagttgtgtgatcagagctcacttcacccttgaactcctgggctcaagtcatcctcctgcctcagcttcttgagtagctgcaactgtaggtgcgctttacgatgcttagctaattttaaaattttttgtagagagtaatcctgctatgttgcccaggctgggctccaacacccggccttaagcaatcctcctgccttggcttcccaaagcactgggattataggcatgaaccaccacacccagctaagaattatttcaagtgtgataaaaatggacagttctataattttaaaagaggaagaaacatattagggacaattagctctatcttaatattgtggtatgatttttttctctcattgttttaaatatgtaaaagttgtctcgcctagattttagattaaggcagaggccatcattccacaaataggttattgaataattactacgtgatagtgtttgccagattttgcaagtacatacattggaacgtgagtatatacttgttcaacaaatgacataagacatttatatcacatttaacattagtattgtaattaatggaaatagcagaattattggttggtaagaaataaggttaaaatgctttatttctatacgcatattactcagggtcctggccggaagcatatagcacattcaaaggatactctgaagagagtttaatgaagagactatttacagaggtgtggacaggttttaaaggaaggagtgatgaagcaatcaatcattaccaccctgggcctgaagacacaaagagaagaagcagtttctggaacttggcaagacctgtggccatgggatgagggtgtcggacaggagccagggacctcaggtagaggaacgaagctagagccacagccaggcagcagggaatagaataaatatcctgacctctctctttttcctttctctgatcatttgccaaagcctccaaattggctgaaaccaaataggaaccagagggcaaagaagcctgggtgacgtgacttccacagaagtcagcctcgcagagcatggaaaggcagagaatggactttgaaggacagagcataacaaggataatatgaaaaagcaaagcatttcacagagttggaacgattcaaaaaattttaaacaaaaagagaaagggaaatgatccaaacagagcgggcacaaagaaagacagaggaagggaatgattacaaagtaaaacagtgggggaggggcacaatgtctgatctatttatgtaagtaggataaagagagagagaaaagaaatagaggcctgaggtctgaagagaatgagaagggtgtgaccagggatcttaaagttgtggatataattggacacagggtatttatcaccatctttctcatgtaagtttaatacaatggtagaacatctaaaacctgttactgattgcaaacattttaaatgcatgtacaccaaggatgttcaatccttgcctctgttcagaggcaacgactgtaactgaggatctgtggtttacagaacaccagcactgtaggtcaaagaaacagccatactctgtaacagaatcaatcagctgctaaaagaagtcaagatgacagaaaaaagaaatacgtggatacaaaagagaaaaaacagcagtagaaaccagctatcagaccactgatatcatggtaaataattaaaattcacttaaatcaaaaatatgtgtgttgcttcctctcaagttacctacatataattaagtgtagaaaaaattaaatgttattcatattcataagtaatattagtaatagaaactacaatctaacttctatggaggcagcctttgaaagaaatcctttttaattactgtgacttcatggaaaacactagttttactttttggatattcaccgacatcctgcaaacatctttctccatatatttatatctatctctgtattacacacgttcctgaaaaatcacctcgtaaataagaaactacacgtgttaacatttcattgacttacattaaaaataggagcctcattccccagaggggtaagaaccattctgtggtaaactatgtaacaaaaatcacatggaagtatggagaaaacatttgtccctgtgatatctcctgggaggctgtattcgaagggctggcatgggtcctgtggccaactgtgggttctgcatcaccctgtagtcatgtttccttcctgactcaatgactgcagaatttggtgagactgcaacagtgaaatgaccattgccctcctttgttccacggtgaactgcaaatccagaattactgtaggtcaggagccatggtcagagacaagaattgagtagcggctttatgggacctctacattctgtactttgagggataacatgtatcacattctttttccttcaaaaactctaagattaaaattaggtattgaattcaagagttgcatttacatgctatccttccatgaaattaacgaactttaaattttgatgaagactagagaattatacattgcacttctcaatgtgttttggaagaggtatgtgggaatgatatgcttcatgtggaacaccgtgaaatctctacattttaaacttaagataattttatgtcaaattttatcctaatttatacaggaatcatatatgaaaagcaaataggtgcaaagggtttatgaaaaatttatagaaaaaactcagtattggaactattctatccatttacatttttccctgtaaatttggaatagtatagaaattcatttttagaatatcttcccttcagcatatataatcccagtgctcagtagaagcagtgtgttaacatttcattgacatattaaaaataagcatatatattgaatgtatgctgtatgacagcactacaattactaaaaccaagaatgcaggatacatgttaaagtcatatattagtatcccctaccgtttgatttgaataaacctaaattttaataatcttcttttataaattgattctaaagatttttcccctattctttagctgtatttaagagataagaagcaaccgtcacacatgcatcatgtttaaagcagtaatttattctgagatttacttttgtctgttttctttccagtccaggtatcaatattttcaagaatattaaagtataataatcaaacattcaattcataacatatatgcttatcagaagcttttacaaaatggaaattttatgttagaagatttgggctaccagtaatattcactgtgcatattttaaaaaaaaaggtgaacagagttcattgtttagggaaaatgattatggagaaactaaaatcaagagcaattttaatgtggatattaatgacagtgatcactttcatatccatgactttatctgttcctaaggactaaagggatgaaggcagattatgtaccttactgtcaagaacagggtcagaaaaggtcaacaatattaatttaagaaatgtttattaagcatctactattggctacgtactccactaggtgttgaggacatagaaataagaaaaaaaagttacctgaaaaggtacttgtccacagtttggcccaaactaactaaaccagaaaccactaaagtaaggaagaaaatgacttctgtttgtctcttcacttcatctctctatgaggtgaggatgaacactgaaggaagcttagcagggaggtacaggccagaaagagaacatgagaaaatgctatttgtaatacctcctaagtttaagagtaggtaaaatgtgtgatagagctggaaagtttttttttcctttctggtcagaaatcagggtagctgtaaaaatgttggtggggtggggtcaattccatagtctatgacctgattcggtaggcgactgaaaaacattgtacaactcttaaaaaaagggaggaagaactcacacttaaccaagcaaagcaaggacaccgtgttgacatacacaagtttcggttaacatggtatcaaggaaagcgaggactgcctgtacttaaaatgatcattaagactaatgattctagttttggcattgaggatgaatgcagatatatagacataatgtatagcaaagaatatttacagtcacatttcatggaccaataaataacgcatttacttctcaaaatgcccaagaaaatgtgggagagaaaatgttcatttatattcaagattaaactttctaactttaaatcatcagacttcagctgtaaatttatttcagttgaaaggtttgaagacattattaatgaatattctaaaattccggaaggtgtttaaaagataattttaacctaataaaaaaatcctgccatagaagtgacaaaaattataagcataaatttattgagcacctactatgtgtcattgtgctaggtgatgtactacgttatttccaatactccggtcacgtttcagttttctcaatttctctatcaataactgctacattgttaatttataactatattacttgaaatacagctcagcttatttattccataaagttggtcccaaagacgtttccttattcgaaggaggtgggaagcaggaaggaaacctaaatctaaattctacttaatactgaagacgactttcttgatatttgtggttatctgtatggtcttttcagaaatcccaaaacttgtaccaagtcaaggataaaataagataaaatcagcaatctatcaggttcagagatcacatctgtcagccgatgcttcttgccttaaggtcctgcacggcgatgaccgctcatttaggaaggaattcatggcctgtggataccttagctctgagtcctgccacctaggatcccacggttctacgcgaggaagagggcggggagcgcggaccgggtgtgggaggccgaggtgacagcaggtgagggccgggtgcggatggggaagtgagacaagcaccgtgtgggtattactcattccgctctactaaggaggctgctggcaagcggaacttctagcctctctttcaatccagctgaagttcaatctcattgaagtcacttcccatcccggttcgcttggggggaaaccaggcgtccctggaagggaagggaagggagtccgggctgcgcgggtcaggtagcctctctccggtcgccgcgtgtcctcgccgtccccaaacctgcccttcccctcatcaagggaactccccggggagtccagaccgcgatccctttccttggccccggggtgcggggggcggacacgcgaggcgtgggactgatggtagccctgcctccaggaagcaggcaggcggggacctctgggcgctcggaggggcagctccgagggcacagggtacagggagaatcagccagatccctccctgccccgggcagccgcggcgggtgtggccagcgcggaggcaggacgccgccgagcctccaactttacctttccaactccgacagcccgtcgcctttctgaccgcgtccctacggtttcccggcatccgcctccctctccccaccacacctgaggaaaacttttccctcgcccctcaattcaaattcagcagtgcccacggttgccgcaaaccgcccggtccctagcaacaaggttccggccgtagagcgagagcctctaggtgtaaggaaggtgatgtcgtaaagccgggagtgtcgtaaaccaggtgcggtggggaggggggaggggtggaggcggaggggtgggggggaagggggagggagggggaggaggtgactcgagcatttagacacaagcgagaggatcatggcggatggccccaggtgtaagcgcagaaagcaggcgaacccgcggcgcaataacggtgagtggcggaggggaccggggagcggcggagtcagggggagctgggcagccggggcgcccccgggggtgaggggggcgagccgggctgggggcagccggggcagggacggcaaagtggagtgggaaagtagaaagtagtgctctctgcccccctccgctgccgccgctgccggagccgcgccgcggccgctcgctctccctgaaccgttatgtctcttacctggtctctctccgcctagcggctcccgccgcccctgccgcctccctggaccgttagccggcgccgacgccgccgcatccccggcgcagggcgggcggccgggacgcactggccacttttctggtcccgggtggagcggctgttgcttctttccgcacttttccccactcttgtgcccttcggcgcctccctctccccctcctcctggccccctcagcgcgattctccctcagcgcccaggcccccgggagccgcggaacaaacttgtgcccggcgctgaccgtgcaaagtggcttccgcgcgccgcggccccggccggcgccgtcgctgtcgctcgggccccgcgactcgggccgggctgtgggcgcgcggcaggcgggctgcggcggcggcgggacggggcggccgcgggttgcgtggggtttgtgcgcgcgtgtgcgcgggcgccggctgtgcgcgccgcgggcggacagggttcggccggcggcggtaaagttgggacccgcgggccgggcgcgctcgcgtaacggggattagaggcgcgggggcgcgggtccctaagcgcccctcctccctggcgcctcccgctgcccggcccagagccccggcctggggactccgcggcgagccccgcgagtggggtccacgtttggcggggcgcggcggggcggcgcggggaacaaggcaggaaaggtacccacttaacgccgccgggagccgcgcggatgggggcgagctgggcggcgggtgtgtttgcggagttgttacctgggcttagagaccgggaagcaccacagacagatccccctcccggggcagacgaggtctctgcgccgggatgggccggtgtgcgtgcgcctcgcgcttttctctttcggtttttggggaagttgttacctgggccggacgcacggagcgctgaagccggataatggggcttggatggcgctctgggtctcgggtggaaggagggtgggggagggggcggacggaccgacggacgcgcggggctgctacttgcaccgcagctgcagtgtttattgatttgtgctgctgtgccaagggaaacacacacccctctgcctggcgtgagagttaaaaaaaaagagagacagcccgagggatcgagacctgaacatgtggtggtggttgcacagtcgccttttccagtttggagagacgttgtaagttgattgtatttctggttatctcggggcgatgctatgctttctctccctctcgtgcagcagcgaaatgtctgctgattgttattgtctggacagttcctgtggcgagaggggcgagacttgtccgcccgggggcggcgggagcgcagggagagcagcccccgcctgcgccgccccggtacctgtttgtataataatgggcggcaacggccctgccgccggccgcagcccaggctatataaggaattacacgtacatttcggaccgaggggctcgctttggttcctgcgttatttttaaaacgacttttaagagaggggcaataaatgcgtctataatgggaccgctgcagcgtcgagaaaacgaggaaatacgtgtttaggagaaaactctctcgtgctcccccagccccaccccccgcgcctgggctccctttctccctcccctctgggatgcgaaacgcgaggttttgtaacctttcctggcaattttagattttgtgtgggatttcctgtctagaagcagatacgaagatttttaagctgtttcaagatgtttccttccaatccataattatatttttaatatattcgagccatcattaaaatcactgctttcgtgattttaattattcaaataaacacttgcattttaaagacgtctgttgattataaacgaaaggtattttggtattctcattgtggagagatgacttgttatagcaaggagtggagcataggctattgcaattttaatttcctgttttagcgtcaaatagtgtgtgttccatattgagctgttgccgctgttgctgatgtggctttatgaaaggtaagttggttcggaaagagctgttcgctttttaccttatttaaaatgttgatcgccagagaaaggggcttttcttgttgctgacgacatgtgtgtgacatgtgagtctgaaccacccagcgtctgtgcagctgctgtaaacatgtttacctgaacaggaaagaatggatttttctccttgagatcctgtgatatgaatattacactcgtaaggcatatcaacagatgacttaaggggggaaaagcgatcctgaaagatacttgaaatcaacaggaaagagaggttcttgatcgctgcagcaaatggcaacttgtgcaggtagaaaaaaagatggtgtttagttttctcctgcatgtatgtcagccccctcctgtctgctgctttcattctcaagggagggatttatttaccacgcttgctgtcagtgtttttcctttgtgtttaatattagaaaaacagatttgcgtctgtttagcacaaaacgtcttgtctgcagtatgcattactctcagaaaacaaaaggtgtttaagatagcactgtactactacaggtatcttccattttcatcacttttggctctgtccttgtatttctttttgttctcaaatgcatttcatccattgctggtgattatagccatgctatttgatttagccttatattttgcaaattaaaaatgaagttatattccattgtgttgtgaaacctcagtatatgtgctggttaatatttcttagcagtgcagtcatatttaagttgcagatgtttattggagaaaattgcctggcaaaacgttaactctcaaatctttttaatgaagaaatatgtgatatatacagtggaagattgtcgtagagatagtttatgttgttatatatgtaaataatgttttattcattttgaaataagatacgtggattttgctgctaagccttctgtaaaatattttaatttcctttctggaatatgtctgaaggtaggatattaaaaggagtatcaggtaatgtaactgacaggggtaaaccaattgagtaaggtttggccaaagcatcaaaccttgtgtggtaacttaatgatgttagtcatccgtaaaggagtgacattagaattgcttgaattagtttttaccatttataatttcatgctttgttgcattttaaaaaatctgtctttttctttttctgctttcttctatgtggttttcttcttgttctaccttttttttttttgagagagagatgtactctactaatgaccacatgctgattaattctctttagatggaatagaaggtacatatccttctgtcatcagcaccatttccccttgctgtcattggaaaccaccagtagaggatgctaacaaaaatgattattggtgtggtagcatcataagtctctctatcgactgtgctgattgggaccttcagtataattctgagtcttattgttacttaaaactagccttggttaaattaggcataagcattttctagtttgccgaaactagaaagaagcaggactgttttaacttgaataattttataaatttgagttatttaagtctctaattgagattgctgttaattcattcttgttttagagcagttgtattactccttattttaaaaagattttgttttatgttcttaggtttggagaagaatatgtaataattgacccatatttatgttgcatatttagaatactttttaatcacccctttttaaaattcatagtaagatcccttaaaatatatattttagatgttaaaatacatctaaaatggtcaaagtttaagagtagcaaggaaaattacaattgattgataatactgtgtaattatttttatataacttatgtagacttagactatggatgggttggcagagagctactaacggaggtggtaactagcagtcacttagatgttagtgatttttagattttatcttttccttccccttcaggtcttttcctactggtagccctcccccacctttttagttaagaatcagtgagtgcatacgttttaaatttgtcagttgtaattaaggaatataagtttgctttgagatcttatatgcagtaaaactctgtagttcgtacgttgctgtatgcttgtatttaaataattcctttcaagaaactatataaattgcatataaataattgcatgagactgtatttagttatgtcttttcattttgtgttcttataggtatattaatataactgtaaattttaagcctctcattaggtagaacattagaagtatttatttccttaattatttttagtggtgtttttataaatgcatcaatatcagtaccgtaatggaatagccatactgtttatcttgaactaagtaggtattgaattgccaggtaagcctgtgttaatttcttattttaggatgtcatggttcttcgtgtgtgtgtgtgtgtgtgtgtgtgtgtgtaaatagtttttcatttcctgacaggtatttcttgaatttagtattctaattcctgagggctcagtagtgaataggtgtgattcacttaaatgtttatgaactcagaaactttgccacaaagtcacgagatacattgtagcatggagcaaaacttaaagtatcttataaattgaaaatattaatcgtttatgaagatgaccctgatataaaaagcatgtgaaatatttgtttaatactgttttcttcctttctctagtctctagtatgtttgaaatggcatacctcctatgtagtagcttttgaagcatgtgctgagaaacttctgttaaattgagaatgatatttttaaaataagagcataatgatttctcatagttgtgtttttcttttgctttatcctcttgtggatttacctgtataaatcacttttaagcatgtggttagagccagatgtaaacacagatgcagtatcatgtggaattatattgttagctactcttaactacctgtattgaattgcagcagaggaggagaaaaatcatgcagatgttggaagaagatatgcattagtgtgcaagagtacagcgagaggttagaaaacttgaagctgtagaaataggattgaaaaaggtttctttgcagtacagtcactaatttatgtggaaatgcatgctctttatttctaattgagatataagctaaaataaaagtccattgttgaaagaaaactcaaaaaattttaaactagaaaaagtgtcctgattaggaaatatgataaaatgattttttaaactactttttaaagggtagatgttgtacatattactggctaaataatcattcaactagatatgaactaaaagtagtaagcaagtagaaatatatgtagtagagaaagttttgtagcaaccctagttaaaattaaatttgatctattatgtaggcattgccatataaactaatcattcttttgcatggggcagtgttttgagtattatgtcactaaaggaaacatctttaggacattagttttactaaataaaaatttcaatatgttatgagcatgtctggattttagccttgatggaggtgggttacgctgttaacttaaaactgggttgcttaaaaagatggcaatataatacagtacttaagtagcaaaatgctctctaataagtaaaatttgctttatgattgttttcagagaaaacaacttaatttttagaacttcattaattttgttaaagcatatttttggattatataatatggatgtagataaatggaaagattatgaaaggaaaagcaaaaaattgaattcaagtgtctatttgtattatagctgtgaaactttaagcttttttcattctctacaaagttacttttctctttcttcaaacagctccctgttgtttaatacacgttccctctatacatagggattgcatttatctgtccatatgcacatttctcctcctaatcaacattatgtatttattgagacttggtacatggaggttgaggtatgaactatgtttgtagaaaaccttacagtatggcaacctgggaaaaccttcatctcttttgcagtaacaactacatctgtgctgaaattattcataacagatgttttgtgatctcttaattccctccctctcccttcccctcccccattcagatttaaaattaaatgtgaatggaagataaatttataaattatgttaatttctttttattgttttattctatattgaaagtcctctgttttctctttttaaaatattctaattttaaatgtttaagatattttaagtactctgatttcaattatcttttaataaaatatgacaccattatttatatatctgttactattcatgctcacggcctaaaatatattctgatttcccttactcttaaggtctttgtattcatttaatccacaattctagcagagtgtttggttttgggtttttttttttttttttaagtagatagtgctgagtgtaactagtttgctgatgaaaaaaactcattttcttggaatcatatatttttaatatggaagattcatcttttccaaaataactttttatctgaaaactgacacagataagctgaaatttagggtctttaagtagaaactctagaagagactttaatgtgtgttttaagaaggggtaatgccaggcagatacagtgacatatggaataacatgtagtgaaatccttcaaggagtagattttctgaacctgggctcagggtaaccttgctctgccttgaatacttgaaaaggctgtcaaaatcactgtatctctttaacgttttctcctttctaccctaaagttaagttgctatttgctcctattgctacatcacttttctgaatctcttttgatacacttggcttttgctttatttgggagggagaaagtaaaggaaggaggaattggagtagacaaaaaataactttatatgaataaatattcattaagaaaatgaagtggaataattttggactggagagatttgggagaatcatccaaagccattttgcagtaaagcagacagtcaaagagataagatgactttgccaagtttatgttactagttagcttggactaggtcacagctttttgggttcctagttcggtattcttttcattaggtcatttgagcatatttatctaagacggtaacaagcaagaactagataccatgaattttcaaatttattatacttaaaaccaaaatgtgtagaatgcttcatcatctcaaaggcaagttctaatacatatgcatacatctgtcaaatttagtagttgatgtagttatatcacttaaaatatttcagatgcagagcattagtattatttagaggcatcctctcatttggattatacttttggtcactattcccaatttcagctcccattcactctatccttcctaccttggacccaatctaatatgttttttatatgctgttggttttgtagctagccttgtaaaattttgtacctcttttgtgtgttttgtatttacataagtgctataagtgctactttgctctatcatttactttctttttcttttcttttcttttttttttttttttttttttgagacagtttgacagtttgactcttgtcacccaggctggagtgtaaaggcgcgatatcagctcactgcaacctctgtctcccaggttcaagtgattctcccgcttcagcctcccaagtagctgggattacaggcacacaccgccatgcctggctgatttttgtatttttagtaaagatggggttttgccatgttagccaggctggtctcaaactcctgacctcagctgatccacctgcctcagcctcccaaagtgctgggattacaggtgtgagccactgcacctgacatataatttactttctttacttagcattgtttgatagctagatatgttgctatatgtacagctagttcattgcttttaaccttgcagtagttcatttatgtagtaagcacaaattacctatcaattcccctaatggcagattcccagattgactccaattcttagataccaataattctgtaataaacatcctcctacgtgttgctaatggctgtggaagagtttctcagcactaccatatctagggacatggtattgtccagacatagtattgctgagtataggtcaatcacatatttaataattactaaattctgtcagattattttaaaaacagcaacaccattttttacgctcaccaacaatgtaaaagaactattttctcacgtttttgccagccttcggtattgtacaacattctacattttgctaatttttcagttgctaaatataatctgatagttgctttaatttatgtttctctgtttattagggaggttgatcatttcttcatatccttgctagctgtttgggtttccctttccatatctggcctattcataccctttacccctctttttggatagatttccatttctcttgtgtatttaagatgataatccccaacgtttcagtcatttgactttggtacaggaatccttaattttaatgtcaaaattttgactttatgggtagtaagaagtccttcctaatctatagattataaagatattttcctggattttcttctattagtttcttagttgtattttttgtatttatatgtctaatgcatcaggagttcaccttttgaatacaccctttcttaagaggaacaagtatagcagttaagagtttgggttgatcctgtaacttactacctatcaccctggccaggttacttagtctttttatgcttgagtttctctgcatgtaaattggacatgacagtctaagaattgggaaagtttaaatgaagcatatgacgcattgtgcctaatacatgttttaagttttcaacacatgttcatttaaaattttacttatttattttaaatatatcttggatcagctgacaattttttatccttttgaccagtattaactccagctaatgtaactaccatctgaaagggggttgctgtaaaatttgtacattgtttgtgtaactttgacatttaacattgcttagttcagaccttggacaaagctgttaaatgatcaatagacactgaagcttcatcttaatgctacttttggtatgtctttcagctttaggaaggattccttggatctttttaagggccattatatgagagagaccttaccatatcacttttatgtataacattgacatgaacttcaaggataatgtcccattgttattctgttacataaatcaaagaactcaagtccaaggaataaaagctgtgcattctatatttgaatagtctaagcaacatggagtctgcaccttctcatatatccatttggctgggaatgtatttaagaagatggctgtcttactgtgttcctatggtatagatcaggactattctaagccaaaagttaaaaccataccctggtgtgtgtgtgtgtgtgtgcgtgtgaacttaattgaggtataatttatatacaataagatataccactatgcatgtacattttgatagagttttgacatacttgcatacatgtgtaactgctaccacagtcaagatgtaatagaacattatttccatcatcctaaagagttcttgtgtacttaatctcagccaatcttccccacctattgccccctagcaatgatctgcttttggtcactagaggttagatttaatgtttctagagtttcatataaaccgaatcatgcagtatgtcctttctgtgcaccttcttttgcacaggatattatcaaaattaataagtatcagtagctcattccttttgtattgctgagtagtattccattgtatgaatgttatatcaccaaatacacaatttgtgtcgccattcacctgcagtggaactattaacttgggttgtttctggttctttgctctaatgaataaagctactgtgaacatttacataaaatttatatgcatatatatcttacatttttcttgagtcaatacttaagagtacagttatagtacaggtaactgtacttctaagtacatatagtaagtatatgtttaacttggtaagaagctgcaaaattgcaaactgcttgtaacaaacatttttacatttccaccagccatgtatgagagttctggttgttccacatccttgcaaacaattgtccatgtttttaattttaaccattctagtagatgagtggtagtatcattttggttttgattggatttcaccggtgactaatgatgtttgaagatcttttggtgtatgtattggccacttgtatattttcctttgtgaactgtctgttcaaataatttgtccatttttaattggattgtttgtctttttattattcagttgtaagagttctttgtatattctggaccaaaattttttgttggatacaagtattaaagatatttctctctttctgttggcttatcagttttcttaatggtaccattgaagtgccaaagctttaaattttgatggagtttaattcataattttattcatttaagctttgtgtcctttctgagaaatctttgcctattccagatcttcaggatttctcccatgtatttttagaagcttatagctttaccatttaggtctgtaatccatttcaggttaatgtttggtcttaactcaccagaatttggcataagaatttttatttgaaatttttaaaaatgtttctcagggcccaactaatacccaaagctcaggattatagaggaacacaagtcctacttccctggttttgaacatttttaactgagagtgagtacattgtgcctagttggggttttcaaggttcttcatgtccttgacacattttaattcactgaaatatactttattgaggatacagtttcagagaaagatgcctaaggagagtggccctagttaggggaatgcgagtgttgtcttcaaggtttcttatttcctacaaggttttaaggaatttagcactataccaattcattttcatgttccgtagcttttatctttagatggggagtttgtttaaacctaacatttatcttgagtttttaagggatgtagttttctccttgagataaatgcttgatcttactgatttttggctacatattttacctcctcactttgttatagctaaagaaaaagtttttagttacttttaactttgataagttgattacagatgggtttattatatttatttctttcatttcttagaaaatatagatgttacttattcctatgtaattcttattttaagatagttttttaacttttctgttttattttatcacctattcctattccttgaaaattcgttataagtaacctgtgccttatttttgtttttacagatctcgctttttaatactccttttagctctgtgtctgtcttgaacgttctgtatattaatgcataattccttctgagctggtatccttaggtgcatttatagaaaaagcattgaactgggaaggagtcttaaatttcattttcttttcttttttctttctttcttttttttttttttttttttttttttgagacggagtcttgctgtgttgcccaggctggaatgcagtggcatctcggttcactgcaacctccgcctcctgggttcaagtgattctcctgcctcaacctcctgagtagctgggattacaggcgcgtgccaccatgcccgactaattttttgtatttttagtagagatggggtttcaccgtgttagccaggatggtctccatctcctgacatcgtgatctgcctgcctcagcctcccaaagtgctgggattacaggcgtgagccaccacgcctggcccgaagtgttaaattctaatattgaatctgccattatttggcctctgaaattgagaaaataattccatttatctgggcctatgtttgttcatctgtgggatgaatatgatggattattgtatgcaaggtaatgagaccctgaagatgagagatgtagtaccttgccctaaggagattatagtgtggtagggaagaaaaatgaggaaagaaacctttagaatacagtttggtaactgatgtgatattctgtcttatatgcatagaggggatggtgcttaaaccaagtcttaaagtatgtgtgtgggttatcctagtaaaatatcctagtggaaaataatattccatacagggggaatattatgtgcaaaggcataacacacatgcacacacatattgtgggactcaagtcacgtttggtaaaactgtagggtgagcggaagaatggctagagatgaggctggagaattggatagtaagcaaatgaagaaaaaatgctttatattgctttcctgaatttagattttatcttggacatgatgggaaattaccacaggtcttgaagcaaagagtgacatgattacatttatatacagtaatttataatattatgtttctttatatactcagtgttaatatgattaaaaatttaagaatatatatgcttgctttactaaaagtgaaaaaagttgtaaaacctgatgtatcctgctttcctgagtttttgcttatctattctgataatactaatagatttgcatagtaattgcttcgaaatggtgctgccactaccacttctaccaccaccataaattagtagaagacttacgctactagaagcataagcagccttacgttatagtggctggtatctgtgcaccaagtttggctgtgcatttctagtccctgcactgttagggggaattgtatatttttttttccttttctcaaatcagtaaatcagtgcaaacaaatgtgttgtggatttacaaacctatggaataaaatgtttttacttctatcaattatggctctccaaagacataaaatactcttcattcactattactagttaattttctagattatttctggcatttattaatggttctgcatagagctccaccttgtgaacatgttattgtactttgatatcagttctgtgtcatagatatttaataaataaaataaaactttatttacctgaatgtttctcattcagaatagctgtaattcaggcctggtatatgtttttatttgaatagaaacagttcactgtttttttggaggttatgctgtatactacaagatagattaaaaccagtgcctttttttagaccagctgctgaggaaatacctttatcatgtttcaacctcttaagtttaataattctcatgtaaaaattagtgcttgatttatgcatcaattttctaaacatttcacatgtgatctactttgtatattcagggacttttgtgttctatgttattatatagcgtattttttaaccaaaactttaaaaattaacctcatttcattagtatttgtttatactttactataccttgtttacatgcttaacctgcctatgtattatctgtgacagtaatgaaactgaatggttataaaatgctatataattttatcaagttaagctgacttttttggtggggaacatcatcttcctcttgctaatagataaaggagttttactgtactaatttcaaaaatggtataaagcagtaaggcagatcttcacagcctattctttgacagtatattaagcatgtggagaggaaagcaaggtgttagctattttaaggtttcacagcaacactcccatcttgttcattttcacctgagttgtatagagcctgggaattgctatatatctttaatgtaaagtcagcagtgcaagtaacagtattggatcatacttccaccattacattctctgagtttctgatcaccacattctcacagataaggaaaatagttgtagatggatggtctgaaatgtaaaaaggataaagaacacaagaagtggtaaatatgtttagtttcagacagacattatataaaacttgggaggagggtaaaattattgattagctacgggtaggcttggtaagttttaacgcatgttaaaatttctaagataaggaataaaaatctagaaggtatgtgtaccttacaaactagtagagaagggaagtagaacaagaaacaatattcaatctgaaaaaaaggtaaagaagctgaagaaagaaaacatggaaaagagaagacaagtagcacaaaagtacatagcagcaataagtgcaaatatattagtaattacagtgcatatgagttgaaaaaatcctccacttaacagaaactggttattagatgggataaaataacaaaatatatttatatgctgtttacaagcaataccttaaaaagcatattctcgcttgaaagtaaaaaggatttaaaaagatattcctgacactactaaccaatagaaatgttgtatggctatatatatcatgtaaagttgactttgaggcagaaaacctgtccgagagagtgagggtcactcaatagttataaaaggaaggtataattttaaataagtgactacctgataatacactttcaaaatacattaagcagaaactaggactgcagaagaaataggtaaatttatcattattatagcttatttaaaataatctctgttaatgtgagaacaagcagaaaaaaattaagaaaaatatagatgattttaataacaggacttacaagcctgctgtaatggacacgtatggaacattgtattccacaactaaagtagaggaggaacacttagaaaaactgatcacattctggtcaaatacagccagctttaacaaatttcagtggattggcatcacattacactttctgtttacaattccattaacttaaatagaaattttgtgtgtgtgtgttttggaaattaacatgtttatttcaaaataacttgtggatcaaagaaaaacttgtaatgatagcagtaaattattgtacacgacaacttatgtatagctaaaatgggaatttatagattttaatgcttatattatgggactaaaggttgaggaataataaacatgcaattttaagaattagaaaaaaagcatactccccgattgaaataacaggggaataattaatgaactagagaaagtaaaagtaattcaaaaaggaaacaatgcaactaaaaatagattatttgagaagagtaacaaaattagcaaaccactggcaagattaataggtggggaaagaagtcataaagcagtatctggaatgaaaatgggaatgttactacaggtgtttcatgaatgatcaactttattttaatgcagttgaaagattaagtggaccaattcctaaaaaaaaatgtagctcatgctggcccaagaagtaatagaaaatggaatacccttaaaacaaaaaggaaaaatattcttacaaagaaaaaaataccaattctagacaggtttactggcaaattctacaaaacattcaaggaacaataattccagttgtacagagagtatttcatggtttggaaaaagaaatgactgtccccaacttttttttacgaagctctaagtataaaaaatgatgattgtctttaactcagacctatgtacaaaaattcatagattagatatcatcacatggtagtacccccttatccatctgtaggtggttacctatgctcaatcacagtccgaaaatattaaatggaaaattcaagaaataaaaattcatatgttttaaattgtacgcccaggatgtggatcctccctttgtccagcatatccacactgtatatgctacctgcccattagttaccattggtagccgtcttggtcatcagataataaaaaaaaacatagtatttatagggcttccatgctatccatggtttcaggcatcctcagggggtcttgaaacgtatgccctgttgataaaggggaattactgtacttgaccaataatgtgtaagaaagtaacccatcataaccaagttgggtttactctagaatttcaaagttggttttatattagaaagtcacttaatagaatttaccacatcatctgtttaaaggaaaagaatcatgtgagcatctcaatagatccatctgtgataaaactcttagcaagtcagtaaatgagaaggcccctttcttaacctgataaaggcatttttttccaaagaaaatttccagccctaccttctttccacttcatggtaaagtattgaaggcattggttccctttgatatcaaaggacaagtgtgcctgctaatgccacttttagtcaacattgtactagaagtatagctagtacagtaaacaaacaaagatacaatgattagaaagaaaaagctattattatttgcagattatatgattatctgtgtaacccagaaaaattcacagatgaattactcaaagtttaaatttggatgcagaattattatacaaattcaattatttttcagactttttgctggcatagaaatgcaattaagaggtagcattatatcatcataaaagtataaaacactgtgagtaaatctaacaacgtgctcaatatctttatggagaaattatgaaacattggcagacataaagatctaattaaatagcataatgtaccatgtttataaaaggagacttgaacattgtaatggtgccatttctccccaattttatctgtaagttctgtgccatctgatcaaaatattgacaggtttttgttgaatttgacacgctaatccaaaaacttacatggaagaactaagagataatagcaagatactcattcatgaaatggatctgtgatggcactgggattgccaatgagtgaaataggatgaccctttcaataattggggttgttggttaattaaatggaaaaaattggggttggactgctgcctcacactatttagagaaaccagtggaaggattatagatctaaatctgtaggtaaggtaaaggtataggtaaagtaaaatggtaacactttataaagatgataggctagaatatctctatgactttgagtaaagataaaaaggcataaaacacagagcaaaagattggcaaatatgactacatcaaaattaagaattttgtttcactaatagatactgtagagtgcctaatcccgtatttagcacatatcaaaatctaccacccagggaaataaagatgaacaatctgatagaaaactgggcttgaataggcacttcacaaaagaataaactcgtttggccaaggagtgtattataagatattcaacctcattaggaatcagggaaatgcaaattaaaaccacgttaagaaggcatttcatgtctcctagattctcaaaacttagaagccagctaatactgctgttggtatagacatggaacaactgaacacttaggcgttgcagatgctaatgtaagtaggtacattcactttgggaaataatttcacattattaaagttgaagatacacataacactatgacccagtattcctatgtcttagagaaatctctatacagacataccaggtaatgtatgtagttgtttatacagtactgatcacaataacaaaacaaaaaaataaataataggataagtaaattgtagtatatttatacaatggaatgcaacacaatactgaaaaatgaatgaattacacctgtgcttaacaacttggatcatcctaggaaaataatgttcgaacaaaacaaatcactgaagaatatagtgtgattccatttatatagaatcaaagaacacgcaaaattaagtaatatattgtttaaggataccaatacacataatacaagtctatgataaacataaaatttaggaatgagtgaatttggacacagagtagatatcacaggtcaggataatgtgtgtttaaaaaaaaacgatggtggaactcagatatttattgtattacttattataccttaaatttattttatagaattctttaatgtttgatattaataattactgatagtaatttatggctactgataatcaacatttaatctaaaatagtaactgaaaaaataaaagtgaatgatttttgggggaactcagtatttgccatgtatttcctatgtacgtatgtttaatttttgtgagttctcaaatgtaatcaatttcttttgagtatctttagtattttatactatctttgtatttaatatagcagataaagcttaataatttctttctgttttttttttttttttttttttgatggagtcttgctgtgtctcccaggctggagtgcaatggcgcaatctcggctcactgctgcctccgtctccccggtcaagcgattctcctgcctcagcctccccagtagctgggattacaggcacccaccaccacgctggctaatttgtgtatttttagtagagacagggtttcaccatcttggccaggcaggtcttgaactcctgaccctcatgatccacctgccttggcctcccatagtgttgggattacaggcatgagacaccgcgcccggcctaagcataataatttctaaccctggttgtgtgatactccaaaatgtattcatttatttttaggggtataggcatttttaattcttttatatttttgtagtcactaaatttacttggcttctacctttacatattttctgtttattgaccaccttttaggaagtttgagaaaggtattaccttattatatttttttctaacttaaaatatgtgtgttactattgcacttgtggatataacatttcattttagaatatttacattttattttgtttatcaaacaatagcatttttgtatcaggcactattctcaatatcgttaaaatattaatttatttagtattcattgcaaccctatgagaaagatcctgctatctttgataggtaaagggaaactgaggcacggaaagtgttgggtaaggtcacttagctagtaagtggagcctgtgttcaaacctaggcagtctggttccacagtctgtgcacttaaccactaagctgtaagagaccatatgaagtagatctctaagaggagtatgtcatctatttcaatgttctttaataaacagggtactatttttgagcggtgccagcatattgtcagattatgatgaaataattatattattccctttgtttgatctgagaatgtaaaaagcaatactggtaaattacacactgctggacattgcttagatttactcttcaatgaattttgtgtccgtacgttcatgagatgagaaaaatagataggcaaaagtacctgttagtctgattgcagatctacccgtaatgcacaaatggtgatagtgtactttcttcttccaaaggtgggttaatggagtcatgatttaaaataagagtttaacagtagcgtgtataaatttgatatttatacatcataaatgatgtataaatcatttatgggagagtgatatttgattcagggatgttgacatgatacctttgggaaattctcatagtaaaatagagttagactgtcaacagggaaaattctaagtaatttgtgaagaaactagtagtagtagtctaaagtgaggcaccaggcaaagagagaagaatcagacaaatcctttagagtaatagttctttacccattcagacccacactccatttagagcatttactgtagaagttcttgagagaagatctcatcctgtagccatatatgctcactatatatatagatataaaacatctctaagaatttcagcttctctttgtgctttttgttagctactttaaatagcttaactttcagtgacacatggttttaacaggcaaaacacatgactgttaatgatttttctttagagcagaaatggtttatatggcctaaattcacttttagagaatcttctgagagagagtatttcctgtctctttgcacatgtgtggcatattgtaaggacttatttacttttaaataaaaaggaaagctcttgcagtgaagtagacatttattttgttaagaacctatataaggccaggcgccgtggctcacatctgtagtcccagcactttgggaggctgaggtgggtggatcacaaggtcaggagttcgagaccagcctgaccaatgtggtgaaaccccttctctactaaaaatacaaaaaacttagccaggtgtggtggtgcacacctgtaatctcagctactcaggaggctgagacaggagaatcgcttgaaccggggaggcagaggttgcagtgaactgagattgcaccactcactccagcgacagagagagactctgtctcaaattaaaaaaaaaaaaaacctatataaaatagtttatagcagtttatagctgtgaccatcaagtcagataatttgggatgttcacagagagctctgggtgattatgacagtgtaccacccacatctcttatttgttttgcttcatttctctactagggagaggaggtcatataatatatggtatttttatgttattttagataaatccatatcaacacagcacaggagaacaaattatacccctggtagattttggggtataaacgtcatgaaatgtttctcagaaagtgagaaatatttcttgattgtatctttaaaattaatgcaaaattgttatgttactccataatttatttgtgtgcattactgtaaggttcatgtgtattcatattaaattttttcttttaaaaattgggttcaatgaattatctaggatgattgcattgtttgtggcatcaagtgttgtttctccctttccataccaagcatatcctgcttttggtacaggatatatttttttcagatgtcaaaacacctagggatacattttatgaattactaacttacttttttaggacagacttgaaatcatttagagggtaaactctagcaatatagaaatctgttttttgttgaatggagtagcagctaatctttaagacccattgatagcattttagtagtagcacttaacattcagaaaagaaaaacaaatcatccagcttctgatcttcagttttatgtaactttacaatttggtacttgatgacttggtattggtatgagactgaatagtgtgatgttacaaacatgtgatgtttgcctaccatgttctaggcactgtgccaagtgctagagatggaatggtaggtaaagctgtggtctatacttagggagttcacagtcaaatgaaggatacagtcacaaaacagacacttgtataaagcatggtcactataatacagagaaatggaaagaatggccagagaaagcttacttgaaaagataatgcctgaactgaatactaaagggaggtcagtgggagagacaaggaagggtagatattgattgtgagtgcatgagcattgaaatgagagggcccaggggaataggaagagaggaatagcctaaaggagaacaggagcaaaggcacatgggtgagaaacaacatggaatgttctggacatacaagcagatctctgttggaaggagtatgagataagggtaagagagtgattggagttgagtctggagagatacgaaaccaaatcatggaagctttttaaatgccatgtttaggagcttgaacttcatctttttgtgagttggacagtcattgaagggttttaagtaggggcccaatttgattgtattcaggttgagtagagtactctgatagctgatgtgaaggataaatttgaagggaaaaagattggaggcagagaggccatttgggaagtagttagcttgataagaggtgacgagggcttaaactgacacttaatagaaatggagaagagggagtagatttcagagtctgtactttttttgttgttgataaatagtaaatttagtaggactcgatgcttggaaatgaccagtgggagagaaaaaatggacgagattaactccaaagtttctagctgaggtgattccagggatagcgatgacaccaaacagagtgaatatatgaataatcagttgaggagacaaacggaagtcagttttggatattttgagtttaagatggttgtgacatcactaatggaggaaggctaacaaggcagttaacctttgaacttgatgctgtgggatatagatgggggtcctgggctggaaatacagcttgaagagttcatcagtttgcaggaggtgattgaaagcataagaccatcaagggaaggtgtgtgggctgaagagaaaaaaaggtcagaagacaggagcttggagaacagaagtgtttcagagtcaagtagagaaaaagaagccccacaaagataagaaaaggaactgaaaaaaatgaaataatcagtgggccaacctgaagatccaagcaagactagaaaccacacatttttaatggaacaaatctatatcgttgtgatttccttagaagccttaaattggtgggggagatcagaatgtaacattagtctaggattgaggttttaccagatggtacagtaaaagttgtgagtttagggaaaccaagttgtttgaagttagagcagtttagatgatcagctgtgccaaatattgcaaattatgtgctgtacattattctttacgtatattaactcttaaccctcaccacaaccatagttgttacagaagattctagaatgtaagttccataagagcaaggtgggtatgctttgttgtctgtgctattctcagtgcctgacatacagaataggctcaaatacttgttgaataaatgagagaatatgagatacatactattattcccattttacagatatggaaaccgggtaagaagagattaagtaacttacattcacaatttttagtggtagagccagtaggaaaggaattgagcccaggattagggagctgatggaaaatagagaaattttaggtctggagatctctctgaggatagtggaaataaaggcatgagagatgtagaaggggagaaagttatcatcagagagtaaaatggtggaggttatgattttttgagatagggttgttcagtgttatgacaaagggtcaagtcttagcagtggagtaaaggatgtttattattgaatctctgtaggcgtcgatgtagatgttgaaggctcctaaggttatactagaagtttgaatagagaggaacattatgataccatcctcataaatgaagtggtataattggagatctatagataagaagcagcagagagtggaatagataagctttcttatttcaattctagctttttaaacgtagattgaggttagatctggtttgctgaaaagacaggaataaattgggcttgctgcatataatttatttcccccatatggataagctcgttggaaagctccagaaatattcagaatataaatacaaaagtttcaaattttacctgacatgccagctctacttaaggtatgaattctaaatcttgtatctctcccctgcaagaaaagctacctcctcctttttatatagtagtagaacaaaatttttgtttgtgtttgtggcagcacatctcacctctttgtttcatagctgttgggtacacattccaaggacggtaaaaacaaaatgcacttgctcttctaaatctttagccactggctagtggattgcatttattctcagtttccttgccgatccttttacccttcccctcccccatttttctttttgaatggttttgtttcatgaagctcttgagagctttctatgttatattgtggcacaggaaaaagtttattcattttagcactaaactgtagttaacattttaagttaatcatttttagaatgttttgatgagcaatcctgtttcatttttagagatgattcaatctgatatttcatttgcttttaaagtctctaatttcttttcatctatttccatagcattgtaatttgtatcctgaacgtttctcttcagagaaatataaaaatccagcaatccattatagtattgtattaagcctaagatttcattatttatcatacacatttatttatttatttttattttttatcatacacatttaaagtacggcctttgatttatagaatttttcattttgtggttgtgcctgcttatctttgtttttgtgtgtgtatgtctttcacagaaattagtatcattctgtcatagctcttaggaaattcagagttaatcaaatatgttataaaatgtgtttgtataatgaaaaggttggaggagatgattctgaaggtgccatttagagcaggtgtgctatggtttggtggctctctattctctgcccgctttaaatcttagtaggcagcagatgaaatactactaagtgacctttgacacagaacccatgaatgctccaagtatgatttcattttaccgtgttctttgtaaactcaaatgcctgtcaaatcagatgtgtgtttcgatgtttttactgaatgcgccttgaggaggagactaaagcttggggtcaatttggcataatccccacgtttttctttttctattatagaggtttcttggggaaggggtgacatttctttctgaggaaaaggtgcaggctaagtgtaggtggactttctgtcttctccatactttttctgacagcctcactggatcctggtgatatcatacataaatgcagagcagactagatgggttgctggttggtatttttggttaccatttgatctggtgtctttggttatgtaataggcacattaactgacaaattatattaagtaaatatatagccatgggctttttaaaatctcactttttaaagtcaataattagattagattgtctcccagtaattaagtttttcatatgttcatggatatatgtagtatatattaaaagattatttgtgtattttttacattaatttggtaattttgacaatttgtcaactcaagtataaaatacttacatataaatatacttaaataagtatttaagatttaatgtcaactttacagtaatgaaatagaaaattcttgaatgttactcatttaaattttctgatttgagttctgataatctgttagaaaattagtaatatgcttaggctcacttcaatttccccagcagaaactattgtatccttactggttagaagctgccaatagtcattaattgttaaaatataagaaggttgtaggggaccatatgacaaaagaactagttacctttacagtttgttcgctgtacctcatacactttgtgttagaagaaaagctctattcagtgccttgagtgaaaagatccttacctccttttagactccgattgtgggaattttcttgctatcctggacattttaacttgttctgggttattttgaacatattaaggtggactcctggaatagttgagaactaattcatgtttgtttgtttttctgaatcagcagtttagtgattaaagcttaagattcttttaatagatttaatgaaaaagaaatcttaacttgaaatttaaattaatgaaaaatattaccagaggagatgtctgatattttgatacgggaaaatacagaaaataaaaacatttaaaaatttatccagatgttaatgtttgactggaagttttctactggaagaattagtttggattttacaatttgggagaggcagaagggagttggggaggtggtcaagcccaaattagcatgttgaatatccagattcacagacatttcactaaaccatttatgtacttagcatttttgttgactagtcttttcatttatagtgctcttaaatcactccatttgtcagttactccatttacctgaagattaaagtatacactgtgatagaaaaaaatagattggcaggggcgggggttgtattatataatgtaataaatcctattaaacctgttaaagtagaaacattaattttacgttttagaattttcttaatgacaggaaagtaaactggtaactaaaattcattttgttctgtaggtttgtggcattttatgtggggaatgtagatgctaagtgttatgagttgtccacctgtataaaactacttcccagaagccttgatgttcccataaagagctaaagacaaaaccaaatcaactgctaacaccttttatgggagatcaacttgtgtgggttatgaggcccaccttgactaagcaggatatgtaggtaaacctgcccagttggaattagtagctgatactctaaaaggagaatggtgaacaggaggccattagcagaaacagcctcattcatttatagagatcatcttgttaaaagggaaatcagcttccctagatcccaagggggtattgaaaatgctaggagagagcctagaaaacttttctgtgcagattgtcagaaaaaggtgaaaatattttcttttactgtaaaaagaaagaaattcttttccttcttccaaagatgccttaccacctttgaaaaagatttttaaaagtctcagagaaaatgaaatatagattcttaaagtggaaagggaccttaaaaatccatctggtctggttcattttatagatagaactgagaacctcaaaaagttatgtaatttggcttacatcacaagagctagtttgaagcagaagctacgattttcttactgtgtccagttgtttggaagtatgaatagtcatcattaaaatgtagggagtttatagggaagcttatgacaactattagttaatttacaatttgttcactgtagctcatctgctttgtttcagaagaaaaattctatgtcttgtgtggaaaaactcttacctccctatgaacagaactataggaaatttcttgctaacttggatgtttcagctacttcagggttattttaagtaactggatagttggttttcagaattctagttacagaaactagtaaaagaatatgagttgttgatacgtggaaactttagacccaaaataaaggtaggatgatgtgagtttagtgcttacaaatttgaatgaaatagtacctttttgaggtgttttagtagttgcccttaatgatttattttaaattagatggctttgggagtaaaaatactgcttttagcaaaaaataaatataaaattgaaacttttgcacgtagagttttttttttctttttgagatagataaagccatctaatgtccttttctatcatgtcttgataagtcaagagcagaccacttgatgaagaaaaatgaaatatcatctaaaatagaaaaatatcctgttaggaaaaataccaccgttttttcgctgcctttagtctggttgttcttattgtgtgaagggaacttaaatcttgtcaaattacatacattgtaagtcccatttctgtcttaaaagtataaccatgcatgctcaattaagtcagttatcgtcttcagactgtacttttgctaattaagtcttttccttggggttaagataagacaagatttacagatttttaagtttaaggcctgtaactactgaggatggtttaaagctttgataagtgagatgtggtgctttaaaggaggactttcctttagtctcttaaaaacacttggaagatatttattacagttttccaaagtaagataaagctcagctttaataatgaggaccttgaagtttttttatgtggtggggaggtgttaggaaactcattttttaactaccttcaagtgattatcgaggcaggtttttcttccctatgaggaagaaaatgaattgtgcaatgccagtttaaagaaactaaagcaatgtatttcttacataaagtagatcattctctctccctgtgtaactgccacctgtttaaaataagattccagtcttgcctctgtcagtcttaatgtgatagactctcactcagtgaagatctatggatttattttattgaaaacatttgtttagcatatatctgtgttattttaattttaatgtttttagagatgaggtctagctattttgcccaggctggccttgaactcctgggttcaagtgatcctcctgtttggcctcctaggtagctgggactacaggcatgagccaccatgcctgggtaagatctaatgatttatttgattgaaaacacttatttagcatacattcatgtatttttgtaacttgttgcctcctgacaggtcactagacataggaaagtgcctcttttaacactttcataaacctttaacataaacattttaaatttcttcattatagtggaaatagcgtctccccttattattggacattttgaaaaattaaaaaaattttaaaacaatttttatcataaatactagatgggaataattatatatgaagcttgtctgacaagttggatttttatgataggatagaatcccaggagtagaattattgggcatacccttttaagcctcacagtaaattattactaaagtgtgttgcaaagattttatcagttgtatagactcccagatatgaattccagggcccttcaggggaattagtggggacattttgcaaagagcaacagatggtgtctggaaacatgttctttaatctttgctgtgccacatactagttgtagatatctgggttagtaacataggttgtgtgggccttactttcctcaccataactcaggtgaattttaactattctactggccttaattctcattctgtaaaatatgagtataatcaaggagaatcagtgcctatatattaccaagtgatttgtctgggaaaaaagcagaagcagggaatgtcagatgtacctagaaaaaggagcaagttaggggaaatgcacaaaacatgatttgctcttctggtttttttaagaatagagtctaggctgggtgcagtggctcacacctgtaatcccagcactttgggaggctgaggtgggtggatcacttgaggtcaggagtctgagaccagccttgccaacatagcgaaaccccatctctactaaaaatacaaaaattagccgggtgtggtggcgggctcctgtaatcccagctactcaggaggctgagacaggagaatcacttgcacctgggtggtggaggttgcagtgagctgagattgcaccattgcattccagcctgggtgacagagtgagactcggtctcaaaaaataaaaagaaaaaagaaaaaatagagtcccataaaattatgtcagatagacactcctcctgagacttagggattttcaaaccatttcaaatagaaaatgaaagtgtaaggagacaagtgtgtaactttccaaaagaagttgtgttctgtgtccgttttaggttacagaatgactcaagccaaaaaaaaagtatgttattcattcatttacacaaaatacaaaatattttcattatcttctgttatttgtttaaattgataaaattatatttatggtgtacaactttattttttgatatatgtacacattgtggaatggctaaatcaagctaattaacatatgcattacctcacatactttttgttgtgagaacacctaaaatctactcttcacaattttcaggtgtacagtatattaactgtaggcctatgatttaccatggatctcttgaatttattcctcctgtttagatgaaattttgtatcctttgaccaacatttccccaccccttctacaccccagcctctggttaccaccattctactctctgcttccatgatttagactgttttagattccacgtataagtgagatcattggcatttctctttctgtgccttagcttatttcacttattataatgtcctccaggttcatccgtgtcgttgcaactgacaggattttcttctctttgaaggaagaatagtattctgttgtgtgcgtatactacattctctctatcagttcatctgttgatggatacttaggttgattccatatcctggctcttacgaataatgctgaaatgaacaggggagtacagatacctcatcaacacactgatttcatttcttttgtatttataactattggtgagactggtggatcatatgatagctccaatgttagtttttgaggaccctccatactgttttccatagtggctgtaccaatttacattcccagcaacagcgtacaggggtttccttctctctgcatcctcatcagcacttgttctgtttcatctttttgataatcaccattctaacaggtgtgaggtagtctctcattgggttttaatttgcatttccctgatgattagtcatgctgagcactatttcatatacctgttggcaatttgtatgtcatcccttatgaaatgtctgcaccctttgctgtttttttattaggtttatttattttcttgctatttagttgctttagctttttacatgttttggatactaatgtcttatcagttgtatggtgtgttttcaaatattttctcccattctgcaggttgtctcttcactcttgattgttttatttgctgagcagaaatttttagtttgatgtaatcctatttgtctatttttgtttttgttgcctatacttttagggtcatatttagaaagtcattgcccataccagtgtcagagagctttttccctatgttttcttgtaggagttttatagtgtcgggtttcatgtttaagtatttaatcaattttgagttgattttcgtaaatgatgtgagatgagggtctaatttcattcttctgcatggggacattcagttttcccaacaccatttattgaggagactgttttttccccattgtgtgttcttggcatctttattgaaaatcaattgaccataaatgtgtggtctctctattatattcatattttttaagtaaattattttatgatgagaaaggtggcaaaaattctgcattatctttgatatgtaagaaaaggccatttgggcacagattggacctgattatttctcttttcaagaagcaagtaccttatctctattcttattccaaagtgatttaatctctattaataatttaggcaactaaacatcattactgattgtaggagaaatctgagtctagtctgtctatactgatcaagaaccaggactacctcatggagactttggtaaaataaatctcaacagcactcaccagatgaataaaggttttcttgaactagtttaagatacttggttatcagttgaacacaaatagtaataatttaaggtttcatgaattgacatgtctataattagcttcctaaactaagaataacaaaaaatgagtagtttgttaattcctaatagcctgtgatgaaagttattatctggggttttttttgggtctgttttaaaaattaacactttggctctgattataaaatttataaattggaaattgaaattactggataaaatacaatttatgttttaaaaacattttcaagtggaaaaaattacagcttggctgaatagtgataattttcaaactaagcctttgagttcactatttagagttctctgataaattgttagagttagaagtagtgagttcattgcttgactgaataaataattcatatggcacaaaagcagctttttctttctcttcagttcccttctcccccattatgttcactttctctcttgtaaaaggctcctttgcagccaaatagcaaccttgtgtgaatatgcagggacttgggcatagtttcaacctcagtgttagctgagtatctggagtcatggaagagaattaagaatctgtcttgaatgtatattttctagtagcaactgaaaagaaatatagtagttgtaaattgctagaccttactcttacggtacagttgctctggaaatctctttttagcaaaataggattttatttctggatatagaatctttcgtagtgtctgcgtcaaaacaaaattaagttttaaaattgagtaaatcatttattttttctagttttttcagaaatgcttttttactagactaaataacttttcagcatcagtctgataagcatagaattttcaaaattctttacttgctattttagaattctttattttctaagaattatgaagactgtattaggtatttatgtggacttcctttttttcctaccttttattatagcaccaaaattggaattacgctagattattttctctctgctgtttaaatcataagagactcttttattgggtcagggcaattgtctttctagcacaataatcttctttgataatgtcactactggaaattatgtttatccttcataaattaactaatccttatttttgtaataaattatctgatatccttcagaggttatctaaaaatattcctttaagtctgcatgtattcagcatatttcatggtataacaagacttttacagttgtataacagaaatttaaaataaggcaacggactgtaatccagacttctgtcaactggaaatttttatgaagtagtattttgctggtatactgatacttcaccaaatacaatgtttatctttaaagaagtttctaaataagacaaaacattatgtttagtaaaattcaatgtagtatgttttactgtatactaattctttatatagcccataatcataatacataggctatataatacatgtaaagcatataattcataatacataggatacaaatcaaatatatgagctttattttgatataatcagactttattctgttacctatttgcctttctttttcaaacttttaagcgttgcccttattttcataagacttagtgtttcactcagtattaaatttatccaaagtcattgtgattttatgaaacattgtgattttaagtgctgaaccatgttgtttttcaatgtaaaatgagtgtaacttttagtaattattgaaatttaagcgttactgtgattttccataattctatttcggtagtcacaaaaaaacaaaaatttggcttcttattggcccttctagtgccaacactggcattgttgaaatacatttctaaggaagatggtgagtgtttcacttcattagtagctgcatgacaagccaccccaaagtttaatggcttaaaacaacagtaattcattatttctcataattttgagagttgactgagtgagtcttctgctttgtgtggtcttggctggggtgctaggaaagagggcagtccacagtggcctcacttacatagctggcagtggatgcaggctgctggcgtggagcacagttgggggtggcctgggtgcctcagctctccttaagtgtgcctctctgtgaagttagttgggcttgcttacaacatggtagctggattccaaaaagaaatgttccaagggcaaagaagctgcagccttttaaagggccatatttagaagttacttagcattacttctgcccattctgttgatcaaaacaagtcacaaggccagcccagatcaacaggaagagaaataggcttcatttgttaaagatggagtagcaagattacactgtagaagagcaaatggtttgggatgtattgttgcagccatctatggaaatgcaaactaccacaaggaagtgcagtttttgctgagcatgggtatttgccattaccacatttcagaaactggtatagtcaagcacacatggatttgaccactggatttacactagggtcacttaagagctatcagccactgtcttctcatctgtatgacagtagtagtatcaacctcacaggattgacagttaagtgagataatttggaagtacacagcgtagtgctggaaattccattactcccatcctgtttcttttcccatgtccctcatgtttaatttttatatttgtgattataatacttaaaggtatgttttaaagataaatcataattcatctaaagtctttgtcttaccaagatagttcaatagttccaatctgaataaagtttataacattaacataatttatagatcttctaatacaagcatctgtctaatgctagaattctttataaaccactgtatataggctactcacaatgtaatgagctactaattggtagaaacaagtggctatttgccatagttctacattctgttctaccttctattttgcagaaaaatcttacagctttcctaagccatctttttaggtcaattccagaatttgtttatgatcaaattgacaagtacctagccaaagagattaagatactgaatcagagaaagaagtctaaagagataattttccaatgatcatttctaaagaaggaatagagataaaatattttaaaacaggtactgaatagtcacagtcaaaggtttgattatgagtcagctttgttggttttagtctcattagtcaccagcaccaccaacctgtcatattggcaatacatagttttggtcaccaggagaaggagtcacagaaaaccagtactactacttacagaagattaactgaaagcacatgtcctgatttgttcttgaagataagactgaggtgaatattgcttaaaacagtatcagcaaaatacaaaatcaagtgaaatattacattgaatataataattgaaagaatgaggatagacacaaagaacttttggatgctagtgattagatattagaattagtttctcagaatattttaaagaatttaacaaatgacagtgttatgaattatgtgggcagtgcttaaagtgggaacagagcaaaagaagtggatttagttttgtcaagtctgtctgttcagcgttagggggaacattttatttcttctgaaacaatgatattggaatcccatttcatcttttcattttcaaacactgactttataagtgactttgggagaagcttttaagttttatataaagcactttttttgtacttagcacaaagtgggcacctttaaaattacctgtttgtatagcagttaatttaaagaatatgttcatgcatattactatattttctcgattctaaaagctcatcaattgtaaggcacattctttgatttcataacaactttttaatgtctctttttggaaaaataaaacacttttcttgggggaggaggagaatttttctaaggattattctgaattcctttgggccataggcactgtagcaaatgctgctcttcctgatctttaacacttttaggattgatagtgtcgttctgagccatgtccaggaattactttggcgaggtttccatttcctatttaattaaaatttttttactaattatattacatttcactagaagttaaataacttctcttgaaagtcatccagaagactttaacagccagatatttggtatctgctcagaattatcacttgtgaaaccttcattaaacataattcagccacatgtcacagaaagttctgcatgtataataactttttgtttcaatgctgcattatagtgatctttaaaagacattttaagaggtaatttagggatttcaaattaagttaaaatttagctgtgcatagttctgttgatgctgataagtgaacagaaggtaaattcttagtcatgtctaagttcacacagagatacaataatacacgtgggtgtaatacaaagcattatagtattttgtatagtatctcctttgttattaaaagttcttttgatatctttggtaagactcctattgatttgaaaaatgttactgtgaaaaaaatgtgctttaagagttgagaaagtaaattattcctttttttctctcagcagctgtttaaggaagacagagcaggcattggataatattcttattaaggtaaagaatctgggtgtttgagccctaaagtcatacagcaagtagtccacctggaatcatgaaccaggtcttcaggacttccagatatttgtgctgtatactatgctgcattttcaacaataattcatttatctgtgggtttgatttaatgagactcatttattcaacaaatatttattaaatgctattcttgccagtcattgtgttaaatgatagtgtaacacagtaaacaagacagatatctttccatgtcctcacgaaaccagcagctttggaactaaacaaataattataactaagatgagcattaagggagaaattgtaagatgataggaaagaatataacaggcggacttaacctgctctgggatggtgggggagtgttgaatgtgaactgagggtaggacatgagaaataacttttgggctgagattggaagaatcagcatgagttagcttaagcctaggaattaggagaagggttaggatggaacattgcaggcaacagaaatagcatctacaaaagtaaaaggaagaactgaaaagattccagtgtgagcgttgaaaagaaggataagtaaatgtagagaagaatgtaggaaagagattatgcattcttcaggattttttgacctatatcctaagggatattgggaaaccatggaaaggttttaagcatcggggtatgccatgattaaatttttcatttgaaaatcatgagtctgactatagtatatatagaagcattgttgttagatgctatttcggtaggccaggttggagatgatggttacagcagtggagctggagagaagggaatagatttgaaatttgggatgtgaacaaagccttgtatttgacagaaatgtaaaactattaatagtattgttattgttccacctatagaatctgattataagattatctctaaaatactttcaggtaacttgtacttaatgttaggaggaagtgactatattataaatataatttagaaaacatcgttccttaaaaaataatttttgaattgtgctaattcttgttattgtttgacttcattaactaatatagggagtatagggagaacttagttttaaaagataatttgacttcctgatttatacataaaacacataagtaattttggacatatatgatgtgtatatatatatatatatagtgcaggtcatcttgtttacaccacttattaatgaatatcagatttggaaggtgactctttaggattttcctattggttgattgattgaaacttacatgaagaatttaacccttttgtttcaaatagctttctattaagaaacacttttttcatgattattcagagaatttattgctggatcattggctctagagatagactgctggttaaattaaaagatgccggaggaaacattttggaaacagacttcacagaattccttatgaacttctgtactttcttaaccaatcttatttctttcatgtacctatggctgttactagcctgttgtatcagggataccatagtcaactacctatacgggccttaactataaagaattaggccatttagggaaataataatgagactggggctttagagaatttgtgctcatctaactgagtagagggacagctaatattctgctccatctgatggtgatcatgggagtattcaggctgattgttacccaatatttcagtttttccaaaggatcctaaaatacagatttttatgtaaattagttggtaattaatttaggtgtttttaagatactctgtgacaataactctacagggcaaaatcgacctgttaaatatatttggcccataggctgttgttttatagccttgaccatatagaaatcttcaatatctatttaaaagtaagaggtcaaaagtatttctaggaaaagtgaatgccaaaagaagggaggaagggaaggcataaatgagatactttttaaaagaagtacaaaactagttatctaggttatatttttaaactaagttcaaaaagaaattcactgtcctgagaataattttcatatgcttcagaacatacttctagcaacttcagccatctgcgtgtgtataactgggaactcagagtaggatgagaatgcacagggcgtagagaaccaatgaactgtagatgagagtgtagtggttctctgaaactgttgtgagcagagtacagcaggaacaagagacagttgatattggagcaaaatcaggctataagaacatagcgatctgagtacatcatgggcccctgaaagcattactagactaaaagcataattttttatactgatgatcaagaagaggtcatattggtacactaagattgaataactctgctcccaatagcacatgtaatacacaatcactgtaggaaatcaggaaaatatacaaaaagtagcatatggtttttttttaaagctaggaatgggtaaaattctaaagttttctaaaagtaatgaaaatagaacttggcaattgttagtttcctaatagctaattagtttccaaattagtctaatttggcttaaataaaaagaatattggttagctcacataagaaaatacatatattaggattagttacgccagtggctcagtgatttttttcaaggactcagtttgtcgtctactctactctttatccataatatttcctttatcccaacactgtagttgccaaatggctgctggctgcaatcaggattgtgtgtttcctccttcagatccaaagagagaaataaacttctcttggcgttctcatgggcaatataggttcttttctctgagaagtccttatgcactcctgcccccaacttgctccttattgtcctaaattagcttaattctaaatatgccttaactaatcgttggcaaaagggatgagcttaccataatggattagattaattgtggtctacccttgcagctcaggacagtcagcttaccctgaggcgcattgaccactgggagagatgtggatatagaaatccaatcatggatcattaggaagaaggaagcgttggataggctctcagcatggtccaccacagttgcattaaggattgtgtattacgttttttacttatgtgaaacaccaccttcccccatcaagcctgtaagtatgaagtcgagtccctagtgaatctactctctgactcctgtgtttcaagcaccctcattagcagagcttatatagttcggagttgaagaatttttttttcccaaaaattctcttctcatttaatagacacctgtctgtagagtaaactatgcaggccataaatggaacaaagatagtttaggaaaatacagtttcttaaataaattacttttaaaaagtatattttctctcagctcttctctccaaaggagttttgtatcataacctctgtagtaaatagtgtcatctttattgtctgattataaaggtgaagtataatttatgggataatttacaaagcaaaaaagaaatacttatttttaaagtttaaaaattttctgtgtagaaaatactataataatgcatgattttaagaatctgttattttggctaaaatatttaaccagccaaccatatatcttatttctttcagttgctagatttctgaatgttagccaaatattttagtatctgggtcacatagtcattacaaacaaatgtaggccaaaatggtttatgcttctcagttgccagctcagttctctctttgactttttattatttgtttctctttgaactaaactttatttacttatattagcacagtactgtgttaattctttgtgtagaactggtcttcttgtgtcgttttgccccaaatcaaggtaacaaacaaataaatgactgtgctcttggctgttatttagaattgttactatacaaaaggtcacacatgttaaattacctactgcagtgctaattattgtgaaaccttgttcaaaatgctagagagactgtgttttggcacttctgctgtaacagtttttaaagatccaacctgtatgcattttggtattgaaatcctcaaaactcctaaagaccctatgttaatttaaaatgcaaagttgtctcacctttttatactagatgagatagcatttttcttaaagtaaaatgagaactcttatgtgttatgatatagaggtaagggcagggaaagagagggaaagaagaaaggagtacattggagtaacaaaaattccaccttcatttataaagtgctataggctctaaaactccattctgaaatactcttttaactttgaaaggggtatgtttactgccagcttctgttaacacaggaaccatggtttttctgttcttaaaattaagaaccttataccttttggaatttttaatatttttctctatgtttgtaatgcttttaattatgtttattactaactgatgttattaactatatttataatttgtacactctattctgtttggaaagtacaaaatgataccatagatacttcctgaatttttttagaaaaatcaaaattttattcatctttattcatagcatcattggacattcagttagtaaattttccagataacaaacacctatcttctttgattgctagaatagttaatctcaacccctcttgttataaaatatagtgactgtggattgttgatgaaaatttcttaagacagtgtattcaggaagacactgcctcagggctactgaggtatgtcatagggccatttgtcctttcaaaaataattctcagtagctattgttgctttgcatttgtataaagtgtctgttttttcaaagcttgatattaattctgatagctactagtgtacagagaagggtgtctgtgaataaagtaagagaaagaatgttcataatagatttgaagagcacttcaatgagtaaagtacttggactttacaatgtttgcttttacttcactaagtcctgccctgtgcccctgctcctgcccctttatgccatagtctcttttttaacatggtacttggcagtgttccaggtagttattgtaagaaggatgagcttagacttggagctagacaaacatgatgggaattaaaacaggataatttaatagctgtgagaccttaagcaagttcacaactgcaaaatgggtttgtatatactatctctcacggttgtaaggattaaatataatggatatagtttaggaggtattttaacaaatgctagttcctttccttatactttaagataaatgacccacttactttggaaatggtatttgcctattttagtatgatgctataaggtttaaagggtcagtatccctaaaatatgacagctgttaagatctctttaattattcagaaatgaatggtatgtgacaagatattattggttaattcagtggatcagatgaataaaatgtgctgaaatattttggagactgaaaatataaatttagatgcaagaaatatattttaaataaacatggaaaacagtttttttatccgagtctaatcacgttgaaatattttatgaatatccccagagagttcgtaaattagtgagtgatttttttaaatgcaaaggtaaatacctagaaatcatatatacacttaaagtaaaatctcacagagttctcaaggccattttgcatttactagtgccacagtagtggcgttacagtgagctgcagtaacctgaaacagtactgcatggatgctctaataaattgcatgtctggaggaagcagctaactatggcgaccgccacggagcagtgggttctggtggagatggtacaggcgctttacaaggctcctgcttaccatcttattttggaagggattctgatactctggataatcagacttcttttctctaagacttacaaattacaagaacgatctgatcttacagtcaaggaaaaagaagaactgattgaagagtggcaaccagaacctcttgttcctcctgtcccaaaagaccatcctgctctcaactacaacatcgtttcaggacgcagtcttgctctgtcaccaggctggagtgcagtggtgcgatctcggctcactgcaacctccacttcccgggttcaagccattctcctgcctcagcctcctgagtagctgggactacaggcacaagccaccatgcccgcctaatttttgtattttcagtagagacggagtttcaccatgttggccagaatgatcttgatctcctttttttaaattaaaaagtaaactttaatgtcgaaaatgcaaacctggggagggcagaaagatcacacacaaggctgtcacttcacacttggaaggttgcacagcagccaggcagagaccctcctcacttcccagatggtgagggggccgggtgggggcactcctcacttcccagacggtgcaggggctgggcagaggcactcctcccttacaaatggtgagggggctgggcagaggtgctcctcactttccagacagggcggcggctgggcaggggcgctcctcacttcccagatgggacggtggccgggcagaggcgctcctcatttcccagacggtgaggaggccaggcagaggcactcctcacttcacagacaggacggcagcagggcagaggcgctcctcatttcccagacggtgaggaggccgggcagaggcactcctcgcttcgcagacgggacggcggcaaggcaggggcactcctcatttcccagacggtgaggaggccgggcagaggcactcctcgcttcgcagacgggacggcggcagggcagaggcgctcctcatttcccagacggtgaggaggctgggcagaggcactcctcgcttcgcagacggggcggcggcggggcagaggcgctcctcatttcccacacggtgaggaggccgggcaggggcactccttacttcgcagacaggacggcggcggggcagaggcgctccttgtttcccagatggggcggcggctgggcagaggcgcttctcacttcccatactgtgaggcagctgggcagaggtgctcctcacttcccagatggggtggaggccaggcagaggcggcgctcctcctcaattcccagatagtgggcggctgggcagaggcgcgcctcacttcccggacggggcggtggccgagcagaggcgctcctcacttcccagagtgtaggggggccgggcagaggcactcctcgcttcccagagtgtaggggggccgggcagaggcactcctcgcttcgcagacgggacggtggctgggcagaggcgctcctcacttcccagacagggcggcggcctggcggaggcactcctcactgcccagacggggcagggcctgggcagaggcgctcctcacttcccagactgtgaggctgctgggcagaggctcttgtcgcttcccagacagggcgggggccgggcagaggcgctcctcactgcccagatggtgcggtggccgggcacaggcgctcctcacttcccagatggtggagcagcagggcagaggcgctcctcacttcccagatggtgcaggcagagatgctcctcaggtctcaatctcttgacctcctgatccgcccgcctgggcctcccaaagtgctggattacaggcgtgagccaccacgcctgccctgccgtctcttctttctcctcctaagcagctgtcttagtctcctgaattttgatgttctacttaacaccctcatgttcttacgcatgttgccctgctggaggcgtccttctctttgggaagcctgacccaccaacagtgcctcaggagatagacatggaagcttagccggtgggggcccctcgtctctatcccacctcagttgcaggggaggggtcggttgcagctgcagtggtggccccgacagttttcttttgtgggacctgtggccggcagctctgggtggagaagacctacttgatccaagagctgcaggatccttgggctgcatgtcctcccccaccatcagcaagcctggagagctgggcaggtggtctttacccagcaccttcaaggccgccttctctggccacagggagcagcccggaactggggcagggagcactgttggaagtgggtcaggcttcccaaagggaaggatgcctccaacagggctgtgtgaactggcgactccatggcccttggagtagaaactcactgcatgcacctgggccttgtcagtctggttgttttctgtcaagctcttgaggtggacatttccctccaagggcctgggattgtaccaggaggaagtgaggtttccctgagtctccaggggcctagaggtggaggctgcttccccattgctacaggggccccttttattgtcctcctgcccctgggtctctacctggtctttcacctccgttgcttctttgggctcttctgccctcacctccatcttcgggagcctggctgggatcacctgctcatctaatgaaggaagttgaaggttaaacttgcctctgagacaagggatccttacggggctgaggtgtccaaacatcatggagttgtgaggagacagcacgggtttcttccttgagggggggctccagaccacaggacgcaggaccctctgtggggtgcccgtgttccgagggataagacacagcctcataggggcgccgtcccacctgactggaaaagaaggcccaagatgtcgctgacggttgaagaggagtgggaaacggcccacaattccccgggcaggcacaggtgcaggagctgcagggtgagcccggccagctgggaaggcctcacggacaagacgagcaggttgccgatggcatggccaggacctgcggcagaaccaggaacaaaatacgcttagcgagttgcccattttgagcgagttgtgcacagacgaaactaagggtcagaagcggagaggatactcctaagtcacccacttctctgtggctgggtgcacactgggcatctgggagtttatgacatcactatggggctggtgacagagccagggtgtggaggagtgcttaggagcccagcgagggtgcctacaagaggagtcaaagggcaaagggtgagacccttccaccggtccagctggactctagcctcagggatatcctgctcctgggggcaagtgtgtggccctggatgggcccccctgtggggctgttgggggtgcgaggctgatccgccagagcccttccacctggcgcctggcccaggtgctggctagcacccagtggccctgttttggccggccctgtcccccaggttacagggccagaacctggaagcagagcgcaggaccagccagatcgcgccaggcttccccggggcctctccagtgcctctgtgccacctggagccaggcccgccttctccatggctgccgtggcctcaagggccaccagccttgctccgcaggtttccaaagagaggacgcagtgccctgacctgactggatgcacctcttaccacatgcctccctggcaggcagggtctccactttttacaaatttgcctgagaccattcctcaggtcattcaggtggtcatggcccagccaggctttgaacccaggctgtgcgattccacagctggcgctctggcctgtgtgcctcatgatcatggatacagcatctattcttattttttcctgtagtcctggggtacttagcaccgtggcatatctgtaataagcacatgcacacctcgaaggaggtcttcacttcaacatacaagttgaccatggcatgctctgggctccagtcctctacaaagatgtagggcaggaactaccagttgtcagcacagcaccatcccacattgctcttctaatggagcctttcaccccagatgttctttctcgtctgatgggaaggatccaagtatgtaaagattatgttctagatcagctttggtctgtcctaaaagaaatttgccagtggattattccatatggataaaagtcagtttctctggtcttcctggaatgtgtctagaaagcaaatacattatttacaagttcatagtagatcaatgtattggattaaaatatgacaaacataatttggtcattgtgagcatgccagcttggtcaactattcaccacacatgatgccctaaatataactctaggttttcttatgcccaagagagggacatactcttgggtgtctggactagggaaacatgtatgaaaaaccatttggccactctacatcttgttattggagaattgaaaccatctatattcaaagatattattaaaaggcaagaagttaaaaaataaaaaaataaattgcatgtctgttgttatggaattttataactgtacataccttttatttaatccattcacaggtcatattataggatatctttcatttaataagtatactaaatccataccttatactgttgagttttgatagtaccagagggaaaaaagaagaaaagcatggcctctatctttaaggagctatttaacagtcatatgaatcactcgattgagaagatccatatgtgtaatataatgaattccacaaaaattgcttattaaaattttttgaaaaagtaggggtgagattgaatatagcaaagctttattgttgatttttgttgttggccaggccaaatttgtgaacattttacatgatcagctatatcgaaatacatttgtatgctctactgaatatagggaacataatttaatatttaatttaaactccaggttaccatcatttacaggcattctgtgcattaaaccgttttgcctcttctttcttcctcagtaacacgtttagggccttttgatgcattggaaagaaaaggcagttgcgagctgctggctctagcaaatcagagctaatcaacctgagaataatgtttgcactttcccgctttcaagtctttgctcaaactgctctctacctttgctcccacaggttagtcctttcccccaatctaaaatctctctgactagccctgaacttactttttatagctctcactgtctaccatctccttcatcttgaatataccaggacagactgggaagttccagaaaaaaacagacataatacttaaatcatctttgatacctaatttgtcctcactgccaattaattaattttgttttgttttatttaattttgtaaagacagggtcttgctgtgtcacgcaggctcctctcaaactcctggactcaagtgatcctcccacctcagcctctcaaagtgctaggattagaagccgtgagccactgcgcctggccataatttaaataatcctttagattcctgtctctgtccattttcaaagccagggttacactatcataacataccccatgatgtacaccattgctaaaacaatcttcctgaagtactaattagatttttgagcagagaataaaaccatcctttccagtgttggcaaatattcaacgtactgtcctgaaatacctgtagtacttccaagtttctgctttgtgctcacactgttttctttgacctgaaatgcaatttctatctataaaaatcttagtcattatgaggtctagcaaagatctttttcttctatgaagccttcctatcgaccctaactaaaatctcttctctgagttcccagcgtatactgcttgagctggagcaagactccagtgatccttggaagaaagtgggaggttattttcccagtgcgattccaggaaagtttaatgtcttatagttcagtcccctttagcattccacatacagttagtgctcaaatatttgataattgctctactcacaaatatttttgtgtgaaattgctagctattctctatccaagaagtaatgaagtatataagcttcttcaactctttgttgagcccgggacctcttacttatttctgtatcctatctactcttgagtagtagggtcattggaaagcaaccactgggtttggggataagttgtgtgtattttagaggaggaagtaaaggtgttactggacttttaaaactgaagctttttctgttttaaagtattttgcttcccgttactgtatttataagatgatactggtatacgtagtgtcttggctatttatctattcccctttctctttaacacaatattccccaactttggtgtgatactgaattgaaatctctgggagtgtggcctaggactctacacttttactaacaatcagttgagatgcttatgaaggtggtggtagtagtgataatggtagtgatgatgatgatgattgtattagctctgctttcgaaggcttatgatgtacttactgcacttttctaggcagtttgcaactattaacctaatgttcacagcaagcctatgtggtaatacgctattatcttcattatacaaatggagaaactgtggcagatataaattaagtaacttgtcgccaaaatgactttcttataaataggtcaagaatccatgaaaaggatgaggcatatttttttggttgatagtttttaaactcactttctaaaggattgctttaagtgatgtgaatgatatgaatgtaaactggttcttatataaattgaagtatcaatatgctgactctatataggaatacttcaacaactagacctaaatatagatacttgctcttgcttttaggaagcctgtcacaattcttggtgaaaaagtaagcatgcacccaaaaacgtagaacattgaggaaaatttttaaataattacactttctaaaatacatgattttaggaagagtgctttattatatactatatatatatatatacacacacacatagacatacacacgtagatgcatatatatttactctatatggatgtgtgtctatatgtatagtcattcttcagtatcctcaggtggttggtgccaggacaccctcagataccaaaatccaaatactgtcccacagtatttgcatgtaagctatgcatatcctctcatgtactttatttatttatttatttattgagacatggtcttgctctgtcgcgcaggcttgagtgcgctggtacaatcatggcttactgcagcctcgacctcctgggctcaatcgatccccccacttcagcctcccaagttagctgggaccacaggcacgcaccaccatgcccagctaacttttgaacttttttgtagagatagagtttcattgtgtcgcccaggctggtcttaaactcctgggctcaagcgatcctcccaccttgacctctcaaagtgttgggattacaggcataagccactgcacccacccatcctcttgtatacgttaaatcatctctagcttacttataatacctaatacaatacaaatgctgtgtaaatagctattatattgatttttatttgtattattttttattgttttgttgttttttaaatttttttcctgaatattatgtgtgtgtgtattgagatgttactttgtgatttaatgtaattcaagtaaaactcgttaagcatttattttctgttttagtagcataagataaatttggttttatatgctaaaatattttatctttttaataataaatgataagaatattttgttcccttttagttcatagactatgggaagtggagtagggagtgaaagtggtggctgtggtggtggtatggtggaagtaatttgtttaccatcactgcctgtccaaaataattttgatgaatgattttaggtgttgcctaataagtgctctgacttttgaaaccagttgaactaacaagcatgttgtgctttgctagaaacatcttgtaagttctgactttgaacagacagtggaatctaaattgagttagtggaggacatatctttacaactaaatctaaagtgtttcaactatttctttttttaatctcctgtttatttttcttgtagaattaatatttttgattgaccaatcataattgcatacatttatggggtacaatgtgatgttttgatatatgtatacagtgtgatgtgcttatgctaattaacatatctgtcacctcacctataatatttcatattgagacatttgaaatttgcttttattattttgaaatacttaaaacgttattattgactctcgtcaacttgctacggaatagatctcaaacttattcttcctctctacctgaaacttcataccccttgatcaactccccccaccaccctcctaccctagcctctggtaaccattgttctattctctacttctatgaatttaatcttattagattccacatgcaagtgagatcatatggtatttgtttttctctgcctgacttatttcacttagcataatatcctccagattcatccatgttgttgcaaatgacagaattttcccctttttaaatgctgaatagtattccattgtctgtatataccacatttccttgattcatccattgatagacacttaggtgtttccgtatcctggctattgtaaataatgcaacaatgaacataggagtgcagatatccctttgacatactgactccagttcctttggctatataaccagaagtgggatcactagatcatacagtagttctatttttagtttttttgggggaaacttccatactatttaccataatggctgaactaatttgcattcccaccaacaatgtactgtataagagttatcatttctccacacactgtccaacatttacctttcatctttttgataaaagctactctaacaggtgtaaagtaataatgcattgtggttttaatttgtaattctctagtaattagtgatgccgagcattttttcttgtactagttggccatttgtgtgtcttctgagaaatgcctgtttaggttctttgcccatttttaaaaattgggttatttgttgttttgttattgagatgttggagttacttaaatattttagatattaaccccttattaaatgtatgatttgcagatatttctttttatatttcctgtttacaaatttcctgaacttctctggctgctcatttatatagaattgggatgagttatgtcacctgaagcagtcaagataagactgtttctactgatatccatatggcaggcttactttgttacccaatccaatgaaaaagggtgccaggatgtgaaagaaaaatagatgtgatggccgggcgcagtggttcacgcctgtaatcccagcactttgggaggccaagtcaggtggatcacgaggtcaggagatcgaaaaatagatgtgatgccatggaacattctagggaattaccatttttagagagagttttgataaaaattttacgtatttttaaaactcatattcttagtctgaagagttggaaataaggttgaatgtatgtcttaaagctaatagtataaaaagagaagtgtaaaatttaagttaatcatacaactttctttccctaactttatgaattgactttttgcaatttccggagctaatgaggtgaatgtctgaaattgagtatgtaggttaaaaagttgaaattttcctaataaaattgtatctctttctaaggtgtaactctttctttctttgattatagtaaaaggagcatctgtggttcttaagaggtcttgatttttctgccagctagttgtgtgactttgggtaaataatgtcatatgactggacctgtttctttatttgtaaaattgtgtgtggtgttaaattctaagactgtttttaaaaaaatttttgcggagactgggtgttgctttgttgccaaggctggtctgaactcctggtttcaagcagtcttccccaccttgacctcacaaactgctgggattacaggcgtgagcctccatgcctggccaaattgtaagactcttataatggatgagtagaatatatttaagattatataaaaacacaagtcacttcatgatcatcgtctgctggaacatgaaaccagctttcttgtgtagatgtgttatcagtaatgttattcacaccgagaggatcattctgtggtttttaattcatgattttgtaatctgatagtgacttttcattatgtctcctgatttataattacatcacagccattatgattggaatcattgggaagagttgaaatgagcaatttagaattgtttctgaaatacagaaagccttattttttggtgggggttgttggaggagatatctctgtgttctgtaatttcatttgactaaggaatttatctttggtcttctcccagagtgaggacatgaatacttccatagctatattccgtattaatcacagtttgctttgtgggtttcattaggctaaataagaaaaacgtcgttatgtattttctgctttaaaaaatgcttcttgatataaagtcttctcagatcagtcccacatgtgataaatctattcaaactattaaactgcctcaatgtgcttgtttctctcttggaaatctatccatttctgtgtctttatgtaccactcactctcccccatcatattttaggttataagctcctttcctttatatctcatagcacccaggaaagaactttgttagtctctgaatagtttataagtgttattgctattgagaattttggatttaaattattggaatgaatagaataatgctatttctagtatatctaactgagggtcagtgttattaactcaaagacatagcagttttattaagctctaggctttgtttctgaagtcagtttctcttaatcataagtggattattcactttatattctcttatataatgccttggtatcaggttattgataggtaaacatcagaaataggctggatagatatgcatgcatgtgtacacatgcacatgtatgtgagagagagagagaaggattgcacatagaatatatgagaatttgaggtgtgtgtaatgtttataactcatctgagtcttacatagctatctagttatgtacacttaattttgcaccttttatagttgaaattcagaaacattttttaaggaaaataaggacgtgtttttctttccttcatgttttcagtttagctttatttgattgtatttttgctaaagacttaaattgtcaataactattgaaatgggccaacttatagctgagcacaaagtatgttaggacactgagatatatcttaacatttgggaataatttaatgtgtctaatacttgagaaggatcaaaacagactgtacaacccaataatcataaagcctatggtcaaaaatcgtatataaatgacaggccctatgaagagtagccgtaagaatcaagagaaaaagaacctaaattggtacagaaaaggagctgagtcatttttatattataattagaagttggtaacgataaattttgtcttcccagtacaaaaagtatcatgatcaggcaggattacgctaaagtgtaacctctaacttcttgtggtatgtactattacaagtagttgatgatttaataaatataaatatagatgatactgtcagagtgtttccagacattacagttagcttttaggtgaaggcagtgcttgacagaacctaagtttgtgactcaataatttattatataatctaataccatttttatcttgtattaatttgggttataggataattggggtaactttttggtgagggattgaaattttcttaaaagcgttttcagaagatactagaattttatgggattcttttattatagcatgtcttctcaaatataatattaggactgcttgaacaggaggcaaatcatattcacgttattttccagtttagagttattgctcttatcagttggtgggtgtgggaacaacttaataaagtttgggtaatttagttttcagtttaaattctcaactggcaattggccgaaaactcccatctgaagacatgatcatccaaatgtcattttgtgatttggctactgtctgcttgacataggaaagcactatcaagaaagactaatggagtgactatcaaaaggaagtcaatggtaagagttttcatttaaattgtgtgtgtgtgtgtgtgtgtgtgtaaagcctaccaatgtattatatttgaattaaaattttagaacttttaaaatctaggacataatgacaagtgtttgaattttatatgtctgtcacttatattttaataaaatatatgcaaagaatggttttatagataagagattttacatacttaatgttgataaatagtataaaagtatggaaaatcaattatatagttcatgtctggtttaaaaattcaatttttgtagttttattgtagttatttaaaatagtatattataaaattgcttgactgaagtttaacttctaaaaaatttgtactaaactgagtttttctgttcagtttcataagtgcttcttaaaatagacatgcattttgtggtagtctgttgaatgctgtttggttttttactttcattataaaataggaaagaaaaaagtataatatcatatgacaaaatccatttagtttaacattagttctttaaaaatgtataattgctactatactttggcggaaactattaaatttgtaagataagacgtttatactctatacccaaaacaaagtgaagtagctgttcataatatggcgcagaatcaaattttggtgataaaatcagacatctctctcctgccttacacatactcccactgagaaaataatttctaaatttggttacattttcatatacttcagatgaccttaaatttatatttttctcctgaatatatttgattcctgcatatccctttttttgggcatctgtgtccaatcagatccatgattagtcatgttagctttggacaagagtggaggtaggatcttagcaagtttgaaatctttaagattgatgtttatctgagattattccagcatgtccacggacatagtagttttgtgataacaaggtaatggctgatgaagattagcatattaataatagattataattctgttaaccattctattgtcaaatacgtgatttttgcgattcacatagtttaagtaatttttcatgcccaattagagatgtcaaaattatgttaattgaatctggccatgttcttagctgttttctagagcttaataacaaacatatcaggaagagctcttgtgacaagcacccagcacagcatctgtcattatgtaatcattccaatgtttacagtgaactaagtacttgagatggcaacattcatactttagtccctctgtctagtaattcatacttgtatagtctgtctactatgtgtcacccatttaggtaggtgctgagaataaaatggtggggttaaaaacagatattccctgttattgaacttccagtgccaatggtaattacagtgtagataataattacacactgcaactggaaccaatactataaaatggcataagttcctataagggtaggaacaataaagttagtgtataaataaagcacagaacctacacatttatttattagattgaattgataacttgcttttgaacttttaaagttaattctattaatatctgctaagctaggcatcagaaagactaaattctaaccatagagaaatacattttttatgctgctattctattttcttagatttcttaagaatttacaacaaaaccctgtcaaagcagcattcttacgtgagaatttcacttacgggagagttcttacaggatttcaagaaggaaagccctgaagagggacactgatttcctcaactgaatttaaaattgttacatgcagacatttttaaaggtagtatgattttccttaatcaagtcaactttatatctttttatctttttaaagaagggaatgtgacatttatgtttttcatacacacacacacacacacacacacacacacacacacacacacacagagaagcatacatgttgattacgttttggaaaataaaatccaaagagcatttggatgtctgaatgtttatgcttcatctccgcagtgacttctaaatttagtttttttctggatatactcaaagtcaccaacctgagttcaagtattctgatttgaagatctcaacttagagatccaggcagtcccccttgtcagtgctaggagaaagatgtccttcccataccttccagaaagagtgtcttgaagaaatatattccttcctgggtaacgtgctttggaatgtacatgatattcatttttctttgacagctctttttggttctgtttagttggctttgatgggttcatgatgcccagtggagaatttggtatttagccacaaaaagatatttaagacacataattatgtaaatattgcagatggaggatgatacatagcatttcttttatcaaaatgaatttgaattgacttctttctaaaacaaaattctaccaatagtcatcagtttttaattatataacttctcaatataggaaataatcagtgtctgattggctgtgtatgttggagtgtaatggcttttgttttgaatttggcagtttctactctcagaagaaatgagttgcgaattacagtggtgttagaagaaatgaattggaagttcgaatgagaaaaatttaaataaaagttattgtttatagatatggaaaggaaaataatgtttttagttcaatatgagaaagaaccttttaaatgtagaaataaaatggggtgcctttctacatccattcttaagaatttggcagaagttatgaagaagttaaaaagaaggagttcctgctgatataagtcacgaggattatttgaaggaaatttatgtcacatctcgtaaaatcatcatattgacaattataaatatgtaaaactttatgtgcaatagttattactaaaaatactgagctactatttatagtgagatcattattaaataaatttaacagatagaatagcaaatcacatttattcattcagtatattcttaccaacaacctgctgtatgtcagtcattgcataagactgatgtgatgccataggtcttgcagggaatgtagacattaagcaagtaattacaataaagtatagtggcttatgatattataaaaacaaagcagtccttaagtataccttgcaattgatctgtagtatattaattttaatccgctcatactcctcatgaaatgaggttgttcattttgatgtaaaaattagactgacgttctttgcagttagtagagactgaaaaagttcttattatttgtataacttatttaaaatgagaaactgctgtggaaagatctgcaggtttctgagataccaagaaacgtgaatatgagcagaataaacacatgcatattatatacattataaacgtcatttaagacaattatatgaagcagttttacatttaaaactaccaagttgtaatagttaagaagttgggctccagagtcatactggttgggtgtgagtattaactctgacacttaccagctttgcagtcttaggaaacctgcataactctactgtgcttcagtttccttacctgtaaaatggggataataagagtatatatcttgtggaaaaatatattatttgatatatgaaaatgctagaagagtatctagcatatggaaagtgcatagaaagggctccatatgttgttttagttaataattacaataataatttcctcatcttaaaaatatcctgcttcattcataaagttgtgccaacggaaataattgcagatgatgcttaaaatacatacaatatatatttcagagtggtatgtaaagagcttttattattactgctaaacaaaaaaaaagtccgtgaaattctcatctaagctttggggcctctttagctgaatttcagcagtcactcaaaggctttctagagatgccatctagagatactttataacctagtgtctttttttttttttttttgcaatacagaatttttttttcattgtaagatgctgaatgagagaaaattatttcagtactacaagtatggtttcccatgaccacaattagttctaatgtaaccagtcaacagttgtctattgaaaaccactagctattaatatagtatcatggtagcctaaaagaattatgctatccttctacttaggctctagggagacaagagccatgtaaagaatacttaaagcacaaaatgtgagactgctctgccactagttcctgctctgccactaataaacagaggtatcttagatatatgaacctgttacaattatgaggccatcttagcatctcagtacccttattatatatatcgtgtgtatacacacatggccatccaatatttctttcccaaattgaaatgagaggaattcattaaggtggttttaatttccaaatttactgagtaaaagaattctattctaaaaattattttgtataatgcccttcaaattgagttttacatgtactatttcaaggcttctcagatattcccacataaattatctagtgtttctgcatcactttgcgatcttttcattaatgtcaagtgtaatgttttttaacttcacaagggaaacatgaaattcctttagtgtgcctcattttcagacattttcttgttgattaaaattcctttttaaataaagtttcaacatgtactaaataatttgtttacctttgaattaactttttataaatgaattttaaataatgacagcagtcattacaaactctgctgttggcaacactagagggcatttctagttcttcagacagtgtcatgagttctcagaataatttaccaattcattaaacagcagattagcattttaagggaaaggaactaaaacaagcacaatacatatatcatacatatatatagtatgtatatattatgcatagacagataatataaatatccatatataatatatacattatataatatatggataatacatatatattggatgtatgtatactcacgtctgctttaccaaatgttctcactgaatcactactcctaaaaaggcgggagagtatttgtgatctgctcactgaagcaccactatattatccagttgtttattagtgtcgtggaggtctatgctctgataggtttagcatcaagtgaacattgagtaaaaaagtatatgtatatactcatacatacatactcatcagaagttagttgctgtgcttattgaactactagatgctaacatagtcataattagaataatttttcagataaaaaatgagagttaaaatagatgccctttataggcttagtagaagatttaagactacctatattttgaattactgtattttagatgttaaaatattttcaagggttttgaatgcaaacatttttagggaaaagatacaattatgtaatattaaatatataatattaaatattaacatgcaatgatatgaaagaagacaagtttataagaaaattcaattagcgtaaagaaaaacttttttttcttgggaggatttgcttactgcggtgtattggggaaaaaatcttatatatcattaagtaatcattaacacggtaaaagtaaagtcaaggaccagcaaaaaataacctaattgttgtgaaaataaggtgacaaacagacaatcccatcttacactgtaacatactttgtataagaggggatacatgataaccactagaacagtggtggatgtgcaggtggtagatacacaagggatataagaaagtctttctagttcaaatgtatttctgccatgtactttacccagtagaaatgcatttacatttttaagaggagcgtataaatctctcaaatatttctgttgatacatatacctatcattcacttaaatacctgagtacctactaagtataaaataccccgttattttatgtttggcacagtgaggctgtaacagtttatactcctattatgtagctgagaccagttggtctcttttagagaggggagtatcagttagttacagaaggactcatttgaatcatgagataatttgtgagaatgcagacccaagtaatatgctctaataaaatcagaaggcagcatgcttttgttgagaaatggaggtaggaaggtaacaacataaaataacctactttgtactggttcagtataccccataaactgtcatctcttttgtttgtttgttttgagggtacaaattatttcattttctgatattctctttcctaaggtattgttggactgaaacttaaccaattctcctctttttctgtctctgtctgtctgtctctctctctgtgtgtgtatatatatatacatatatatacacatatattctttctacacacacacagtaacagtatgtgcaagtcaaatttaattttaaaataaatcttttaaagcgtgggtcaatctgtgccagtcacacacagggcagtctgccgtatcttttgcatccttgttttgtactgctcgtgaatgttcgttatatagtagagtaggtaattccatatttacttgtactagaatatatctggcttaatagatgatgttccaaaggcttgaattaaaaaaaaaaaaccttagtgtaaaaaatttcaggcatacacttaagagagactagtgtaataaaccccatggcctagatttaacaatcagcaaaattttgccacatttgcttcatctactctcttctttttcctcaactatttttaaagtagatcccagacttcaagtcttttcactcctgcattctttcatatgcatttctttaaaagaaggaatttttcttatataaccacaatacctttattacatccaacaaaattaacaataactactaaccacctcatattctctctgtattcagtttctctgcttttaactgaaaaatgtcctttttacgtttagattgttctttcagaatccaaccaagatctgtatagcatttggttgtttggactgctgtataattaaaaggtcttttctttcccaccacttgtttacctcactcacccccaaacccccttcttcctccttccctccccttttccctttaatgtgttaatgaaaaaactgggtaaactatcctgtagaatatcctccattctggatttctctgttgccttctaacttgttcctgtagcctctgaatttcctgcgaactaaaagttggcttgaaagacttaattagtttcaggttcagctttggttttggtgttgaggatggaaggcatgcaggaatactttgcacatggaactgtttcttcatactgcatcacatcaaggagcatataatgtctgcttgtcatactcttatcaatgctaaaattgggcagtggtgccaacccaatctctctattgagagttttctaccaatctttcctcccgtgggaaaagttgctgactgttctccaaatcaattctgtcattagggtttgcaagagaatgaatttttaaatctgccaccccttacacatttattagtggaaattcttctgtaagaagaagtttccttcataaattacacctttttgatttatctgaaacaatgtatactggaaagaagcctggtgtcttaaatatcatctgttaatacctagtgtaacattccaaaggtaacttgagatactgcaaggaccacatagcaccttgagtacctattttacatgtgactctgaggactttcacagaataaagatatttcttattttaatgaacgttgtcagtatcaggataattttatgtagtcaacatatatacagtgttggtcctataggagttggagaccttttgccagttttatttggtcaaatacattattttgtgatgaaataactgtgagtgatgagttgagcctcaaagaacatgatacttcattaaatcaacaagctgaacagtatcatctaaccaaagctgtagaataaatggtgataaacttaaattcaggaatgaaacaatcaccatttttgttacaaatttgtccacccgtcatcactaaccccatttttatttaatactggtaatgaacaaaacctgaagaagaaataaaactaaaatatttcatttgtagatgacatgattaattatctagaaaaatctacagcaatcagctctaaaatgatttattaaataataaaaatttaataaagtaccagatatactgtatctttataccatgtgaaaatcattctgggaaaatatcccattcagaattgcaacaaacgatgtaatatctagcaatacatttgagagagatgttagatctttggaaaataaattaacatccagtgtatttgaaacaattttaagattcaaataaaagcagagaaactgtttctaaatcaagaatattggcaaattatttgactaaaagtaagatttttgggtttaacctctaacttccaaaatttctagtgatttattttatagtgattctgtaatgagaagtctcgtcctactaaatatcaaaaggttttaaagcaagaatgtctaaaacagtgatgatgatgtaagaataggtgtgttacccagataccagaagagacttctctgtctgttggagatttaagtatacattttctggccaggcccagtggctcacgcttgtaatcccagcactttgggaggccaaggaggtcagatcacttgagatcaggagttcaagaccagcctggccaacatggtaaaaccccatctctactaaaaatagagaaattagctgggtgtggtggtgcacgcctgtagtctcagctactcgggaggctaaggcagaagagtcacttgaccccaggtggcaggggttgcagtgagatgagattgtgccactgcactccagactgggcgacagtgagactgtctcaaaaaaaaaaaaaaaaaaaaaaaaaaaacaaagtaaatttcccttgaagcccgacttcatggccggtgagagtcaagagacatggcctggatcccgtgacttacacaaatccctgtggctgactcagaccttagtttctctgcctctgcttgcatgccaccttggtttctgccagtgtcaatacatatgtgaaaccagcccctttactagtttcaaacatttaacattttgtgagttaagaaatcctgaataggtgatagaccagcaaatgattttcttaatttttgagtggaacatgctatctatgttcattcttttcttctactcatactttactgaattaatacagttgttttcttaagaggaatactgaacaaataagcttgttttcattttgtaaaacatagattactggagcactatgaggaatacaaaatttgtcccatctgttatcatatacagtaactaaatgtatgacaaaataatctttcctaagagaggggcacttaaaggatatttgttcagtggtgttggatagtactattcagtgatatgtcttaaaactaattagacaaaaatcatccgtatattacacaaccataggaataaaaaagaaaaggtaacagagagaatacctttacatctcatatttgaagaattagtagaactcacccagaagatacttgaatattaaaaatttttgttggaccaaaatattatgattaaaaggataatagaaaattgtggaaactacattaaaaattataaggaaagtgataataggtataagttatatattgttgtaaatatgcaagtttagatatcaagattataatacataagtgagaaatgaatatgacagattaagaatatgaaagtaaagacacatgaataataaagaaatatgaggtttttttcattgtattaaaggacataaatttttaaaaagagaaatctaatatttgcaagtaagcagtgctaacagacccttttgggaaataatgcagtaatacatgctgagagtcacaataatgtttagaaatttcataataacatattaggaaacactatgctaattattttacatatatatatatataaaatgcccagcttaaaaactaattatagaacagcaacataaaatattacatttaaatgattatttttggagactatagaacaacactgttcaggagagctttgtggtgatagaaatattctgtgattgcactatccaatatgtagccatttggcacatgtggctgctgagcccttaaaatgtggctagggcaactgagaaactgaatttttaatttaatgttaattatttaaatttaaatagataaatggggctagtggccacaattttagatagtgtagttccagaaataaagagaaatgtttggtataagtgaaaataaaatagtaaatttatatgccatgattacaagtatgtacataactaaatgtacgtatggaaagtgatagtcataattaaaatatttgtgttaggattgaaggaaataggtaatttttttaaaatgctaaatttttaaaaggttacatgacaataatgtaacacttcagcattgtactggtactgttcagtatggtagccaccagcctgatgtgcaatttaaacttacatctgtttaagtaaaattaaaaattcagtaccttaatcacactagccacattccaaatgagcagtagtcatatatggctaatgtttgccttttcgaacaatgaagctatagaacatttttgccattgccaaaagttctattgtacagtgttgtagaaagaactggtaaaaggaatatactggaatcagtcactgatagtttatttgtcagtagtttctaagggcacatgagaattaaaactggaaattggattcagtaaaaagtataaaggaagagtaacataagatcctactcctgtaacttagattagtgctttttttttttttttttttttttttgagatagagtctcactctgtcgcccagactggagtgcagtagtgtgatttcagctcactgcagcctcaccacctcctgtattcaagtgattgtcctgcctcagctacccaagtagctggaattacaggcatgttccaccactcctgactaatttttgtacttttagtagagacggggtttctccatgtttcccaggctggtctggagttcctgagctcaaataattcacttgccttggcctcccgaagtgctaggattacaggcttgagccactgcgcatgacctacaccagtgctccttgaagaatgggctatgaactggtgctggtttgttaatcaatccatgactaaatgcttactctcaatttctatattggtttagaaactcttacagccatgtgatatttgtgtcattcaggcacatcacctgtctccccggttgaagttcaggccagtagttttaacgcagttgcctggagagttttatgcaaagtgagctgagtatagtcatgacggtagtccatgaacctgggtccccaaaagggagaaaacagtctttcactacagattgcgtgagaaacattggccagcattaaagaaggaaagtagattgctcagggaagttttgtagggaacttaaaatgagatgttagtatggcttagtaatctgtatttgcaggtgaaatgaaaaattcagccctaaatctctgaatatggtaaacttagacttcatcttctgcaggtggaaatgaggcaagggatccattatccacagcatgagtaagtttctagtcagttcctctgtctagggagtttgttttcccttttcgcccttgttggcctgggagactcaaccagcttagtagtcttttcctttcagtaagatttccaactttgggttggtctttacccctttttagctctttttgtcgtattatctgcacttagtactttgtaactgttttcaccccttccccccaaagttagttcaaaggcttacagcatgttgaaaataggaaaattgtttttaaattaagtgagtttttgtgtacacttatttctttagtctaaagttttgttttaaatctctttttcacatttaaacctgattccctgagacaagatataaaattgaattatttgtgaaatgtggaaaggtttttattgcctgtaatcaaagcataatctgtccattaaagcattattttagtgatgaagggtggacatacatcccaagtttactacctgttttcttactgtggttttgaccatacagcaaatggtattttatactctgaaatgaaatgcaccatacacattgtccagtatgttttgagttttaattctacattttcagattttggggtcaaatgaaatcaagtactttataaatagttgtttcttctgattctactggccttacatgttagatttttttaaagtatacacattcagtcctttatcagtaccattaatcaaatgttgatttcagcatttcttcattttgttttcttttttcttttctttttttctttttcttttctttttttttttgagacggagtctagctctgtcacccaggctggagtgcagtggcacagtctcagctcactgcaacctccacctcccaggttcaagcagttctcctgccttagcccccccaagtaactgggattacaggcgcttgccaccacatccaactaatttttgtatttttagtagagatggggtttcaccatgttggccaagctggtctcgaactcctgacctcgtaatccgccagcctcagcctctcaaagtgctggaattacaggcatgagccaccacacctggccagcgtttcttctttttctctctaatttatcaaatttggaaacagttggaaaacatttaaaggaaataagtctctgtgtttttaataatagtttaaaagttaaaggaaaacaaatgaataatattctgtttattatagtcagacaaaatgtacatacgaaaatacataaggaaatatagaatggcatcttctgattttaatttaatattatggtaatgatttacttaggcagaattatagctatagacaaccattttatcactttatttatatcgatctactctctatggatgaaaacagttaatactaaagcattaagaaggtatattgcttttcatctgtattaatattcttcttctgatatttgatatttaataatatattttaaaatactctgcatgatttcctgatcttaaagcattccattcctttcaaggaatttggattataatgatttatttatagtatttttgtcattaatattttaggatatggcatcttaaaatattgtattcctaacagttatttaatatataattaaacatctatattagtattattttatataacatattttcaaactcctcagaacatttgtaggtttttgtttaattttatgtaagtttcaccttaagaatattgactaatcggttaatattcttcttaatcatcgcaattttttaaaatgctttctatgtaccaggacctatttaaggtactacagataatcagtgtgtcaaaaaacaaaaccaaaattcctttcctcatggagttttacattctagtagattgattctactgttgattcatactaaattaatttattaattatagtagattattctgtggcatttaacagaattcaaagggctacttttctgttgttaggaaatagcatatgccattatcttggaaatacaaagggaggacagaatttccgctggctctaacccattgctttttaatgagtttagctatgtatatatattttaaaatggaatttataattatgatcatttggcaacctacagtttttctgtattttttcaacttctcaacttcccagtgatgggggtggatgttgaactagtcacttaaggttttgggtctaaggagtaatatttgaaacatgcagtatttagaggagatatttttgtgaatgaagagaatgtgattttaagaatactcatgattttatctaatttctgttctcaaaacttcattttgtaatatagaagataagcttgatcaaaatagtttgatcccagtataatcttttactcttctctcctcccttaggacaaccttaaacttccaccacaagaggaatataaagaggtccctcctgcaccaagaaagatctgcagatctttttcagtgttcttggaggtgtggggtgtgagaacttgatcagtttgtgtcagccaccttgttctctaaaggtaagcactgtgtagtgagtgcacactcgtgggcccaggctcctaacctaagactggttttggaatgctccattgagggtgtgagaccttcagacgttcgcacagaagggaggccctacctgtgggtaggacatcacacattcatcaagaggtgcttttcgttatttagaagtgaagcatgtcctggggatgtatggatatttttgttttgttttactttaaaaaaaatcccagtcatagtaaaaccttccagtttagtctgcatttattcagttaataactgctggagttaatcaaaaatttttcttgtatgtcttgagatatggattaagaattttgaaacaatgacaccatttaggcaatctagtgacataatagcttcagttgatagagccagctgtgaagaattacttttcatgatctttttgaagctgtatcttatctttacttcagggaaagcccctcaaaccattttgtattctgtattacacttcagaaagtgtggaagcaaaggtcatctaatctttaaaaggtatgtaatcataaaattttttatgtcagatcttaattgaaaaatattacttaaaacttgaaaaaattacttaaaattggcaatttctttttcgtcttacaacttcttcctgtcttcaggaaatgaagaataaatatgttggttctatcagggaaaccttatgaaggataagcaaattaatgtctgtgctttacttccaaattctgacatcagaaaaccttattgttaactaatataatctatagatgtctctcaaaatgaccagtcttaaattcaaatgtcatttggatatcattaattgactatggagaagagcagaagcatgctgatttcgaaaatgtcattaatattaggattaggtcagtcttaggcaagaatactttgaataacaagagactaaatgtctagtaaaacattttagattgtaattcccagtattctgtagtattaacaatgagacttaaagtactggtgaagaaattaaatttgtccctttcatttatcttttcttaaagctcttaaagtgatcctgaagactttagttctacaaaatgtgaacttcttatggaccattaaagtggggagtaatctgctgatttttgtctagcaaccctacctctgatgcaggataatttttcaaaaccgttgttcttcctatagctgtataatagaagatattaaagaggaaaaatacttgtgtgtttgctgttagaatgaggaaaaaatacaaattggacctttttgaaaaaccttgagaaccaatttactttttttgtatgtaaatggtcgaggagttagaactagtcttggttattataactgcaggtaaacttaaaagatttaaatcttcaaaacagatatcatgtaggttttattagaaaagaaatatagattattgggtgtatagagataatctatatatacgtacagttttttttaatttttatttgcaagagcatgctaaatatcttagcctttataatagcatagaatagaatggacaaatatgttatccctttttgccagttgagaaaacactttgaattaaatctccaacctaatgaaaattataaggtgggttatagaaataactaaacaggttattatttcttaaccaaactaaaggtttattctaactaaaatacttgtaatctaagaagtctccctaaacatacaccttttttaaagtgagttttgttttatgatagtacatattttagcaacatactttagaaaagaaaagtttatttcactatcctagaactcgtgttctaatttcagatcagttttgtaggatgtataaataaaatggggacctatgagatctatgagatcttgccgtctgtatctacagtatcaaaaataagatcatttccttaacaattcttattaataacttatccatctcaattcataggaggtgacaaaatcaactgttgttctatgattttgatcataggtaggagggaaaacccaaaataatggtaccgagggcttcttccattgaaactaatatctgggagaagatttgattttcatgtgtacatatacacatacctatattagtgtttatttcttttttctaatcatgtaagaatttgtcaaagatcaggtttctgatttgtctttcatcggtatctgtatgccacattttgtttttgtttttgaagtgttcctagccagttcatgctagtccctactataaattttgtttccctggcatgatcatgctctttacctactctggtagctggagggaggtgagagaagcagtcttatgtgtttaccgtactgatttttttttagagatgggacaacaaagaaattctagcctttggagacatctagaccagcactatatggtacaaagataattcgagccataaatagaagctacgtatgtaattttaagttcttaatggccatattaagaaaataaaaagaggcaaaattagttttcattacattttatttaacccaatatatacaaaaatattattccaacatataattaatagaatgttttatgagatttttttcatactcagcattcaaaatctgtgtattttatactcacagcacatcttatattggactagccacagttcaagtgctcaatagccgcacgtggctagtaggtaccatattccacagttcagatctagacaatgagtggaattctcattttagcctcatacatgccaaaatccactggatgaccctgcgaactccccttgtttagagtttccaaatttagcagaaggaaaaaacaaaacaaaacaggatgtccagtgtaatttgaatttcaagtaaataacaaataatggtttagtgtaattttgtcccatgctatatttgaggcaaacttttaccaaagaagttactgcttattcgaaattcaaatttgactgggtgtcctatattttatctgacaacccttctctggtttaacttgagaagaggacatcatcaggctgcctggaatcttggaggactagaaaatagagcatctctttctctgcgcaggattttaataatcctccaaaaatcagcctgtaaactagaagatatctctagcccatttcttcctaatgacctagtatgtttaagacagaagaggggctcaaatggcaaggatttagtccatacatatttaaacattttacatctaaattattacattaagatataaggtttacgaaattttacaatttttgaatgattacttgaatttataaaatgtagatcatctaacagcacaacgctgctatcatttctcttgaaaactaattctcctttgacagtaaccacagcagttttcagggtcttggccatttcaaggtattttcctaccattggtttccattgcatctgtcacataaacctctggtagtcaagcatgaacacaaaatacaaggctactgaatgcagggattaggcttacttcgttacaagtatttaagtacttgtaattcttagctctggtgttgaccattggatcctgaccagttcagcaatcagtctcctaagagcttcttttacagaggaacatctttccgttttcattctttaacatttttaatgtattgattttagtacatttttgaagcatacagtcacctccttagtagtgtggatctaccctcaagtgctatagaagagactgtttgtctcgaaagacagtcattgcaccacctctctccagagaatacttttccttcacaaggtgcatgactcaagatgacaggcttacattattatttatgtaggcaggtggatgccaactgccagtgcagggtggcataagttagcgttccaaagttaagctatggtgcattccaaatccattcacacttaggagaatgtacccaagagtgtggggatgttttcaattactgcatttccttcagagaacaagaaccacaggtaagtttgtgtgtgtgtgtgtgtgtgtgtgtgtgtgtgtgtgtgtgtgtgtgagatccaataattatttctaaataagaaatttcagaatttgaaaatattgcccctcccccaaaacagtcacctgaaaggtctcaaatatagctttcggtatatatttttcttcctcactctaagaaggaaggtattggagttggtggtgatggtggagttgggatgagggagacaatttactgtcatttgaaagctgtgaatgtcacacattttcatgtctagaaatatcctgggtttatgtaagaatctgattttgcctaacctctaatgtctcaggtatgaattattttgtcagattaacacatctatataagtaagatgttcagccttgcttagctaatgtcttcaacagcaatgagtaaactaatgagttgtgtctgcatttttcacttttattctcaagactgacttccttttgtttaaaggcttttgccttatttctgaaaccataatttaaagctacaaaagacctgaaatataatctagtaccctttttacctggggatccttggatggatttcagagattctgttgaatcccctaaaattacagtcatattttgtatatatgtgtttttactggggagaatgtccatattttcatcatattctcagaggatttcataacaaaaaatttggtcgacaaccactgtgatctagtctaatgtgatcattttactgataaactgaagttgaaagaatttaacttatcttcatttgaaatttaatacttgtgaaaattaaagtttatttctttaaaattcatactgatttttaaaagaaaaatacatttaacttcaactaattaaacttgaaaataccagcctaaatgggagcagttagtttgctaatgctttcttctgttctgccctttgagtggactctactagttaacattaaaatggccttccaataaagtatgaggctatgtgataagttcttgaagatagattaaaaagaaaaggaattatccattataatttaaatccctttttctctcttcaaattctgtctccaaaactaaaactcaagaaaataggtgaataatgttatttttatatttccagaatattaaaaaagtaggtaattgccttaataaacattacactgggcattattgggacagttttaggttctgaaccctagttaaagaaattcttcagtagcctatatacacttcctgttggttttcagtgataagggcattttaaggtctttttgatcataagatgcttttaatgttatagtaggactttagaaatggtaagtaagcaagttctgtattaattagggaaactaatacctttttctcaaaatgaaggaaatattattttttctttttcttggtactaaccagtaaagtctgcctagtttaagatctagtgcatttataccataaactgaatattagaataaaaagaaatatagaggatgttatataaaagacaattattttctgaaaggagtagaaaacaaggcaacttggaacactacatatatataaatgtaaaatatattaatatacttttatatagatgatattatatatccatatatatatttttttgtttgtttgagacaaggtctcactctgtcacccagcctagagtgcagtggcacaaccacagctcactggagcctcgacctctgaggctcaagccatcctcctgtttcagcctcctgagtagctggaaccacaggtgtgcaccaagatgctgagctaatttttctgtgttttttgttgagacgggggtctcatcatgttgcccaggctggtctcaaacccctgagctcaagcgatcctcccaccttggtctcccaaagagctgggactatcaggcatgagccaccatgcccagctgtactatttatattttttatttaaattaaattgtgcttaaagattctaaaatttatagtataaagctcattatagaaaatggtattgacttctgaaacattatagttttggttttgtttttattccttcggacattttcacttaaggtagttatcactcatgcttttctgctattataaaaagtgaccagattttgcttttttatccaggaagaacagtttgtgaatgccacttgataggccacctgtgttattttccatgggtatttctaacaaataaaaagttatatttttactttgtattcatcaaattattttatgtttaatttagaaaagcttaaattcttcttaggaatatttgcaaatatttgtaaatagtttttttcaaaaaagttgaggtagatagatattaaatatttttgtgacttctcattaaaagaaactgaagcaattagttgacctcactcaattcattaaaacagtgctaggttcctggttttcgtgacattaaaaacaattcaacatctgtgtgtagacaatgactaaaactttatgattttgtttcagagttttattaccatagatattgtttaaaatagaactttcaaatacatttaagaaccattaaaagtgacttctccctgtgcctgaaagatacatgcatggcttatatctttttgtgtataaacaatttaatgtttaacttttatttcctttaagtttgcatatcaaacactcttagcaatctcatcatttatactggagtacttagactttgaaactttgccacagctacctgccacgtccttgtataggatataagtaaatatattcagtcatcaaatctatagagaactgtgagaatagagtggtaaacaaaacacattgcctgccctcacagctaaagaggagtgatggtgggaaagtggaagtgatcagaacccaatctgaggtcagaaaacaaaactacaatctatttcaggttgcacaaatgaaattttaactgaatctgagggacattagatttaatcaaaccaaatgagaaggcaaggtggtgttttgagctaagggcacagcagatgtaagagtcataaaggaagaagaacaaaacacattcaagataaaagacacggagagagggaaagatgacactgtacggtgaaatatcttgcaagtcaatattagatactagcctttgggctttagcttgagaacagtgggaagacattgacgctcagatttttttttctaaagttttttattaatgcctaatacatatagaagcattagcatactgcttcgtgaattttcacagacttagcacacctatgtgatgaacacctagatgaagaaaaacaacaatatcagcatcctaaaagttccccttcattttccttccagtcagtcctgtctcttgcccaccaagggagacctcttgcctgacttctcactgtatatggaggatattgcctacattgtacttaatataaataggggcatacaatgtgtattcacttgggtgaagcattacgattatgagatttatccatattgttgactgtggttgctaattgttctcatagctgtataatgttccgtcatatgcatgtactacagatttgcatttttctgagattgctgaatctgcatcatgaaggatgggagggtgtgaatttagtaagcttcacagtaaatctaggaaagagatactggggcttgagctagtgtggtgacaatgaggatgaagagaggtgggtatatagagagatatttacaagttagaacttaattggatgaggggatgaagaatcatacaccagagataactcctgggtcctgacttgggcaggggttaatggcagtgcccttcattaagtccaaatactggagaggaagtgggttgttgcttgtgctttagtgatacaggggattaacgaattcaatttctgatacagttaaggcatctgtgaaacattgcatagatctgctttatacaactgttttattaactgaattaatgaataaccttaccttcattaacaacagtgtgctaacaaatagttctacatatggaaaactgcaaatcttgtctagtctcactgttcttcacctctgaatctcacgagatactcttttcctaaatgtgttaggagtggttttgttgcatctcatgcttttttttctttttatttatagaatatacttcatctaaactagtgctaactttatgcaagaagagtagcacttcctaggtatatgatatgaaaggcattggtgaaatgccttcatacttaaaggcattgtttttccaacattatggtctttcctttagcacaataaagacaccttaaaatgagtttgtttataggaaataacctacttatttagtaagactttaatggactgaagtaaatattcatgagatttgggcaggggaaagaaaagaaagatagggatgaggtctgacctgagcacaaacctaggcagggtgccacagggggaaccctgaacatcagagagcaggttgaatgcacctgattttaaaggaagattatgccaaaagagtgacgtaggagctgtaaaggagggacttcacctcttttcgatgctgcctgggactagttatacttgtggaaaattttatgtgaagataactaataattctagcactgaatgaaacaaatgcctgagacctactggaacattaaatagacttttatgccagccagttatgattcagtgctatatttagaccacaaaatttgaactaaaatcaaggcagtttattcttatcccatcatgtccatggggtggagaggaacaactaagtaatcatgatcatgcacttcagtttatagcgttttctctagctttgggcattgtcacttaacagacaatacaattttaaaaattaaatgctcaatttcatttcactgaggttttttgttgttgcacaacattgtaagtatacagtaagttgttttttcttttaaatttttgcctctaattcaggtttacattgagcaaccaaatcagtattttcagaaaccattgaagttaattcatttatttaataattacttatgaaatatgtcatgtataatagtgctatagcctaagatgatgatggtgagaagtactcctaccttttgttactggcacgatggtggcgatactcagaacaaacaaaaacagtgtgataacacaaattattatatgactcgctgttttaatagtgtttacaaaagcagtgaatcccaggaaaataaactattggctacaatatcaaaaaagaaatgatggaagtggtagaatttaatttgggtcctgacaaataggcaggatttgaacatgtatggcaagaacactgcaggcaagggtaacatctcatgagaactgatgcagaaaaaaatacagcatatattggcagagtgagaaactggccagactgtagcagaaatcacaagctggtgtgaggagagagagaaaagcttcattaaggaagttttgaattactgaaaaattcaccagtcataaggcatggattattgtcttgctgtttagattacctataaatgtaattttactttactcaccaccatgtgataattatgtagggttttatctttttagaaacctgatgtgaaattacctgaaggaatgaagttagtgtgcttttaagttaagaatatcttcactcagtatccatggataggcttcagggaatctggatctctttgaaattaaagcaaaagtttggatgtatttctttttctggaggaaggatccattgcctttatgagtatgtaacagtccagaagaagttaataaaatagctcgagctctcctaacttaaaacttttttattttttattattattatttttttttttgtagagatggagtctcgctctgtcacccaggctggagtgcagtggcatgatctcggctcactgcaacctccacctcccgggttcaagcaattctgcctcagcctcccgagaagcttcatcttgggttttttattattattattattattattattattattattattattatactttaagttctagggtacatgtgcacaacatcttggggtttttttaatgcagtaaattaaaatggggaaattaaaacacgttaaatactttccctttatttcactatttactgatacggtatttaagagataatcctgaaaagtatatcagttgggttgattatataaccagagatagtggctattttatcaattccgtggctttcagtaaaaggacagctcaattgcctttttagatacagaatgtttctgaatatgctatttcaagtagaaattccttcctatttttggacaggcatatgtctgctttctgcagaatacaaagaattttcaatgtgtccagcttcagtcctgaaatttgacttacctggatcatatttaatcttttgcacaactgtttaaagcaggagtcaacaaattatatatagcccatgggccaaatccagccctcaaacctatttttgtatggcctatgacctaagaattgtttttacattttaaaattgttaaatttaaaaaaggattgtaagggattaggattttaaaaaggagaatatgcaacagagattttatgtggccctcaaagtctatggtatttactaactggccctttttttaaatgccaatccgtggtttaaagtacagtttttaagttctcctagatgcatgtgttattctacaagcagatacaatgcttgtggatagatattatttttgaagttgggagtatatttatataattttagcaaagttgactgaataagataacctgttttctatactgaatattcagctaatagtttcgctttctaaagtctggatttgaaagtgtatgaacaaagtgtggacttagtaatctacttcaaagaactatgtgaatatgaaagtagattttgtttttcatggatatattacacagcaaccacaattcagatcaagaaaaatattaaaatataatctttgttttagaagacaccacttaaggcaaagaaggcaaaagaaaacatttgtacctgttaatgagttgggaagggcagctcttaaaaattatactattcattggtttattcaacatttatacttatttttagaaccattatatatattggcttctttgtattatattttattaatattattgtatgagatactatgattctaaattttggataaatattgaaattatttttaatgggggatatgtcataattagtgagtctcaaaaaattggggcaattctgccttctctctctgcatcattatttttccttcactactggatcttttccaccaacatacaaataatgttgagttttttcccccatcttaaaaaaaatcttactcccagttctcctttagttactaccccatgtctttcatgtaaagcctatatctctgaagtatgtagttgcctgtgctgtctgaattcagttcctataacccctgccatttcaccagaattgtacttcttaatgactgccatgctgccaatcagatggtcatctcagtcttcctcttatttgacctggcaacggtgtttaacactccttgtttggccttttagatactatactacactgtcctgtttttttttctcctacccctctggctgctgctttttcaatctcttgctgatttcttcttgcctccccatctccaaattgggaatgctccaacatttggaattttgaggcctttaaaactgcatgttcactcccttagtgacttcatatagtaccatggctttatatgatcatccatttgctaatgatcagaagtcctttagtctttttttttttttttttgatatggagttttgctctgtctcccaagctggagtgagtgcaatggcatgatctcagctcactgtgacctcctcctccggggttcaagcgattctcctgcctcagcctcccatgtagcggggattacaggcgtgtgccagcacacctggctaatttttgtaattttagtagaaatggggtttcaccatgtcggcccggctggttttgaactcctgacctcaggtgatctgcctgccacggcctcccaaagtgctgggattacagatgtgagcctccgtgcctggcccctgtagtcttcttagaatgtaatatagtaaactgaattcctcatctttcccccaccaaaacctcctccggcagtttttcccatctgagtaacagcacctgctgtcttttaatcagccttggtgtcaccaaggatgcctgtcctcctttcattccacatatgataattcttcacatttctgttaccaaaatattatcttgcttctgtcccaaaaatatttctgagattcagttattgcttaccatctctactcctacaaccctgatccaaatcaccttcatctcttacctgtattgatgcaaaaagcctcctgtaattggtcttcctgttttttcctgttgacttaacttcagtccattcttaatatagcaggtaaagtagttatatttaaatataagccatattatgtcactcttttgatgaaaatcctccattgacttttcatctcaaccagaataaaaactaaagttcttaaaatagcctaccaggctctgtgctctgggctgtcattcccagacagccactgccaaccactcctgcctgctcacacccactttgctctagtcatccacactggcttctttgctgttcttagaacatgccaggcaagttcttgctttagagcctttgcactggttgttctctgtaatactctttccctgtatatctacagggatcaatctctcattacttgagatttgtacttaaatgtcaatttaatgaagctttctttagccacttgatctaaaattgcagatttcccctacttcaccccaattctccttcctgctttatgtttcttttcttgaagacctgttaccatctaccatcccatatattttacctacttttttcatttattttttgccttcctccactagaatataaaggctttttgtttcctttgttcactggtctgtcctcagcacatagaaatatagtgtttggcccacgttatacacttagttaatattgatgaattaataaataagtggaatttaaaaatagccaacacaaaattttaacatagttcagggatttttgagagctcctgggatcattgaataagcattcaaatattccagtaaatgacatgcatggagctaaaggtattagaaatatgactgtatacattggtatcattatatatgtagaactttcttttttgcacagatccttagctttgaccatttattctatttttaaagtgtggaatactaaaaaaaaatattatttgaacttaaatatgattactatttgagtatgctatgatgtgaatactttttaaaagaatcttttatcattaaaagtagtcatttagtacagtaggaatttttttacaaaaaaacttataaaataatttaaatttccagaagagtttcaaaggcagtacagagactgaacttttcaggatccttgttctgtgtcttataagttttcatcttcaaaaagcatggaacaaatactaattcagcctaccaacatagcttttgttaaagtaactgctttttaaaataatttttaaatacataaagctaccaaataattagtttcaaatttcataattattttttcttgactatatgcataactgatttaaatagagtcataatccaaattttctcaattatgacatacatttcttcatgtttcattatagtctttttaaatgactaataatagaccatcttgctgatgtatcattattaataaattgttttcttcctgttggacatcttaaggctgttttgttttactgttattaataatatggtaggtgatatatttgtgcatataacttcttgcatttgcctaaattatttcctttagctaattacccagaattagattgggcaataaaaatcatagggcttatgaggaaaatggggttggagtacagcccacaataattttgtcagtgacacatttttaaaaagacagaaaactaataacaagtgcagcacagttttacatatgttaaatggttaagaaatacataattactattatacaagtgacactttttaccttgaacaaaccctgatgtttgcttgtggaagtaggtatggaattgtgatctccaagttaatgtgaagtggtagaaggaggattatctgaaatcagaaggaaagttgtaacattgcatgtgatgggtgtggctcgtaacagaagcacggtgaactgaagtggctggtaacttgagatgtgtgcaggtgtgctttttgtttattcttatgtgacttagttaagctggcagcaattttctgtgttcacttagtgtttctcgcagataaaatcatgcataagcaaaggtgacattctctttatgctcatgtagttctctaataaaccaactgcactgaaacaaatttgcattttcaaaataagtgttatggcagaagagactccactaatttgttatcccatcaattttactgcaattttaacatcgtgctaggtttttaagcttttatatggtaatttttctgatatatttttaaccagatgcctttagaatacagtttggtgcagtcttacagatataactccaaccataataggcagtggagatgttattttaaaataataataaagcttggttaattgcacagagacaagaaaaaatggaggacaggtttcttccaagaatgactgaagccagaatagaggttagagaaaacagaagaagaaaaaaaaaaccctaaaacctgcaaagggagtttgtacctaggtagagcagtaccttgaataccagattaaagtttcaacttccagaaggcaaccaaaagtcagtattttgttgttgttgttgttgctgttgttgttgttgttgttgttgttgttaacaggaaagatgaaagaccagataaggaagaaaggccaaggaggaggacataggaaaagtgtaggttggagatggtatggttaccatccaataagaacagaaaagaaagtataaatgtaagggttttgttagcagtactatttgccttctgattaaatgataaagaagatgtaaaataaatgtttgtctaagattactccaaagtattatcctgagtggctaaagaatagcgatcctagaaaaaaaaaattgatgatcaggaagaagagctgtatgagtgggaggagaaggtattcctgaaatgatgagtttagtttgaaaggaagcctgactgagtggacacagcccctgattgagcattaagaaaatttttgattaattactggtggggccctggacaatagtatacttctctggctttcagttttctcacctgtaaaataagtattgaactactagtgactgctgaagtttcttccagctttgaaacaattgctgtgtgttttttttttatttgaactttattactgtttcttcatgattgctgtctagtgaccttttatgaagactttggtttataatgaaacaaggataaagtgctcagtcttgagtctgttggagattaaactttcctgactcctgaaatgcttgacttgacaccggaagtgccacaactgccatctcactttatcttttttctgccaaaggaagcttcttgcagatcaaaattgggagcaaggagaattggatgtataaagccaaacttggaaaaagcattctgcaatttttcttaatacaatcttttggggctctatttgttattagctgttagaaatcccaataaattatttggaaagaaattcagtacaaatataataatgttatagaagtatatgtatatagtaaatataatctaggagaggcttaccatagaaaaggtgcaggctttggaattagcttgaattcaaatattagttttattactctactagctgtgtaaccttaggtaaacagaaatgaaaagctttattttggaggatgattttatttctttctgtgtaaaatggaaatagtaatactaagtttcagaattgttgtgaggattagagacaatgtttgtaaagaactgagtatacaacctgatacttaataaagagtaacctttatcagttaccaggtaatagttattgttgcagtatgaggacttggttaaaactttttcaaattcttacctgtattaaacacttaacctacattctcctcttgtaatcagaatctcgtgtgcatgtatgtaatgatgggttctctaatattcagttttctggcagattaaaacatctgacaaaactaaagaattattttaaaaatatttagagtgtcaacatattcaattcttagatggaataatgatctttaaagagatgagactagtatgtaaaaagttcatttttaaaagtaagaatcttcatcctaattatctgctagctaagacaaaataatagaatcaacattcttacagattttcgtttacactgcctcctttaaaagatgcccaatactgtggatattaaagagtgattactagtatattatgtatattatatattcagctttccttttgtaaattgattttaaacatttccaagaaatagtttcaaactaggtacttcttaacatctcttatacttttgccttaaataaaaacacattgataatgctaattatatggtaaaactgttaggtctgcagaagtcatattttatttctgaaataataaaaatacattttaaaacagatgcagaaaatgtgaaaggtagattgctgctggaaattcacatagtctttaaggaataaactatgtacgtgttgactatgaacagactagtctatatttactatattaaattttcaccaagttataaagattcagtatgttatccttttggaaatttaaaaaatagtaaaacacattctttttaagagcaggaacaatgtacttgaagcaacaaatttatgactgaagattatatatcagtataatccttgcttctctgattgctgtgtacccttttctgcagccgttttttttttaactcttaaagtctgtgctctattacagtgattctttttcttgtttctaaaagaataaatgaatagttttttgttaataattaatgtaggcctctgcttacctgctttatacattctttacctgcctgtacgtagcacttgcctatgcaagtattcatttactgaaaaagttaccaactttgtagccttgaaatcatttaaaaaatatgttaactgacttgaatactctggttagaagcaaaatgcataccttctacttgaaggaatttgttttcacctttactgaaaaaaatacatatttagttgtattttaaacactacttattttgacatagtaatcactttatagttttctaggaagttcatctttgtatgcattttatatctcctattcttttcttgtaaagattaggttacaattaaaataattcaaagatcattgggaggtactgcattaaactgtgggttggatcttgccttttgtcttgttcaaactgcacctctccttttatttttttcaatctgaagatagtagcatgcttagagcatgaatgtaagccatgtggtggctaagatagagaaggcagagatggatgacttcagaggaagtaagtgtttgacaggagactggactgggtgatggtgtgaaccaaagtcaaggtcacagggagaaaaagagcaggctggcttcatgggtgtgcaacctgtacagttacacaaggctcagcttttttaatgttctgctactgctatgttgaaattcttaatcaatttcacacaagaggccctgaatttttattttgcactgagtctcacaaattatctagcctgttctgcagatgagaaataacaggaagcagaaatttcttgtctttttagttattaattccttttcccagattagccaaaatgggaattattttttaaatgatgacttacggacatttaaaaaaatgtggaaaattaacctaatttgaaagcagttgtgtgtgtatgtatgttatttagtaatttacccaagtattggagaggggaaaaaggagcttgttaaattttcttatggaagtgtcaaaggtggtcaaacttccaatagactttaccaagtcagtatgtaatatacatagtttgagaagtaaaaacaattggtattacagaattgtatgtctgaattacctactacgtgctgggctttacccagaaaagtgtttctttacccataaagcctgatgctttatattcagtacagtactttattatttagtaattattctttcctagtattatttctaaagtggtaattgtttcttgcctttatagtgcttgtaaactttattttttaaagattttggaaattaaaatttagaaatttataagcccattgtggtttttacacagtcctgtcagtttactagttttatttgatagctatctaatacgcacctgtttaaagtggaacgtgtttctattacacctaggctctttttttttttaaaatttaagttctgggatacatctgcagtttgttacataggtatacatgtgtcatggtggtttgttgcacccatcaacccgtcatctacattaggtatttctcctaatgctatcccccacctagcctcccacacctcaacaggccccagtgtgtgatgttccctccctgtgtccatgtgttctcattgttcaactcccacttatgagtgagaacatgcggtgtttggttttctgttcctgcgttagtttgctgagaatgatggtttccaacttcatccatgtccctgcaaaggacatgaactcatcctttttatggctgcatagtattccatggtgtatatgtgccacattttctttatccagtctatcattgatggacatttgaattggttccaagtttttgctattgtgaacagtgctgcagtaaacatacatatgcgtgtgtctttataagtagaatgatttataatcctttgggtatatactcaataatgggattgctgggtcaaatggtatttctagttgtagatccttgaagaattgccacactgtcttccataatggttgaactaatttacactcccaccaacagtgtaaaagcattcttagttctgcacatcctctccagcatctgttgtttcctgactttttaatgatcgccattctaactagcatgatgatatctcattgtggctttgatttgcatttctctaatgaccagtgatgatgagttttttttttttcatatattttttggccgcataaatgtcttcttttgagaagtgtctgttaatatcctttgcccactttttgatggagttgtttttttcttgtaaatttgtttaagttccttgtagattctggatattagccttctgtcagatggataggttgcaaaaatcttctcccattctctcagttgcctgttcactctgatgatagtttcttttgctgtgcagaagctctttagtttaattacattcatttgtcaattttggcttttgttgccattgcttttggtgttttgttcatgaagtgtttgctcatgtctgtgtcctgaatggtattgcctagtttttcttctagagttttttatggttttaggtcttatgtttaagtgtttaatctatcttgagttaatttttgtatgaggtgtaaggaagggttccagtttcagttttctgcatatggctagccagttttcccaacaccatttattaaatagggaatcctttccccattgcttgttttttgtcaggtttgtcaaagatcagatggttgtagatgtgtggtgttatttctgaggcctctgttctgttccattagtctatatgttttgtttttttgtttatttttaacttcttatttatttatttatttattattattataccttaagttttagggtacatgtgcacaatgtgcaggttagttacatatgtatacatgtgccatgctggtgcactgcacccactaactcgtcatctagcattaggtatatctcccaatgctatccctcccccctccccccaccccaccacagtccccagagtgtgatgttccccttcctgtgtccatgtgttctcattcttcaattcccacctatgagtgagaacatgcggtgtttggttttttgttattgcgatagtttactgagaatgatgatttccaatttcatccatgtccctacaaaggacatgacctcatcattttttatggctgcatagtattccatggtgtatatgtgccacattttcttaatccagtctatcattgtaggacatttgggttggttccaagtctttgctattgtgaataatgccgcaataaacatacgtgtgcatgtgtctttatagcagcatgatttatagtcctttgggtatatacacagtaatgggatggctgggtcaaagacaaaaaccacatgattatctcaatagatgcagaaaaggcctttgacaaaattcaacaacacttcatgctaaaaattctcaataaattaggtattgatgggacgtatctcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcaattaggaaaagaggaagtcaaattgtccctgtttgcagatgacatgattgtatatctagaaaaccccattgtctcagcccaaaatctccttaagctgataagcaacttcagcaaagtctcaggatacaaaatcaatgtacaaaaatcacaagcattcttatatgccaacaacagacaaacagagagccaaatcatgagtgaactcccattcacaattgcttcaaagagaataaaatacctaggaatccaacttacaagggatgtgaaggacctcttcaaggagaactacaaaccactggtcaaggaaataaaagaggatacaaacaaatggaagaacattccatgctcatggctaggaagaatcaatatcgtgaaaatggccatactgcccaaggtaatttacagattcaatgccatccccatcaagctaccaatgactttcttcacagaattggaaaaaactactttaaagttcatatggaaccagaaaagagcctgcatcgccaagtcaatcctgagccaaaagaacaaagctggaggcatcacactacctgacttcaaactatactacaaggctacagtaaccaaaacagcatggtactggtaccaaaacagagatatagatcaatggaactgaacagagccctcagaaataacgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagacttaaacgttagacctaaaaccataaaaaccctagaagaaaacctagacattaccattcaagacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacaaaatgggagaaaatttttgcaacctactcatctgacaaagggctaatatccagaatctacaatgaactcaaataaatttacaagaaaaaaacatacaaccccatcaaaaagtgggcaaaggacatgaacagacacttctcaaaagaagacatttatgcagccaacaaacacatgaaaaaatgctcatgatcactggccatcagagaaatgcaaatcaaaaccacaatgagataccatttcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaatggtctatatgttttgataccagtaccatgctgttttggttactgtagccttgtagtatagtttgaagtcaggtagcatgatgccttcagctttgttcttttggcttaggattgtcttggctatacgggctcttttttggttccgtatgaagtttaaagtggttttttctaattctgtgaagagagtcaatggtagcttgatggggataacattcaatttgtaaattaccttgggcagtatggccattttcacgatactgattcttcctatccatgagcatggaatgtttttccatttgtttgtgtcctctcttatttccttgaacagtggtttttagttctccttgaagaggtccttcacatcccttgtaagttgtattcctaagtactttattctctttgtagcagttgtaaatgggagttcactcatgatttggctctgtttgtttattattagtgtataggaatgcttgtgatttttgcacattgattttgtatcctgagactttgctgaagttgcttatcagcttaaggagatttggggctgagacaatgaggttttctaaatatgcaatcatgtcatctgcaaacagagacaatttgacttcccctcttcctatttgaataccttttatttctttctcttgcgtgattgcccaagccagacttccaatactatgttgaataggagtggtgagagagggcatccttgtcttgtgccggttttcaaagggaatgcttctagcttttgcccattcagcatgatattggctgtgggtttgtcataaatggctgttactgttttgagttacgttccatcaatacctagttcctggagagtttttggcatgaacgggtgttgaattttatcaaaagccttttctgcatctattgagataattatgtcgtttttgtcattggttctgtttatgtgatggattatgttgattgatttgcatgtgttgcagcttcatcccaggtatgaagctgacctaatcgtggtggataagctttttgatacactgccggattcagtttgccaatattttattgaggatttttgccccaatgttcatcagggatattggcctgaaattctctttttttgttgtgtatctaccaggttttggtatcaggatgatgctggcctcataaaatgagttagggaggagtccctctttttctgttgttcgagatagtttcagaaggaatggtagcagctcctttttgtacctctggtagaattcagctgtgaatccatctggtcctgggctttttttggttggtaggctattaattactgcctcagtttcagaacttgttattggtctattcagggatttgacatcttcctggtttagtcttgggagggtatatgtgtccaggaatttattcattttttcctagattttctagtttatttgcatagaggtgtttatagtattctctgatggtagtttgtatttctgtgggatcagtggtgatatcccctttatcattttttattgtgtctgtttgattcttctctattagtctggctagcagtctatctattttgttaatcttttcaaaaaaccagcttctggattcattgattattttaaagggtttttcgtgtctctatctttttcagttgtgctctgatcttagttatttcttgtcgtctgctagcttttgaatttgtttgctcttgcttctctagttcttttaattgtgatgcacttattctaaaatcaaccacatagttggaagtaaaacactcctcagcaaatgcaaaagaacggaaatcataacagtatatcagaccacagtgcaatcaaattagaactcaggattaagaaactcactcacaacctcacaactgcatggaaactgaacaacctgctcctgaatgactactgggtaaataattaaattaaggcagaaaaaaataagttctttgataacaatgagaacaaagacacaccataccagaatctctgggacacagttaaagcagctcacgcctgtaatcccagcactttgggaggccgaggcgagtggatcatgaggtcaggagatcgagaccatcctggctaacaaggtgaaaccccgtctctactaaaaatacaaaaaaattagccgggcgcggtggcgggcgcctgtagtcccagctactcgggaggctgatgcaggagaatggcgtgaacctgggaagcggagcttgcagtgagccgagattgcgccactgcagtccgcagtccggcctgggcgacagagcgagactccgtctcaaaaaaaaaaaaaaaaaagcagcattaggagagaaatttatagcactaaatgctataaatttctctcccacaagagaaagcaggaaagaactaaaatcgacaccctaacctaggctctttttctgggtctctttctttctaaagttttgcttattttgtttactgcacaatccaactaaaaccaaattttttacatcatttcatttgagagttaccttttattctaataaactgtggaataactggggttggggagggaattgcttaagttcataaggattcttgcaaacttgaatgtgtcgatacaagattttttttgaaaatttgtaattccatttcacgatctcaaccagaattcattatgtttaaaccacctgatatagactaaaacattttttcaggagcacaattgtaaaaaggatgcagagaaatatttacaacattacttatttctttgcagatttagtgaaagtatgtcctacttttacaaaatatcttattttcctctcttttttacacatataatagagaactaacttttataaactaaatgagaagggaatactaatttttaaattatgatgtcacttgtagaatttgttttaaaattgataaaatacacctctttttttattattatactttaagttctaggctacgtgtgcacaacatgcaggtttgttacatatgtataaatggccatgttggtgtgctgcacccattaactcatcatttacattaggtatatctcctgatgctatccctccccactccctctaccccatgacaggccctggtgtgtgatgttccccttcctgtgtccaagtgttctcattgttcaattcctacctatgagtgagaacatgcggtgtttggttttctgtccttgtgatagtttgctgagaatgatggtgtccagcttcatccatgtccctacagaggacgtcaattcatccttttttatggctgcatagtattccatggtgtatatgtgccacattttcttaatccagcctatcattgatgggataaagcacacctctttaagactgcttatagaatgctatggactcattggcttggttttttatttccttggtttcagtccaaagtgtaataagcttttcagaaagtttctcctggatgtgtaaagaataccaacagatatcagaaagcatctggctgaaagtttaagcagggagtattgttattcatccagcgaaggtggtaaaactctcctgtatcctcgaagtataactaactgagagagagaggccctatataaagccagctgacttaccctgcaattgcttgtctggcaaacagacaatttttaaagactcatatatttaggaatttttaaatgccatagaatcgatggacaaaatgattttcatttatcttaatccaaaatcacaagattgattatatacttaggttatatggaaaatcagcattagaagcattagttctacacctcatttgcatgacattattacaagatattaactgtaaaaatgaagtaaatataatatctgttcaccagatgcctaaaacatacaacattagtatagacatatagaaggatctgcaagcaactaaacaagtagcgtaaatcaaagaatatactgataaagtggtaagtgccttttgggcttcttaggtaataagcccttgtatctgccagaatagtctagcaaaaaatgcatttttttctttagcctagggaaacttttcacaggagatggagttttaggtattgtgtagatgatgggagaaattgcttttgataagcttcagtgaaaaaggaagggaatgtgtcattgcagatagagagggagagaaacactggtagttggtcgtagactggtagtggtgtagaaatagaaagcaaaacctattggacaaaggaactgaacagatttgttaaaaaggaatgagacaaacagatatgaaagataaggagtaagctgatacaggctggtgagctcactgatagcagagtccaccaagaggcatttagtggttttccttcagggcaaaaagtttgaaagagaaaaatatgatctctaaatagggctactcataaaaaatattgactattaagaatatagatacagtctgtatctttaagactgcaatttagtacaatttaattttgtttataggctaaacatttttataatttcatagcgattaacttgataaaaaagggaaaatttcttggtctttctgccaatctgtgtttctaactgaccctaaacagctctgttggtttcctgctcatgcattagagcttgtccatagccacaagcccctcttttcctgtcagccctgcaaagaccgccccttccaaattgccttctcctcttgatggcacatccaagcactagcaaattcggaatcatttttgacttatcgtttccttttaccctttttaatcataggtacaatcttttgcaagttgctttatctctctgaccttagttttttcatatataacatggagttaataaaacaatattgccattttcagaattcaataagttaatgtgtaaaagcacacaacatagtgcatggcacataatagttgagctttaattgtacatgttacttgttttttctatcttctcaactggtaataataactctactgaataggtagtaatttaatgaaaaaaattaaatgcattgtggtgtttgccaaaatttttggtttgtatgtatacactggattacagttttataaatttgtcctcatgaaattgattgtcaggtgttttctctttagttgttttgttaaaaggttaattggagcataacaaatgcatcactatcttatgtagctcctataaaaacataaatactttaaaataaatttgaaaattagaggggctactacatgcaactgattatagttctaattttagttatgaaatttacttctcaactaaggcacaatctctaattctgtatctgcattgatgactcagtgattttagaggttgtgagttgatattttcacatttctacctatggtaactcattacagaatgtctgatcatgatatcctgttctgtgtagcatcatagtggacacttcatgatatttctgctaaaccctttacctgtcataactgtctcctttctgttttgcaaattccctcagcaaagtcaaattcagtcctcacttggttataaatagcattataaaccatatttttgatttaaataaagcacacaaatctcaaagaatgataaaagcattgttcatactttgtaaaacttaatcattgattatagattaaaactgaaacaacatgaagggatcagactcactcacagaaggttattgagaaccaggaatcatagatttcattcaattcaaattatcagttgtacattgttgcttgttcaaaatcattttacaatccactttgcccacctccatcttcttacgttacaaagaactttcatctgctaggcactgctgatggtagaatgccatgcctttaaggtttccctttggaatataaagtctatgttttcaatagaattaactgttcgacagagagagaacaggatttctgtgcaaagatggtacagtgctagtaaaatatatagcccctttactgtctacattaagcaaggatgataccctaagaattctagctgctgctgttgatgctgctgcaactattactactactacttctactaatcacgagtatagaaaaatatctctttgatcctgtgtgtgtggtggtaaggttttgggagaagccattatctatgggtggtggaatcacatatattttaaagtcttttcgaccatgttcgttttctaatttttctcaagtaaaagattcttctatacttttaaaaaaattataatttaaaaaaaaatcttattggacttgtttaaattatcagatatttttcagttatgtaattggtttctggcatacatagacttttatcatttgctctgctttaacataccttcatcagttttataaatacagttcgaaaggattgttctaaatatatataaagggaaaacttcatttgaaagcaaaatctgtatttgggatatttgttgtcttttttgccttctaaagggcaatctagaaacactaatattgattggttattttgtttcataatactttatagctgattcttggcaaaaatggttgatttctctttcattgtaatacaataataaaaaagttactcagaatttctccagtgttttaagagctgtccaggttgacatccaaaaatttaagagagcgttagaacatgggatatctaattgttaattgagactggaattatttctaataatcttagttgtaaatactaatatcttattagtcttcttatctttgctggtataaaaatggttgaaacatttgaaattattttctcagttacagttttgccctgtgtagaagtgtgattatctaagaagtgattttttttcagatttcaaatatgaagtgttgtttaatactaacatatagttacaaagactatcgtgactatttttggtgttcttgattatgatttaatacttcatactttaggaaagacgatttagttctaaatatatttataagtgagttcctaattttttgtgtgctgtagacttctaagctattgatataattgaatgttaagcattttcattttttatggcttactactttaatgcaaagcagaataaaatactaatttatttcttaccctcagatgatgttgtgctgatgtatattttccagtcttgtcataagctcacaattacctacataatggtcttgaaccaaacgattaaatggaagacaacatttctggtcttccattttaattagtgtggtgcaagactattatgtaggtttttgtgtaaaatgtggaatgtgaatcctcaactctttagtcattcttcctattagatattgaagcaaaatttaaaatatgccatttgactaaagatatcaaagtgctttataaagatattacaatgtacctaagtcctgttttagagcaccagagagaaaaatagaagcgcatagaaggaataaattcagttgcacattttgtatttaatccaatgactcaaaaacatgggcacatatttaccaaattaaacgctttcatcaaacatcttcttgatcataccataaaagcccccaaagtttttattggtagcattgctctgattaatgaaatgagcttcagtgcaaaaacttgggctgttagaatacttacaaaaccattattgtccagttctatagctgctaccctagtccctggctctcatctttttatacctggtttaccacatcagcatccatgctgagaaccatgcctcagtcttgcactgctcaaatacatttagtcatgaacttatttattcagcagacctttgaggacctacaatgtgccaacaatttatttaaacaatatttgtatattttccatccccaggctaggacttatagtccccagttggttatcaaatctaaactaaactcagcctaaaaatttagagttctccaaatctcacttattcttgttctttcatgccagtctccttatggtaacattcattcttagcacaatgtgtgtctgttcccacttcttgtcctagtgcatcatctttcctcttcaaggatgtactccttctcctccttaaaattttaaaaatcatagctaaaactaccctgtgaggtgtgaggtttaggttggtgtagtcatctgacttggatcattctttttattctggatcctgagagtatctagaggaaattgcgtattctggttaatgagtggcttatcacatactgtcttaacaacactaagcactctttattcagtaaaagttcacaccataagaaaatatattgtaatgtatttagtgcttcttcggtgatatataaggtgttctacttagaaatttagatttgtaggaatgctggttaatagaagtttctaatatttactgtcttccatatttcctgatgttttgtttattttaagctattttaaatattttgcatttcatatttttaaccaggcagtatctctgttcctcattctgaacacccaatatggtactttgaacataatagggtttcataaagtgcttgattcagtaaaaaaaaaaattgaacatctactatgttccaggcattttgctggatttctggactacaatcatgaaaagacagtctattctctcagcctgcttatagtctagtgggaaagataggttgacagacatccctaatatagtataagttcttgaatacaggtaaatacaagagtatagagtacctagtctcttctaggagtgtcaagcaaacttttttagtagaagcagcctctgcaccaaggagggaattaggaaattttagtgcctgataatctccttcagtctcctaaattataccaaatgaaacaaagtaacagtgtgtgtttgctatgggaatacacctggaagtcaaatatccagcatgcactccctaaagagtgccaccctaaaccttcccatgtaggaatgccagcgccacctctgagaggaagggatggctaaacagaggcaagcagcagacaagagcaggaggattcctgcaaggggaatatgaacaaatacccagtggcaaaaacaaaacaaaacaccaaggggagttggaagaagtcattttccaaggccagaatgtagatttgtttggacggagtggatggggggatataggcacagtctttgagctgcagaagaatgccaggagccaggtcttaaaggattttaaatcagtgattttttaaaacctttattttcttaacagtagaattcttaagaattttaaaattttaactttagctcaatatttaaaaaataaaaacagaactagtttggttttgatgttgtttaaggtttattttgctgtgcgttttggtggggtggtagaagtgttagtttccttggttgcttgcttctctctgtactctactgaggttaggaattgtgttctagagtcacatcatgttactaactggggctttgtgttctgactggtagtagcaataggtttcaccctttgtgattgagtaggctcctaggaatttactttcatctattcaacaaaaatgtgtatacaggttgagcgtcccaaatctgaaatgctccaaaatctgaaacttgttgagtgccaatatgatgctcaaaggaaatgctcagtggaacatttttagatttcagattttcagactagggatgctgaaccagtaagtataatgtacatattcaaaaaaaaatctgatatccaaacacttcttttctcaaggattttggataaggtatgctcatcctgtattcttagtactagtaatgtttctctgagcaaaatagacacaatccctgacctcatggagtttccagtataatgccagagatggatattagaaagtaatcctgtaactataagctgtgagataaatgctgtacagaagaggtcacttacattgagagatctgtaaagaaatgacatttagatagaaacttaagtggagatctgaacaatgagctggtggtagacagtggtgtaggcagaggctgtaacatgcatgaatgccctggggggataaggtttgtggcagcagtaaagccggagagggaggtagaacccagattatggacagccaagttagggatttcgattttatcctcagtgtaatgaaaaaatcatcaaaaggttttgaatagtggaataatataagatgacttgttttattaaaatattaattatactatggctaatgtgtggagatttgctaagagaacaggtagaatgagtgagtatggggacatcagttacaggagtcatattctcatatccgccacatagtgggcactcattcaccattttgtggttagctgaatgatgactagatcactgcctctgttgtaacatctcaaattatttgcactttaaccatgagttaagttggatatttttgaggaatcatgaagtgttgctgatttgtactaatttttcctcataaaactttagatattttgaactgctgcttcatcttgccaagggtgaaaacaaagcatttattcattcattcgagaagtgcttaagctgtgccaggtactggctgagagctgaggatacagactgaatgaataagttaggcatgatatctgccatcaagtggcttgtagtctgggtaaccagagctgagtagagcaggcggtatgttggcctcatacctccgaagtagtatgtctggaattagcctgtctgtagtcccagcctcagtatctggaatatcctaggtgaagatgagatctcttaacaatttaattacattttctcctacctcctctttgttctaatgtatactactaaatttctacttcgatgacctttgctgaaaatacagccactcttaagtcctataacacatgtgcccaggaccggacaacctaaaaattaaatcctgattcttctttactcttagaaaagctgggaccttccttaatggattaaccttctattgctgcgtaacaaatgacaagaaatttagtgatttaaacaacacgtatttattgtctcgtgcttccatgggtcaggagtccaggcactgcttagctggctcctctgcttaaggcagcaatcaaggtaccagccaggctacattctcatatctagctcagggtcctcttccaagatcattcaggttcttgacagaatttgttcccttgtgcttgtaggaaggttgcttctctccacaggcagttcacaatatggctcttcaccttttcacaagtggcagaatagagagagtttactgctttgcctctctgaattcagggaaggcctaactcctcttttaagggttcacctgattacatcaggctctcccaggataatctcctttgataaacacaaatagctgtttgggtaccttaattacatatgcagaatcacttcacatttgccagataacataatcacaacagtaatattccatcatattctcaggtcctacttatactcaagggaaggggatgatagaagaccatggatcattggaggtcagtcatcttagaattgtggccacctcacttgctttttagtaaaaactctcacatcttttagtttccaacaagtgatgcttgtctcagtctcattatatctttgatgacttcttcaccattctttctcttccttcattccgtagatatcgagatttctcaaaacatctcatcaacagtccagcctgtttcttgaccctgtacctcttatttttcattggctgaggaccaattttcttgttctaaaaataaagctaagagcaggcacttttttctccagtcatttgctgaaaaacataaactcatcagataataaaacaaatgctgtttcttgcctgccttgtaccaatttagggagaagcctaggggagagtgactgattttagctccagccactccaggtagggaaaactgtgcatggatgattgggagaaccttacttagatgggggacaggcagttgtgttagtgagttctagcagatgcaccctccatggcatggaggagtattgtccttttatgccagggtaccttagaagagtatcggtgtgggttgtgacttatgagaggggctacacatgcatgggttgggacaaccatgtggtattaatctaccagtggtttcaagttatattgataaaacaaatacattcttacaatttaagtgtagcctttacacctgaattcaaccatctgctatctagcaaaattcagtatcttgcaaacttaaggctgtcaggcgtctgctgctaatttaaggatagcttggtggaatttgcatggagggagcagttctcttttctctttctgaaatgaccttcatctctctttttatctgattggtttatctgttaaaacccagcttaggaaaaaaaaagcttagacattgcctccctgctaaagcctttccatttctagaaacctatctccagtgtccatccttgagaaagtcaatccttcttttctctttgttctctacctggattgaagttgtttctgtcaattaaaactaccatattttattataatttatttacatgcctgtctcctctactagtgagatccttggggatagaaactgatttattaattttcttaactataaagtgcctgacctgtgacaaaagctcaatacatgttttgagtaaatcaatcactgcaccaactcaaatcacagtattccccccctccccgctgatttcaagtgaccacctctgatccccttagacacaaacattgaccctgattaaacctgtgtttgctttgatccatagatacacatttgaactacaggccatcctttctggacggggttttgttactctggcctacagttctttattctttttctccccactgaccagcatgtattaaagtcacaagaccagtctttcaaatagatgttttgaatggggcaaagccttttcatcttgaagccctgtaagtcactccagagagtgtgggaaaagcaaagtgcttggcatagggtacggtagtagcagaggatcttaattatagttcttcacatttgagtgaagttctgaagctatgaagtagaaagtaggaattatcatctcagttaccttagttttgatgtgtggaccaaagaaaatgttcaggaatcttcatattgtgaaatgtgcagtacatgtttaaggttgtagaatattggctctaaggagaattttatattcattcttaaaagagaactaagttagagacagtatcttcagattattgtttccccaaagacccttacctggttttactgttgaattaaacagtaaaattaaactgttgagttaaacagcattaaagatggtgcagtagcatcattagatgcatggccttggaagaacatagctttcatatcagaaatgtacttttcaaaaaatctatatttccttttaaataattttataatctcagctttcattttagagttgggggtacatgtgtaggtttgctatgtggatatattgtgtgatgctaaggttttgggtgcaaatgatcctgtcactcaaatactgagcatagtgcccaataggtacctttccagcccttactccttttcttttgttcccccctttggttgtccccagtgtctgttccaatctttatgtctatgtgtgcccaatgcttagctcccacttagaagtaaaaacatgtagtatttggttttctgtgccagtgttaatttgcttaggatgacagactccagctgcatccatgctgccgcaaaggacatgatttcattctttttaatggctgcgtagcatttcatggtgtgtgtgtatatatatatacatgtatatatataaatgtatatataaatgtactttttcatgtgagaattcttccaataaaatattgatgactgtggcataggagtgtaaaattagaagtgcttcatatggatacaatgcctacatttcagaaatcttcatgcagctcttctggaatgtgggcaaattagtctcccggttttctctatggtcaaccattttctattatactcaccttgtcagaagatatttaatttaccacaattaactaaaagcttttgtttaaaaagtatgtcttatggaaaacagaacagaggtgactaattttttgtgtgcagtaaatgtttttaagtaagcatttctacaaccaggtgaaggaaatgattaagtagaaattgggacttgcatgtaattttttaaaagattgtgaaacttgttaatattatgcatgtatccaacttcttttctattttcaaattattccagtaacaaaggtttatgcaataggtatactcccaaaaggttgtgttactatataatgcaaatgcatgaggatcagtgtttaagcaattagtcaaaacctctaatttacctcttcccaaacgtaatgtattatctcttgagttatctataagcggctagttgtaggaaaaaatgagaaaagctggctatatagcaagtttgttcatccagaaaacttcagggtttttagtttgaaaccttcatgagaaatttttaaatagttaaaagcaactgtaattgtagctacttgttatcagttgttcttcaggcctagttcttaaaagagaaattttaggagtatgctactctaatttcagcagataatcatttaagatgctgtcatgatagaaaacgactccagaataataaggatagtttatatgtttcttagagattctgtaatgatcaatttttagaaagtatacttcatacaaagccaaatatttgcttttgtttttttgttgttgttgtttttcttttgtttggttgatttcagccaaccccatttaccccattatactcaattttaatttaattgttttggaaaatgttcttccatttcattacaacattttacgttttctctaatatgtgtttacgtaaattcactttgaagaaatgcatttataccatcagctttatggagttattgcaaaccaatgccatcatcagtgagactataaatttttttttgcagactagtcttttcatcatgactttgcataacattgttccagctagatcaacaaattgattattatattttactatatcatgaataatgcccagaggcttagtaatatgagtgaaacttactggggatgatattttatttaagctgctatatttaaatggtgctgcaatttaggtattccattgaatctacatatagtgcatacttgacatagttaagaaaaggttttgttacttttcttatattgaatatttgagtaatacacagttctgttgtacgttaggatttgagtcccttatgtacaaaaatatttactaccttctttgtttcatttcagaatgaccttatttaaaagtgtatgaggctatttataatcaactctgtggaagtgattaaagaggtgtgaataataggttattggaacttgacagctcatagtttgctaaactagtgttagaacatttatgctgctcagatgtaccttattttccttaagtgagaatttctgttttgacatgtggtttgttgatataatatattgcataggtttttctcttttaagtggtttaccaaatcttgatattttattgccttattttacattttcagcttaatcaacattttatgcttaataagaataaccttggtacaggctataaacaaaacagtcagtatagacagagtacggtccttaagtggagcatcagccttccatttcaagctatcctataaaataaatacaatcaaattttttttaaatgggaaaaaaactcttttcttacagaaaatttgaaaacatttggtaggttaacattcagcagttgttactctgggaggaatgttagaactcctgaagaaatttgggatagccaatatatccataaaaagaagaggtgtgtatttggtatttcattaaatctttactaattttaaatacaaagaccagaaaaccacgaatttgaatcaattgaatttgagttagacagcctttttatttgagaataaaaagaaatctaggaaagcatttttaaaattttgaaaccattacttaatgagtttccactgttctcatggattcagagcattgtcatttggtagtactctcaagtattctcaagatttactaaaatgcattttaataatcgcaattcagttttccctaaccagccaggaggtaatgtttctaaaaagaacgtggttgggaaaactgtggcagagaaaatcaggcctcatagacaacaaaggttagagaaataaaagtaaaaattactgtgtatatattctacaataaacctgagaaattctttataaaaaaatccaaaattaaccacatttctcaacatgaaaaacttcctagactaattcatcactggacccatttactcagttgtgattttagcattagtcacccacaaattttgaattatgtaaattacacccattttaaagtttttgaactatctggcttgaaacctaatttttctcttgatttcctcttgtcttatttttcaagtctgagaaattattgtgcagcagtctatattttggtggaacttaagggtatatttttctagacctgacttcatttattaaaaagttggagtacaagtgtttatgaaaggatggtataattgtttgaaagtatcagttgtatatgcatacatataaatagcccaaatgttttataaaaatgaagtgtgatgatatattcaaagaacgctgcaataatttatttttggagtaccatggtactttggagagaactctagagacctgtttttaatccttttcttctaattactctctgtgtgaatttgaatagtttgcttagctttactaagcttcctatatcttttccttaaaaagtgatgataataccaactctaccaatgttacagtatgttgttctgaggatgttctggttaaagtgctttgtaacttgtgaattgcaagggaattgtaagatttgccaatgttgcacttgttgccaatctgaagattcaagctataagttgaatacaaagtatgtgacctagagaaaacattactctgccccctaccctcatcccacccccatgactcaggttgacagctattcttagttaagagatacttggggaaaagaggacagtttagagaacttcctgtaggtattcattgactcgtagttccttttggccttctcagacacttttcttaaaagacagttttatatcggtaacctcactctaaagtctgtagaataatagcacattctgattatagagtcagtctaactttataacgctagagtagtacagagaactctcatgttgtttaggttttccaactggggacatcctgtgatctgactgttcctagtgcacaagctaatcccacccatatcctgtttgtgagtaattggatggatgcctggaaaatctagtgccagattgtatagtgcctttacaacagaaatctctagtttgaattgatttaccctctacctaaacaaacacctctcataggtgagcctctactctaaaaaggcaagattatataacatagatccctagttcttgtttccatagtcatgctttggatggtactcccattgatctggatcagagacatatgtaaaatacaatttcagggtgttgtttttctgtataactgaagcagtagattttgaattgtatacctcttcccatgaatatagaagacagctttgtaggaaaaaatttcttcttaaatcatcttttttatctaaattattaagaataggaaaataccatttgcatcattgtagtctctcttacttcttgggttctctttacaagatatcaaaatatgtttaaaaaaaaaacccggatgcatataggtgtgtgcaagcttgtcgtaattcaaaaaaaaaatccattgttaaatttcaaagacgtgtaatagtgctagcatttactacagcattgtgataaagggcacaagctctagagtcagtatcctggatataaatgctaaatccaccacttactgaagaattctaccaggcatggcaaaaataaaacctttcttctaattgccatattcttagccataatttgtgaattattcaaaattaataatttgttttggaaccccaactcagtaggtataagccgaaaaagggaaggactgaaaagtatgaaaagtgatagcttcagtgagccctggttgataccagggctcaaattatattatgactcactctctttctctccccccacctcccttgtatttcttcctccctttcctctgtctgagacatagggcttgaactgattgctttaaaaggcaatgaatcttggccaggcgcggtggctcaacgcctgtaatcccagcactttgggaggccaaggcgggtggatcacgaggtcaggagatccagaccatcctggctaacatggtgaaaccccatctctactaaaaatacaaacaaaaaaaattagccgggcgtggtggcgggcgcctgtagtcccagctactcgagaggctgaggcaggagaatggcatgaacccaggaggtggagcttgcagtgagccgagattgcgccactgcactccagcctgggcaactgagcaagactccatctcaaaaaaaaaaaaaaggcaatgaatctctaatggttgattgtatttctgtggggtcagtggtaatatcccccttgttgttgtttctgattgtgtttatttgaatttttggtctttgtctagctagcagtctgtttcattaatttttttcaaaaaaactagctcctggattcgttgatcttttgaatgttttttcttgtctctgtctccttcagttcagctctgattttggttatttcttgtcttttgctagctttgggatttgtgtgctcttgattatctagttattttagttgtgatgtcaggttgttaactcgagatctatcttttcgatgtgggcatttggtgctataaatctccctcttaacactgccttagctgtgtcccagagattctggtacattgtctctttgttcccattagttttaaagaacttttttattatgtccttaatttcattatttacccaaaagtcattcaggagtaggttattcagtttccatgtaattgtatgagtgagtgaatttcttagtcttgattttgaatttgattgcactgtggtccaagagactgttaagatttcagttcttttacagttgctgaggagggttttacttccaattatgtgagcagttttagagagaaagtgccatgtggcaatgaaaagaatgtacattctgttgtttttgggtggagagttctgtaaatatctatcaggtccatttgatccagtgctgagttcaggtcctgaatatctttgttaattttctgtctcagtgatctcatattgtgagtagagtgttaagtttcccactattactgtatgagagtctcagtctctttgaaggtctcttaagaagttactttatgaatctgggtgctcctgtgttgggcacatacatatttaggatagtttgatcttgttgaatgtaaacctttaccattgtataatgcccttctttgccttttttaaaatctttgtttggtttaaagtctgttttgtcagaaactagaattgcaacccctgctttttgttttgttttgttttccgttagcttggtagattttcctcattccctttattttgagcctatgtgtgtcactgcatgtgagatggatctcttgaatacagcataccattggatcttggttttttatccagtttgccatcctgtgtcttttaattggggcattgagcccatttacatttaaggttaatagtgatatgtgtggatttgatgctgtcataatgatgttagctagttactttgcagacttgtttatgtggttgactttatagtgccactggtctgtgtacttcagtatggttttgtaggatctggtaacggtctttcctttccctatttaatgtttcctttaggagctcttgtaaggcagatgtggtggtaacaaattcagcatttgcttgtctgaaaaggatcttgtttttccttcacttatgaagcttagtttggctaactatgaaattctgggttagaatttatttaagaatgttgaatattgactcccaatctcttctggcttgtagggtttcggaggccattatccttagcaaactaacacaggcatactgcatgttctcacatgttaagtaggaactaaatgatgagaacacatgggcacacagaggggaacaacagacactggggcttaccagtggtggagggtggaaggagaggatcagaagaaataactaatgggtactgggcctaatacctgtgtgatgaaataatctgcacaacaaaccctcatgacacaagtttaactatgtaacaaacctgcacttgtacccctgaatttaaaagttaaaaaaaaaaaaaagccagtgaatctgttgtgaatacttacaggcagaactttttttttttttttttttttttttttgagacgaagtctcactcttgtcccccaggctggagtgcaatggcataatctcggctcactgtaacctccacctcctgggttcaagcgattctcctgcctcagcctcctgagtagctgggattacagcctgccaccatgcctggctaatttttgtatttctagcagagacagggtttcaccatgttggacaggctggtctcgaactcctgacgtcaggtgatccacccgccttggcctcccaaagtgctgagattacaggcgtgagccaccacgcccagccataggcagaacttttacttgagggaaggattgatataagattctgacattctgttttttatgttctttgtatataattgcatatgattttgaaatataaatcttttgaatttcttattaaacttgtaaatgatgtttgtaatcgtaggcaatttaagatttcgtactagttaaggtatagactgttagaatgaattcagggtaaactgtgtgtgtttgtgtactggggaaactgtgtagtggtagcttatagggtcatctgttaattagttactgagataggcagtttatataaattgctcattcagtccttaaaaaatcttataagtagttattattctcccattatatgtgaggaaaatacaagaaactgcttccttttgcaaaccaaacactgcctttaaacttagcatcttagactgccactacctgcagacatgactagaacttattaaatattgtcttttttcagtttaatagttacttagtaatatggcctttatctaaatttcctaattttgccatgttaaaatgtaatcctatttgaactatgaactttgaatttactttaataaaaataatttctaccactgctaatacaatgtaaaatttttaagcttagcttaagattaatgttactttggaaataaattgctacacatttacacacataatttatataggaaataaatcagtctatggaaatatatttagattataagcctttttagctacagaaacaaaattgtttagaatgaacttacatagcaagacaaaattgaaaacagaggctttagaagctagtgtaatataaagtttacaatttacaaaaattacttcatttaaatagcagttatttttacttactttcattgaagaaataaaatcctatgattcaacttacagtatacagtctttttgcatggagggatgattttgtaaggcccaaatcagtactgcttaaatcagtacaaagagtgtatttgttttatggatcatgtttctggttttttcacccagaataaaactttaaaaggaaaaattttcttctgtttccaaaaggaactattggggtatgtggaggggttgatccacaaccctaaactggcagagagcttgggtgtatatataagcagctaatctctcacctagttccaggtacatatctttgttgttgaccagaaaagtgcctgaccagaagtccacatacctctcctgttattttccttcctataaatgtggccttgcctgccagggagcattgccttaaactaaactggaaataagaagcagcattcattatactatacacttgatcttagccaaaaggccaagaagcaatcattcattatactataaatctctattgtatgaggagtaatagagggcagatatatcactacaggacatgcctagtatttttacatcccagagtatgttgcagggatcctagtatgtaaaaatctcagaagcataaacaaaatttattttaaattttagttttaataagcttttttaaactccgcatcctacttttagtgggatataagggttattaaatcacacttcaaaaagttagaaaccctacaaaggccatacagaaaataaaatcctctgaacctaggtgctactaattcactcaagataaatttaatcattttattatttatggatataatctaatggaataattttaatactttaatgaaaacattactttcaatcagatgtacagaactcacaggaaaacttgaaaattcttaattataactgtaagacctacgtagtataactaacagataaaaggattgtctttaaatctttatgaaaacgtgaaatgaagcaacataaacattaattcattgacaaaacagtttattttaaacacgtaagaacagaaaaggtggagacttggtggttgtaaatttggacaggaatatattgaaatatcatgtgtatgtggatacagatatcagtattctggttactgccctcaaaaagcatatgttctttttaaggagttaacaaagatatgataaaatactgaaagaataataccagtgatacttagtaagtgctaataactaccttcagaatatagtatagaccaacactgtccggtagaactttcttggatgaaagaaatgttctctattttatctaatagccactggctacctgtggttatttgagcacttgaaatgtatgctgtatgaatgaggaatttaattttatattttatttagaaatttaattaactaatttaaggatagacatggtggctcacacctgtaatcctagcagtttgggaggccaaggcaggtggattgcttaagcccaggagtttgagactagccttggcaatatggcaaaaccctgtctctacagaaaatttaaaaattagccaggtgtggtactgtgtgcctgtggtcccagctactcaggaggctgaggaaggaggatgtcttgagcctggaaggttgaggctgcaatgagctgtgatcatgccactgcactccagcgtgagcaacagagcgcaataccctgtctcaatttttttttaattcagtgtgaatagatacatttgattagtggctaaccttattaaattctacaattctcaaaagatgcttgtctcaggaacccttcatttaaaagtgatttacggccccagagtgcttttgactatgtgggttatatttactgatatttacagcattaaaaatagaaaaattttaaatatttattcattcttaaagttactacatgttaacataaaatatctttgaggaaaagctatttttaaaaaagagtggcattgttttacatgtttacaaatctctttaatgtgtgggttaatagaaggcagttgaattctcatatctgcttctatattctagctgttgcaatgtgttgaactgtattaaaacctaacctcacatagatagttagttggaattagcctttttagataattgtggatattctttgattaccaaaactcaccaagtagcagtttcttaaagtttagttgtgatgtaaaatataaaaccatatcaatgaattttatagttacattaaaaaatcactgctctcttgaactttgagtgggccttttacccacttactaatttgcaacatcatgcattagttatttggaagatattggttcactgaattgtccagatcttccaaatgttgacacattccattttacccaatcaaaaaatcactaatagcagcaccaatctcttcagaagggtcttcaaaattaggaaattgcaaaattcaactcagctgcagttaacatgttttccaaaattctcatttacatctgaaagctcaaattttattggcaacaaatttggccaatttgtcttcctttaaatgacaggcttatttggcttatttttgagaaaatatctgccaaatactcaaacctgaataaccattgtttgtcagttggttattctttcaagttaaatagatgtaccatgaaaaaagcagctacttcggtagcaacttaattccaggagtgattttccataagacatctgttatactttgatgtccagcagaagtgttttgtgtatacatcccattttgttgtacagaacactaaaaagacatacactacagggtcaaaacttattaaagtaatttttactacttcatcaaggatgtacttaagtgaaactggcaaattttttaactggaaatgagtggcagtgagggctacaaggatatagtttgctgctgctgccttggtaagtgctaagatgccaacagtttgacctaccattgtctttgtatcatcagtgcaaatgccaaagaagtgaaaagggcaagtactgccttagtattattataaaaatggttttgaccttgctgaaaagacaataatggaggaaagaaattgcttttagttcaaataagttaaagaagactccatgataaagatcaatgtaatatgcatgccctactttatttttctttacctgcttttttctataaaaataaaagtaggaaagcaattagcatgttaaaaattatttaaccatgttacttttaaaatcattctttgattcagcaattatttattaactattttgcataagttatttttgttgttgataagtgggcaatatgtaatgtttagaataatgatcatgccaataaagcatctgtgcccccactataaagcactgctatgtgctgggcactgtgtttatgtgcttttaaatgcattcacggaatcttcatggtaaccttaggaggtaggttttatagaaagttaactggaattagtgccagctcacaatttttatataactagataaattacttaacttatttggatttcagttttctcaagtataaaatacgaagctgagacatatcttcagatgcttaaccaggcttaaaattcattaaataaacatatatttcacagcaggataaccctttattgacacattatcagaatactctgaattttattaggaagccataaaaacaattaccaaatcattaacataaactttttgaaactttatgtccctttcattttaaaattcgttgagtcaatacatttttcataacacttaatcctttactgacacatgatcagaacactgaacacttgaccaaagacctaatgatagatgtgaacataatgtaaacatgaagggatatagtcactattgtagcggaataaaaaataatacaaaagcgcaaagaacaagagtcaggaaaggtcaagaagagcatcaataaagcagcagtgttttagtttgttcattagttcaacagatgtcttatatgcctttgttatgccctgtaaagcttggaatttagactactggagggaacaaaatgatgtccttgccctcatggagcttacattttagtgggggagtgtggtaggtaggatagtggcctcccaaatatgtccatgtcctaatccctaaaacctgtgaatatgttacattacttaaaaaaagattattaagtagcaaaggaatagggagattacttcgggttatgtggctaggcaaaatgcaatgttaaaagtggaagctggagtttgaagaagggtcagtggcagaatgatgcgacatgagaaagtttcaactggccatttctggctttgaagatggaaggggccatgtgccaaggaatgcagcagcctctacaagctggaaaaggcaggaaagtggattctcccctagagtctccagaaagaacacagttctgccaacatcttgattttagtccagtgagacccatattgggcatctaattgtgaaataataaatgtatgctattttaagcctcttagggatatgtcagtttgttacatcaacaatagaaaactaatacagagtaaaagaaagtaaacaagtaactaaacaagataattacaaactacgatggatgctttgaaggaaataggatgatgtgaaagagtaaaggataaagcatgttggtttaggtgatcatggaagtcttctttggaactatgacactggagtggaaaagaaagacccagctgtgtggagttggaaacagaatctcaggccaagggaaaggcaagtgtaggggcatggagtagagaaggcttgccatttacaagaacaaaaacaggtcatttagcgagaatgaatagaatagtggaaaaggtgcaggcccaaaaatgtggagccttgcaggaatgatggaacaatggaaagccattgaaaggttttaagaaggagagtgatacattttgctttacatttttgaaagatcaccccggctgctgtgtggtaaatggaaacaagggaccaatgacatggtattgtagtcctgaggaggaagtttacaggcggaagcaaactagtggcattggtgcctggagaggattgttgatgatagacgggatatgagttccaaaagatgagtaggaatttgcccctagagaagaggaagaatacatagcagaagcatgaaagttcaggatgtctgggaaattgaatatactttgcagaacagtagcaagtgaagatgaagagattgtttaagcgataatgtatgcagtcgggagacccttattcgccatgtatgggagtttggaatttatggcatatgcaatggagagccatctgaaatttcgaatcaagagaacaaaacaatctcttgacctgaagttttgtgattattatgtatgtccttcattttcattctgaagtaaaggagaataataagggtgctttaagttttatcatcttagattctgagaagttcagaaagatttgattaagtacttgtcaatgaagtctttaataattcattgggaaccacacttttattctgttttgtttttttgtaaggacttttttttcatttatgggctctactcttctgctgtctttggagagacagcacagtaacctgttcagagcatgtccggagccacatggcctagggtacagtcctggttaccagtactaactggtcaacctttggcaagttatgtaatctaagtcttagtttcattgtctataaaataaggataataaaaattcttcaagtggcttctgtaaggattaatggattcagtgcatataaagcactgaatatgtaataagcactttgtggatcagggttgaagcagggtgcagaagtatacgaggagcattggttgtaagcttttctatatatcagtagtagaaatgtgacaggtcataatttctttaaagtacgtttaaaatacctatttcccacttcatttttatatatggtattaaattttctatttgtttgtgttttccaagaatgtccacttctttcatcacaaagcccacttattctccaaaaagtttatataagaaaatgggtagttagtttgcatgatcttctgctttattggatattatttattttctggaataagttatgtccacagatgattttaattcacactgctactcaggtaacttaggtaaaacaaaacatcaggattttttggtactacagttcaaatttatttaacttcccaacaatatattttaaataacaaagaaacaaaatactcaattttacctctgttgcacattagcaaggcataaaagagagattaatataattaggtaaggattcttatagtatttattttctgcatcacttttaatttagcatttaattatgtactatgacatttctctatataatacttcatgtatattactcatatttgcaaagattacgtatatctcagaggtggagactagatattaaatgtcttcattctcctatcttctgaagcacttaagtcagaggaactaaattattcattctaatttgacaactcaagcttgtaacatattataatgcttagaaaagctcagtaaaactaaactctagttacctataaattgtttgtttttaatacttcatcaggaaataaattccaattaaaatttcattaattatcccccttgttctttcatgtctttccaatgaaggagtagaaagactttctttacaaaactaggctcagggaattagtgtcccatgttgaaatttggctctcaggaaagctcccagaaaggaagtctcctagttggcaaccaataagccttacttagattactatatgttgtcattcccatggaagtaagggaggatccgtcctcaaactacatccttggggttcatgatctttttcttttcacttttcctatgatttctcttcccatggtcaggagttttaaattacacatacagcattactagtttgaaggaatcttggagaaccaaataaaatgaattagaatgtaattcttgtcctcttccttcatcttatttttcacaaccagttctgctactaatcgataagcctcaaagccaatcaaaggagaattaccttctgggattagtaaatgtcaaaatatttcttaaaattttttcataagatgagaaaagctgaaaatcatgccaactcctgtggttgaaactatttaaataattgactgtgtgtttgggtgtatgtgagatactataacctgtactttggggatgctcattgcccttgacaagtgaaagcgtgcgctctccacgaggcctccctcctggcgtctgtgcagtaagagagcagcttccctcagcactagctggaaggagaagtcacttgtgctggtgttcagcaagtattaccttccttttcattttatataatgttatgtagccatgaataggaaaggtaaatgtttttcatactttaaatagactactatctttcaaaaataagaaaatagatcttattattgtctcataaaaccataaaataaaaattgttttatttcaaaatccacagatatttatttacaacatagtattcatcaactaataaatgtcctttttacctttcattattctttagattttatttcagtatcctgattagtgtttttaattatacctcctattcaccgtgataacaaattcaaataacataaaaatgttaaggaagagagctgggtgcagtggcacataccagtaatcctaacactttggaaggccaagccggaggattgcttgaggccaggggctcaagaccaccataggcaacatagtgagaccctgtctctataaaaaaaaaattttctttaaattacctgggtgtggtggcacaggcctttagtcccagctacttgacagactaaggcacagaggatcgcttgagcctagcagtacacaggtgcagtgagctacgatcatgccactgcgctccagcctgggtgacagagtgagacctcgtgtctaaaatatacatacatctatagaaatatacacatatacatacgtacatacatgcatacatagagagccagcaaatattttgcccaatcccagttcagttttctaaagtttgccactagcaacattatgctgaaaattatttggctttttctttgcacatttaaaatatatctttaaaatttttttaaagtaatataaacattaaaataatatcaaaggaataagccagaaaaacaagtcactcctttggtacctgatttcctcatttgtatgtcctagacatcatgaattgatgttaaggcacatgtatagtatggatactatactgcatctactgtattttctggaaggatggaatcaaactattttggaagactttctatatcagtaccaaacaatatatcttagatgactattaaggtttttttgtaattaaaaacaagttttcagataaacatatgtatgcatatttgcatacatgtgttaatttgcacggtgccaagaaattgttagatcaacaggtcggcattttaaattttgataaatattgccaaagtaacacagcatataagagtgtactcttttatttaaaccttgcatatgtcaggcgttactgggacttttttgccgatttactaaacatcatttatctagggattagtatctacagccagtgttctagatgaggggaacagtggtgatcgaaacagaaaaaattcctgtctgaatggaacttgcattgtagtgtagtagataatcaatcaataagatattatagtgacaagtatttttaaaagaaataaattgagggagaatagggagtgcaatgggggtgggggtggtatttaaatagagcagtcataggagacctccctgaggaggtggaattgggcagttcataaagaatattacaggtagagtgatatgaagcaagaggccagtatacctggaatgcagtgagccggggtaaagtagaagacaaagtctgagagagacaggtgaggagagtcagcccatggagggccttggattacagtgaataggatgggaagtcattagatggtttgacaagattccactgatgctttagaaggttttgtctgctgtgttgagaactgactacaggaagacaaaggtggcagcacggagaccagataggaaccagtgacagtactcgaagtgagagatgatggtaccatcaggtagttagtggcagggaattggtagtgggtggtcagatcttgaatatatttttataggtatttccttccagagtagatgcatgggatatgagagaaaaagaggagtcaaaactatcactgagacttttggcctgaacaactggaggaatggaattgccgtttactgaaatagagaagactgagagaccaggaattgtatttggctatggtaaaaaatttcccattagaaatccaagtggtgatatcaccaaagacaaaagccacatgattatctcaatagatgcagaaaaggcctttgacaaaattcaacagcccttcatgctaaaaactctcaataaattaggtattgatgggacgtatctcaaaataataagagctatttatgacaaatccacaaccaatatcatactgaatgggcaaaaattgggagcattccctttgaaaactggcgcaagacaggggtgccctttctcaccactcctattcaacatattgttggaaattctggccaggacaatcaggcaggagaaggaaataaagtgtattcagttaggaaaagagggagtcaaattgtccctgtttgcagatgacatgattgtatatttagaaaaccccattgtctcagcccaaaatctccttaagctgataagcaacttcagcaaagtctcaggatacaaaatctatgggcaaaatcacaagcattcttatacaccaataacagacaaacagaaagccaaatcatgagtgaacccccattcacaattgcttcaaagagaataaaatacctagaaatccaacttacaaggggacgtgaaggacctcttcaaggagaactacaaaccactggtcaagggaaataaaagaggatacaaacaaatgggaagaacattccatgctcatggataggaagaatcaatatcgtgaaaatggccatactgcccaaggtaatttatagattcaatgccatccccatcaagctaccaatgactttcttcacagaattggaaaaaactactttaaagttcatatggaaccaaaaaagagcccacattgccaagacaatcctaagccaaaagaacaaagctggaggcatcacactacctgacttcaaactatactacaaggcaacagtaaccaaaacagcatggtactggtaccaaaacagagatatagaccaatggaacagaacagaggcctcagaaataatgccacacatctacaaccatctgatgtttgacaaacctgacaaaaagaagaaatggggaaagaatttcctgtttaataaatggtgctgggaaaactgactagccatatgtggaaagctgaaactggatcctttccttacacctgatacaaaaattaattcaagatggattaaagattgaaatgttagacctgaaaccataaaaaccctagaagaaaacctaggcaataccattcaggacataggcacgggcaaggacttcatgtctaaaacagcaaaagcaatggcaacaaaagccaaaattgacaaatgggatctaattaaactaaagagcttctgcacagcaaaagaaactaccatcagagtgaacaggcaacctacagaatgggaaaaaatttttgcaatctacacatttgacaaagggctaatatccagaatctacaatgaactcaaacaaatttacaagaaaaaaacaaccccatcaaaaagtaggtgaaggatatgaacagacacttctcaaaagaagacatttatttatgcaaccaaaagacacatgaaaaaatgctcattatcactggccatcagagaaatgcaaatcaaaaccacaatgagataccatttcacaccagttagaatggcaatcattaaaaagtcaggaaacaacaggtactggagaggatgtggagaaataggaacacttttacactgttggtgggactgtaaactagttcaaccattgtggaagacagtgtggcgattcctcaaggatctagaactagaaataccatttgacccagccatcccattactgggtatatacccaaaggattataaatcatgctgctataaagacacatgcacatgtatgttgattgcggcactattcacgatagcaaagacttggaaccaacccaaatgtccatcagtgatagactggtttaagaaaaggtggcacatatacaccatggaatactatgcagccataagaaatgatgagttcatgtcctttgtagggacatggatgaagctggaaaccatcattctcagcaaactatcgcaaggacaaaaaaccaaacactgtacgttctcactcttaggtgggaattgaacaatgagaacacttggacacagggtggggaacatcacacaccggggtctgtcgtggcatgggggtaggggggagggatagcgttaggagatacacctaatgtaaatgacaagttaatgggtgcagcataccaacatggcacatgtatacatatgtaacaaagttgcacgttgtgcacatgtaccctagaacttaaaagtataataataataataaaaaaaaaagaaatccaagtggagctatcaagtagataatttgggattcataggagaagtcacctgggatataaaactgggagtcaacaaatggcatttagagccatgaaacagattgaggaagtggaggaaagaaacgaaaaagaagcagttggtgagttaagaggaaactgatagagtcaagagaagagattgttttgaaaaggagagagtaatgaattatgtcaaatgctgctaaaagatcaagtcaaatgaggactgataattgtcattgcatttagcagtgctcacagtcatgacaagaacagtgttggtggagtgttgtaattggagtaatttaagataaaataggaagaaacaaattagagacacatgtaggcaacttttccaaaaagctttgaagtatagagggactgagatatagaattaggagtgctggagtttaatcaaggtaagagattagccagcatagagattttgaagccagagagagcaagaaagttgagagtgtacgtgagaagtgattataaaaatataagattaaaatggatatttcttctgttactgaggttgagcatctttttacatgtttattgggcattcatttttgtgtgtgcgaattgcttgtgcatattcttactgggtggttcatcttatgagtgtttaagaattctctgtaaaataaagatgtcagcctttagtcatatgtgttgcacatatttttcacaatttgtcgtttgtcttttgacttgatttttttctgtgtatagttatgggtttcatttcatgcttataatggccttcttattccaggtttgtaaaaggatttgcctatattttcttcttttttttttttattatactttaagttttagggtacatgtgcacattgtgcaggttagttacatacgtatacatgtgccatgctggtgcgctgcacccactaactcgtcatctagcattaggtatatctcccaatgctatccctcccccctccccccaccccacaacagtccccagagtgtgatattccccttcctgtgtccatgtgctctcattgttcaattcccacctatgagtgagaatatgcggtgtttggttttttgttcttgcgatagtttactgagaatgatgatttccaatttcatccatgtccttacaaaggacatgaactcatcattttttatcgctgcatagtattccatggtgtatatgtgccaccttttcttaatccagtctatcattgttggacatttgggttggctccaagtctttgctatcgtgaatagtgccgcaataaacatacgtgtgcatgtgtctttatagcagcatgatttatagtcctttgggtatatacccagtaatgggatggctgggtcaaatggtatttctagttctagatccctgaggaatcgccacactgtcttccacaatggttgaactagtttacagtcccaccaacagtgtaaaagtgttcctatttctccacatcctctccagcacctgttgtttcctgactttttaatgactgccattctaactggtgtgagatggtatctcatagtggttttgatttgcatttctctgatggctagtgatgatgagcattttttcatgtgttttttggctgcataaatgtcttcttttgagaagtgtctgttcatgtccttcacccactttttgatggggttgtttgtttttttcttgtaaatttgtttgagttcattgtagattctggatattagccctttgtcagatgagtaggttgcaaaaattttctcccattttgtaggttgcctgttcactctgatggtagtttcttttgctgtgcagaagctctttagtttaatgagatcccatttgtcaattttgtcttctgttgccattgcttttggtgttttagacatgaagtccttgcccatgcctatgtcctgaatggtaatgcctaggttttcttctagggtttttatggttttaggtctaaagtttaaatctttaatccatcttgaattgatttttgtataaggtgtaaggaagggatccagtttcagctttctacatatggctagccagttttcccagcaccatttgttaaatagggaatcctttccccattgcttgtttttctcaggtttgtcaaagatcagatagtcgtaggtatgcggcgttatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatgcaggttcttttttggttccatatgaactttaaagtagtttttttccaattctgtgaagaaagtcattggtagcttgatggggatggcattgaatctgtaaattaccttgggcagtatggccattttcgcgatattgattcttcctatccatgagcatggaatgttcttccatttgtttgtatcctcttttatttccttgaccagtggtttgtagttctccttgaagaggtccttcacgtcccttgtaagttggattcctaggtattttattctctttgaagcaattgtgaatgggagttcactcatgatttggctttctgtttgtctgttgttggtgtataagaatgcttgtgatttttgtacattgattttgtatcctgagactttgctgaagttgcttatcagcttaaggagattttgggctgagacaatggggttttctagatatacaatcatgttgtctgcaaacagggacaatttgacttcctcttttcctaattgaataccctttatttccttctcctgcctaattgccctggccagaacttccaacactatgttgaataggagcggtgagagagggcatccctgtcttgtgccagttttcaaagggaatgcttccagtttttgcccattcagtatgatattggctgtgggtctgtcatagatagctcttattattttgaagtacgtcccattaatacctaatttattgagagtttttagcatgaagtgttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgccaggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaaactattgattattgccacaatttcagatcctgttattggtctattcagagattcaacttcttcctggtttagtcttgggagagtgtatgtgtcgaggaatgtatccatctctcctagattttctagtttatttgcatagagctgtttgtagtattctctgatggtagtttgtatttctgtgggatcggtggtgatatcccctttatcattttttattgcgtctatttgattcttctctctttttttattagtcttgctagtggtctatcaattttgttgatcctttcaaaaaaccagctcctggattcattgattttttgaagggttttttgtctctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcgtcccagagattctggtatgttgtgtctttgttctcgttggtttcaaagaatatctttatttctgccttcatttcgttaggtacccagtagtcattcaggagcaggttgttcagtttccatgtagttgagcagctttgagtgagattcttaatcctgagttctagtttgattgcactgtggtctgagagatagtttgttacaatttctgttcttttacatttgctgaggagagctttacttccaagtatgtggtcaattttggaataggtgtggtgtggtgctgaaaaaaatgtatattcttttgatttggggtggagagttctgtagatgtctattaggtctgcttggttcagagctgagttcaattccctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcatatatatttaggatagttagctcttcttgttgaattgatccctttaccattatgtaatggccttctttgtctcttttgatctttattggtttaaaggctgttttatcagagactaggattgcaacccctgccttttttaattttccatttgcttggtagatcttcctccatccttttattttgagcctatgtgtgtctctgcacgtgagatgggtttcctgaatacagcacactgatgggtcttgactctttatccaatttgccagtctgtgtcttttaattggagaatttagtccatttacatttaaagttaatattgttatgtgtgaatttgatcctgtcattatgatgttagcaggtgattttgctcgttagttcatgcagtttcttcctagtctcgatggtctttacattttggcatgattttgcagcggctggtaccggttgttcctttccatgtttagtgcttccttcaggagctcttttagggcaggcctgctggtgacaaaatctctcagcatttgcttgtgtgtaaaggattttatttctccttcacttatgaagcttagtttggctggatatgaaattctgggttgaaaattcttttctttaagaatgttgaatattggcccccactcttctggcttgtagggtttctgccgagagatcagctgttagtctgatgggcttccctttgagggtaacccgacctttctctctggctgcccttaacatttcttccttcatttcaactttggtgaatctgacaattatgtgtcttggagttgctcttcttgaggagtatctttttggcgttctctgtatttcctgaatctgaatgttggcctgccttgctagattggggaagttctcctggataatatcctgcagagtgttttccaacttggttccattctccccatcactttcaggtacaccaatcagatgtagatttggtcttttcacatagtcccatatttcttggaggctttgctcatttctttttattcttttttctctaaacttcccttctcgcttcatttcattcatttcatcttccatcgctgataccctttcttccagttgatcgcattggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcgtcaaagtcattctccatccagctttgttccgttgctggtgaggaactgcgttcctttggaggaggagaggcactctgcgttttagagtttccactttttctgttctgttttttccccatctttgtggttttatctacttttggtctttgatgatggtgatgtacagatgggttttcggtgtggatgtcctttctgtttgttagttttccttcttacagacaggaccctcagctgcaggtctgttggaataccctgccgtgtgaggtgtcagtgtgcccctgctggggggtgcctcccagttaggctgctaaggggtcaggggtcagggacccacttgaggaggcagtctgcccattctcagatctccagctgcgtactgggagaaccactgctctcttcaaagctgtcagacagggacatttaagtctgcagaggttactgctgtctttttgtttgtctgtgccctgtccccagaggtggagcctacagaggcaggcaggcctccttgagctgtggtgggctccacccagttggagcttcctggctgctttgtttacctaatcaagcctgggcaatggcgggcgcccctcccccagcctcgctgccgccttgcagtttgatctcagactgctgtgctagcaaccagcgagactccgtgggcgtaggaccctctgagccaggtgtgggatatagtctcatggtgcgccattttttaagccagtctgaaaagcgcaatattcgggtgggagtgacccgattttccaggtgcgtctgtcacccctttctttgactcggaaagggaactccctgaccccttgcgcttcccaggtgaggcaatgcctcgccctgcttcggcttgcgcacagtgcgcgcacccactggcctgcgcctactgtctggcactccctagtgagatgaacctggtacctcagatggaaatgcagaaatcacccgtcttctgcgtcgctcacgctgggagctgtagactggagctgttcctattcggccatcttggctcctctctgcctatattttcttctaatacttttatggtttcagttttttttctaagttaaagtctttgatttcgtgtgggtttcattttggtgaaagtcttggggtggggatctgatttttttccaaatgatttttattaaataatgcattttccccccactaatttgcaagactcctatttgtttagggtctattttgtattatattcaagtccattgattgcccatccctgtaatagtacaaatctatttccatttctgtagcttcaagataaagtttactctctggtatatctagtttatgttctcctaccaccaccattactattatttttctgaattttcctgagtattttaatgtgtttgttttctcagataataataccaacagtatgtatcaagaatatatgtgcagtattaccaagtgttttgcatatatacctattttcatcattgtgataaccatgtcaggggtatactattaatatttcaatcttggcaatgaggaaactgagacattagaagaatatataacatgctcaaggtgacaaggctagtaagcagtgaagctgtgatttgagccaggcagttaggttccagagaccatgctcctacttctctatataaactgtagacgtgttgatctaagtcatttagatttagaatccaagataccatgtgtagcatttggatcaaaattgcattgaatttatagaaaaatttaggtagaattgacatatttatgacacaaaatcattctattcaaaaccaagatatagcttttcatttattcaaatatttgatgacttttacatagaatgctagttttcttcatgtaggtcctccatgttttattttaagctttttccttcatgtgtttcatttgtgttgctagtaatagaattttttcctctttcgtgtttttagctggttattgttgattattggaaagctgttgatttttttctgttggaaagatattgatttttttcttttaaatttgtaattaaccatttaccaaatgtccttactgctaatagtttttttattgatttttcctgaattttctataaatgttattctgcaaataattttgcttctcctttctaatatttatactttctcttttattctttttaaaaattggtttattcttgtaaatcattgttaactaatgatgaaactaagcatctttatcttacaaatgcctgtcattcataatcatttattatgatactaacttcagttttcttttcatgcaaaagtatcagcaagggaatggtgaatttttttcaaatgcctttctgtatctatagatgtcgtttgtcctttatgttaatatagtaaaagcacatatattttctaatattaagtaatgtttgcttcattcttttaatttaatattttatttaggaccattgcatattttatttaggactgagcgtgtgtgtgtgtgtgtgcgtgcgtgcgcatgtgtgcctgtgtgtgtgtgtgtgcacatgcatgtatatccttcctcagattttaattattatgttgacttcctagaattcagacttttcattttcctctctctttaaaaagttacaaaattatcagtcctttacagatctgaagaaatttacctgtgaaaacacctggcagttttgggtggttaactactatcttcctaaatttattctatgatgtgtctgtctatgtctcttaaataattttccaagttctataatacagtgataattatttacattttcctagaaagggttttcatctaggttttcaaatttatttgcttaggtttggacaaaatatttaaaaagtaagtttcctaaatttctttatagttgtagttaactccatttgcattttaatattgaacattcgtgctgcttaatttttttctctaggattaagtaggctggtaatttatcttttttcttgattctttaaagtttgggcttttggactgatatatcaattacatggcttctctattttttgactaagtactttccgcatttgtatttttgattttgtcttcacacttagatttcgtcatactacctatcttccataagtaacagtttctatgaattaaaaagcatccttttataaatgcagactttacttatgaaggaaatattagttataggtaatttagtgtgaattattttactccaaatactttcctcaacacaaaaaggaatcatcttttttgggactgaatttaatttaatctcttgaggactttgctttttcactgtttcatctatctgtgagttgtacgaacactggctgaaattagctcattgagtggatgggagtttagataaaaggggaaaaggggaaggtaatttgggaggatggctcttgttgggggcagatagatacaggatctgtggaggaagagagaaaggccagaacaagaactgagagagtaacaaagaaatcctacgaatccttagtaactttcatgtaatgagagacaggagaaaataagaactagcattctgtgagcaatgacaaccctttccctgcgtttgcctatcagttttcattctattaatagcatgtatctgaagatattaaaaaccaccaccccttttgcaggggtaaaatttagaatgattgacttttattggagttatgttttaaaatatattttgaaaatataaaaagagtttatgaagattttacctagagaaggatttaaaaatttcacccaaaatttactgaatcattagaattactaaaatctaacatgttcatggtacttggggtactctaaaaccattatgatacctatttttagattatttaaattaaaattagataatatacacattgttcattattatataacattacatttgtatattacattatatccttcattatacagtaaaatatatatagacagtaagctaacattatcagttcggtcaaaagtcagattaacaaaaatttacagtaaatgcttagtatttatagacaagctcctctttcctggagtaatattatatgcagaagttttctctgatcctatgaattaccacatgacctctccattccattttgtgtacctgtttgcctggtctggttatgactgcagttttgttttcattttcctgaattgttgctaacacttaagtatattgacttgtttcttcactgagaaaagaaaaaagtgtggtcccatattcagttcagcaaataattctatacctactatgtagaaggcagtatgccagtgactgtatttaggataaaatgtgtgtgtgtgtgtgtgtgtgtgtgtgtgtgtgtgtgtgtgtgtgagagagagagagagagagagagagagagagatgttattgtagtcccaattgatgttaaagaataatggatggaaacacttggtcagtgtttccaccgatctttgcatcactcagcattcatgcctaaatttgtggtgttctcagaattgtgctaatgtgtaaaatattcttatacttaatatgagtacagtctgttggctctgtagaacacaactcaaagtgtatgtatttttctagttatttcttaaattatgacaatatgcttatctgatatatgtggaaccagtttgttaaaagtagtctgttagtttttaaggattagtcttctaagaaagattttctctttcttttctaacatgcaaatgagtgcatgcttaggggcttgatggcaatgagtgggatatagttaagcacatattaaaggcataacataataagggtgtcctctggaaagaaaagcctttacacaacccaaaataggtaaaaatgtggccttcgcctgtggctttaatcaatacatgccacagttatcgtcggacaagaattgaagccctcaaagttaatcttttccatctttcttccccacttccctaagtttcttcctctacatggccctatcctgctattccaagtcacaataaatgatgatagtgagattctttatgaagcatttaggtgatcttgctttcataccaatgaataaaaaattgagaatgtattggttttggaaccatactcatataagttatctaatgcttttttatgattgtacattacttaagaaacagatatttacatgagactttaattactatagttgatacagtgctgcatgcaatcatgtgctaaaaataatatgtgaaagttcttgtaaagatttattgacctcgcaaataaactagaaaatctggaagaaatggataaattcctggacacatacaccctcccaagtctaaacccagaagaagtcgaatccctgaatagaccaataacaagttctgaaattgaggcagtaattaatagcctcccaataaaaaaaaatgtccaggaccagacggattcacagccgaattctaccagaggtacaaagaggagctggtaccattccttctgaaactattccaaataatagaaaaagagggaatcctcccgaactcattttatgaggccagcatcatcctgataccaaaacctggcagagacacaacaaaaaaggaaaatttcaggccagtatccctgatgaacatcgatgtgaaaatcctcaataaaatactggcaaactaaatctagcaggacatcaaaaagcttatccaccacgatcaaatcagcttcatacctgggatgcaaggctggctgaacatacacaaatcaacaaacgtaatccattgtataaatggaacaaatcacaaaaaccacattattatctcaatagatgcagaaaaagcctttgataaaattcaacaccccttcatgctagaaactctccacgagctctaggtattgatggaatgtatctcaaaataataaaagctatttatgacaaacccacagccaatatcttactgaatgggtgaaaactgcaagcattccctttgaaaactagcacaagacaaagatgccctctctcaccactcctattcaacatagtgttggaatttctggccagggcagagacttggcatgcaagagaaagaaataaagggtattcaaataggaagagaggaagtcagattgtctctgtttgcagatgacatgattgtatatttagaaaacccctttgtctcagccccaaatctccttaagctgataaacaacttcagcaaagtctcaggatacaaaatcaatgtgcaaaaatcacaagcattcctatacaccaataacagagaaccaaatcatgagtgaactcccattcacaattactattaaaagaataaagtacctaggaatacagcttacaagggatgtgaaggacctcttcaaggagaactacaaaccacttctcaaggaaataagagaggacacaacaaatggaaaaacattccatgctcatggataagaagaatcacaatatagtgaaaatggccatactgccgaaagtaatttatagattcaatactgtccccatcaagctaccactgactttcttcacagaattggaaaaatctactttaaacatcatgtggaaccaaaaaagagcccacatagccaagacaatcctgggcaagaagaacaaagctggaggcatcacactacctgacttcaaactatactacctggctacagtaaccaaaacagcatggtactggtatcaaaatagatatatagaccaatggaacagaacagaggcctcagaaataacaccacacatctacaaccatctgatctttgacaaacctgacacaaacaagaaatggggaaaagattccctgtttaataaatggtgttgggaaaactggctagccatatgcagaaaactgaaactggaccccttccttacactttatacaaaaatcaactcaagacggatcaaagactgaaacgtaagacctaaaaccatgaaaaccctagaagaaaacctgagtaatccattcaggtcataggcatgggcaaagacttcatatctaaaacaccaaaagcaatggcaacagaagccaaaattgacaaatgggatctaattaaactaaagagcttctgcacagcaaaagaaactatcatcagagtgaataggcaacctacagaatgggagaaaatttttgcaatctatccatctgacaaagggctaatatccagaatctacaaagaacttcaacaaatttacaagaaaaaaacaaccccatcaaaaagtgggcaaaggatatgaacagacacttctcaaaagaagacatttatgcagccagcagacatatgaaaaaatgctcatcatcactggtcattaggagaaatgcaaatcaaaaccacaatgagataccatctcacaccagttagaatggtggtcattaaaaagtcaggaaacaacaggtgctggagaggatgtggagaaataggaacacttttacactgttgtgggtgtgtaaattagttcaaccattgtggaagacaatgtggcgattcctcaaggatctagaactacaaataccatttgacccagccatcccattactcggtatatacccaaaggattataaatcatgctgctataaagacacatgcacacgtatgtttattgcagcactatttacaatagcaaagacttggaaccaacccaaatgtccatcaataatagactggataaagaaaatgtggcacatatgcaccatgaaatactatgcagccctaaaacaggatgagttcctctcctttgcagggacatggatgaagccagaaaccatcattctcagcaaactatcacaagaacagaaaaccaaacaccgcatgttctcactcatgggtgggagttgaacaataagaacacatggacataggaagggcagcatcacacaccagggcctgttggcggggtgggggtctaggggagaatagcattagaagaaatacctaatgtaggtgatgggttgatggagcagcacatcaccaaggcatgtgtatacctatgtaacctgcacgttctgcgatgtaccccagaacttaaagtataataataaaaagatttgactataaggatgatattatgctgtaatacactgttcaaatattatgagattctaatggttaaaattgtttagtcattagaaaatatctgcagtggtaaattgttaagtatggaatttcagtaccccaaaataagtatacacacaaaagtttaagaatatttttcatcagtgtaacgattttcagtcaggagcctttgcacataatgaagtatgtaggctgtggaatctagccaacctggctttcactcttcaacttagtagctacataacctcagacaggctacttaggtactctgtttttctttgtctgtcagagggatatataataatacctacttcttaggagctgctgtaaagatttaccaagctaatagtagtagcagaaaacacttctctagtccttactgtgtaccagacactgatctaagcacaatacatttaaaaatcattatatcttcacaaccactgtatgcagtggttactgctgtgtctggcattaaatattagcaaataataccaacaactaccaccatcaagaagtcaacatgtctttacattctgatgacaataagtatgcattgaaaatgttaccatcttctattgaagtttaaattcatattatctaaagtcatgtttaaagatttttaaaactgtttaccatattttttacccttgctttcttcatattttaattaaaatcagaatcaagatgtgatgatcacctatgattgttattttcagataaactatactatattttcagccacaggttaaacagttcaggggtatagagatcattggacagaacatttagataactgaagccctcattggctactagaatttatcaagggcctgcattactctgtatgcttttggtggtgggccattttttaaataagctgtgtagatccacaaacaaaatgatagattcagaaatacaagtaagcttgactattaatttaagtttcagtcattaatatcagcagttttcactgttttttttctctcagctaagtgacagaagcaaaagacagtaaaaatcttggaaaatagttatcggtctttttttccatctcagcagataaaatacattgattttttggatttttcccattttatgacacatatcaaacatgctctgggaaaattcacaagatagttataaaatatatacaatctctgtgttttggatttatgacataatctatcttacaatggcagcttatacaggggacaggaaggagttctgctagagtcccagaaagtgataggcagtctttaagagtgctttgagctatggttgacttgggcagaatagaacacccagtatctctggttaaaaagaactcagtaaaaaaatatgaaccatgcaagcaagcatttgaaccagaatgcatatatgtcttaaagcctaatttgggggaagttttcaagcccaaaatactctagatataaatgtgttaaatgtgcaatccaaggtcaaccagagaacctacagctaacaaaattgataatataatgctaggctgcaatattgcatcattaaaaggtaagaatggcatcagcataaaaccatggccaactcaagataccaaagatgtccagaagcctcccttcgcaaaacagcaggaatgtcagctatctaggcatgcagtttcactggtcaagcatatttgagagccttgcagtgagccagaccttacatgatagccagatcttagtggagtatagaattgattaatcctcagcaaatacttaccatgttctaattttagcttgtcatatataaatgccaacttaaaatgactttatcaagtaggttgctaataagtactgaaagtaaaaatgaaagttaatagcattgtgcatcatttgccagtaagcatctccattccgtgtgtgtgtgtgtgtgtgtgtgttgtgtgtgtgtgtgtgtgtgtgtgtgtatttgcctcttactatgagttaaaggcccatcaggaaactcttacagtcaggaaacttaagcttatagtcagctgtgaaacagccttttaaaaatcattccccttacccacacacggacttcactctgcttgtagtgtggctgctcatagtgtggctgtttttccatcttgacacgtattttctcattactatattaaagtgacttttttctttattgtattgatatactgaatagacctcctcagataatatttatggaaacataaaaccattctggaaggcagtttaacagtatctacttcataagtcttcccttttactctaaagtttcacccctactaatctgataagtatatataaggaatggccaaaattatacatatttacaagaaaaattatggcattgttgctagtgcttaacacaggcaaaaaaattatcaatagatcataggttgaagtatatctgtatgatagaatgctgtgtagctatccagagggaaataagaaagctttatgtatatagatgccccttgacttatgaattatgatggtgttatgtcctgataaattcatcgtaagttgaaaatactgtgaaatcgaaaatgcatttaatatacttaacctatcaaacatcatagctgagcttagcctgccttaaatatgcctgcaacacttatagcttacagttgggcaaatcataacatgaagcctatgttttaatatgatgttgaatatctcttgtcatttattgaatactgtaccaagggtgaaaaacagaatggtgttgcaccatcataaagtcaaaacattgtaaatcaagccataattagtcagggactgtctgtactgacatagaaaggcttccaagacatgttataaagtggcataatataagtggcaaagcagtatgatgtgatcatgtgtattttgaattatatatacacacatttgtatataggtgatgctggatttatattaaatataagataaggtgaggtttgtgttacaactaagtaagaaaagtatataaaatgagttacatcatgcctacttagtgcattgaaataattaataaaatttgccattatttttatctttatggagtggattgaggaaggaaaaatagggctgcctttactaactttacatgttttgcattgactgattttacatgcattacttttataataaaataagagagaaaaccatttactcttgggaaaagatctggaaaagcatattcatactaaaatattaatggcataacaaaacttgacgtttttcttctgacacaagatattgaagaactcctaatatgtgagcacagtggtgacctctggtactcttttggacaagagtcttcctaaagtctataaaagctgttttggagttttggttatttgttttcacctttaaatatctacccatattttcaattgtatttcttccttcgtgttctcaggagtgtgtgtgtgtgtgtgtgtgtgtgtgtgtgtgtgtgtgtgtgtgtgtagagggatatgtatacatattatttaagcatttaggtgattatttttcaagaattgttggaaaatttaaggaagcagtggaaagaataactgatagtaattactgcctagttatctaaataaagtgaagcttctttttctcccttcttccgaatcttttcttagcaaataagaatcaccctgaaagtagtttaaaagagatattctagtgaccatacccaatgaagtactaaatattcatcctgttagagtgattattgcaaggactctaaaggaaaacattgattatactagattatttattttatagaattttattctcagcttatactcctggttctatgaactatagaaatcactcagaataataaaatgctgatgttatattttattgaaattcattaaaaattatagaaaaaggtgctcatttgaaaacttccaaatgtcagttattcagaatgacaaacttaattatatagaaattgactaatttggttgattctttctaaagtcagtgttggattaataatgtaatgcatggatcattaacagcttaaaaatacttgtggtaaacttgatgatgtaatgctattttgttaggaaagatggcctcttttcttaagttgcaatcctttaaggattcaaagccctaattgtacataagcaatatcgtatgctgtaggctcgttatcattggaggggaggtttaatatagagtttaagagcacaaaatatggaatcagactgttgctgttaaaatcctggctctgccacttcctagctgtgatcttagacaagttactctctctctgccttgattttcttacatataaaacaaggatataagtagtaagtggtagaactcttatttcataaggctgttataagattgttgtaagaatttaatgggttagtatttataaagcaggtctatatatagtaagtattcaataagggtagctactatttgtcattttggtcatgtaatatctagtgttacatatgtgtgttgtcaaataaattagttgttaacattatttaaaagaaaacattgaattacaatctgttttaagcatcttttttatttttctgagatgtaaaaactgattgttttactagttggttttgattatttgtttcttgtttgtattacagttacaaattataatactgtggtagaaacaaattcagattcagatgatgaagacaaactgcatattgtggaagaagaaagtgttacagatgcagctgactgtgaaggtgtaccagaggatgacctgccaacagaccagacagtgttaccagggaggagcagtgaaagagaagggaatgctaagaactgctgggaggatgacagtaagtctgatttttttttgtaatattgtattctcatgattcgttttttaaaatatatattaactgaaaagataaattggatgaaaagtttgaaatcaatagtaaatttggctatcaataaatattaggtgtcctacttactaaaaagtggattatgaagcagaataagcaagttattttgaccatatttacaatgcatataatgtattgaaatttagtagaatttattaaccaggatcaagctttccaaatattgttgatataattgaacctacctttaattttttattgtaaccccgaatgaatactctacttagaaaccaataaatatcatatagatatagtgaaattataattcaatatgcaaaaatcccaaacacatataaatcatggaggtatttttagtgcttgtaaacctctctatacatacatcagaatcctttaagtaaggtggttttttcactttaaatttttacttttactcaaagtatggctgagtggaaggagcggtgaaagtaaggagaccctctacttgctgcactttcagtgagtaaacactgaaagtttaatcttcttcctcatctgtcaaatggagaaattggacctagtcttttattctagctctaaaatttcttctttctacttttcctaataaactaattaaattatttagcctgtcttgccaggttaagcaccaatgatataaaaatgggatatggaagtggcatagtattaattagagaggttggggatcaggaacaagggcatcagaaaaggtaaacaagtacacgcaataaatcgaatccaagaccagtcaaaggagaagcttcccagcaagaattcaagttcaaagaggtcgtctagacaagatatcaaaactaaaatctggaaaagtgggtcaggcatgcaggtcaggatattatctggataatgaaatatggaagtgtagataaaagctcagataataggcacagattggcagaagttaagatttctacaatatgacaaatctaatggttaacaagggacttttgaaataatgtaatcagccctctcattttatagtgttgttcatttgtccattcagcaacctctgtagaaattggttgcaactgtggataagactctctgcatgaatgatgtttatatggcttaatggagaagagagataaataagtcacaaatacattatagttttatttaggtatacattatatggcagcatcaaggaggagcatccgaattagagaaggaaggagaagtcgtagaagagttctgagtgaaacagagtggtctttagttcttaaggaccgatggaggttaattagacaaagtacagtgaatataaggttttcaggcaaaagaggcaacatacatgaagccacagaggcttgagcaaagtgttcacagaaaatgagatcagagaagtaaacaagggaaaaaatatgaagtgatttgtgtactatgtcaaggaatttgaaccttatcatggaagctatgagaagaacatcattaaaataatttataaataagtctggtgtaatatggaaaaagaattttagagggagggaggctgaggtagtgtcttcaacgagacggctgtaataatcaggcagtgttaagggtttttgagttaaagtagttgcccatgggatgggaatagaagggagataattgaaagacagaaaggagatagaatatataagaattggaaagggctgtttttagatacagtcccaggtttctagaaagtgagactcagagaagttgacttgctcacttatggcagctggttaattgtagagctatgaacctgttaatgttaatactaagctcaaacatttttggagcaagggtttcttatgtatttcttatctgtggcctgaattacgtagttgatccagagtcttaataggtaatcaagaaggaaatgatctgtctggggaaaaaagggggcaataagaataaggtagatgaagggagaaaggaaggtgaaaaaatcagtgaacaggttctgcttctgagaatatgttgggttcgattatttgaactaaccctttttactgaaaacaactaatggtgctagattaaaaacaaaaacaaaaaacttcttagcacttctaaagagctaagtaagacactaccttgtcaaaatctaagtgaaaaaaggaacccatagaagtaaacagagcagatcatagaagacactttggtcctgaatacatttgcctagccagtgaaatgtaaggtgattttcaggcttctgagaggaaacaaagcccaagaccaccaaagatagtttaatagcagtatggattatgtctcgactgtgaggatgaactaaaagcaaaccattttccatctctaccatccttgagagtgaacaagcaaagtttccctggttaggtattcagggaatggaggattgtctttgagaagtagtaaccacaagctgtctcgcactgatttgaagtccaagtttacattgctgtgtagcctgaaaaatctcaagccatatttgagtttaaagtggaactgctacaaatatctattggcaccaggcagaagtaaacacaagtcttttggagaaatataccttcatcctagtactatagaagtctcccaaataatttagcaagaaggtagaaacatgagtgagaattaccagaaacaaaaggaagcagaaactgacccataaaggctaattactagagttacgtcatacagatttataaaatgactactgtcttgtttaaagaaaaatcagatggttatctgctatgatatgataaaataaaaccagtgtgttttaagaataatctaatagaactaaaaataaaaaattgaatagtaggaatttgaaattcagaggatacatttaacaacaaattaaacagggttaaagaaaaattaataatttggaagatagagaaaaattacactaaatggaactcagagagacacatagaaaaaatatgaaaaacaggtgcctgtagtcccagctactcgggaggctgaggcaggagaatggcgtgaacccgggaggcagagcttgcagtgagccgagatgatgccactgcactccagcctgggcgacagagtaagactctatctcagaaaaaaaagaaaaaagaaaagatatgaaaaacaggttaagatacatgaagattcaatacatcttatgccaggagaaaagatactagggcagcagccatacttgaagaaataatggctgaggtttttatttataatcagtgaaaaacaccatactacagattcaaaaagcccaaatggacattcagatctgtaaagatcaaagaagtccaatagattgaacataaaaagatcttcactaaggcacattacaatcaaattatgaaaagtcaacgacagttttgaaagcagcaaaagaaaagttgcagactccataagactgtaggcagatttctgtgcagaaacctgtcaagcaaggagaaagtgggatgatatattcaaagtgccaaaagaaaaacactgctgaccaagcatactatacccagcaaagttatacttcagaaatgaagaagaaatactttcccaaaaacaaaagctgagggattttgtcactgttaaacctgcttcgtaagaaaaactgaaggcagtttttcaagttgaaacaaaagaacactaattagcaacatgaaaacatgaaagaataaaactcactagtaaagaagttccaaactataaatactattctatatagtgagaaagaatgaataagacctactatttgatagcacaatagggtgactgcagtcaataataacttaattttacattttaaaataaaagagtataattggattgtttgtaactcaaaggataaatacctgaggggacagttaaaaaagaaataaattcagaatgctgtgatactataatgatgttgtgtaaatgtcttgtaactctaatataaaaataaaaaacaaggtattaaaatatagctacaataatttttaatagatatacaatatacaagtatgtaaattgtggtataaattaacacagaatgtgggaggggagaggtaaaagtgtagtttttatatgtgatggaaattaagttcttatcagtttaaaatagattgttatgactataaaatggtttttgtaagccttttggataattaaaagaaaaaaactgtgttagatacacaaaagataaaccatgcgattgcaaaaaatatatatatatatataaaatatcaatggaagcagcaaagaaacaaaggcacttaaaacttttcagaaaacaataaaatggcagtagtttttacttatcaataattactttaaatgcaaatggattaaactcagtaatcaaaatacattgttactatgcatgtttttaatacagagatagggccttgctgtgtcaccagggtagagtgcagtgatgcagtcacagcccactgtaacttcaacctcctggactcaagcagtcttcttgctttagtctcctaagtagctaggactacaggcatatgccaccacatgtggctaatttaaaaaaaaaaaaaactttcatggaaagatggggtcttgctatgttgctcaggctttaaatgcattttttaaaactgacccaactacaagctgcctacaggagacttattttacctttaaagatacagataagatgaaagaggaaggttggaaaaatatgttccatgtaagtggaaccaaaagagagcagtggtggccatttttacaccaggcaaaataaattttaagtaaaaaattgtcacaagaggcaatgaaggtcattgtataatgataaagaggtcaatttatcaagatgatacaattctaaatatatttgccaccaattttggagcacataaatatgtaaagaaaaaatataactgaagggagaaatagatagcagtacagtaatcataggggtcttcagtgctttcaataatggagaaatcatctagacagaaaatcaataaagaaacagtggatttgaacaacactagacaaaatggacctgatatacagaacattccattcaacagtagcagaatatgcacatttttctcactcaaacatgtaacattctccaggacagattatttgttaggccacaagataagttttaacaaatttaaaattaaaattatatcaagtatgttttctgtcaacagtggcatgaaaccataaatccgtaacaggaggaaaattggaaaattcacaaatatgtggaaattaagcaacacactcctgaacaaccaaaggtcaaagaagaaatgaaaggggaagtaaaaaatatcttgaaacaaacaaaaatggaaacataacataccaaaacatggaatgcagcaaaagcagttctaaaagagaattttatagcaataaatgcctacattaagaataaggaatgatcttaaataaacaacttaatattggacctcatggaactagaaaaataagaacaaagtaaaaccaaagttagaagaaggaatgaaataataaagattagagcacaaataaatgaaataaagagtagaaaaacaatacaaaagatcaacaaaactgagttagttttttgagaagataaaatcaacaaacatttagctagaatttaaaaaaggagggaatatccaaatagaataataaatgaaaaatgaggagagggattaaagatggccaactagctggatctgggatgcacctcttctacagagaggaaccaaaatattgagtaaaccctcacactttcaacagatcttttgagagaaaacactgaaatttaatatataggccatgacagacatgattgaagaagtaggaagcaacactgctggctcagtattgccagacaccttaggaccagaatggacccaaggaaggtgtgagtgaagaaacccgggaacaccactttcccactgtcaacctctgaaattctagaggagttcccacaacccctgaatacgtttggattggtaggaggagctgcctggagaccatacagaggcactacttgaagccacaaggagcccaaaagccttcagtgtgctaggcagctgcagcaaaacgtgactctgggcacccacccccgagtgccctgcatccgagcggctacatctgctgtctgccacaccaggatagagtggggcccatgcatgttcacatgaccaattcaggatccaccaccattcctgcaggactgaggtgaatctaaaccacacacgaccatgcctgccagtccctcctaagattgcctgcctggccattgctgtggagtgggacccacagcatagcctccattgccccacctgagtggtttattggctacctgggaacactttactcctcctatcactgccagtggttgatcctaaggagccagaggacaaatccactggcctggtctcagtttgccaggactcaagcataccacccaggaatatggggatgagatctgtggcctgatctcaagcaggggaggaacccccactgtcagaacacagggaagagtgtggtgtgggtttttcaggtgatacagaagctgggcacccctcccttcatgagaatagactaggaagggtatagcctcatagccttgctttctgctgcagggagtcttgcattctggaatgcctgggatggcatggcagtctgggcacaggtggtttgggatttgcataactaattgggccggctgccagggtggacactggagggagacccaccagtcaggggtgtagaagctgagtgggcctcatggccatctgctggaatgaaatcccagggctagccctcttaccctgaaccagctcttgtggcacagaagaggtgcctgcacccctccctagagtgttgttccagctgcctgagaactgcccctacagccctaccaaggtcacgtctgcctcagagagcctgatcacgggctcaccagacccagtcccacccagctttgccccctctagccagccttgggagcagagcatgggatgggaccactgagagctccacaccccccacccatcaccaagaacactcttgtattccttatcaacaaaggccaagtaaaaatcccactgtcatcactgcagctgcctctcacctgccagcatcacctactggccaggaggtcaaaactgcatgtcctgtcgcagcaactgttgatatcattgcacagcactcagacagctcttacctgcaggcatcacctgctggcctgtagggtgaactgcacaacccaatataattcctgctgacaagtacacagctctaaggaatgaggtaagtttcccccaaaagacctccaactttgcatctctataggagacagtgagccttaccacatatacagcataccactactacaaactacaaacaattaacatttgagaaaacaactacactaaggctatctgtaaccaaggaatttatacagagccttggccccctaaaagcacgtagaagcaaagccaaaggacacaacccaacatatgcaagagtcacaccctcaaggggcaacgaaaaataatcccacccaaatgaagataaatccaaaaataataagtgccagcttctacacatgagaaggaaccagcacaagagctccaacaccaggaagaaatagaatgttgtgacacccctaaaggaccacattagctctctagcaatgaatcttaatgaaaatgaaaactttgaaatgacagataaagaatttaagatatggactgttaagaagcctagtgagatacaagagaaagttgaaaaccaaagcaactagagaaacaatctaagagatgaaagacaacatagatatattttttaaaaaacaaatggaatatctgaaaatgataaatttgctgaaggaacttcaaaacactgttgaaagccttaacaatagactagacaaaccagaagaaagatttcagagcttgacgactagtctttcaaattaacccaatcagaaaatggccgaataggaacagctccggtctacagctcccagcgtgagcgacgcagaagacgggtgatttctgcatttccatctgaggtaccgggttcatctcactagggagtgccagagagtgggcacaggtcagtgggtgcgcgcaccatgcgtgagccgaagcagggtgaggcattgcctcactcgggaagcgcaaggggtcagggagttccctttcctagtcaaagaaaggggtgacagacggcacctggaaaatcgggtcactcccacccgaatattgcgcttttctgacgggcttaaaaaacggcacaccacgagattatatcccgcacctggctcagagggtcctacgcccacggagtctcgctgattgctagcacagcagtctgagatcaaactgcaaggcagcagcgaggctgggggaggggcgcccgccattgcccaggcttccttaggtaaacaaagcagcccagaagctggaactgggtgaagcccaccacagctcaaggaggcctgcctgcctctgtaggctccacctctgggggcagggcacagacaaacaaaaagacagcagtaacctctgcagacttaaatgtccctgtctgacagctttgaagagagcagtggttctcccagtacgcagctggagatctgagaacgggtagactgcctcctcaagtgggtccctgacccctaacccccgagcagcctaactgggaggcaccccccagcaggggcacactgacacctcacacggcagggtactccaacagacctacagctgagggtcctgtctgttagaaggaaaactaacaaacagaaaggacatccacaccaaaaacccatctgtacatcaccatcatcaaagaccaaaagtagataaaaccacaaagatggggaaaaaacagaacagaaaaagtggaaactctaaaaagcagagcgcctctcctcctccaaaggaacgcaattcctcaccagcaatggaacaaagctggacggagaacgactttgacgagctgagagaagaaggcttcagacgatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaatgcagaagcctcaggagccaatgcgatcaactggaagaaagggtatcagcgatggaagatgaaatgaatgaaatgaagcgagaagggaagtttagagaaaaaagaataaaaagaaatgagcaaagcctccaagaaatatgggactatgtgaaaagaccaaatctacatctgattggtgtacctgaaagtgatggggagaatggaaccaagttggaaaacactctgcaggatattatccaggagaacttccccaatctagcaaggcaggccaacattcagattcaggaaatacagagaatgccacaaagatactcctcgagaagagcaactccaagacacataattgtcagattcaccaaagttgaaatgaaggaaaaaatgttaagggcagccagagagaaaggtcaggttaccctcaaagggaagcccatcagactaacagcggatctctcggcagaaaccctacaagccagaagagagtgggggccaatattcaacattcttaaagaaaagaattttcaacccagaatttcatatccagccaaactaagcttcataagtgaaggagaaataaaatcctttacacacaagcaaatgctgagagattttgtcaccagcaggcctgccctaaaagagctcctgaaggaagcactaaacatggaaaggaacaaccggtaccagccgctgcaaaatcatgccaaaatgtaaagaccatcgagactaggaagaaactgcatgaactaacgagcaaaatcacctgctaacatcataatgacaggatcaaattcacacataacaatattaactttaaatgtaaatggactaaattctccaattaaaagacacagactggcaaattggataaagagtcaagacccatcagtgtgctgtattcaggaaacccatctcacgtgcagagacacacataggctcaaaataaaaggatggaggaagatctaccaagcaaatggaaaattaaaaaaggcaggggttgcaatcctagtctctgataaaacagaccttaaaccaataaagatcaaaagagacgaaggccattacataatggtaaagggatcaattcaacaagaagagctaactatcctaaatatatatgcacccaatacaggagcacccagattcataaagcaagtcctgagtgacctacaaagagacttagactcccacacattaataatgggagactttaacaccccactgtcaacattagacagatcaacgagacagaaggtcaacaaggatacccaggaattgaactcagctctgcaccaagcagacctaatagacatctacagaactctccaccccaaatcaacagaatatacatttttttcagcaccacaccacacctattccaaaattgaccacatacttggaagtaaagctctcctcagcaaatgtaaaagaacagaaattgtaacaaactatctctcagaccacagtgcaatcaaactagaactcaggattaagaatctcactcaaaaccactcaactacatggaaactgaacaacctgctcctgaatgactactgggtacctaacgaaatgaaggcagaaataaagatgttctttgaaaccaacgagaacaaagacacaacataccagaatctctgggacacattcaaagcagtgtgtagagggaaatttatagcactaaatgcccacaagagaaagcaggaaagacccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaattaattaatcccagagctggttttttgaaagggtcaagaaaatagatagaccactagcaagactaataaaaaaagagagaagaatcaaatagatgcaataaaaaatgataaaggggatatcaccaccgatcccacagaaatacaaactaccatcagagaatactacaaatacctctatgcaaataaagtagaaaatctagaagaaatggatacattcctcgacacatacactctcccaagactaaaccaggaagaagttgaatctctgaatagaccaataacaggatctgaaattgtggcaataatcaatagtttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcattctgataccaaagcctggcagagacacaaccaaaaaagagaattttagaccaatatccttgatgaacattgatgcaaaaatcctcagtaaaatactggcaaaccgaatccagcagcacatcaaaaagcttatccaccatgatcaagtgggcttcatccctgggatgcaaggctggttcaatatacccaaatcaataaatgtaatccagcatataaacagagccaaagacaaaaaccacatgattatctcaatagatgcagaaaaggcctttgacaaaattcaacaacccttcatgctaaaaactctcaataaattaggtattgatgggacgtatttcaaaataataagagctatctatgacagacccacagccaatatcatactgaatgggcaaaaactggaagcattccctttgaaaactggcacaagacagggatgccctctctcaccactcctattcaacatagtgttggaatttctggccagggcaattaggcaggagaaggaaataaagggtattcaattaggaaaagaggaagtcaaattgtccctgtttgcagacgacatgattgtatatctagaaaaccccattgtctcagcccaaaatctccttaagctgataagcaacttcagcaaagtctcaggatacaaaatcaatgtacaaaaatcacaagcattcttatacaccagtaacagacaaacagagagccaaatcatgagtgaactcccattcacaattgcttcaaacagaataaaatacctaggaatccaacttacaagggacgtgaaggacctcttcaaggagaactacaaaccactggtcaaggaaataaaagaggatacaaacaaatggaagaacattccatgctcatggctaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcctgcatcgccaagtcaatcctaagccaaaagaacaaagctggaggcatcacactacctgacttcaaactatactacaaggctacagtaaccaaaacagcatggtactggtaccaaaacagagatatagatcaatggaactgaacagagccctcagaaataacgccgcatatctacaactatctgatctttgacaaacctgagaaaaacaagcaatggggaaaggattccctatttaataaatggttctgggaaaaccggctagccatatgtacaaagctgaaactggatcccttccttacaccttatacaaaaatcaattcaagatggattaaagatttaaatgttaaacctaaaaccgtaaaaaccctagaagaaaacctaggcaataacattcaggacataggcacgggcaaggacttcatgtctaaaacaccaaaagcaatggcaacaaaagccaaaattgacaaatgggatctaattaaactaaagagcttctgtacagcaaaggaaactaccatcagagtgaacaggcaacctacaaaatgggagaaaatttttgcaacctactcatctgacaaagggctaatatccagaatctacaatgaactccaacaaatttacaagaaaaaaacaaacagccccatcaaaaagtgggcaaaggacatgaacagacacttctcgaaagaagacatttatgcagccaaaaaacacatgaaaaaatgctcatcatcactggccatcagagaaaggcaaatcaaaaccacaatgagataccatctcacaccagttagaatggcaatcattaaaaagtcaggaaacaacaggtactggagaggatgtggagaaataggaacacttttacactgttggtgggactgtaaactagttcaaccattgtggaagtcagtgcggcgattcctcagggatctagaactagaaataccatttgacccagctatcccattactgggtatatacccaaaggactataaatcatgctgctataaagacacatgcacacgtatgtttattgaggcactattcacaatagcaaagacttggaaccaacccaaatgtccaacaatgatagactggattaagaaaaggtggcacatatacaccatgaaatactatgcagccataaaaaaggatgagttcatgtcctttgtagggacatggatgaaattggaaatcatcattctcagtaaactatcgcaagaacaaaaaatcaaacaccgcatattctcactcataggtgggaattgaacaatgagatcacatggacacaggaaggggaacatcacactctggggactgttgtggggtggggcgggggggagggatagcattgggagatatacctaatgctagatgacgagttagtgggtgcagtgcaccagcgtggcacatgtatacatatgtaactaacctgcacaatgtgcacatgtaccctaaaacttaaagtataataataaaagaaaaaaaaaaacaaattaacccaatcagacaaaaaataagttttgtaaatgaacaaagtcttcaagaaatacaggattatgtaaagctaccaaaactgtgacttacaggcattcttgatggagaagaggaaaaagtagaaagcttggaaaaatatttgaggggataatttaggaaaatcacccaatcttctagagatgtagacatcaagatacaagaaattcagagagcacctgaaaaatactgtacaacattaacatgaccaaggcatatagtcattaggctattcaaagtcaatatgaaagaaaaatcttaaaggcagctagagacaagtgtcaaatcacctatgaaggaagctcatcaacctaatggtagacatctcagcagcaaccttgtaaaacataagagattagaggcctatttttaaccaccttgaaaaaatgtcagacatgaattttatatcctgccaaactaagcttcataattgaaggagaaatagtctttcccagataagcacacatagagagaattcatcaccactacaccatcttacaagaaatgctcaaaggagttctgaacatggcaatgaaaggataatactcaccatcatataaagcacaggtaagtagaaacctcaaagatccaataaagcagttacacaactgagactccaaggcacctagctaacaaaactatgatgggaaaaaaacacacatattaatattaaccttgaacataaaaggcctaaatattccatttaaaaaataaacactagcaaattggataaaagaagcaggacttaaccatctgctgcctaccagagacccacctaatggcaaaagacaactacagactcaaagtaaagggactagcagaagaagagaaataacaaagagcagaaccaaatgagattgagaccaaaaaaaaatgatgaaaaggatcaacataatgaagagtttgttctttgaatggataaacaaaattggtagaccactaactagtttaatgaagaaaaaagagagaaaattcaagtaagcacaatcagaaatgataaaggtgacagtattgctgatacaacagaaatacaaaagctcatcaggggttactatgagcatctctatgtgcacaaactagataacctagaagaaatatgtgaattcctggaacacacaacttcctgagattgaatcaggaagaaatagaaatcctgaacagacaaattatgagtaaggaaattgaatcaatagtaaaaaaaaaccttccaacaacaaaaaagcccaggaccagagagatttacaggacagttttgccttatctacaaaggagagcaggtaccagtcttacagaaactattccaaaataccaaggcaggaaggatacctccctaactctttctgtgatacttgttatctccctgatgaatataaatgtaacaatcctcaacaaaattctagcaaaccagatttatcgcacatcaaaaacaaaatgtatcacaatcaagtgtgttttatttcagggatgcaaagatggttcaacatttgcaagtcagtaaatgtgattcaccatatatgcagaattaaaaagaaaaacgatatgatcatgtcaatcaatagatgcagaagaggctgttggtaaaattcaatgtcacttcatgttaaaaaccctcaaaaactaggcattgaaggaacgtacctaaaaatagtaagaatcatatatgacaaagtcacagccaacatcatattgaatggggaaacgttgaaagcattcaccctaagaactggaacaagacaaggatgcctactcacaccacttctattcaacatagtactggaagtcctagacagaacagttgggcaagagaaagaaacaaaaggcatccagattggaaaagaggaaatcaaattatctctggtcactgatgacatgcccccatacctagaaaatcctaaagactcctagacttgataaacaacttcagtaaagttttaggatatagaatgaatgtacataaaccagtagcatttctgtatactgttactgaatctgagaaccaaatcacgaactctatcccatttacagtagtcacacacaaaaataaaataactaggaatacattgaaccaaagaggtgaaagttctctacaggaagattacacaaatggaaaaatatctcgtgctcatggattggaagactcaatattgttaaaaatgaccacaatgcccaaaggaatctgcagattcaaagcaatccctaattaccaatgtcattcttcacagaattagaaaaaacaatcctgaagttcatatggaccaaaaaaagagcctgaatagccaaagcaatcttaagcaaaaagaacaaagccagagacatcagattacctaacttcagattatactacaaggctgaacagcatgttactgatatcgtgataccatgataaagatggacacatagatcagaggaatagaacaaagaactcataaataaagtgacatacctacaaccaactgactttcagcagattcaacaaaaataaacaatggggaaaggacatcctattcagtaagtggtgctgggaaattggccaaccacatgcagaaaaatgaaactggacctctgtgtctcatcatattaaaaaattaactcaagatggattaaagacccataaatgtaagatgtgaaacttaaaatcctgaaagaaaacctaggaaaaactattctggacattggcttaggcaaagaatttatgactaagaccccaaaagaaaataaaacaagaacaaaagtacacaggtgggacttaattaaaccaaaaagcctgttcacagcaaaagaaataacagagtaagcagacaacctacagaatgagagaaaacatttgcaagtcatacctccgacaaagaactaatatccagaatctacaatgaacccaaataactcagcaagagaaaaacaaccccattaaatattggtcaaaggacatggacagacatttcttaaaagaagacataaagttgccaacaaacattttaaaaatgcttaatatcactaatcatcagagaagtgcaaattgaagccacaatgagatattatcttataccagtcagaatggctatgattaaaagtcagaaaacaacagatgttggcatggatgcagagagaagggtattcttatacactgttggtgggaatgcaaattagtacaaccgctatggaaaacagtttggagattcctgaaaaaactaaaaatggaattaccattcaattcagcaatgccactactgggcttctacccaaaggaaaagaaatcattatataagaaagacacctttatgtatgtttatcgcagaactactcacaatagcagagtcatggaatcaacctaagtgtatatcagtggataattggataaagaaaatgtggtccatatataccatgaaatactatgcagtcataaaaacaaatgaaattatgtcctttttagaagtttctacatggatggagctggaggccattatactaagtgaaataactcagtaacagaaaagcgaatactgcacattctcacttgtaagtgggagctaaacagtggttacatatagatgcaaagatgtaaatatcagacgttggagactccaaaaagggggaaggtaaaaggggaattcggatttttataattcgaatttacaattttacaattgggtacagcttgttcactgtttggattatgggtacattagaagcccaaacctcactattatgtaatatatctatgtgataaacctgcacatgtgccccccaaatctaaaatcttaaaaaaagaaatttataaggaaaagggtacactacaactgatactaaacaaagacagaggatgataggagactgttatgaacagttatacactaacagattggataatcctgaagaaatggataaatgaatagaaacgtacaacctaccaagatataccatgaagaaacagaagatataacagaccaaggaaggagattgaagctgtaatcaaaaatctcccaacaaagacaagtcaagatgagatggcttcattggttaattgtactaatcatttaaggaagaattaatgacaagtggtcaacttgtagaatcagttcttctcaaattcttctagaaatttgaagataaaggaatactgccaaagtcattctgtaagaccagcattgttatgatatcaaattcaaataagaacacaagaaaattataggccagcatctctggtgaaggtaaatgcaaaaatcctcaacaagataatagcaaattgaattcagtaggaaatttaaaatatcatacaccatgatcaactgggacttactcctgggatgcaagaatggtttaacctatgcagataaaaaatgtgacataagacattaatattctgatattcacagatctgtaacataatgtcaaagatctaaattatattgggaaatataatatgctattgaaattgttaagtatgtagtaagtacctttaaaaagctattatctgtgaatgaaactccaaattaggattaagttcttaaaagaatcatatggaaaaaggagtattttattgtaaatattaaactaggacatgtttgttattaaaaataaaatttatacagtaagtgctattgacttaaaatactatcaactttattctctgtagagaagaaagtataagttggcaatgttccaacatgtctgtattaatcttacaagatcttgtggttcagccaaaaactctcatgcttgtgtcagttaaactttttaagtataacttttgaaacacctgtcttaaaggcatccttatgctttcagtttttaaaacatatataaaactgatctgataatgtgaaatattgttcaacatgttagctatttcttaatgttttgcaattggtgagttttaaaactgtcccaagttaacagcgatttaaaaacatttttctcacatgtagtttttaaagctctctagaaattgacatgtttaaaaactgccaagacaattaaactttttatgttaaaaatgtttaaaactctgatcatatagcacatagtaataacgctttcttgggcataaattataataaaatactataagtaatacatgtaaagaatgtatcagtcactatctaagccttgaagcaaattgtattcatccttcaagattcagttgaacctactctttggaatcattttcaaccagaggtggtgtatgatttagaaaagattgagcacatggcttctagtcttcgctgtaccatctcttgagttccacttgtacatatgtaaaatgaaagcaatgggccagatgacccctgagtgttgttttattttttagctctacttataagggaacacttccatttgcactaaatatactgtatgaatgtttaagtatttctgggtatcttgagtattcagaggtggcactaatgaaggagtgtaggctttccctgcaatgttgaaccttggtgtacattttgtcctctttaaaaaaccaatcaaacaaatttgctacctagaatacagtgtgtataggtcttttggtcattagccttataataggtagtcatttaaaatattttccaaagttacttaggtaatttcttgttttccatacctcattcataatagttttattactgttggtattgtatttttcattctccctatctgctggatgatttaaattatttattttttgagggaataggaaacattgccatagttatataaataagctctacaaaagggtgtactcagggaagtatcaatcctccccctatgcctactaccctgtttccattctccttccagttattaaatttgtcatagagatttgggttgttctgaaactacttaagtgtatactgggatataacaagtaagtaaatatgtttcagataataagacccagatttctcaccgtaagataaaaggctagtgtgttcagggctatggtgttcagttggaattggaagtatcagtatgaacttatggttctgaatatatataaaaacagataaatatgaaaatatagatggggtatgttagtgtacatacatatatttccaagccctgcctactaacaagacatgaaagcagtgacacccagtagtagtgaacatagataatacccagatctaggatttaaataccattctccagtagaaggtactatgccgccttggagaaatggctgattctatatctagggcagggaaaatggaagatgagcctagaatagtaagtacacataaataagtaaaaataaatttcaggtgcagcggcatgcacctgcaatccctgctactcaggaggctttgtaatcccaactactcgggaggctgaggcaggaggatcgcttgagaccaagagtttgagaccaacctgggcaacttagcaagactccatctcaaaaaatgaatgactaaatgaatgaatgatgagagcatgtcaaaaaaacacaggagccaacttgaaggagttcccaatagccaattctggagcaattttagcagcaaaataaataatgatagcattattataatccagaaaataaaagaaatatccatccatctgtattgatataaatacttaaacacctgggagggaaaggacaggtcttccttacagtagaaatccaattataaattaataagtaaatatggaaatggagactcaccattaggcaaatatcatggtaataattgtttaaaagaactatcaatggatattaaaataagtgggtgaaagtgtcatgagaaaaaagattttttgcataattttgaagtattttcccagaagataattaataattgctaagagaaacatcacaactggtgtggaaaaataaacctggcaggcaccaccttaaccagatgatcaattacagatgataatatcaccagtaataagacatagtgacataccatgtgccactagtgtggtatattgacaagggcacctattgctttagttctgtttttgctcaaaatacatcacctcaatctaataattagaaaacatcagagaaatccaagttgaggggcatatgacaaaatcagtgcccagtacgcttcaaaagtgtcaatgtcaaggtcataaaatacaaataaagacagaagcaacttgtcaaagacaaacagattggattatcaaattttggtagaggttacaggaggttatggacacatgatacagtgtagcatactaaattggctcctgggccagaaaaaaaaaaaaaggattattagtggggaaactggaaaagggcaaataaggtccctagataagttaatagcattgtataatgttaattttatatctttcataacactgctgtgattatgtcatgttctctttaggggatactggttaaagggtatacaagaatgttgattttttacagcttttctgtaagtctgaaatttttcaaattgagatactttgaaaatttctgatcaaaatgaagcaaaatcctttccttgggctttgttagtatgtattacctgaaaaaagttggaattttcaaaaatattttaataagcagtaataaaacaaaaggaaaaatattggaatataataataattcagtttacaaagtgcatagtaggtcagaggatcattcctagatctctgactcttgtcccattctgttagcctaaaagaatgtcagatatcttgccccaaaggaaagttttttgtacttttcctgatctgcctccatgttgcagagtgccagcttacttccgcacatttcagacctggtcgcgataccttgaacttcaggggcaaggataaatcaggctaattctgctttcattaggcttttctgttcaggcctggttggggtttgagagaatatgcctcttctctaaaacactggaggactgggaaggctggacacaataaattaacaatcagtggcaatcccacatttcatatattgggtaagaaaaataatactgagtgtacctgtacagacctaatgctaattgctttcccaaatattatttattttcatacttagaatagctctgtgagatagatgttggctcctttctaaaaataaggaaaatgaggctcagacaggttaaatatcttgccaagatggtacattaagtaatggaaagccaagattcaaacccaggtctatttgattccaaagcatgctattctttttttcttataggtccaacagaaaaatacatatacattaaatatgatatccatacatataatagagcagtgcagaggtaattctgtcagtatcaatgcccatccatatagaaacatcttaagagaagttaccatatcatatattctttttaatttcccatggcctccaataaggtagaatccggtaattactacattactggtgattttcagattcatagtatctgatgaaagtaaaacagcaaaaagaaaaaaatattgacctctgcagggcaatcttatctgtagctagctggcagattgctgttatcttcattcttctctctgttctataaatatttaaccacctgtattggttttctgttgctgccataacaaatgacaacacacttacgatttaaacaacacaaatttactttcttttggctctgtgggttgtgagtccatcccaggtctcactgggctaaaatctaagtgttgtattcctttctgtaagttcatggggaagattcattttcttcctcagatggtggcatagtcagatccttttgatcatacaaggaccccatttccttgctggctgaaggccattcccagcttctagagggtacctgcattccttggcttgtgacttcttttctctaaagccaggaaaacaggtcaagtttgtttcatatcgtatctccactcctgcctcactctctttcacttttaagagctcgtgattaactggcccacccaaataatccaggataatctccccaccttgaggtccataattttaatcacatctgcaaagtccatttcaccatttaaagtaatatagtcacagggtcagagtactaggatgtggacatcttcatggatgccttattctgcagaccacaatgtaaaaaaaatcacacaagttcataaaccactggctaatattaataatcataactatactgagcagtttgtgtcaagtaatgttctaaattgtgttttatatattaatctaatccttgcaatactgtaatgaagcaggttacttagccctattttatggatgagaaaaaataagtacaaaagacattaggtaatttaccagagtcactgatagtaattattatctgtaatttcaaccaggcggtctgagtctgtaaactatgccattaacttccgtactatcataagtcactcagatgattcaggacttcggatattttacttaactgattagggtcaaaatgtttagcaagcctatactgtatgtgggctggttattcttagtttttacggtaaatgaatatttttttcttgctggctgacagaaaaggaatgataatgagggtacacagatgactgaaattgaatgttatttccttagattattttactcattatcactattgtataagaatatgtcactgtttgttatataagttccttcagaacaacttagagaaaaaatatggtaattaggttatcatgtaatccaatgacatacatctctgttgcagcacttttgcaatgatgttgtaattctctgtctctctctcccccaacctttgttctttgatgttagtggtctttccaattttgtatttcaacatctatagagtttctggctgatggatcctcaaatagtgaattggatgaatggattagttaattaattaaatcattcctataattgtcaatccatttataccctgctcttaaaatttaatgaattaatttgaggtgaaaatgtttcagacaagatgatcttcaaattctacatgtaataaagataattttaagagtctcaaaacaatttgtatatttatagaatccctaataatggccatttgcagtgtgctaagcattgggctaaacgagagctcagtattcacaacaatcctgtgatgtaatgctctagtcgtatacatgtggaaactaaggactaactgagttgtatcactccccaaagtctactcacggacccagtagagccaatgtcttcacctaggaataattgactctaaagcgtttgcccttatccactgcctcatttctttttattcctaaagtaaaactactcataagatttctggatctgatttctgtactacttgtggattgattaaatacaaaaacattattgtgtattattatcagttggtctttcaaataactgagaccaaaacattaaaatagttttaaaaatctgtaaacactcctattcttctggatttctacttacagaattagcacctagaactagaaaagtaagtttcttttttttttctgagtgttaagacctcaggaaatatttttttaattaacatactataaaattgacttgatattcatttatttgagctttaatacacacacacacaaacagacacacacataagtgtattcatgtagcaaccatgacgatcagggcacagaacagttccatcatcagagcactatcgtgctacccgtttttagtcacattttcattctaccacaaatcctggcaaccgtgatcttttgctatcattttctcttcttgagaatgttataaaaatgaaatcatacaacatgaaacataatctgtgtcactcagcatacaatatgaaacatttctatttcactcagatgtattcaagttgttgcgtgtatcaatagtttgatcctttttattaatgagtagtatttcattgtatgggtgtgccacagtttatccattcattagtggaaggacatttgggttgtttccaatttacggagattatgagtaaagttgctgtaaacattagtatacaggttttggggggtgaagttaagttttcatttctctagggtaaatatttagaagtgtgattgctgcataatatgttgtatatatttaatgtttcaagaaactgccaaacttttccagagtggttgtaccatcccaccagtaataaataagagatgatccactttctctacatggccacaggcattttgttttatcagatattttttactttaaccattctaataggtgtgttttcataacaggtttggttttcatttgcattcccctaatggctaatgaagttaaacattttatcatgtgtttattatgtcctcttcagtgaagtgtctgcttaacaccttttgtgtattttcttttcttttttttctgtagtgttttttttttctttttttaattatactttaagttctagggtacatgttcacaatgtgcaggtttgttacatatgtatacatgtattttctagttgagttacttattttattaaattttgagagttctttagagttgtagtaaagactactgtagcttgtcttttcattctcttatcctagtctttcacagaacaaaagttttaattgagatttagtttatcactttttctttttatggatcatgattttcatcatgcttggtgtcatgtgcaggaactctgcttaactccagatcatcaggtttttctctttgttttcttcacctttttattagggcttgttgtattttgacctaatttttttataagatgttagattgaggtgaagtttcatttcttcaatatggatgtccaattgtgccaatactgcttgttgaaaagactattctttctctattgaatatatttgcatttttgtcagaaattaattgtctatatttatgtgggtcagtttctggactttgttccattctgttgatctgtacatccatccttttgccaataccacgtaatcctgattactgtagcttgatagtaagtcttaaaattggaggatgttatttctctaattttatttttcaaaatcattttggctattatagttcctttgccttttcatataaattttagataatctatttatattaaaaataatcatgctgaaattttgatttgatttgtgttaaatatgcagatcaatttggagagaactgacttcttccttaaagtgttgaggagtcttccaattaatgaacatggtgtgtgtttacatttatttaggttttctttttcttacatcagtgtttcataatttcagaatacagatcatgtacatagtttgttaaatttacacctatatatttcttctttggagataagaactgtgaatggcttgaagtttttttcttttaatttggtttccagttcattgcctatgtagacagtcttgttttctgcaaatagggacatttttatttcttcctttctaatgtgtatgcctgtaattcttttattgacttattgcaagacatcaagagaggtgataacggacattcttggctttttcttaatcttgagaagaaagcatagtctttctcctttaagtgtaatgttaactgtaggtttcttgtagatacgctttatcaaattgagtaacttcccttctattcctggttcgctgcaagttttcatcatgaataaatgttgctttttttcaaatgctttttctgcatcaattgaaatgatcatatggttttactttaatctgtgaatatggaggaatgcactaatcaatttcaaatattgaatcaggctttattctctgaaaagcctcactttatcattttctttttgtatattgctaatattttgttgaagatttttgtgtcgatgttcataaggtatgttagtctataattttttttctttttctttttcttttattttcttcgtactattgtcctatggttttggtattagaataatcctggccttaaaaaaaatatttaaattggtgttatttcttctttaaatatctgataaaatttgcaagtgaaagttggtcctggagttttgttttgcttaggaggaagattttctaattcaatttaaaaatatttacaggaatattcaggttttgtattcatcttggatgtgtttagtgtctgattttcaaggaatttacttatttcacttctttaggtttatgtttacacaattgttcagagcattcctttatatccttctaatatctgctggttctacagtggtattctcttttcattcctgatagtagcaatttgtggcttctttttttgcttaccgatcctactacagttttgtccattgcattgatctttacaaagaaccagctttttgtctcactgtttttttttttaattttattgctttttgatttttattacttctttctgcttgctttgggtttattttgctccttgtttactgttgttttaatacacaattcagaattttgatctgagaccttcttttctagcacaagcatttaatgctataaattcccctctatacagtgttttagggacactccacagattttgatgttttttatttccctttttgatccatagattctctctaaatcagtttattaatttccagtgttttggagattttcttatctttttcctattgacatctggtcattatgatcatagaacatactttatagaatttaaatcctttaaaatttgttttgttttatgatcttggaagtggtgtgtctacatgaatattttgtgtacatttgaaaagaatgtgaatttcgtcattggggtgtgttctataaatctataaatgttatttggatctagttgttaatgttgcctggttcttctatatccttgctaattttttgtctacttgttctgtcagttaatgcaagaggagtattagaagcctgcaagaatattgtagatttgtctctactttttgttctgttcatttttgctttgcttattttaaagctctgttgttaaaggcatacacatttaagatctctctgttttcttggcaaattgaccctcttatcattatgcaatgtttttcttgatctctgataattttcttatcactgaagtctactttgtctgatattactataatcacgctagctttcttctggttaatgatataatttttcatgatagaattttttatccttttacttttaaactatgtaattataattgaagaaatttttgtagataggatattaatggggattttttttattatttttggtctattctgatcatctctgcccttaattggtttgtttaggccatttatatttcataaaatgttttatgtttggatttgggtttatcattttattatttgttttttgtttttctctctgtattttcactcttctggtcctctttttctgccttgttttggatcatttgaatattttttagtattccattttaatttagttttgactatgtatctttgtatagatttcttttagtggttgctctatggattagaatgtacatcctaacttttcacagtctatttagaatcaatcttttaccctgccaagtggattgtataaatctttcatgtaagtcttgttattctccctcctttattttatagtttttatatgtactacatcatttctcttcttcttttattcccgacattccaagtgtccctcatttcaccttctttatgacagtcttcctttagtaattcttttagaacagatctgccagcaatgaactatactttttatctgagaatgtctttattttaccttcgttttttaaaggatattcttattgaatttagaattttgagctgacagatattttttgttttaaacatgttccactttcttatggaatctatgatttctgattataactctgtagtccattgatcccctataattatatattatttcctctggctctttttagtatttttttaaactagtttgattgatggatttgagcctagtgtttgattgatgggttcgagcctagatttggggggttaggaggttactatttgaggttcagttcttaaatctgttggtttatgtctttcactaaatttgggaaatttttaaacattattcagttttttttctgcactacagctcttttccttctgggactccagtgacatgaaagttagatattttattattgtcctgcattatcctgagactctttattttttaataaatatttttactctgtcttattcaaagtggatagtttccattgatgtactgtcaagttcaccagtctttgctctcttatctccattttactattaagcccatccagtgatttttaaactttggttactgtatgtttagttctaaaattttcttttagtttttatttaaatatcttccatttgctgagacattctatctttccattcttttcaacagtgtttacccttacttcttggagcatttttataatagttgtcttaatgtcttagtttaataattctaacatctttttttcccaatgttgccattttttgatcatcttttcctatgtgacttgagactttttctgattcttcacatgccaagtaatttgagattatattctggatatttcaagtattatgttgtgagattaataagttaaataagactaatacttcgtcttatttaaatcctatcgagaattttgatattttttgcttaacaggcaatttatccagttgtattcgggatgcagtctccagccagtatataggttttgattccacaactggttcacttttcaaagcctttgaaatgctgttcagatctgtccttcatgtaccacccagggtccaatctagaacatgggtaattgtctgtctatacttagtttctcacagtctgtgatcagattcacacatgagaagtttgagcataaacccaagagttcataaacagccttatgaggtcactttcctgagcctctctctttcatgatctcagtactttgagttcctggagactctgcttttcagtcctctagccaaaactctgggactttatttaccctactttgccacatgcttcctgcatctatgcctgtagaagagctgaaagaagacagggagagaaagagctcagtggagtttatattgtactcttagggccacagctcctcctactggagaggaagttttccctccctcaaagttttaaattcttgcagttatcattatctctgctactaccttgaaggctaggatgcaagagaatgaaggagaaaagggcaatttttctcttctttgagacttttcctgctccttgagcctaaactataaggattctcctagagccttcactgccatgccccagggcccactttcaggttttaagctcccttgaatccaggccaggggtaccttttaaaaaaagaagaagaaagaaaaaggtaaggggaatcaccctgtgctactctgaattcttgtcatgtcatcttctccagtccacctgctgtgacttaccctttagagtctttaaataaccgtttccttcattctcaagttttattatctagattcagtagcagacataaacagtttgtggattctccatattaactggatctgacctcaggtatatatttttaatcattatctaagttaatgggtgttcatggaggttgtgagttgcatttgttttaactttgctatacagttacaccccaaatattcacatacatattataaattggaagatacaggagcaggaaaatgaaactatctggaaaagtatacagtgaaacatttcatctctaaagtttgaacacattcaggtctgaatttaggaatctgttggcattcgcttttttgatagttttcccttagcagggaatagggtaggaatagcagaaagctggctcagcgatgacttacagaatgagagagatgtgaattggccttttaaaaatctgtggaagttactcatttggactgggtaacggctttctaggcagagggagcaacttcaggaaaggtatagagaaggtccccaacttacaacattgacttaagacttttcaactttacagtggtgtgaaagaaatatgtattcaatagaaaccacactccaaggacccatgtaatcgtttctcattttcaatatagtgttcaataaattatatgagattttaatactttattataaaatgggcttcatgttagatgattttgcccaattgtaggatactgtaattgtcctgagcattaaggtagactaggctgaactgtgttgttcagtaggaccggcgtattaaatgcattttgacatgatattttccatttataacggggtttatcaatatttaacctcatcataagtcaaggagtatctatacaggtataaatgtgcatggcatgtgtgaatgtgtgtcaaagaggagtagacaaaccaggaaagggaaatatgattcagttaggcatttactgtgccttcttagaggttgcagtaagatattcccatgaacatatttgaaatggttagaaacacatgggtgtgaatttcaaaaaatacaagtttttgaatttaacacatatgctaaataatcagtccttcagcttaaactatgttatcctgcaaatgatagtaagtcttctggatttttattagaatgaatcacattttccatccttgtttttatttactaggaatttcatcttatgactaaaaagaacaagccataagctcttttggtctaaatttgagatatttgcctttgacttatttttaaattaaactttttattttgacataataatagattcacaaataatacagagaaatcctgtgtaccctttacccagtttcctccaatggtaacataatataatgtcacaacaagcatattgacattgatacagtcaagatacagagcagttctgtcactaacaggctctcgtttcccattacatgttcacccctgtccctctaccttgccgcattccttacccctggcaaccactaatctccatctttacaattgtgttatttgaagaaagttacataaatgaaatcatacagtatgtaaccttttagactgactttttcattctctataaattcttggaaattcatctgagctgttgcttgtatcaatagtttgttcttttttattgctgagtaatatttcatgacttattttttagcccacctttttccattatgtttcattttgaaaaaacaaagtcttactactcaggcatttttctcacttacatatttgctttagaatttatactataaacaaaaaccttaggagcattctagtgttctttttaaaattgcatttaggttaaccagttaatctgttgacattattacgtcttacaggaaaaaaatatgtacaagtagattttattactttactccccttttaattcctaaatccagaagtaagatcagaacacatgagagatactgctgcttgaaaaatacttagcacagcctgtttgcagacacactcatgctagtccacggctgatgcagaaaggagcctatcccaaggcagcatttttttgcagtgctaaaggccaacattaggatgttgtctgttttcattaggcaccatggtcttagttgctcaaccaaaactccagcctcaataatgagggaaaaaaatatacttctagtttttaaattgtgggaaataggtctgggagtagattctgaagtatgttaaatactcatctaaagagcctagaatttatcccaaggggggatgaagaaatgaagaaacaaataaattaatcaaattgcagttcctaaaatagttataagtagaaaaattagcagtgtccaaaaatgtcattttacctttaatatcaatgtcatattccatcttacgaggtagtaactctggctgttttgattttcattttagaagaataaggaacataggtttacaataatcagtaactatattaccatcatataattacccagttggcatactgtttattattttagtttaaggagacacattgaagcgagaaaaagggggtgctagaggtttgcagacacttagcaaacactagtgtttatcctacagctttgtaaacactttaccaagaatttttaaactgtcattttgctgatggaaagtgtaaaatgagacttcagcagaagttaatctcatcatctacttaaaacagtgttttttacattgatctaaagaggtttgtgcatattttaactgtttttcctatatgatcatcttcatgtactagtatgaaagttaatgagtaaagaaaatctgctgaataaatccacgtgataatccaaggcacttaaaagaaatacatgctataatgggatgcaaagattttacttgattagtgctctatttctcaatttaacaatcaaacctaagagaaatctcaatcaagacttttgactaacatagtgcaatttgattagggtgcagataagtacactatttcggtgtgactgtataagtattctgatcataattatgacatatactctgctactagttagaaaaagaacagtttttaacttcttcatgcctttcatttatgcacatgttcttaatacactattataataaataaaatgtacctgaaaatataaaacatactttttgcttgtccaaaaagtatgcatttatttataatacaaaatatttattctgaacctatgctgtatgatagcccactataaatgtagaggtagcaagggaagatgacagatatctaaaaatatttgttagtagcactatattgttgattactacatatcagtaattagaataacgaataaagtgaaagaaaaagcataatgccttaggtgtttactttgggcacagtaacatttggtccagtcatctttctagttttctggtacccaagttaaatgagcaagagtgtgatggaaagtgggctttggagccaatcagacctgcatttatatttcatttctaccacctaataacggcatgtctttgggcaagttatttaacttctccaagcctcaagttttttaacttataaaatatgttgttacaaagcttaaaagaagtaagttactagcacagtgcctggaacatagaaatttgtgctttagagaagaaataaaaatatataattctaccgtctataggtagagctcttttcccaaaatagtactaaaattccagtttgcttataatcctaaaatatttataattccagaatatctaaatctgtactgcttttacttctctaagatatcttcgtgagtttggtaagactgtccacttaatttctttaaacagctttacttttcaaggacacattaccatattcataaaaggaaaaaatccaaattaaatataatctgtactgaaagtttccttttcagatttcgggaagttaaaatgtttgtgacaactggatttgtttttttaatcttttattgatatataatagctgtatatatttggggagtacatgtgatattttgatacatgtatacaatgtgtaatgatcagatcagagtaattgggatatccaaaactttaaacatttgtctttcgtttgtattaggaacactatagatctattttaatttcttctttgatttcagcaggaaaggaagggcaagaaatcctggggcctgaagctcaggcagatgaagcaggatgtacaggtactctgctgcgactttctttcataccatagcctttaaaagaaggtctttgtgtcactgatttcgcatttgtgagtcctgaatttagtccgtttccttctcttttatcttaccttccttaaatgtttaagtacttaggcatatggtgcactacataaaaagaagtaaatattccttaaatacagagtaacttacagattcatattatgtagcagatttctccattctataagaatgacaagtataacctacagataatccaaaaaataagtgtttgaatgatgatttgaacttctatcaagtttttgaccaaagttagagaaatgcagatctaacttttgagtttcgttattagttacctgggtctgctttgaattgcccacaagacaaaaagcagaagaaaatagaaaaagcatggatttatctataaatccgatgagaatcatgaatattaatgagttgagtgaacatgtcacagcaaacgagaatcaaaaatttttcttaaattttctgtgattgaaaaagagtaaaatgaagttgaattataataaacaaggaaatttgcttttaggtgactaaaaagtacatattccctgaaacttaaggctattcctctgtaatggattcagatcagatttaagaagcaaaagagtaggtggaaaaattaaatcagatcttatgtatagtaataccagtcactttttattgtgttccctaagagagccagaactgttagaatgtaaacttcaaaaatgcattccagatttttaaaacatttcctcaaaatattatacttaaacgtagtgtaattgtactttgtatattcaaccataaattagatatttctgtcatatagttttaattacattttctttttccttctcttctatgagttatcatttatagatttgtttttttactttgctgtgcattttaggaatattccataaaggcttacaaattatctttcattaggtaagatgaggtatggttcatggctaataagtgtcaagattagatttttatctgtaatataaacaatagcactcctatactcgtcagtcatttctgtaaaacagagtaaatctttgtgctgttattaaaagtgaattccaaaataattaaataataatggagtatgtgataatttgtggtgcgtatagcctgcgattttatgttttgcccctaacttcgttctgtgtaacttgcatgaataatgtattcagatatgcttgttatcaaatatttgccatactaagctatagaatatgtaaaatatttaagctggacatttgttagtagtaatacagtagtgttaataaacataagagtacactatttacttttacctagaatcgttaaactttggagacttatattaccagaattacagaagacaacttgcccttctaggtaaaatgctatccaaaaagatgctcacaggtttacagtattttatctgtcatgctgttcttcactataaaaataaatgaattctttcagtttgaagtactgaatagtatgtaaatttcctcaaaaaagttgcatctggaaggcagggtaaccttctcaaatttgtgtttaacaaaagttgctgctgaaatgtaaaatctcccccacgtacacaatgatgatccctgctgcattattcgcctggaacatggggagttaggagtaagcaaacttccattaaagctccagtgagtgtagctttaaaaggaaatttagcttttgagacttttgagcagttaaactgtaaaatgatgtcctgcctttgcttttgttacttccttgacttctagggaataatatgctgacaaaatgagcaaaagcattgtacagcagtcgccatcattagttcagaatgttgtcagatcttttttatagcagacttccttctgcagctcgtgaagttaaggaactatagtctgaactcagtaatcagagtaaaaaattcattgaaaacatcctttgttccttctgagcgtccctttttttgtttatatagttgataattttagaaagtttcaaacatggaggataaagataagaggaagcctgaggatactttattcaggatggaaaaatagatagatagatagatagatagatagatagatagatagatagatagatttaaaaatattcagtgtttatattaaatatttgctctctcaaatacatgtatatagtcatttaattctatactttgtcaattttgagttttatcatatttaaagaaaacccaattaccttttatgctgtgtatatttgctcatctccctaatatttaaatatataagtttatcatctaaagaccaggacatttgctttataattgaccttttcaagatgtgcatttcccaacactttaaattttaaaaaactgcagaaattctggtctcagtttgaaattgggcctggtaaatgtgggttcatggatatagagtgtagtttaatggaaagagctcagattttatacctgacacctaataccaatttgtctgctctaatagtaatacattttctctctgtgatctcagaagagcttttctgaccctaatttttctattgaggaaaaattttaattgtaaaattatgatgttcaccttgcaggacttctttaaggtgtaaatagctaacaattacatagtacttactacataccaggtaccctactaataagtacattactatattaattaatctaattcttacaacaaccctaagaggtactgttatataaattttataggatgtaaacattatatactgtctcacaaatttcttaatggacatataaaatttttcattttaaatgtcagtagttacaatttaatttctggcagagtaaaacattgacattttaacatcactattacatatgaaatccatagtatattaatacctattatcttttttaaaaatatgaaaatgctctttaagaaatgttgtgtcataatatttactttttgagctcatatttccattctatatgcactatagaattttatgcaaacgtatattaattacttcataaacagtaattaattgtaatagcttaatattacttctagaaggaaaagtgttcatcattcagtttcttttttttagcattgaggtacctttattctcaaataaaaagatgaaataaaattttatgttataactgagttgctcagtttttatgcatcttcagctataatgtcaaaagttatttgtcaatgaaaatattttaatgtcctgtcagtatttcttcaattttgttgaaaacaaaaatttaaagccatctaatttgcaaaaagatttgtttcccagtcattacaatcatctattccctcattttctgggacgtataccagaaagactttaccaatagttatttatcaaaggactaatgatacctgttttgggctttaaaatgttttttctcacagtcactttgtttaatgtattcagaaatgattaaggaaactgaaatatgttaatttcagtatcttttatcagtatatttttcatgaaaaacacttttattacatgaactgtattttgagcaataccttattggttcacccaatttctggaaaatttccaataacctacccagcaaagccagttatcaacatcacaccagccagccaagtcagacttactttctgtcaggaaaaaaagcattttttcgttttttgaactcagtgtgtcaatacatattttgaggaattctataaaatctcatcaataaggaagtgtatgaaggatatatttaaaatacaaaagttaaccaggcatggtgatgcacgcttgtaatcccagctactcgggaggctgaggcgggagaatcgcttggacccaggaggtggaggttgcagtgagccaagatcgcgccattgcactccaacctgggcgacaagagcgaaactcattctcaaaaaaaaaatagaaattatcaataatgaagaaaacataaagtataagtaaatacatcttataataatactaagtagtaaagtcaagattaagattatgtagatcgaatctaatttgtatgttaaaaaaatctttatctctaaatgtgtatatttagacctaatcaatgtataggaaagctagaatttattgaagtagcaaaattcatatataaaatacagatcatgcagttctgaaaagtgtatactatttaaaaactcattattccaacagctagcacacttataatttttattaggatgtagaaaatataagatggagattgcttaattgaaataaatattttataatataatttgataaaaataattttaactatcttagcaactctacatggaatctgtaagaaatcacataaaatattaatttcattttttacttttatctagtttaaattgaaaaattgaagttgctttgaaaagaatgccactgatttgttctgctttagctcttcagaaatgctttttgttctacctaatgacaaatcctaggaatgatgtttgagaatgttatttgctttgctcttatcagtctcctgaaaagcaatgaatttttaaataatagggaggtcattaagggaaaattaccctcacttcctctggccatattatatagttaattgcagcttcccaaccaggaccagcatacccccatttcagttgtgctttatgcctaatagaaattcatgtaaacaggaaagaccagaaaacctatagtgattctctgttgccttgatttgtcagtaaagaaggctttccctaatcggtattttgaactttactcctttggcaccctggaggactttacactccaagcagtgtaccataatcatgtcatggatggatagaggaatacgccttttctctttttttcttttaagaaagtgagaacaaggtatactgtataaaggagagcagggagaagaattttcaaggatgctaggaaagagtttacatggaagttgaggatccgggagttgattcctttaaacccaacagtccagcttacattttaaaagtcttcgcttacctctggatccaataatcccaatttggtaactactgacatgaactaaataatgcagttcttggtatatagcaaatgctaaataattgatagctattgaaaagtggggaaaaaaattaggatcaccatttgttactgtcattggttctcaggttttaaacagcagtcaccctgatgagtttggttactgctacagtgcaggagatgtagcaagattgttttaataaccatcgaacaaacagatgcccatacatccccattttaatttggccaaacttcagcctgctggggagtgctgttttacaaatttagacctgacagttcagtcagagtctataaagaagtcatccctgaggcatttgggagccatactaaggcattgcagttgccagcatggagtagagaccctcttctggagccagtggaggaaatggaggaaaaccatagtgcagcaataatgctttagaaacttggcagcacgctgggctaccttctcaaagcataagcctttctaattcaagaaaagttgccactgccttaatcccacagttaaacatttactgaggcagaaatagagaaagaataggcttgttttatatgaatactagcgtagctaagaaagagttttcatagatttgataccctttgatgcttattagaaatccttcttactatagataattattaaaaactattttctaagaaatcatataactgaactgaacgtcagagtggtttatatgagaattattcagatttaaagtagagctcccccccccattatctgtgggagataaattccaagagtcccccattgagtgtcttaaataaatacttatatatactatactgtttcctatacatacatacatatgataaagtttaatttataaattttatacagagttgcaacaagaactataataaaatacggttataacaatatgctttaataaatttatgtgaatgtggtctccctcgctcgctctcaaattattcttcttgtactgtattcacctgatttcatattgcagttgaccacaggtaactgaaaccatggaaaatgaagccacagataaggggctgtctattgtccaactttaaataagtattatgatatgataggttgctaagaaggtgacctttgagaactaaagtttttttcttgctttatcattaattgagaaagaattcagtcaactatattgccttctctgtgttttattagtaaaatgcaatagaagtatgactttaacatttgaaagggatactgtgagaatttcacacattcatagcattttaaacttataaagcaaagatatatcttaatacattacaacaaaatgagtggaattcatttttaattttcaagaaatattttctgcagattcaagaacaatcatatgttctctcaagataaataatttcttatttagaaaacctttgtaataacttagtggtgagattgctgtcttaaaagtatgcattttttttagtaaaagatgatgaatgcgagtcagatgcagaaaatgagcaaaaccatgatcctaatgttgaagagtttctacaacaacaagacactgctgtcatttttcctgaggcacctgaagaggaccagaggcagggcacaccagaagccagtggtcatgatgaaaatggtaaatggatcttaacagttgtgtttctttccctctttaaaggattcttgtttctaccattctactatgggaacctgctctactatagggaacattcttgaagaccaaactttattacaggtgcctatagagagtaatctgttttattaatggaacactatgatgaccatgcagtaataaattattagctgctcatgtattgtggtagtaatgccactgcatgtgaaatgcttagaacagtgtctggacatcaaattccatttacttacatggtagcaggcagtagaagtgagaactatacctttactgccctttggattctttcccaccattcttttaacaaataaaaatatggttgtctgctttataccagaacatactaatttggaaacagtggttttcctgaatctgccttagtccactctgatatgaatagtcagcgtacagagtgtggaaaatgcaataaaaatgtgttcagactctcctgagaagaaataggctgtgatacagtttgggaggaaaagactatgttattgtttcaccagaagaaactaggttatcaaagaaatgaaagggaaatacaaaatttaaaaatatatgtatatttacgtaaaatttttatgtgacaaaaggctttcaaaaagcctcactgaaaggaaacaatgaaacctaaagaaatgatccattatgtagttctaataaaggttaaaccttttaaagtttgtcaggtccatacagtacgatctaaaaattgaggaactaccattctgaattagtttgaattatagaataagttgttgattttgttattcattactttcagatatttaatgtaatttaattaaatgctaataaagcattttgaagtattctgtcatatcagcgacatttgtttacatatttatccctttttataaccaaatagtattcattcgtgtgtatatgccacatttgcttcatccattgatgtacactgaggttgattccatatctttgctattgtgaatagtactgtaataagcatgaagatccaggcatctctttgatataccaacttcctttggataaatacccagtagtggaattgctggatcatataatagttctatttttagttttttttgagaaatctccgtagtattttcacagtggctgtcctaattttcattcccaccaagaatgtatgagagttcccttttctccacatcttcaccagcattcattagtttttgtctttaatagcaatactaactgggatgaaatgatatattattgtggttttgatttgcatttctctaatgattagtgatggtgagcatttttttgtatatctgtggctatttgtatgtcttcttttaagaaatgtttattcatatcctttgcccacttttcaataggattatttgggttttttaaatctgttgaatagtttgtgtattcttcatattagtcccttgtcagatgagtaatttgcagatattcactctgttgtttcctttgctgagtcttagcaataaagtctttgcctacccaaatgtcctgagtgttttctgtatgttttcttctagttttatggtgttgtgtcttatgtttaagtctttcattgatcttgagttgatttttgtatgtggtgagaaataggagtccagtttcattcttcacatgttaatattcagttttcccagcaccatttattggagagtgtgtccttttcctggtgtatgtttttggtgccttgtcgaaatcaaatggctgttaataatgtggattttattctgggttctctgttctcttccactggtctgtgtgtgtctgttttttactaatgccatgctgttttccttactgtaccttgtattatattttgaagtcaggtagtgcgatgtctccagctttgttctttttgctcaggattgctttggctatattggtcttttgtggttccgtaaaagttttaggattgttttttctgcttctgtgaaaaatgacatagatattttgatagggattggattgaatctgtagatcgctctgggcaatatgatcattttaatgatgttaattcttctgatccatgagcatgggatgtctttccatttacttgtgtcttcttcaatttctttcatcaatattttgtagttttccttggagaggtctttcaccttcttgggtaaatttatccctaggtattttacttttttgtagctactataaatgagatggtcttcttgatttatttctcgtctagttcattattggtgtacagaaacactgctgatttttatgttgagttttgtatcctgcaactttcagtttatttagcagattgcagttttttggttgtgtctttaggtttttctagatattagatcatatagtctgcaaagagagactatttgacttcttttccaaattggatggcttttatttctttctcttgcccaattgctctggctaggactttccaatactgtgttgaataggagtggtgaaggagtggaaatccttttctgattacacttcttagagggacgtctgtcagcttgttccatgcagtatgctgtggttctgtcatatatgtcctttattatatggaggtgaaccatctttgcatccctgggataaatcccacttgatcatattgcattatctttttgacgtgctgttagatttagtttgtgaatatttttttgaggattttgtatctgttgtcatcagggatattgacctggatagttttccgttttttgtttcatctttctctggttttggtatcaagatagtgatggacttatagaatgaagtagggagaattccctcctcttcagttttttggaatagtttgaggagaactagtgttagctcttctttgacagtttggtagaattcagcagtgaaccctttcagtcccagacttgaaatattcattatggattcaatctcattactcattattggtctgttcaggttttctatttctttctaatttaatcttggtaggctgtgtccaggaatttatccatatcctctaggtttttcagttttttcatgtatagttgttcataattgtctcttttgtatttctgtggtatcatttgttagtcttctttttcattttttatttgcatcttctctgttcttttcttagtctagctagtggtttatcagttttgttaccttttcaaaaaaaccaactttttgttttgttatttgtgttgttttttagtcttcatttcattgattttgttctgattgttattatttctttccttcttaaatcctaatttagggtttgctttgttcttgcttttctaagttcttgaggcacattgttagattatttgaaatgtttctatttttttgttttaggtatttattgctatatacttcctcttagtgcttttgctatatttcataggttttgatatgttctgttttgattttcatttaaagaaattttaattttaatttcatttaaagaaattttaaattttcctccttatttcttccttgacccagtggttattcaaaagcatgttgtttaattttcatgtgtgtgtagagtttccaaagttcctcttattattaaaatctatagttgtattactttgtggtctaaaagctacttgatatgattttgatttttaaaaatttgtttgagacttgtcatgggtcccaacatacagtctatcctagagtatgttctgtgtgttgatgacaagaatatgtatcctttagtagttggttaaaatgttctgtaagtgtctcacatccatttggtataaaatgcagtttaaattcagtgtttctttgttaagtgtctttctacatgatctgtctaatgctgataggggtgttgaagtccctaactattattgtattagaatctgtctctccctttagatctaataatatttcctttatatagccaggtactccagtcttgggtacatatatgttaagaattgttatatcctcttactgaattgattcctttgtcattctttaatgaccttctttgtccccttatactgttttgtttactggatttaagagtttatctcattatagctactcctgctcactatggtttccatttgcatggacatctttttctgtccctttactttcagtctatatggatctttacaggtgagatgaatttcttctaggcagcacatagctgggtcacagtttttatccattcagccaatctgtaccttttaagtggaaagtttaatccgtttatgttattattattgatatgttagagcctatttctgtcattttgatttctggttgttttgtgtatcatttgttcctttctttcttactgattattattgtggtttgatagttttctatagtggtaacatttgagttctttctctttcttatttgtacttgttctaccagtggattttatattttcatgtgttttcattatggtagatatcttcctgtcacttccatggataagactcccttaaacatttcttgtagggccagtctagtggtcatgaattctctcagcttttacttgtttaggaaagactttatttctctttcatttatgaaggataattttgctgggtatgatattcttggctggcagggtttttttctttcaatactttgaataaatatatcatttctttctctccttgcctataaagtttctgctgataaactgctattagtcgtatggaggttcccttacaagtgattggacacttttctcgtgttgtttttagaatatctctttgtcttttacttttgacagtgaatataatgtgccatggagaagatctttttgaattgtatctatttgggggtgcgctgagctttctgtatctggatgtctaaatcctttgctagacttgggaaatttttggatattatttcattaaataggttttctatcccttttgtttcctctttgccttataacacatcaaaaattcgaatatttggttactttatagtttcttatatgtcacacaggctttgttcattgtttttttattcttttttctcttactaggttattttaaaagacctgtcttcaagttctaaaattcttcttctgcttgacctaatctattgctgaagctttcagttgtcttttgtctttcattcggtgaattcttcaattccagaatttgtttagttcttttttatgatacttacctctttggtaaatttctcattcatatcctgatttgtttttctggttcctttgtgttgcttttctgttttcttctatctcacttagcttttataagatcattatttttaatcattttccaggatttcataaatttattttgattggaatctgttgctggataattattgtattttttggaggtgtcatatttccttcctttttcatgtttcttgtattcttaccttgataccacacatctggtataatagtcaattattctggttttttggatttgctttcattggttgagtagggcactttggctttgattctgggtacatgtggtagtgtaatttctgtatgatatctttcgttataaatagtgtgagtagggtccgtgatttcctcgttggcttaggtgcaattgttagtggaggctgaggtgaagtttggctgggacagggatgccaggtggaccattccttgggccctagcagtggtagtaacgggcttacagtacctgtccttagaccacagggtggcacattgacaccttgtgttagcaggtccagttgggctgatccttggaactccaggtggcttgcttgggtgctggtagtggcagtggtaagctgggcaggtgggcaggttctcaggctcctgggcagtggatgtcacttgggcaatggcagtagcagtggcaggacaccctctggttccctagtgattcacgctggtgttggcagtgactgcaatgggctgggtgagtcagtccccaggcctaccggtggtgcatgcaggagggtgccagctgtagtgatagtagcaggttgggtggacccaacctcaggcctccaggaggagtgttcaggtgacaacagtgttggactgggctgggtcatccccacgtccctgaatagcatgctcggaaactggggaggaggtaagctgggccagatggacctgtcctcaggccccttggtggtgtgtgtaggcattggctatcatggcaggggcaggatgatcccaggccaccagcagagtgctcaggtaaggacatcagtggttgcactgtggccttcttactggggagggcaaggttgctcttggtggcagcagccatagggagggagctgggaaatgtgcgctttagccccagacagcggctgtggatggggtagcctgtcctcaggtcccttataaatgcttagcagctcagctgctgaggaaattagggtcgctgccagtggctagcactttgtccccagcggtggaagcccacagtggcagcagtctgttggggagtctgtccttggggcatgtaaaaatgtgtgcagctcctctgctgggaggaggtatggtcactgccaatggcttgcacttcagccttagcagccgcaaccagcattagtgatgactgggaagggaggtatgtcagtggggctcaacaggatgtagtctgttgggggttgggctctcaaaatagtgctgtgctgtagctacttagaactcagggggtgtacagattcagcataagctccctctccggagcagcattgtcatgtggtctccacatacctccctgtgttagtctcagagcccacgatggtccaggggttctcccatggctaggattgcaggagtccatggtgggaatgtggacccctgggggtctctcacttactctttccctgcattggagagcctttgcaggttgctttacttccttcttccttacttgaggtgtttcctgtcacttttctgttgaattccagtgttctctcttagatgatctatgtgaagtgtgattattacctcattattttggtttttccttgtagaggaggtgagtaccagatgcctctattcagccatcttgaagcccctctctcaacatatttgaccaactatttaacattcaggtgctcagtctattatttgcagtctggtccttgagcaagacatttgatttatatggacttgaataaaggaatatatgttcagaaagcacttggagattttatgaaattatctgtggtggtttgtttttctatagtgaattcaaaatgaaaatagagatgatgtttacaaaaagatatcacttaatttatttcattgaagaaatgtcaaatatggaaaactactcttagttaaataatattaattggcaaaatattacattttaggattgtcaggcttagacagctccaagtgtaaaaataaagttcattcagtaaactaatttattcagaatgcctttgttttctaaaagctatatatattcatacatatacagttatatagcagatttgccagtgtatttcaataggggaaattacaagcagggtcatgcatgggatgtgtttatgtagcaggcctagatctggcccccatcagtctttccttccccaccttacacactatttttttggtctgaactcagtcctatggccacacctacctgcaagggactcttggaaacatagtgtgtgtgtactgtttactctttgatgatgatgacttggtagtttcattttcaaaatcagaggaataaacattaaataaataatgatacataccattgttaccaatagactctgttgtagagcacaaaattcccctttaatctgtatacacttacaaagacaacctacattctaattttacttttgttttcttttctagctaatcacatgacaaaagggaagaattatggtttagggaaaaagaatgggacttgaaggtcagacagcccgtatttgaaccctgacttcatcattttctggctctgtgacttttcttttaagttatttaaccttcctggaaaccactgttctctctcttataaaatagagatgagtatcattgcattgttttgaggatcaaatataaagtgggtagcacaatatctggaacatagcatagggactcagtggaaactttggtaatattttctgaatgttttaaatttaaaatatatgatctttcttttacaggaacaccagatgcattttcacaattactcacctgtccatattgtgatagaggctataaacgctttacctctctgaaagaacacattaaatatcgtcatgaaaagaatgaagataactttagttgctccctgtgcagttacacctttgcatacagaacccaacttgaacgtcacatgacatcacataaatcaggaagagatcaagtaagtgcaatgactgagagttcactaactttccagattttgacaactcagccctcaatggaaggcaaggattttaatatatttgaaagttaaaagaatgtactaaacagtgctatatctgcagccttataaaagtgaaaatgattatttatttgagttatctggtcattcctgagattaaaaaccacatatgaacgttactttagaggtaactcagtattttgttcaggtaagaccctttccatcttgacttaattattttgcttatgccataacagttaattcttcaagtttagaagatgttaaattgcattctattaaaatgttcagtgtaggaaaaataagtactgactatataaaccacattatactaaccaaattgacaagaaagtcaaattaaaaagtttaagtttctttgaaccagttactatttattctcagtataagctacgtggtttttttcccccgtagtaaagggagttgcctcctctaaaaatctaaagtttagatttttttattctgaagactcaatttttatatggtttattctacttctgtgtcactgtgccccagttttcagaagtataaaccaagactgttttgtaactataagttacatttaaattgctggttctatatttaggattaaagtcaaaaaagcttttatcagttgttcctcttttacaaggtcctcatagttatcagccatcaacaatgaaattaatattgccttaattctaactttaaaaattaaataaattttcagccacacagggtttatgagggtacatgttggggttaggccacatttccagtttcttacatcaaagaatgatgtatatctacatacctgaactctgccctatggatgtacctaatatgtgtcacatatcccatagagaacaagttagaccatttgctaaggtgatggctaggccaaacaaacaacaaaaaagaattgtaacagaaaaagaatgactgagcagagtcaacctatttccttagtactttggcaacagtactcatgaaataacaagataataagaagagggtggcaatcagggagaatagaaccaagattttataggtttatggtccataagcccatgaaggagcacttgaaacaggtgagagctccaagagaaggacgaaattaatacagagaagggacgactgaaggcaaactccgtctccttcctagtgcccctattaatgagtcttatcagagagaccagcagaagagtatgttttataccttagcgctgtgatgtggccacagtgtagacaaggcttgggaaagagcctactcacgtgacattcaggaagcagacccatcctgcagctgctgccaccatattccctctactccaagggccatcgtgaaaggagaggacagattgaactggtggcgaaagcagaagatgccattataaaaacaaactccaaaatctttgatgagcatgaaaaccaattctatgatgatttttccagtgggtgcaaatgtagtaggatttacatataaaccgtgggtcagactaaggtcaggaaggagctgtgataaatatggggaccagtaatgtgaggaaatataactgggaggtcttggaaacaatttagtttgcaaggcagcaaactaaaaggtagaatgtatattttgctggcccttgagaatcatactgtgactaacaagcattttcaagtcttattaacttgtttattcaacaaacatttgtgtttcttttatatgtgaggccctcttctgggtgttaaaggcacagtagtcaaaaaggaagtccctgatattagggaccatacattagtagattatataaaacagaaataaaataatacatactgtgaagaaaaatacagcaggataagaggatagaaagtgatgaaagctgctaggtttcacagagaagggagatttctctgagaatgggatatctgaatacagtgaaggagccagtcatggaatattggagaagggcattccagtcagaggaaacagtgaaacataagaaagccttgaggccagaacctgctgggcacacactgagaacagcagaggccagtgtgaaagggagaaaggtaaggccagagaggtgttgggggctacatattataggccaagataaagacgttggattgtattctaaagtgcagtggggatgcctgtcaaggatccaggaatttttaatttttatttttaggggaacactgactgttggatgatagataagagagacaagaacggaagcagggagatcatttagaggcttttgctgtaatctaggccagaggttttggtggcagacagataaataagattgttggcttcagaatatgttcatatgcttgctgatggattgggtgagggtacatgagtaagagggtaatcaagaataactccaaagtttaaggcctaagctataaccaaataaatgatagtgctattcacagagataggaaatactaaagacggagctggcttgcaggagggaaattaagagtttggtgttaatcatgttaagtttcagatctctatcaccttccaactggcaatatcaaataagcagttggttgtaaaagtctggagttaaggggagaggtttagagatacaaatgtgggagtcgccaccatatatttggtattttaagtcatgggttttagtgaagtaggacctgattcagagtaagtactaattctctttccttcctgtataaaaggcaaaggaagggagattccagctggaagagcatgaagcagtagttgagttaagccgttaaaggctgggtagaatcttagtagtcaaaattatgggaaaacacagtgaaggagtaaggaattatgtaaaccaaagccaaaagataaagaggagcaatatgtgtgcagaaaaccatggctcgctaaatgactgaggcatagacttgtcataaaaaactggtgaagaatcatcttggaaactcagggactataatcttggaatctgtagacttggaatctttattgaggggttaatggggatccttcagaagtttatgaggaggagttgatagaatgcaattcaagcagtgcttttgtaagattaatctaagtatgaagaatacatttgaaatatgtgaaaatgggaatttgataaaccagacagaaagctattataataatccacatttggctgaaaaaactggaagtatttttttaatcatcagattaaagtacattttggaaatatcaaatagaagagacaggataaagtacaggaaaaatcctgtcttctattcaggaccttgttctgttgagtgagctttagacaggttattcagtatttgtggatgcggtttctatatctataaattggaaagcaaacaagttaacctctagttcctagcaaagtatatattactttatttttactaattttgaatattgtttaataaaggatgaactctgatactttagaaagttggtatttttctgtatcaaattctgtccccactatcactatcctttttggtaataatttcaggagttacatttttgtgactgctacaactgctaataatttcaagagttagatttttgtgactgctgcaatttgaggtctttaagaaacaaaacaaaacaaccatcaggctcacaaaaatgtcactcttagtagattggatgttctttagtctaaagatcttttgcttttcaaataaaataccaattcttttcttacagagacatgtgacgcagtctgggtgtaatcgtaaattcaaatgcactgagtgtggaaaagctttcaaatacaaacatcacctaaaagagcacttaagaattcacagtggtaaatattttttttctttctataccctgaatatcatagcatatgtggtaataaataaatatcataacatgtaatctacgtacatgatcagaaactccttgcatttcttttggcatacactaattgggagaaattttatgtttattttatgttttattagagtcttaacctttgactaaagtatatcaaattaatatagtatgacatactccagatttcctaatcagaagataatatagcatgttttagtaagtacaacctgaaaacatattagctttctgatgaatgtaaatgtcattgcctcctttgcacaattagcaggggaatggaaaagagtatagagatacgatttgcacaagagaatagggaagtgaagacatcctttatttgagaaaagttgaaatggaactcaagattagaaaatattggagagctgatatagaggcaatgagagggagtgaaaggattacagcattaatgagaatctgaaagaaaaatgtgctcacccaccatcttcacctgtctattccatgtcattctgtaaattattacttacaaggttaatactattatgcgatgaaagtgttgtgtctattttaggaactcagagtaaacagagagctatatttgcatttctttggagacactacttgaacaaaagcgcaaaaggaaaacttgctggtatcccacaatgccctatgaaatctgttcatctcctgataaattttgatatgttattttagatttaaatcattttaatgaaaaaattattaaccatgaatgggaaattatgggttttcacacattgcttattttgtgaaaattatgtattgacatttacattttacaaacatcttcctacaaaaaaagtatagttggatagctttgtgaagcatagttgatgatatttatgttttattttggaactgcatttctaaaagttttactgtattgctcattaaggctaaccctcaatgttaaacgtgctgaagttaccacttgaaaatgctcaaaccaagatccttaccaaaacatttattttcacacattgattattgtttctaaaaagtagaggttgtcttttgcagcctgccacaatattctgtttcttagcttctatgctattgaacaatttttatcaataataatatattttaacaacctaccttcttaccagagatgatttaaagttgttaataaagatatagctaattcaagagggatttttaaatgttgaaatcagggcagaggaaggaaaataaagctaacagtaagattcatgtatataatgagtcatattcattttgtcatattgcagtcatggaagatttatcagatctataaataatacaaagttggaaagtataaatcagaacaaggattgaaatactggtctagaaataagaagttgaaagttaagcattggtatttaaaaatcagtctcaatcaagtagtaaatttgaatggcccagagcttaatatgagctgactgtatgctgatactgctcaaaagctaatgcaaatttaggccagatcatggaacacaaagctcccactgtactctgcactgtccactcattatgtatgtacttatttctgtcttgtttttaaaacatctaatgtgaggcttgtatacctttaacatagcaagtaattttaatttaaaaatatgtaggaaaaattaagaaacactaacatggagtaaattgttggggggacaaaatgaatgctgtgaaatgccatacatatgctggaagtggaccacaaattaagctctaaggtttaggaagaaaatgacaatcagtaaccaagacccagggtgtctgtaagtaaaaaaaaaaaaaaaaaaaaaaaaaaaaaatcagttgctagaaaaaggactattcttccttcctgataccaagtccatagaaaacgttattccttggaacaacataaagagaaaagaacaaaacagaagttatataatcctcagaaatatccttaaaataacacagcagagaatttgatagggtttcttttttaaatcagattattcaatagaagccagtcatagttcaccaaagtgctatttaggaaaagcattgctccagggtggccacgtagatacagtttaagtacacagctctctgatggtctggttgattccaagagaagatttttgagcaaaggctacccaaagtgacatctcaggactggtaccagtctgcaaaccctgtgttactcattcttgagataagtacagaaattgagagtaagcatttagcatttattataccaagactttgtgacattttactatattttataaaatattggtccacagtagattggaaacttaaaaaagaaccaaacaaagccaattggtcattcaccacaaatagtttgaaaagctcttcctagggtatctaataatggaagagctgaatatcttttaggaaacctccataactttcttttcacatgacttttgaaaagatgttgagaatcaggatccaaaattatactctctaaaattacctatattgttgctaaatactggtacccaaaaaattttgatcatgaccctatgcagaaccgtgtgtgttaataattagttgattctacctgtaggaattgagctatcatgaggaaaaggctaccagacctccactcagattagagacaaaagaacacctgcatatggctgtggtccacccccaaaaataattttccatggtcttagtaatttttgcctggaaaatttttgtatcagatgcagccaaacacccaccttagccattaaaaaaaaaaaaaagtcagtatacatagtataccgaactttgagtagtgaaacttcctgatgtaaccttcaggctaaaatacttgtaaaccctaacctccatagataaattagtgatatgcctaactaataaactgtaaagctatgaagctagaaacaaggagttttaaattaacaaatatagtgactttggctttagaataattgttgtgtaaactttctttctggcaatgataaaatatcaagataatttttaacaataataatgataactagcacttattggatccttagctatgtatagccacatgttagttatttgtatgcattaattcatatagtcctcaggataaccctatggagtaggttttattattttctactttttactgatgagaaaattgaggctcagagggcttaattaacttgtccaaggtcactcaggtagtacatggcaaagctagggctgtgatgtagtcatcctgacccaaagtcattcccttacgtaccatttctgtccccctgttttaaaaaatagtctgtatttatagatgtttatctttctagcgtctctagaaggaaaataagcatgtagttcatgtaaaaatgttatcaagtaattaaaagtgttaaaatagagatgtactagagtatattccttgttttacccccactggaaacttttgtctgttgtattttgagaattgaatcctattccaggcatcgcattggaaaaatattgataaattggagaatccccagaggtgggttaacaagcaggtaagggttctaaaacccacatcctgtgcagaatgtttgaaggacctaggtatatttaacctatataagagaagtttaagaatacatatagcagctcttgatccatttgaaggtttgacttgagaagaaaagttacacttgttctgtgtggcatcaggacaaactaggatagggaaataggcatcatagctatttttttggctcaaactcagcctgtctcttagtagaattgcctttttaaaaagtgactagcatttgttgagagcatactaagagttttgctatataatctcatatgacccctataacagtccaatgagaatgtatctgcatttgcacattgaaaaactaaggcttggacaggttaagaaaatactatgtgatggagccaggatttgaacccaaatccatggacctcaacagaaccagacaggaccatcttgtgcagggctgtccagcaggtcctaactccccttttattaaagaagctcaagcagagattagctggtgtcaagaatgatatgaaatgaactcttcattgaaaaggaggctgtactacaagggtttcttaaatctcttccaattcttatatatgattcttcaaataatcatatttattagaaaatataactcacatgtttaaactatagcattgaagttactattaagcaatttttagtagggcttaaattgattcctcactgctttcattttaattcttaaaaagagcaggagatggagagttttattttgatactaagtagacaaatcagtgtcatcacatctcatcattcaacaattagccattcactcatccaaaaaaggtttaatgagcatctttgcaacctgtactttgatgggtgcaagggataaatggcaaacaagcctcagaggctcctgccttactgaagcttatagtctgtaacctttaaattataaattagtgaactataacttaaaactcaaaggaaacattaggtttgtaggaaaatattacatttagctcggtgctttcaaaattttctaccaaagtatccctaacagccaaggagaataaatgccttttaccccacagagtctagggaagcagcttgagggaagcctctgcaagccaaaggctactttgacagtgcgtggcttttcctagcaagtcacacaaatgtgtttttctctgttttaatataaaaataatgttttatcatatccactgtcactaaaattgaaactccaaggtgctttgatacccactacagtgtttatcctgggagtatatacatttcagtttaataagccaatgcttatagaatatcttatataagttttcctcccattagggaaaaactattttcaagaaagccctatgggtacaggaattattattaatcaaagatagatattcatacttgttaagtcatatgggacattttacttatttttcttttctttaatatttctcctacagatggttgagtagagtaaaatatagaaaattatataggtcggtgaaatgggataagaaaaaacatacttgaaagagtagaatgtaattacttttgatacttgagaattatttgaagttataaagattggtggaaatattatacacatatgctgagaagattccatgattggttagcagaacatgtacctcagacttagttactagcgttcatcacatctatgtaggttttgaagctaaaaagtttattctaaatacagttctgtcacaagcatgcatggcagtcttctttttaaaattgataccgcttgttttagggaaatgaggatacataaaaatttatatgtaataattcagtgaatataatttgtttgtttgtttgtttaggagagaagccatatgaatgcccaaactgcaagaaacgcttttcccattctggctcctatagctcacacataagcagtaagaaatgtatcagcttgatacctgtgaatgggcgaccaagaacaggactcaagacatctcagtgttcttcaccgtctctttcagcatcaccaggcagtcccacacgaccacagatacggcaaaagatagagaataaaccccttcaagaacaactttctgttaaccaaattaaaactgaacctgtggattatgaattcaaacccatagtggttgcttcaggaatcaactgttcaacccctttacaaaatggggttttcactggtggtggcccattacaggcaaccagttctcctcagggcatggtgcaagctgttgttctgccaacagttggtttggtgtctcccataagtatcaatttaagtgatattcagaatgtacttaaagtggcggtagatggtaatgtaataaggcaagtgttggagaataatcaagccaatcttgcatccaaagaacaagaaacaatcaatgcttcacccatacaacaaggtggccattctgttatttcagccatcagtcttcctttggttgatcaagatggaacaaccaaaattatcatcaactacagtcttgagcagcctagccaacttcaagttgttcctcaaaatttaaaaaaagaaaatccagtcgctacaaacagttgtaaaagtgaaaagttaccagaagatcttactgttaagtctgagaaggacaaaagctttgaagggggggtgaatgatagcacttgtcttctgtgtgatgattgtccaggagatattaatgcacttccagaattaaagcactatgacctaaagcagcctactcagcctcctccactccctgcagcagaagctgagaagcctgagtcctctgtttcatcagctactggagatggcaatttgtctcctagtcagccacctttaaagaacctcttgtctctcctaaaagcatattatgctttgaatgcacaaccaagtgcagaagagctctcaaaaattgctgattcagtaaacctaccactggatgtagtaaaaaagtggtttgaaaagatgcaagctggacagatttcagtgcagtcttctgaaccatcttctcctgaaccaggcaaagtaaatatccctgccaagaacaatgatcagcctcaatctgcaaatgcaaatgaaccccaggacagcacagtaaatctacaaagtcctttgaagatgactaactccccagttttaccagtgggatcaaccaccaatggttccagaagtagtacaccatccccatcacctctaaacctttcctcatccagaaatacacagggttacttgtacacagctgagggtgcacaagaagagccacaagtagaacctcttgatctttcactaccaaagcaacagggagaattattagaaaggtcaactatcactagtgtttaccagaacagtgtttattctgtccaggaagaacccttgaacttgtcttgcgcaaaaaaggagccacaaaaggacagttgtgttacagactcagaaccagttgtaaatgtaatcccaccaagtgccaaccccataaatatcgctatacctacagtcactgcccagttacccacaatcgtggccattgctgaccagaacagtgttccatgcttaagagcgctagctgccaataagcaaacgattctgattccccaggtggcatacacctactcaactacggtcagccctgcagtccaagaaccacccttgaaagtgatccagccaaatggaaatcaggtaaaaaataacctccatcctgaacctggctagtaatatgctatttgactaatttcaattaactttgtctaataaatatcagtcccgtagagccaactagattattacaaactgtcatttttaaaaggatcaatgtttgctttaacttttctggcatgatgtcttcagttggttgtttgctaatccagggtattgttaccagcttaaagtttgaaatgctattctactgaaagatgatttttaagtcccagctaaaaacctgtttgaagttagaaatcaaaaaacaaaattgaaatactcgctaattgggtttctgtttttatagctaaattcctaaaattagtaatagtttctgccttgattatggtcattaattaatgaaaatatgttcccattcacaggttcataccaggcaaacttatctatcacttttatatactaatacatctgtttataaaaggttttaattaaataaacaggaatgaagtatacaaagaacgcatcttgtgaatttactgatcattttatgaactgtgcataaacagtgttcagtcataatgtatatgaggaagtgtggctgtgaacctaaaaatacatatgcattttcctccttaactatcacagtgtttaccacaacagtgtttattctgtccaggaagaacccttgaactggtcttaccccaaaatccacaatagttttggatagagctattgtatgcctcattgtccagactttttccatgtcactgatgttgatgttttcccattttttccatcaatttctgatggaatcaaatgaatactagagacaaatttgatattttatgcaaatattttctataagtataataatttcaatatcctgctcaaacttgtatttgctgcttttgttttcccttaaatattgctattgattgggtttcctgtaattgtgataactcttgaaaaaaagttcttacgtgatcattgaattcctctaaatttttagtgtacagaacactttgcatgcctttgaatagaaaaagagccatccttagcatttcatagactcacgtgtcacgtgactagatcaagtagcagtgaaagtagaatcaagttacttcagcaccagggccactcacaaatgacagggacaaatggctgcacctctcttgcctcatagagccataagaaatgttgtgaaaaaccttcaacttttagaaaatgtgtgggtttgaggcaatggcgtggaacactctagataaggtaggaagatcttaggggacccagttccacaacaggctccctgcagggttatttggcttacataagaacgtgctgcccaaaattatctccatgagactgcctggagtttctaaaggttcattttgattagcaattatttctgttaaaaagatagaccctcctgcattgtttttccatcttgctccttagacaagtggtagagcacacctctctcttttcaaggagaccgtggaggttaaagaaccctgaagttctggaggatacaattgaaagaccaggttttaaaaatagaatgttagcttttgcttagtgaaacccagaatgagaaaaatgaaggcaaaagatgcagttagtaatgagcgattaattagcaaactaataagttaaaaccttctgcaaatttctcgtaaagtaatgattcacatgaaactaggtaaactctgttactatatattttacatgctttcttttcggtgtccttgctttctttccagtaccagttgagtatatgtctttgctatggttttgactgtgttatccccaacctcactcttgtctttgtcatctccacctgtgatctggccccacccttggggcacatgtgcagtgaagatcagtgtgcttgctttggtcaagtccttgaaagtataaaagtataagttaaagtagttctttatctcatgcttttatgtatatctcttgtttatcttttaatgttaaattacattttctcacacctttctccctctaggatgaaagacaagatactagctcagaaggagtatcaaatgtagaggatcagaatgactctgattctacaccgcccaaaaagaaaatgcggaagacagaaaatggaatgtatgcttgtgatttgtgtgacaagatattccaaaagagtagttcattattgagacataaatatgaacacacaggtatgtcagtgaacacaaacataaagtgtccatgatatgatatactggaagatgcaaaattaaaaactaaagttttagaattttctttctttttttttttttttattttgttttgagacaaggtctggctctagtcacccaggctggagtgcagtggcacgcaatctcaatctcggctcactgcaacctccgcctcccgggctcaagccatcctttcatctcagcctcctgagtagctgggactataggcacataccaccacacctggccaattttgatatagacgggttttgccatgttgcccaggctggtcttgaactaatgagctcgagccatctacccacctcggcctcccaaagtgctggtattacaggcatgagccaccacgcttgacccagaattaattttcttattttttacttatctgatctggccattttcacctgtttgcccacttctacctagtacttaaggtctgtgcctttcttttggttttttgcttcatctgtttttttgtttttttcatgacttatttcctttaagctgacacagcatttattctgtccgcattcatttaatgcaagcttatgctatattaataaaaacatagtacatagtacccattaataaaaaatatgagaccagtgggctaaagtcatagggagacaggatctggcttcataaaagaaaaagctgcttcataagcatgcggcaagctgtcctggcaagtcaagatcttttgttttaagtaagaagttctgcctaagaggttggactagaagattctaagatcctgtaattctgagatcctgtaattctgccacaaaatatgcctccttaggttgactcagggatggcaaactatagctcacaggccaaatgtgagcatacgcatgtttttctatgaggtaagaatggtagtttttgattttgtttttacatttttaaatgattggaaaagatgaaaagaatatttatgactgatgaaaattatgtgaaagtcaaatatcagcatccgtaaataaaattagttggaagacagcatcgcctattcatttacattttgtctatgtcagctttcatgctgttctacaatggcaggattgagaagctactacagagaccatttggcctgcaaagcctttaatactcactaccctttacagaaaatagttgccaactcctggcctatttcattccttccatcagtgaagtactgataaattttaacacctggttctctgaagggtggggaagccctgatttgtagtgtttgcagctttttgtggcataaatactcccatcatggtggatttcgagcttgaatgtgatgtcagcttgcagaattcctgaaaatttagcagtagactctctccagccagtacaaactggctccagcacactcctgtgtctctctctaacatgggttgctgtagaaggggctgggtttatcctgagctctttaatcccctacctgctcttccctgcccccactaccagccattatgactacagtatccatatttatctttcatattcttaactgtttcagtgtattttttactcttgtgagaaaagatagaattgtttttccttcttcaatctgtggattcatacagtgacacttggaaggttcttggagctaaaaactggttacataagagaaagtcacacctctcaaaatcagccccttgtaactcagtcctctggttttcagagatctaagaagagttagaaaatccccttcctcttcaggcaaagttaaatattagcaaatatcaaagtgaaaaatatatatgaaaaactacactatttctaaaattaaaaatcatttctgcatttgttagtgttaactgcttgatagctctgaaattggacattatcgatcctgactatgatcagttgttgccagtccttttcatgtctgggcagcaacactcctgtagcccatgcgttctcaggaggggcaatattgccctcacgggccaaaacttgtttcttagggggcaaaaaagtctgagatactacaatggctgtggttttctaaagaagctcagtatatatactgtatatttatgagttttatcgtatataaaaagtgtatagtaaacattaaaatttcactgggagcagagcttgtgactaggaaaacaaaatgactaaaaagggaccttgtagtgataatgaacacaaggtgagcagcaagtctgtccctgtctgccctcactgtgctcgttcactaccagacatctcctcccagctgcacttggcccattttccacctcgctgtcatgatgcttgtatttttggcatttcaatgtcatgtagctcccattgacctaatcatctgcacagcagagtgtagagcactacgttttttaatgtaaagaacaaaccaaattgcaatattatattacaaagagtttgggacctggaaatgttttaaaaatgaaactaataaccctcccctttctacaacatgaagtaccccaaaaaccgtataaggattttatttgctgaataccaccattttatttaacagaattcttattttgcaggtaaaagacctcatgagtgtggaatctgtaaaaaggcatttaaacacaaacatcatttgattgaacacatgcgattacattctggagaaaagccctatcaatgtgacaaatgtggaaagcgcttctcacactctgggtcttattctcaacacatgaatcatcgctactcctactgtaagagagaagcggaagaacgtgacagcacagagcaggaagaggcagggcctgaaatcctctcgaatgagcacgtgggtgccagggcgtctccctcacagggcgactcggacgagagagagagtttgacaagggaagaggatgaagacagtgaaaaagaggaagaggaggaggataaagagatggaagaattgcaggaagaaaaagaatgtgaaaaaccacaaggggatgaggaagaggaggaggaggaggaagaagtggaagaagaagaggtagaagaggcagagaatgagggagaagaagcaaaaactgaaggtctgatgaaggatgacagggctgaaagtcaagcaagcagcttaggacaaaaagtaggcgagagtagtgagcaagtgtctgaagaaaagacaaatgaagcctaatcgtttttctagaaggaaaataaattctaattgataatgaatttcgttcaatattatccttgcttttcatggaaacacagtaacctgtatgctgtgattcctgttcactactgtgtaaagtaaaaactaaaaaaatacaaaatacaaaacacacacacacacacacacacacacacacacacacacacaaaataaatccgggtgtgcctgaacctcagacctagtaatttttcatgcagttttcaaagttaggaacaagtttgtaacatgcagcagattagaaaaccttaatgactcagagagcaacaatacaagaggttaaaggaagctgattaattagatatgcatctggcattgttttatcttatcagtattatcactcttatgttggtttattcttaagctgtacaattgggagaaattttataattttttattggtaaacatatgctaaatccgcttcagtattttattatgttttttaaaatgtgagaacttctgcactacaaaattcccttcacagagaagtataatgtagttccaacccgtgctaactaccttttataaattcagtctagaaggtagtaatttctaatatttagatgtcttagtagagcgtattatcatttaaagtgtattgttagccttaagaaagcagctgatagaagaactgaagtttcttactcacgtggtttaaaatggagttcaaaagattgccattgagttctgattgcagggactaacaatgttaatctgataaggacagcaaaatcatcagaatcagtgtttgtgattgtgtttgaatatgtggtaacatatgaaggatatgacatgaagctttgtatctcctttggccttaagcaagacctgtgtgctgtaagtgccatttctcagtattttcaaggctctaacccgccttcatccaatgtgtggcctacaataactagcatttgttgatttgtctcttgtatcaaaattcccaaataaaacttaaaaccactgactctgtcagagaaactgaaacactgggacatttcatccttcaattcctcggtattgattttatgttgattgattttcagaatttctctacagaaacgaaagggaaattttctaatctgctttatccatgtacttgcatttcagacatggacatgctattgttatttggctcataactgtttccaaatgttagttattatggacccaatttattaacaacattagctgatttttacctatcagtattattttatttcttttagtttatagatctgtgcaacatttttgtactgtatgtcttcaaacctggcagtattaatacccttcttactgacatatgtacttttagttttagaaaacttttatatttatgtgtcttatttttatatttctttatttattacacagtgtagtgtataatactgtagtttgtattaatacaataatatattttagtatgaaaatttggaaagttgataagatttaaagtagagatgcaattggttctcctgcattgagatttgatttaacagtgttatgttaacatttatacttgccttggactgtagaacagaacttaaatgggaatgtattagttttacaactacaatcaagtcattttacctttacccagtttttaatataaaacttaaattttgaaattcactgtgtgactaatagcatgatgctctgcagttttattaagaaatcagcctaaccatacaactctcatttccttagtaagccaaattaggattaacttctataaacagtgttgggaacaatgtttaacattttgtgccaatttgttcctgtattcatgtatgtaagttacagatctgactcttcatttttaagttccttgttacatcatggtcattttctagttttttaccagactcccatctcacaataaaatgcatcaacaagcctgaactgctgtcattcttttcatcattatcagtattttctttggaaaactgtgaaatggggtacattgtcatcctgcatttgattcatcttgagctgaatttgggtaacactaaatgttttagacattctccactaaattatggattttcttgtggctaaatgtttctggagaggtcagagttgacaaaacctcttcacaggttgctccttcttcctgaaatccttaatcctccgcatttcatgcttcaggtcatttcagggaagcctgggtttagatgcctttctgactctcagctcctgcacttctgtcatcatacctctgatactattatttatattccttccccactaggaacaggaaccacatttgtcatagtcactctcacattcctcactgcctaacagggtgcctggcataagttgggacaacagatatttgttgaataaaaatataatttgcatgtttatggagctcagctatgttctcactttttttgcttctaattccagaatatatgttaaatgatctaataatttgattattttcttataagtcttattaaacactagtcataatagacacaataaattatgccttctttttctattgccttactattttgattttttgaaagtgtatttctaggtgtcttcctggtgcttaacctcatggtatatggcacaggtattgctggcttgtggacatgactacctccaataggagcgataggactgatcctagtcagctctcctttgtagaattcacttccctttctaggaccccatattcgtaggtgctcgttaccatgttgcctgatttcccctgtcactgagagcagctaccaataaacagactgactgaaaaggattaggaactaagaataagatactcttcttaggaggtatccacaatgtaatataaagttcaatgagggcagtgcttgatatgtatggataaatgactaataaaggaatttaggcattaccagaacttttcagaaagaaaacgtacatggacctttcccagtattccctcatatgacatacaacaaaaataatagcagggccatatattatttattcatgccatgcacaggtatttcactactatcaaaatgttcacaaaagcctcataaaaaatacaaataaagacaatgtgcccatgaacacatacgtcttaagtagcagaatgaggatatgaacataggcttatctgagtccaaatccatgcttcttcttttttatttttttgaggcagggtcttgctctattgcctgggctgaagtatggtggtgtgaacatggctcactgcagcctcaaacctcctgggctcaagtgattctcccacctcagcctcctgagtagctaggacaacaggcatacaccaccacacctggctgtttgtttgtttgtttgtttgtttttgttggagagtcagggagtctcactgtttcccaggctggtcttgaactcctcggctggaggaatcctcctgccttggcctcccaaagtgctgggattataggctttagccactatgttcagcccgaaatccatgctcttacctagcctgtatcacatctcatgtgagaatagtttacagtatctcaatcttcgccttgaagtatatgaatggaaaatataagagcaatatacatttcatagcctggtggaaaagaatggatggggaatgagatttttcaaatctgtgtgcaaacttaaaaagaaccttgaaaaggatactattaaagtgcagtgattatgttgacatgaaaatgtagaacagatttcatctcatcctatcaatgggagaatatattaggacgttcaatatgtgaacattgtcctctgctctagctcacattctattcaacagtagcagaatacacacttttttcctaacacatgggacattcatgaagagggaccatattatgggccataagtcaactctcagatttaaaagaattgcaaataaagtattttatttgactacaaaagaatttattaaagtagaaatcagtaaatcaaatgtatctgaaaaatcccccaaattattggaaaattgacaccacattagcccagatgtggttaaaaataaattataaaatatgagctaaaggtaaatacaacatatcaaaacttgtagcttgcagcaaaagcaatgaatataagaaaatgtatagtattaaatgcttatattagaaaataataaaggattgaatcttatctaagcttccatcttaagaaatgaaacaaaacaaaattaaaccgaaaccaagcaggaaagaggaaataacaacaatagcacagaaaacaaaatagagtaaatcaatgaaatcagaatctatttttttaaagattagtaaaattgataaacctctaccaggatagatcaaggaaagaagaaaagagatacaaattactaataccaggactgagagaggcacatcattacagagcctataaagaaataataaggaaatattaatgaactttatgccagtaaatttggcaacttagatgaaaatgacatatttcttgactcaaactaccaacatccactcaagaagaaatagataacctaaatttctattatcaatggaaattacatttctagttaaaaatcttcccaaaaagaaaattcccagcccaaacaaattcactggtgaattctaccaaacatgtaaggaacataactgtacccattctacacaaactcatctataaaattgaagaggagaacacacttcccacttcacctgtaaagccagcattaacctaataccaaaaccagtcaataacgttacaagaaacaaatctacatacacattgatgttgctcataaacatggatacaaaaatttttaacaaaatttaggaaatcaatttggaccatatatcaaaaggaaaatagatcatgaccaagtgagatttatcctaggagtgcaagctttttaagcattcaaaaatcagttgcagatgcttcttcccaggggttaaagcccgacaaacccatcataagtttaaaataccatgtcaaaaatgcatttagtatgcctactgaacatcatagcctagcctaacctagcttaaacatgctcaaaacacttaattagcccacagttgggcaaaatcatttcacacaaatcctattttataagaacgtgttgaatgctggcaacgtagtacactgtggcatatcagtcgtttaccctcatgatcatgtggctgagtggaagctgcggctcactgctgctttgcaacatcacaagagtattgtactgcatattgctggcccaaaaaaatcagaattatggttaatcaaaaaatattttgatcaaaatatggttgctattgaatgtgtattgcttttgcaccatcataaagatgaaagatataaagtcaagtcgtcataaggcagggaccgtttgtagtgtaattcactatatttatagcataaaaagaaaaaacaatcatctcaataggtgtggaagaagcatctgacaaaattaaacaccaagccatagatgttctcagcaatccaggaattgaagggagttttctcaacctaataaagagcatcaacaaaatacctacagttaacatcatactcagtgtgtaggatctactgctctccccctaaaattaggaacaaggcaagaatatctgctctcacacctttattgaacattgtactggagatcccacccagggaaacatgacaaaaataaatgaaagaaatacacattggggaaaaaataagtaaaactttatttgcagatagtgtggctgtctgtgtagaaaacaaggaatttgcaaaaaactagaaaaggtaaatgtaaggttacaagatacacagccattatgcaaaaatcaatcatatactatctagtgataagaatggaaaacagaggaatttgcaaaaaactagaaaaggtgaatgtaaggttataagatacacagccattatgcaaaagtcaatcatattctatctagcaataagaatggaaatgttttaaatatcaaaagtataaaatacttatatttgataaaatatgggcaaagcctgtacactgaaaactacaaaatgttgctgggaagaaattaaagatgcaatgaaaattgagagatactctatgttcatggatcagaagactcaatatcattaagatgtcaattctccccaagatttattgactcagtgcaattgcactaaaaatctcagcaacgtatctgtagaaattgacaggctggttctacacttacatggaaatacaaaggacttcaagtaggcaaagcaattttgaaaaaaaaaagttggaggacttacactacctgatttctagagacatttttataaagctacagtaatcaagacaaagttgcattgggtgtgagaatagacacatagatcaagaaaacagaaataatagtagaaaagacacccacatatatataatcaattgatttttgccaaatgtttcaaggtataaatggtgacacaatcgtcctttctaaaagcaatgctgatattagatatctgtatgacattcgatatccatatgaacttgattcttaactcataccatatacaaaaattgtttcaaaatggattatagacctaaatataagagctaaaattataaaacctctagaggaaaataaattctttgtgatcttgagttagacaaaggtttcctagataagacactaaaagcatgaatcataaaattgttggattggacttcatcaaaatgtaaatctgttaagaagatgccgttaagaaaatcagaatgggatacacagatggggagaaaatatttgcaaaacatatgtgcatatacccaagagacgtttaaagcacgtctacacaacctatatatgaatgttcattgcagcactacttataatagccaaaaaatgtaaacaacccaaatccatcaattgatgaatagttaaaatgtagtgtatccatacaatggaatactatgcagccttaaaaaggaatgaaattcttgtacatgctacaacctagacgaatcctgaaaacattatgctaagtgaaagaaaccaatcacaagagtacgtattctattattcatttatatgaaatgtccaaaataggcaaatcgatatagacagaaagtagatgagtggctgcgtagtgctcgaggtggggagagaatggggagtgactgactactaatgggtatgagtttcttttgggggtgatgaaagtgttctaaattagattgtggtgatatctgcacaactctgtgaggatactaatccatgtaattatatattttaaggggttaactatggtatgtgaactgtatcttaataaagctgttaaaaatatgtgtttatacatgttgaatatataaagaatatctaaaaactcttacaactaaataaaaagaagaaaacactattttttaattgggcagaattttaaacagacgctttaccaaagaaagcattcaagagagaaataagcttatgaagagatgatcaacaccattagtcactaggaaaagacaaattaaaacatacactggcctgggtgcggtggctcacgcctgtaatcccaacactttgggaggccgaggcgggtggatcacgatgcccggagttcaagaccagcctggcaaatatggtgaaacccagtctctattaaaaatacaaaaattagctgggcgtggtggcaggcacctgtattcccagctactcaggaggctgaggcagagaactgcttgaacccaggaggcagaggttgcagtaagccgagatcacaccattgcattccagcctgggcaacagagcaagactccgtctcaaaaaaaaaaaaaaacaaaaacactgtgctatcactacacaaccaatagacaaaaaaaaaaaaaaaaaaaccactatgctatcactacacaaccgatagaatggctgaaatttaaaagactgtcagtaacaaacaccaaatgttggccaggatatagagcaactagaacttttgtacatggctggtaggaattcaaaatggtaaaatagtttgtcagtctcttattaaaaacccacatatttaacatacaacccaaaaatctcaccccctggtattcatccaagataaatgaaaacatatatccacctggagaattgtattaatatgttcacatcagttttagcagttttagtcataatagccaaactggagatagctcaaatgtctatcaaccagtgaatgaataaacaaattgcattacatccatgcaatggaataccacaacaataaataacaacaaatgacatggatgaatatcaaaaatagatatgccaagtataacatgatggtgtggtggctatatagatatacaaatttgtcaaaactaaacaaattagtgtgtttaaaaccatgtttttttgcctgcaggttatagctcaatagggctgatttttaaacacataggagaatgtattaagataaccaaaaaatgaattaaatccctgaagctataagaaagcaaaagttccaagctcaaacagaaatacaaatgcacttttacataaaaatcatctgattttattcaaaagaaggtaggtatgtcattctaaatttaagtcttggaaaaacatttttaactttaatctgttttataaataataattccatacaatgaattatctcatttagtgactttgctgtacatttcacaacttacctttgaaaactatcctttctgaaagctaagcatttgtgagtataacttgttgggatgttactttggctaagatagacattctaatgacatctgcttttagacattggatttttttttttggctaaagtagatttaattctatataatatctaaactatagaaaatgttatagtgcatcagaataacagaggtacataatttataatttggaggacagattatcctttttgatgtcaacctcacataaccctcatttcctttactaattaaaaacagaccaaaagtacttgttttatattctaagcataatagtaagcactcttttatgttctaataatacgttttgagctttgttgcccttttttgttcagtaactcatatttctgttattggattaggtttgcttttctttcagtcttagaatactagaaggtgggaagggagaaaatatcttcagtacaggcatcttcaaggcaaattacaagttatatgtttttaatcatctgtatcttcagaaaatgctgtgttcctctattgctgaaacctagacctgtgatgttgtcctcacgtcatctctgatccaaagattgtccagagcattaggtcagttctggagctagtccaaacctggcttacttgagggaaataattttcaaacttttgaaaaagagatggaaatccaatgtgtgaagcatgtacaatcagagctgttctggtggaagagaaggagacagggcagagcccaaacccagcagctcgtgttcgagaactgtttcctacagcaaacgttcctggggtgggggtggggtgttcactgagtttacaagtcctggagcttctccagacctgccctagactggcccaaatgtaagccaagatctgaacacccagactactgaggcaggcctggcaatgtatactggcttgacattcacctgagatggttatgcatttgaaaaagataggattttagaaatacagtgacttttagaaaatgctttcctcaagagtatagttaattttagatggtgatagcacataactcatttttaatattagaaactcaagaagtttttgctttccagatcttcaaaataaggaattatgactagaaaatgttcagggtcatcaatataaaatcaccagaaatcctatgaattatgcacaataatttcatctgacgaacatgattcccaatgtaaacaaatcatagagcttgtgtcagtattaactcgtgtaagttttcatcagtaattttatttttcacggacttaaatgaggggaaattttctgctccaacctacttctcagagatatactaaaatacatggcaagatctatgaaagtacgcttggaaaagtagacgaagaactctaaaaccatgtgtgtgcctgtgtgtgtctctatgcacacatatacacatgtgcttacacatacacaagtatacatcaacttattgttct

SEQ ID NO: 233 - DNA, 3494 bp, Homo sapiens
atcatggcggatggccccaggtgtaagcgcagaaagcaggcgaacccgcggcgcaataacgttacaaattataatactgtggtagaaacaaattcagattcagatgatgaagacaaactgcatattgtggaagaagaaagtgttacagatgcagctgactgtgaaggtgtaccagaggatgacctgccaacagaccagacagtgttaccagggaggagcagtgaaagagaagggaatgctaagaactgctgggaggatgacagaaaggaagggcaagaaatcctggggcctgaagctcaggcagatgaagcaggatgtacagtaaaagatgatgaatgcgagtcagatgcagaaaatgagcaaaaccatgatcctaatgttgaagagtttctacaacaacaagacactgctgtcatttttcctgaggcacctgaagaggaccagaggcagggcacaccagaagccagtggtcatgatgaaaatggaacaccagatgcattttcacaattactcacctgtccatattgtgatagaggctataaacgctttacctctctgaaagaacacattaaatatcgtcatgaaaagaatgaagataactttagttgctccctgtgcagttacacctttgcatacagaacccaacttgaacgtcacatgacatcacataaatcaggaagagatcaaagacatgtgacgcagtctgggtgtaatcgtaaattcaaatgcactgagtgtggaaaagctttcaaatacaaacatcacctaaaagagcacttaagaattcacagtggagagaagccatatgaatgcccaaactgcaagaaacgcttttcccattctggctcctatagctcacacataagcagtaagaaatgtatcagcttgatacctgtgaatgggcgaccaagaacaggactcaagacatctcagtgttcttcaccgtctctttcagcatcaccaggcagtcccacacgaccacagatacggcaaaagatagagaataaaccccttcaagaacaactttctgttaaccaaattaaaactgaacctgtggattatgaattcaaacccatagtggttgcttcaggaatcaactgttcaacccctttacaaaatggggttttcactggtggtggcccattacaggcaaccagttctcctcagggcatggtgcaagctgttgttctgccaacagttggtttggtgtctcccataagtatcaatttaagtgatattcagaatgtacttaaagtggcggtagatggtaatgtaataaggcaagtgttggagaataatcaagccaatcttgcatccaaagaacaagaaacaatcaatgcttcacccatacaacaaggtggccattctgttatttcagccatcagtcttcctttggttgatcaagatggaacaaccaaaattatcatcaactacagtcttgagcagcctagccaacttcaagttgttcctcaaaatttaaaaaaagaaaatccagtcgctacaaacagttgtaaaagtgaaaagttaccagaagatcttactgttaagtctgagaaggacaaaagctttgaagggggggtgaatgatagcacttgtcttctgtgtgatgattgtccaggagatattaatgcacttccagaattaaagcactatgacctaaagcagcctactcagcctcctccactccctgcagcagaagctgagaagcctgagtcctctgtttcatcagctactggagatggcaatttgtctcctagtcagccacctttaaagaacctcttgtctctcctaaaagcatattatgctttgaatgcacaaccaagtgcagaagagctctcaaaaattgctgattcagtaaacctaccactggatgtagtaaaaaagtggtttgaaaagatgcaagctggacagatttcagtgcagtcttctgaaccatcttctcctgaaccaggcaaagtaaatatccctgccaagaacaatgatcagcctcaatctgcaaatgcaaatgaaccccaggacagcacagtaaatctacaaagtcctttgaagatgactaactccccagttttaccagtgggatcaaccaccaatggttccagaagtagtacaccatccccatcacctctaaacctttcctcatccagaaatacacagggttacttgtacacagctgagggtgcacaagaagagccacaagtagaacctcttgatctttcactaccaaagcaacagggagaattattagaaaggtcaactatcactagtgtttaccagaacagtgtttattctgtccaggaagaacccttgaacttgtcttgcgcaaaaaaggagccacaaaaggacagttgtgttacagactcagaaccagttgtaaatgtaatcccaccaagtgccaaccccataaatatcgctatacctacagtcactgcccagttacccacaatcgtggccattgctgaccagaacagtgttccatgcttaagagcgctagctgccaataagcaaacgattctgattccccaggtggcatacacctactcaactacggtcagccctgcagtccaagaaccacccttgaaagtgatccagccaaatggaaatcaggatgaaagacaagatactagctcagaaggagtatcaaatgtagaggatcagaatgactctgattctacaccgcccaaaaagaaaatgcggaagacagaaaatggaatgtatgcttgtgatttgtgtgacaagatattccaaaagagtagttcattattgagacataaatatgaacacacaggtaaaagacctcatgagtgtggaatctgtaaaaaggcatttaaacacaaacatcatttgattgaacacatgcgattacattctggagaaaagccctatcaatgtgacaaatgtggaaagcgcttctcacactctgggtcttattctcaacacatgaatcatcgctactcctactgtaagagagaagcggaagaacgtgacagcacagagcaggaagaggcagggcctgaaatcctctcgaatgagcacgtgggtgccagggcgtctccctcacagggcgactcggacgagagagagagtttgacaagggaagaggatgaagacagtgaaaaagaggaagaggaggaggataaagagatggaagaattgcaggaagaaaaagaatgtgaaaaaccacaaggggatgaggaagaggaggaggaggaggaagaagtggaagaagaagaggtagaagaggcagagaatgagggagaagaagcaaaaactgaaggtctgatgaaggatgacagggctgaaagtcaagcaagcagcttaggacaaaaagtaggcgagagtagtgagcaagtgtctgaagaaaagacaaatgaagcctaatcgtttttctagaaggaaaataaattctaattgataatgaatttcgttcaatattatccttgcttttcatggaaacacagtaacctgtatgctgtgattcctgttcactactgtgt

SEQ ID NO: 234 - protein, 1125 aa, Homo sapiens
IMADGPRCKRRKQANPRRNNVTNYNTVVETNSDSDDEDKLHIVEEESVTDAADCEGVPEDDLPTDQTVLPGRSSEREGNAKNCWEDDRKEGQEILGPEAQADEAGCTVKDDECESDAENEQNHDPNVEEFLQQQDTAVIFPEAPEEDQRQGTPEASGHDENGTPDAFSQLLTCPYCDRGYKRFTSLKEHIKYRHEKNEDNFSCSLCSYTFAYRTQLERHMTSHKSGRDQRHVTQSGCNRKFKCTECGKAFKYKHHLKEHLRIHSGEKPYECPNCKKRFSHSGSYSSHISSKKCISLIPVNGRPRTGLKTSQCSSPSLSASPGSPTRPQIRQKIENKPLQEQLSVNQIKTEPVDYEFKPIVVASGINCSTPLQNGVFTGGGPLQATSSPQGMVQAVVLPTVGLVSPISINLSDIQNVLKVAVDGNVIRQVLENNQANLASKEQETINASPIQQGGHSVISAISLPLVDQDGTTKIIINYSLEQPSQLQVVPQNLKKENPVATNSCKSEKLPEDLTVKSEKDKSFEGGVNDSTCLLCDDCPGDINALPELKHYDLKQPTQPPPLPAAEAEKPESSVSSATGDGNLSPSQPPLKNLLSLLKAYYALNAQPSAEELSKIADSVNLPLDVVKKWFEKMQAGQISVQSSEPSSPEPGKVNIPAKNNDQPQSANANEPQDSTVNLQSPLKMTNSPVLPVGSTTNGSRSSTPSPSPLNLSSSRNTQGYLYTAEGAQEEPQVEPLDLSLPKQQGELLERSTITSVYQNSVYSVQEEPLNLSCAKKEPQKDSCVTDSEPVVNVIPPSANPINIAIPTVTAQLPTIVAIADQNSVPCLRALAANKQTILIPQVAYTYSTTVSPAVQEPPLKVIQPNGNQDERQDTSSEGVSNVEDQNDSDSTPPKKKMRKTENGMYACDLCDKIFQKSSSLLRHKYEHTGKRPHECGICKKAFKHKHHLIEHMRLHSGEKPYQCDKCGKRFSHSGSYSQHMNHRYSYCKREAEERDSTEQEEAGPEILSNEHVGARASPSQGDSDERESLTREEDEDSEKEEEEEDKEMEELQEEKECEKPQGDEEEEEEEEEVEEEEVEEAENEGEEAKTEGLMKDDRAESQASSLGQKVGESSEQVSEEKTNEA

SEQ ID NO: 235 - DNA, 91071 bp, Mus musculus
  misc_feature (1)...(91071): n = A,T,C or G
tgcaccaatttatcctacaggcatgtcactgttgagggtttcaaggttttcagtattgatgattgcttttctccagtagtgtgcagagtacctacctgccagtatctaaatgctagggtcagcatgatcttgtgtgagtcttgtacagttgtatataatgccttgtcatatctagaagacatagtttcacagcagttactcaccatctttagctcttaagatctttcctgttctctttctcttcatatctgagacttgggaatgggggtgtgatgcagatgttctgtttctgaatgagtactcttatcctgtatatgttaaattgtaatctttttaattaattgccatcaactttaaaaaggaacatctcaaaaggaaaaaagaaatgtctctgcatttttcttttaaagtgtagttgatcatgctctggtgggggaacacacatccataagtattgtgtgcagcacaaattggtcttgaagggtttttttttttcttttggtttttcaagacagggtttctctgtatagccctggctgtcctggaactcactctgtagagcaggctggcctggaactcagaaatccacttgcctctgcctcctgagtgctgggattaaaggtgtgtgtcaccacgcccggctcaagatttttttttcttttttttaagacacaaaactgggtgggtaggacaggaagggatggatctgggaatagttggggaagagaacgaatacaatcaaaattttcaactaataaaagagagagaaagatagaaaacaacttcttgagtgttgggggaatcattaatggatgagtataaagacatacttaggaaaaaacttaatactgtgtctatgtagcagaacaatattagtaggttttcttccgagtgtgacctatcaagccatcagttcttggcccagttaacaattccaagcatgaattgtcctgattaggccttaaatctagtcagaaagtattgattactagacaacataacatttttgccatttttgtactagtgagcatatcttgacaggaatcacagctgttttgaaaacttaacaacttttgtcttcattactctcagatctatatactattattattggtttgtttgtatttgtggtctaggtataaaagacactttttaactttacaattctgaaatctgtgtcatttgtgtgttaggttaacttatgcttgttgcaagcttcagtggaggagtctccagccacagttcctagtagaagtgtgactcatgtgtccctggtggctttgtgctttgacagaattgctacacaagttcgtatgaacaggtgaaaagatcttattaatttgagcaatgattgttggaagtgaaaagtcttgttctatcctaattattcataattattttatagaaacacttgggcaatattactgatactggtttagtttcattttaaacaatgtagtgaaatgtttttattggatgacatttaaatgttaaccattttgtacattttctgtttccattaagaggtgtggttgaagagactgcaaataatgtagatgctggtaaaacatcaaattttgatagatacgttcatgccagcaagatgcagcctcagtcatctgggtctcttaggtcaaatgctggagcagagaaaggcaaagagattgctgccaagttaaatatccatcgagtccatgggcaacttagaggtcttgacactacaggtaaacttcagacattttgtttctttgtcatttgtaaatgtgaaattttccaaaagagaacattttcctttgaacattgctgcaatttgatactatcaggaagagaaaagcacttcttcgtatggtgtactcatggtatttaactattctatattatgttctgtgcaaaatggaaagtaagttttaggactatctgtgttctaggtcattctaactgctgtgcctatctcagtgtttgtcttagagtttctgttgcctcaatgaaataccatgaccaaaaagcaaatttagggaagaaagggtttatttggcttatacttcacatcatagttcatcaccaaggaagcccggacaggaacttaagcaaggcaggaacctggaggtaggagctaatgtagaagccatggaggagtgctgcttaatagcttgctcttcatggtttgcctacagcacagtcttgtgggagcattttcttaataggttctctcttgtcaggtgactttagcttgtgtcaagttgttgtcattcagcacatgcttattttacctctttgtataataccacagcatcggacttgaggctttaacaaaggaaaattaatttttataattacccgcaaactgtagtcttaaaactgaggcaaagaacagtggtttgagttgtaaaaggtctgtagattgtagtggtgaccagcttgcacttatttattagatcataagcattacattatctaacttgaaacctaccagctggaataaaagctcattacaaacaaaagtccctatgaattcccatagtatatttgcataaaaatgcagaacacatgtagattttttgtttatacttgtttgagattctcagtttcatggcatttgatagccacagggagacgaggtcagttttctgagtgcagtactctgggctttctattgtgtatgccttcatatgggagtagactgcttacaaacttaaacacatttctcaccttatacccgcacttaaaactaagttcaagagatttaaagagaaatgcaaataattaagtaatcagaatgatttcagaaaatggaggttcattttactgcattgcatgagtaagcagtggattcatgtcaatgtctaataaatttcagttataaaaaatttcaatgttaagttgtctttcagtaaaagttaatactttttctaggaaataatgttttccctgaggccacataattaaaataattttattttgtaaatgatgaaagctttttaaaatactttgccagaagactgtattatttagacgtttgttgacagaattctttaatctttcaaaaaggaattgataaattcattgttaactctagaatcgtcttactacattggaggtagcattattttctttacatattttatttatttttctgccttttcagaataccaagatgcctttttaatacaactcatatattaacgtctgatttttggtttttttcttaaaaagattttcattgtgttctctcaataatagacattgggacctgtgccatcactgccattccctttgaaaagtccaaagttttatttactcttgaagaattagacgaatttacttttgtagatgagacagatcaacaagctatcccagatgtaacacggataggtcccagccaagaaaaatggggctggataatgtttgaatgtggacttgaaaatttaactataaaaggtaaacttttaactcctgagttctgctttggtggggatttaagtgtatttaacagtttttactttttttagagtttagagccttgccatataagaagtaaacatttcatgtgaattcttcctttaatgaaaactactgatttatacttgtttcttatataagacaaggggaggaaggaaagtctgatctggttatgagtaatactttaaagcaggaaagttgaatagttgtaagactttcaggcttaatcttacatgatacaataacttaaaatactagtagctctgtctccacaccttttacctgcaaagtcatacataactctcttagataaaggcaaagcctagtgaggaagaacatgatcttgatgaagttctatacagatattttagagtataacagtgaaacacatatctactttttttcctaacaagtggctccctttatttttataggaggaagacagtctggtgcagttttatataacagttttggaattatgggtaaaaatagtgtcacagaaaggggtggagtgctgacatccaataattcttctgattctcctactggcagtggctacaatactgatgtctctgatgataacctaccgtgtgaccgaaccagtccttcctctgacataaatggaaactcagtgtcagatgagcaagttggtgattttctaatgatactactagtttggaaatagagaactatgtactcaatttaaaatcaatttctagagcatatttccttgtcatttcctgttttagagttgtaacattttgttgactatagtatgattacagtatagttcctgaatgggtataagaatatatactaatggtgcacatttctgcccattatactagttagcataatattctgcatatgttatacacatagtaaacattggctaaataaatgaatttatagaatttaagaaaggtagggtgtgattagttaattttagaagtcattttatgcttataggtaatattttatataagttgtaaatgtttttataaatatctgcttattttagcatatcattttaaataatacttttttttttttttttttgagtcagggtttctctgtgtagccctggctgtcctggaactcactctgtagaccaggctggcctcaaactcagaaatccgcctgcctctgcctcccgagtgctgggatcaaaggcgtgcgccaccatgcccggctattcatttattattttattatggtagaatttaattgtgatgaatacggtaacagcaaagttatttaaaattgtgtattgttgagaagttgggccactaactttttggtgaccttggacaaacaatcaaaaatttagtgaatgtatgcacatctacacataaactcctgagagtaaacaataaaagcataagtgagcaccctttcattaagaaataaattgtgggtacctagtgctcatgattatacttacctctggactccatttcctgggggttatttatttttatttctctgtgtatgagagacagatgtgtatgtgggtatggagtatgccataccttacatgtggctgtaagcccttaccctaaccttgagacaggttcctctaatgccatataaaccaagttggctggtctttgaacattggagatcttctgttactacctcccatttccttgtaggtacacactgaaatacagactcatgttttgtgggtgatttggtttgggttgggttgggtttggtttcgggtttttatttttaatttttttacacttttattattttttgatagatttttttctaatttacatttcaaatgttgtcccctttcctggtttcccctctgaaaacctcctatctcctcccacttcccctgctcaccaacctactcactcccacttcctggccctggtattcccctacactggggcatcaagccttcacaggaccaatggcctctcctctcattgatgtccaacaaggccatcctcttctacatatgcagctggatccatgggtccctccatgtgtactctttggttggtgtttagtccctaggatctctggtggtactggttgtttcatattattgttcctcctatggggctgtaaatgcctttagctgcttggatcctttttctaattcctccattagggatcctgtgctcagtccgatggttggctgagagcatccacctctgtatttgtcaggcactggtaaagcctctccggagacaggtataacaggcttctgtcagcaagcacttgttggcatcctcaaaagtgtctcagtttggtgactatatatgggttgaattcccaggcctttccttcagtctctgctctatactttgtctctgtaactcctcccatggatattttgttccctcttctaagaaagaccaaagtatctacactttggtcttccctcttcttgagcttcatgtgttatgtaaatagtatcttggatattctgagcttctatgctaatatccacttacaagtgagtgcatatcatgtgtgttctttgtgattgggttacctcactcaggatgatattttctagttccatccatttgcctaagaatttcataaattcatcatttttaataactgagtagtaagtacgccattgtgtaaatgtaccatattttctgtatccattcctctgtcgaggaacttctgggttctttccagcttctagctattataaataaagatgctctgaacacaatggagcatgtgtccttgttatatgttggaaaatcttctgggtatatgcctaggagtggtatagctgggttctcaggtagtactatgtccaattttctgaggaactgccaaactgatttcgagagtggttgtatcaatttgcaatcccaccaacaatggaggagtgttcctctttctacacatccttgccggcatctgctgtcacctgagtttttgatcttagccattctaactggtgtgaggtggaatctcagggttgttttgatttgtatttcccttatggctaaagatgttgaacatttctttaggtgcttctcaaaaatttagtattcctcagttgaactgggttctgatgatgccaagtagtcttggtttctgttgcttatgttcttgtgcttgccttttaccatctgtttatctgtggtgttagctggtcttgctatctctgactttgacttgtccttcctgcaagcctgtgtgtcagtattcctgggggaaccagttctctcttggaggaactagggtatggagaactgtggtacagggtcagctctggggagcagatagagaccagaaggatcctgtccccagctgatcttggttcttgtgtcctggtggatctgtgagggtccctcttgggccaggaatttggagaaaagtggtggtcttacctgttctggcaggtgtgtgtcactcctgggagaccagctctctcctgacagtatttgtgtatgtagctctgtggcacaggatcagctctgggtgcagatggaaactggatgactcctgtcccaggcagtcccttgcttcctgtgtctgagggttctgggtgggttcctctgagcagcagtggtaatcttacctgtgctctcaggcctgtccgcactcctgggagacttgctccctccaggcgctattttgatatggtttttgtttgtttgtttgtttttaatgtggcttctgttgatataaactcaggttgtcaggtttactgggcaagtgcttttactcactgagccatctccacattccctaggaatttatttggtgtatatttggagagtttatcaatttccataatagtctaatggcccagcaggtagaagcaattgctaggtgtccagtctggcaaccagagtttgatctcttgaatccttgtaatagtagtaggagaaaactgactccacaaaggtcttctctgatccccatatataccccatggtactcttacaaccacacttacacatcatgttcacatatccccacaataatcataaataaaattttaagttaatcagtttcattattctttaaaagtgtttggagggttccattagaattttaatgaagggaattaatgtggctatgcactaaacaattattttagtattcttccttaccttttgaaaaactacagaatatttcttaaagatttatttttattttatgtggaggagtgttttacctgcatttgcttctgtacatcatgtatctgcctcgctggatctccaccatgttggggctgggaattgctctctggcctcacattacagaattataagagcctttctcccagatcttttgctccttggattttgtaacaatttatccaggctctgtgttattttttttttccattttttttttttacccaattgtttttcctcaaacatgggtattccctggaagttatattcatgacactaatttccttcactctctgatattttcattatatagtgatactttcctgtgcctcttttacaaaatttatgaatcatgacattaagtgtgccatggccccagagacgagtcagcctgcagttacttgcttgaccatgaatgttgctgcagtaataatgtattagtctccctctttttttcaaaagtcaaattctacatctttatatatctaagttcttggcctatagtttcttgagaaatcaatgtttcaaatttatttattatgttttatgatactgaggattaaactcaggaccttacaacatgctgtgcgagaactagctctacctccccagctatattgattggttttattgttgctggtttgttttggttctgtttttttttttctcattaatttgtttatccacttaacatcctgatcatagccccattacctcctctcctcccagccccatcttcataagtccttccccccatcatcccttttccttctcctcagagaaggagaagtccttcttgtctacctctctgccctgggacatcaagttccagcggaactaagtgcatcttctcccacaaggcagttagactagggggaggggatccagtggcaggcaacagaattagagacagcctctgttctaattgttaagggacccacacgaagaccaagctgtacatctgctttatatatgtagagggcctaggactagccccggcactctctttggttggtggttcagtctctgtgagtctctattaatctaagtcattaggtttggcagcaaggcagtaaatacctttccttgctgagccatcttactggactccaaatactttactttgaaaaaaccaaaagctaaacctgtagtgttagataatcaggatcctaaaacagggggaatctcttaaaagcccaggaggtcaatactagtctaggcaacatagcaaagttttctcttttaaaacagaaacaatgcatctgaaaaacttgtgtaaggctaaggacatcatcaataggacaaaatggcaatctacacaatgggaaaagatattcaccaacccttcatccattcagaggatgaatatccaatagatacaaagaaatcaagaagttagactacaaaaaaccaaataacccaattaaaaatggggtacagagctaaacagaattctcaacagaggaatctctaatggctgaaaagcacataaagaaatattcaaagtccttaatcatcagggaaatacaaatcaaagtaactcttgagattctgtctcatttcagtcagatggatagtataaaacaattcaagtgacatcacatgctggtgaggatgtggaataggagaaacactcctacattgcttgtgggaatgcaaacctctatagctattttaagcaacatccacaggtcaaggttctatgtaaggagcagtctgctaagcctgatgaatgaaaaggttttgtgcttaaagtgctaataagtctgtctgactggttctggaggatcaatattggttttggcttttttatataggatgaaggagttgaatctgatgatttgaaaaaagatctacctctaatgccaccacctccagattcatgtagcatgaagttgactattaaagagatttggtttagttttgcagctcccaccaatgtgagatctcctgcacatgcattttctaggtaagaaatttcaaagtgtaattttgtccattgacagttcctccatgtttcagacagcttaccgttctgttctgagtacttcctgaattatttttctggcatatctaataccatatgagtgatagaatggctattcttactatctttctcatcgaatattttctatagatactatatttctctatttagcccaatttctttcctaggattttggctgtatttgctcagcttgctgccttagacttttgttttatttttcacttcaaacaagtttcccgctaattcatttccaagtattaattttttatttagatgttgataatttgtcagtgaccaaaagggaaaaatattgtcaggataaaatagcatttagtgctagatatataaagtttaatcttaacacttgtttttgtgtgtgtgtgtgtgtgttttaaaggcagctaaacctcttaagcactgcaaccccagctgttggagcatggctggttcctattgatcaactcaagtcatccttaaacaaattagagactgagggaaccttgcgaatttgtgctgttatgggatgcataatgacagaagcattagaggtatgtcttttaatcatataaggtatcagatatactttgttactgtgaattattcattactattagtagttgttggaagttactagaactacaagttcctaattactaaatatctttgactatagaaatttttatacatataattctaagtctttttgtttggttttcagaataaaagtgtacattttcctctaagaagtaaatacaatagacttacaaaagttgctcgctttcttcaagaaaatccttcttgtttattatgtaatattctacaccactacctgcaccaagcaaattactccatcattgatgatgccacgatggtgagtgttcaaggaagctgctattctgtggaaatagtactagatgggcatattgagaaatggttagaaatacaggttagtgaatgccattttgctctgactgacagcttgtatatagaagctgtcgacatggataaaatttctcagcttgataggtttaatgagaaattgtcaaagatgaaattttgaaaagttccaaacttcaagaaggttagagaggttgtgtaaagctaaattgagtgctcagaaggaaagtaaagacctagaactgaaaggttgtattctagaagctaaaagcatacattttaagtcaggaagtaatccctagaaccattatggtttaataaaatagagattaatcacagagggaacgtacataattgtacgattcatccccgctcatagaaaatcaatttgtgattgtggttttagaattttgaggacattgcttgatttctcctagcttccaaatagtagagcatacacaacaatatttatccaaattaggcacctgtgtatcagtattattaatggctgtccaaacctttcactaggcaagtgaatctatattaaatagtgggttttacaaagatgtttttatctaagactgaaatagtattttgtactatcctggaattgatcacaaagttgcactatgtgagcctgacatgctcatcctagttgtggtcagagaaactagtacagaggaatttgaaagcattagccatgtgtggatggatgctctacataccaagagaggaagccagaggctgtgaaggtagtggtcttgctctttaataactgcccatatacagattaatcaggtctcgccaaaatggctgtaatgaattttaagaccactgtcctccatgatcttcactagattgcctcttaaaataaccctccctttcaaacatttccacactgagaaccaaacttttaaagtacatgaacccttgagggacattctaaatatatgcgtagctgtagcaggttttgttgtcaacttgaaaatctgggtaacattgaacaaattaaagatctaaatttttgttccttcatctctaagtgggcattttgagattaaatttagttcttcattgttattacagagtgatggtcttcctgcactggtaactttaaagaaaggattggttgctttggcacggcagtggatgaagttcattgtggtaacacctgcctttaaaggagttagcttacacagaccagctcagcccctgaaacctccagctactgtggaccaggagcatgaagagggacttggcctggataatggaggtggtctacaaagtgatactagtgctgatggtgcagaatttgagtttgatgcaggtaacttttgttcagggagcttttctttcctcagtgtaaacactctgtgttcttgtagaaatgacttcacatcaataatatgcctctttaaaagataccaaccaagaccttttgcctgtaattattagaaaattagtaataggaaaatattctgactattatatacttgatcacatggtactcaataattttaataatttttgtccctaatttgaaaatgttgtggttgaactatgcagttgtgaattttattaatccaaattcacagtgactttggaatttttttactgaacaaattttataatttagttttgtgagatacagtaaaccaacgaatgtatcaaatagcgatatcttttatagaaaactttaaacaaaaacctgccttttaaaatttgtatttgcttattagtctgtttttaaaggagttttcttttatcacctgtgtcgtggtaaatctccaacccaaatatgccccggcaatgaaaacacaactcaattaatatgaatacatgctgtgcgcctagattgggcagatctaccactatactaccatcttccccatctatgggaccccttagaacttgaggtttctccaggccttgtgcttctgctctgcttttctccttcttcctcctcctcctctgcatcctctccctcttccattttttccttctttctttccacctctgctccacctcctctttatctgccccattatcagctcttctttattttacaaattaagggggggaagcaggtttacaggaaatcacctgagtgctgactcattcctagttgcaacccttcaccagagagtggaattaacatcaaatataattagccccaaggctatccacaacacacctgtttctggaaatatttaaaaaatgaacccaccaactctcagcaggaccaggccatgcacctgcactcctgctgcaaatactctctagagctagcccctgtgccaggtgatcttacttgctcagtctctgcccaccaactcgccaaccctgcaaggccacatggctcccactgggcctccattctggttctctttctcctcctgagacctctctctctgtctcctcaactcctcactctgcctaatgtgattgaacaggaaaaatcctgcaacaaccacttgttacatatatttttactttaaataaatttggaggcctgagctgagaatacaattgtatatataggatatgttgcatctgaacaaggtagatatacttttttaaaataaatgtatgtttttactttaactttttgccaaagactaatttagtattatgatgataagttgtcttacagtgcagaaaattcctaaaattaaagcttctagaacacttatttagcttaattaaaacatacttttaataaatggtttataagaaatagcctgagttttattgcttattatctagaatttgttatgcacagaggttgaattagttcagtgactataccttctaaacaccaatggtgcctgtgttcatttctgacactctgaatattctagatggtgactgaattggttgttggccactaccagttacatggctagtgtaaactcatactcaggttggatagtaaggaaacaaaaaattaaaaatcataaactgtatatctgtttagattatgaaaatgtatagtaattttacagacaagaatgttggtgatgtttaagatgaatatgtgatcatatgtgtataattcatttatcttttgaacctttacagccacagtcagtgaacatacaatgctgctagaaggaacagctaaccgaccaccccctgggagctctgggcctgtcactggagctgaaataatgaggaagctttctaaaactcacacccatagtgactctgcattaaaaataaaggtatggcattgctagcactgattagagcttaaaacttaaagagctgacctaccttttttttttttttttaatttcagtgttaaaaatcttagatgtctattctaaatattccagtagtttgttagaattaataactttatgatgcttaataacttcagtgtatagatttccattaaatttgtaccattaatacttaatatttaaagaccactaaacttttttttgtttttttttctagttatctccgaaacctttttttcttattgaatcttacatgtaataaagttcagggttgaaaatgttgataatcttgtcatttaagttctagtaagaagccgtttaggctacacattattgatacaagtttaggttgagtttttacaaattataatcttaatttatactccattgttttaacaagtttaaaggattcttgataagaaggaaagcagagccaagtaagtagactagcattgggagcagtatcctcactagaatcctgccctgtaacttggacattttctgacagaattatgcaccagctcctttatttataaggtgtggactttgatagcgtcctcctttggaagattgtggtgagaaataactgagtgaagacatgataagtttatctgacacttgtattgttttgctttattgttgctgttgttagtttgctattctaagaactgaatacgagttaatagtattactttcactcaaagtctgcatatagacttacactggaatttagaataatttcgacattaaaatttaaaatttctgggggctggatacatggcttagtggctaagagcactgactgctcttccagaggtcctgagttcaattctcagcaaccacatggtggctcacaaccatctataatgggatctgatgctctcttctggagtatctgaggacagctatagtgtactcatatacataaaataaataaatcattaaaaaatttgaaaattcaaaatgaaaattataaccaaaaacacatgaaaagggctaatatatctcaaacaactacaaaagcatttttaatcactaagaaaaagataaaatataaaaaggaaaagttttaaaaatagataaaattattaaatatgtcacagaaaaatatgtatacaaatatgaagatgtattctctcataaggaaatataaaataaattgatgtttttatttttataagattagggtaacaaaacttgatattacatatgaagataaaagaaaacagtcattctcatacaatattagaatattgttgtatgacagaatttttcttgcagagatactacactcatctacttacccccaaatagagaactcctgataggccaaagtatagatagatatcgccagaattcaacttggtgaaccagtgagttttattggggttatgtacagcagtaggaatggaaagtttcaatctaggaggaaactgttacataagaagtttacatggttttgaaggatcagtgtggccctaaagtataagtgaaaacatttacatgtcaaggactttcattctggaaggaactgtaaatgatcagatagattctagagctttcttgcaaaaaatagtggatgtgacataaaagaattaaacattacagggccaataaattatgtacactgttataattaactactatatagtctttccaaaaaggggttggtttatgtgagactatagatgccactggagttacatggattgagttaatagcaaaatataggggtgtttgtgttatgtttctactgttgtgtagaaacaccttgaccaaggcaacttattaaacaaaatttaaatggaagcttccatagaatttcgggtgattatatttgtgccatcattgtggtaagcatgggagcagacaggtaggcgtggcaatggagtagtagctgagagcttacttgtcaagacaatcaggaggcagaaagaagagatattactgggaatgttatagcttttgaaacctcaaagccacacctcctccaacaagtccacacctcttaatttttcacaaacagttccaccaactgcaggaacaagcatccaaacataggagcctattgggggccattcacattcaaaccaccactgtgtttgcttttataacacaaataatataggaatatgagaaactagaaaattcttggggaaaatgatctagaagattagaacataggacttcctattgaagtttcttatgcttttaacgtttttattttgtgtacataatgcctttcaaattaaagtgtattttagtttttcgtcttagtattgtattttggctttataattttttttttttttacatttgatacccaacaatcctagtagacaaaaagcactgtgagtttaaaggatagaatagggtaagtatttatataaataaatggtactaagtgttattaagtgctagaagtgtgaacattctagtttcgtttttgttgctatgacagatactcataaagcagcacagggaagcacaggttttatcatgttatatagctcatcatttatggaaagtcaagttaggaactcaagtagctagtcatatcatattgatagtcaaaggagactatttgctctcagctgtgtcctcttttatactgtgcaggacccctttcccagggagtggtacccacatctgtaagcagttaaaacaatcttccaaagacatggccataggctaattcagtattgacagttccacattagactatctccccagtgactcttggctgtgtcaagaccggtgacagtcaaaaccagtgagcaaagatagtctaatatcaagaattgtggagtggaagtaaggcatatggattaaaacgtctgacttttcttgcttggttatttataaaactgatttttcttttgtgaaataaacttaatcatctacacaaagaacatatcagggataagatatgaaatgtgcataacacatgtgtagtatgttaaaagttctctttcttcctatagtgaaaggcttcttcctcttccccatctaagtgaaagcatgtaaacgtgaatggacctcccactttgtcctaaaacttcagtggtctaatgcactcaagtccttgtgtacttgtccttgcttagtttcttgtccttagtcagaaagcctctagtttcctttctgttggttgtctatgcctacctccaataaaaagacatacttccttctttagatttgctctgtgttttttatgtttcttttttttgtttattttggtgaaggtcttgcatctccttggctggtctagaatttactggtagattatgctggtcttgaactcatggtggtgctcttgcctcatcctcctgtttgctgagattgtgttcaatgccattgtatctgacctggtagtgataacttccttttgatgttgtcagtcatgtaacaagtgattcttagttttaaatggagtagttgtatagggaaattgtttttggatatcaatttgctgattccataattaagccataacagaaattgcttcaggctacttcttattctttaaatagccataaacatgttctttaaacacctcatgacttgcttacatcctggtgccgtggatacccaccctcctaccactgatattaaccagcatttatttcctatattctgcttaagatgctgttctatgacttgtttagctgtagaaattaatgattcattgttaaattacttcaaggaatatacttgaatatgatgtgttgcccttagtattgtattacagagttataaaaaattattgtttttacatttgacttaataatcctagtagccaaaatcgctgtgagtattaaaagatagaatagcagaaataggaacaattatggtggttgtaattattagcagtcagtttcactacttcagaaaaaaccaactgtgtgttcattttgtagggcattcacccatatcattctctgagttataccagtggggacactgctactgattctccagtacatgttggacgtgctgggatgccggtaaaggagagtccaaggaaggagagccttctcagctatctgactggaagcttcccaagcctgcacaactttctggaaggcactcctcagagaagtagtgcagctgtgaaaagtagctccctcacaagaacaggtacctagcccagtggatccaacacactcctctggactacaagcaactgcacttcctcacatatatacaaacacacacatacaatttaaaataaaatgcttctttcagttacattttcttttgtgggaaaaatagaaaaccagtttattatatactttggttgcatgactaatccttttacttactttgtttttgaaaaattattttagaacaaaattgtaaatttctcttcatgccttttatttttattttcaaattagtgctgactagtgccaagctacacattctgagtctaaagaatgcagaatcttcactattgtgataacaaaatgaattttgtactaatgtcttaggatccccatgccaatatcatgagagtttaaaaatacatggagagatggcttagtaattaagagtactagctgctcttgaagaggatctgggttcagttcccagcaccatcatagctactgacaaccatctgtaactccagttccagaggatccagattcctcctctggcccccacaggcatggcatacactttgtacacaggcaaactcgggtgaagcacctgtatatataaaataagaataaatgaatctttaaagtttttttcaaagagagacattttaatccaactttctgaaagtatgcaagtagcatttttctgttttatagtatataataatcttattcaccataaactttttttcagggaatacagtagccactgacatgctgtctgaacatcctttgttatctgagccatcatctgtgagtttttataattggatgtcaaatgctgtgggaaatcgtggaagtgtggtacaggaatctcctgttacaaagtcaggacataacagtcttccaacaggtaatacagttatcattttcatattaaccgtcttcagtcgtacatacagttacagcaaaaccttgttcctcaaaggataactagacggtcagctgttaggatgaagttggaccgtttcagcaaaaagctaattaaactttgacttggtgttattataatatcaaatacaagatttaacgaatttaaagcatttaatgtggttggttaaacattcataacacaaaaggaggcaggttaaaaaacattaagtatagttacaacatgatatacctacaatacaggaaaatatcttgaatctgtctagttccctctgagacatcataactattaattatatactctttgtagttacttaaatatttaatcagatctatggggatagaaaagtaagatttctttccttaaggagagaaataaattagggccatttattaattttaaaagatcatgcatgtataaaaatatttggcaagatgttccccaagaaagtggtggctgtatcaagtgtaagtatatcaaccttcctttgcctatttttgaagtttttccatgttagtaaatattgaagaatattgaagtagactttggtactgattaataaaggcagctaaaatgaattttcgatgctgtttaagccatatgagttatttcccgatggaatgagaagagtggttgatttgtgactgcccactgggttgtttctcgtgtgggtgtgatctgaattctaaccacatgttaggtttctgcattgactcttgacagaagaaaatagaaagatggcatcgcacagttcttggttctgatttcactgttgttcagagtggctatagtttaaattttaagacaacttcagtggactagttcctctctatcaagggtcctttgtctggaaggacaggatataaagcttggatgtaattctgttaacaccatggccttttcctgctgtacttccttttcaaagattttccagtcagaaaattctacattttggattggctggcttgaattcctgtataaacatcatgggtattttctgaatatttaatgtcattttttattagtcacatctgtaaatatttagtattccatattattgggttgggtttttgtttgtttgtttgttttgtttttcctctgttgtctggtaagggcattacaacgtagttgcttttaaatttgacttgatatgcgtttgtttggttttttgtttctaaatgattcatatttactcttaacattttgctgttaggagttgcacccaatcttcctacaatcccgtcagcttcagatttcaacaccgtcttatctagtgaccagaatactctggatgggacacattctcagcacagtactagtcaagatgatgtggcaggtgtagaagaagcaaaccaagggtttcctgctgttcagctagctgatgcacaggtgagtgtgcctgggtttcctgagactggttccttcagcagtaggtacctgaggttcaagtgaaatctctattctctgtttgttggaaaaactttcatgcaaaaataggagagcctttagaagcaaattacccaataggttatcattaattgaaagtttcatcatcatatttttgttatggggagtgggggtgggtgggtatgggggacttttggtatagcattggaaatgtaaatgagctaaatacctaataaaaaatggaaaggaaaaaaaaattgaccatgatatgtttaacaagttaaattttatcatattctacagactcttgtacagtgttaagaatttattaagtgagtagttgggagacagtggatttagaataaagaaagtaattcaaacatgtagatatctatgagtagcagtgtcttaaaggactagaaggagaaagtagatgtgaaatgtgaactgttgatgtagttcataccagtgagcatgaaatctaggaaaagttgttgtttgcaaaaatataggacagatactgtgaaattatttggaatatatttaagtttgaatgaatagaaggtaagctggagaatggggtatgggggataaccagggttttaaatgtggacatcggaaagctgtgcatacacaactggataagaaaattgttatatttcccccagttgtttcttccctttatataataatagaacagaacatttcatccctttcccataaacaagtttctgataaacaagttttacagaaacaaaggcagctgttaatacctcacagcctattttcctctatcctattcttcttttagttaagtaagtaattaattttttaacatcttgaccttgaccacaagtttttcctccctcctttccttctaatcctaccaagcccctacctcccccatccactcattcctcttgtcttcaaaaatgggtaggcctttcatggatatcagtcagccatggagtgtcaagttgcagtaagattaggcacctctcctattaaggttggataaaacaactcagtgggttgataggggccccaaaacaggccatcaagtcccggtccaccctctgactgttccacttccatacctcctacctgtacccctgtctccacaagaatgtccccatagccccatcacctaccccaccaaacctccagactccctggggcctccaatctcttgagggttagatgcatcttctctgacggaaccaagagccagcaatcctctcctgtatatgtgttggggcctcatatcagctggtgtatgctacctggttggtggtccagtgtctgggagatctcggtgtccaggttaattgagattgctggtcttcctacagggttgccctcctcctcagcttcttccagcttttccccaattcaaccacaggggtcagcaccttctgtccattagttgggtgtaaatatctgcatgagaatctttcagctgcttattgggtctttcggagggcagtcatgataggacacattttgtgagtgctccatagcctcagtaatagtgtcaggtcttggggcttccccttgagctggatcccactttggacctgcctctggggcttcttttcctcaggctcctctccatttccatccttgcagttctttcagacaggaacaattacgggtcagagtgttgactgtggggtagcaatcccatccctcacttgatgccctgcctttctcctagaggtaggctcgacaagtttcctcttcccactgtagggcatttcatttaaggtccctccctttgagtcctgagagtctcacctcccaggtctctggtacattctggagggtgcccctaacctcctacctcccaaggttgcctgtttccattctttctactggccctcaggccttcagtccttttccccacacccaataccagatcatgtgtcccccgtcccccctcctcccatcccaagtctccttttccttccaggttctctccccagttgtggttgctttcttctctctagtgagactgagatgttctcacttgggcccttcagcttgttgaactttttggtttggtttggtttggtttggtttttgttgttgttgttgtttgagacaacaaaacagggtttctctgtatagccttggctgtcctggaactcactctgtagaccaggctgacctcgaactcaataatctgccttcgagattaaaggcgtgtgccaccaccacccggcttgttgacctttttgaatcctgtggactataccttgggtattctgttgctgtctgaagttctctgttgctggctggcagcagcaggagcggagaagcatgtttcctgccccatagagaattagcgggtttgtttgtttgtttgtttttaattatttacagcaacatttgtggctatttgtgaatggagttgtttccctactttctttctcaacctgtttatcatttgtacaaaggaagactactgatttatttgagttagttttatatccacccactgtgctgaagttgtttatcagctagagaagttatctggtagaactttggggttgcttatgtatactatcatatcatctgcaaataatgacacctttatttcttctttgccaattggtattcccttgatgtctttttgttgtcttgttctagctagcaggggtactatattaacaggggtacactgttgtcttgttctagctagctagtactatattgaatagatatggggagagtgggtatccttgtcccgtttttagtgggattgcttttattatggttaggtatggtccttgacttcttgatctctacagtacttttaaaatgaagggctgttgtattttctcaaatgctttttctgcatctaagaagatgatcatgtgatgttttctttgagtttgtttctatagtggattatgttaatggatttttatatattgaatcaaccctgcatccctaggataaagcttacttggtcgtggtgaatgatggttttgatgtgttcttggattcactttgcaagaattttattgaatatttttacatcgatattttatgcaagattggtctgaagttctcttttttggttggtttcttgtgtagtttaggtatcagagtaattgtggatttacagaatgaattgggtttctgtttctattttatgcaatagtttgaggaatattggtatcaggtcttctttgaaggtctggtagaattctgtactaaatccatctggccctgggcttttttggtaggaaggtttttaatgacttcttctatttccttatgggatatggacctgtttagatagtttagcttgtaggacccccgatatggggacccccactctagtccagggatagggtgcacccacgaacacacaagaatccttcttgttgcaatacacacgaggctttattggcagagctgtgggccgacacgtacctcacacaggaggcagggaagtcgactccgaatctcaagagctaggggtttttatggaggaaaaagggataggggtgggaggaatttcaacaaaggtatgggattggctcattcaaacattagcagaaagattacatgtcagcaaaagggcatcaggactttgttcctgtgggctgggggctcatcttgttcacatagcaaccagttgatgtatgactttacccggcgtcaaggggcaatagacagaggggaggttctggccagatggtgttgacccagacaagatagccctgcttgtccttgcattccttttcatctttacagtcaagctgttcttaggaatgtccaacagccctgccctggcatgcaggctcatagacaactcttttacatgaatcacaagttacaaaatctcattttccttcaagctgttcttgatttaactttggtatgtgttttctgtctagaaaactgtccatttcatctagattttccagttttgttgaacatagggcttttgtagtaggatctgataattttttgaatttccttcgttttggttgttatatctttcttttcatttctgattttattaatttggatgctgcctctgggccctttagttagtttggctaggggtttatctatcttgttgattctctcaaagaaacagcttttggttttgttgattctttcttctctttgtttctacttggttgatttcagccctgagtttgactatttcctgccttctactcctcttgggtgagtttacttctttttgttctagagctctcaggttgctcttaagttgctactgtaacatctctccagtttctttaccagagtgcttagtgctattcattttcctattagcactgctttcattgtgtcccataagtttgggtatgatgtgtcaacattttcattaaattccaggaagtctttaatttctttgtttatttcttccctgaccaagttgtcattgagtagagagttgttcagttccacttttatgtgggatttatgttatttttgctgttattgaagaccagccttaggccatagtggtctgataggatacatggtattatttcagttttttcgtatctgttgagggttgttttttgactaattatatggtcaattttggagacagtaccatgaggtgctaagaaaaagatgtcttcctttgttttaaggtaaaatgttctatagatatctgttaaatccatttgattcataacctctattagtttcactgtttctctgtttagtttctgtttcaatgacctgtccatgggtgaaagtggagagttgtagtctctgactattattgtgtggggttcaatgtgtttgtttagctttattaaagcttcttttataactgtgcatgcccttgtatttggggcatagatgtttagaattgagactttctcttggtggattttccctatgatatatatgtgaaatgaccttcctcatcacacttggtaacttttggttgaatgtctattttattggatattaggatggcaactccagcttcttaggaccatttgctttgaagacctttttctatccttttactttgagatagtgtttgtctttgttattaaagtgtgtttcttgtatgtagcaaaattctgaatcatgtttgtatatccagtctgttagcttatgtctttttataggtgagttgagtccattaatattgagagatattaaagacagatgactgttgttccctgatatgtttgtttttgtgggtggctttatgtgcttgtggttctctccttttgaatttgttatgagatgcttaatattttgtcttttctttggtgtaggtatcttccttgtattgtagttttccttttaggatcctcagtagggctggattggtagatagatactgcttgaatttggctttgtcctgggatattttagtttctctgtctatgttgatttagagttttgctgggtagggtagcctgggctggcatttgtgttctcttaaaatctgcatgacctctgacttttagtgtctcctttgagaagtctggtgtaattctgataggtttaactttgtatgttacttggcacttttcccttgcagtttttaatattcttcctttgttctgtgcatttagtgttttgattattgtgtgatgagaggattttctttttttggtcccatttatttggtattctataggcttcttggacatttatggccatgcctttctttaggttgggaaagttttcttctgtgactttgttgaagacattttcaggtcctttaagctgggaatcttcgatctcctctattctgattattcttagatttggtccttttattgtgccctgaatttcctggatgctttgggttaggagtttttatgtttcgaattttctttgacagttgtgtcaatctcttctacggtatcttctatacctgatattctcttctatctcttgtattatgttggtgatacttacatctgtaattcctaacctctttcctaggttttccatttccaagtttgcctccatttgtgttttctttattgtttctacttccacttttaggtcttagatcactttattcaattccttcacctgtttacttttgttttcccatatttctttcagtgagttattgatatcctccttaaaggactctattatcttcatgagatagaattttaggtcctgattttcaggtgtgttggtgcattcagggtttgttgtggtgaaagaactgggttctgatgatgcccatgtatattggcttttgttgctcttccctctcagcatctagttatctatccctggtacttgctggtctgagtgactctatctgtagtctgccttttttgtcccttggttgcttctggtctcctggtagacctgaagccctggctgtagtaggcctcctgttggaccttccaaacggtggggcagggtaggggggtgggctaggaatgggcgttttcagaggagcagaaaagctgctgatctgttgccctggctgcagtagatcttctggcaggcctttagactgttgggtcttcagaggagcagtcaagctgttctcctgtatgaagctggacctgggaggtcttcagactggtatctgttgtccatttaccttgtgtagaggaactcctgggatgccttcaagctgtggtgttttcaggagagcagactagctggagatcagttgctctatgtgcagtggatttcctgggatgcctcaggatgtagtatcttcaggggagcagactagctagcagtctgccccagcagaaaggaccaggtggaaggggagtgttattcagcaggccggggttttggatgtgatgggtcctgagtccactgggcttccagaagcagctgtgggacttcaggcgggtttttaccaaatgctctgagtgcagcggatctcctaggataccccaggatctggtgtcttctgcggagcagactagctagcagaaggtgtctttttattagcgaattgagtccattgatgttgagagctattaatgaccaatgagtgttaattcctgttattttgatggtggtggtggtggtggtggtggtggtggtggtggtggaggtggggggtggggggtggagggaggtggagggaggtggagggaggtggannnnnnnnnnnnnnnnnnnnttctctgttagttatgataataggtctggtgccaggttttttttgtttttgtttttttgttttaatagaaatatacgggtatccatagacctttaaaaagcacaaatgaatgtaatctaaattattttaccctcagagaagttatagagtaattgatttatttttttatcaaaacaattatgatatcttttggttttgtttcattttgtggtaatagatattatgcgttagtataagaacagagttatcagtgaacaataaactatgttaatgctgttgtttgatatcttccaggttgtttttaaacctcttctgagtcatacagggatccagtcacaggacacaatgcccctttgttaccggatgtacttcggagaacacctttcattttcaggaactttagactgcctcagagcagatattgtagattcggacacagctaaagacaggaaaggaaaaagagcaagaaggtatttttcatattgtataaaattttattttaaaattataattttagtaacaatgagaaggtaatttccagttattaaatgtaatgatcatattttattaagaataaaattttgattttattaatggatcagacagtattttaggcctatttttatagaaagtacatgaggtattctaaagaatatctattgatatattgataaattcactcagcactatatgcttaacttcactagtaaagtttttatgtctatggttttaatctttgcaccgacagtttattcctaacatatgttttgagttgacttttaccatatttgtgtaggtgtggctgtatttatatatgtgcatgtctgtgtgattgtatgcaaacatatatgtatagggaccacaagaggatgtcgggtgttctctaacatgttctacctgttcatatgagacagtctctccctaacctaaggctaatcatttctttgctaggctggaagctaacaaaccctagaaatcctccagcctcctctaccagcaaagctgggttttaggtgttcatgggatgcttggcttattaaatgagtgctgagatctggacgccagtcttcataattgcatagcaactagtgagctacctctccaggtcctcagacaatatttttatccagggatagagtaaaattcacattgaaagcatagccataagaaacaaatatacaggaagacatatgtaacatatgacagataaagctatgagctttctgttactgccattctgttttcatgggtaagttttacatttctttactgcttgaataagcactttcatatctactaacaggtttgactcttcctttgaaagttggaattttactttgggtatcttgttgacatggacagaaatcctaaaatatggtcataggtaacatttctgataatgttttcccaaaagtcttagtttttttgttttgctttgtttttgatttttttgggtttgtttttttgttgtttgtttgttttgttttttttgcagttttgcaagttgtaagagtaaaagatcacttatattcaatttaaacttaagaaaactggaattttagtttgaatattctgtttaaattttttaaaaatgaaattacatttatttttttgtgtgtgtccatgtgtatactcatgtgtgcaggcatgagacagcatttgtatggaggtttggggataccctctgagagtcagttctttccagcttgtaggtcccagaattgaagtgataccatcagacttaagtagccagtgccttcatccattaagccaccttagtggcccatatttaaatttttaaataaattaataaaattcatttttgtaaacgaatcatgtatagaatatagggctttcttcaatttaattgaggtcaaattatctgaggattttctaataatacagaaacatagaaatagtattctctgtctgttaaacacagagagttcttacaagctgtttgtaaaacttaatggaaaaatcttaaaaatgtttgtcaaaatattttataaatgtttatgtatgtgtgtaggaacacacatgcaagtacatcatatatttcttctaagtatatacaactacattgtataatcattatataaaatatataagatataagaagttgcctatagatatacagattttgtggataaacacatatgtataattaaaaacaagttacaaacttttactggtatcataaatgccatgcggtggtacatgtaccaaatcccacccacctagccacagttccctttctgtgattctctagccaaacttaatattcctctctctattgcttctggcagcactctgagtgctctacactcttagaaccagctcataggcagcctgctcagaggtttgcagttttactctaaactcttggtttcttgaggtctcactacactagactttcctcagccactaattttagtcttaatttctttgttttatagcacactatttattcttctatttattgtacattaattttggattgtaattttttgtataaacattcactttgactttaaagccttggcaataaaccatttaacatagagattagtatgcagtatctcttagatgtagttgacatgttaacttgtaaattatttgtaaaaattagtggaaaaattacaaccttcaaatgtttgtcaaaatattgtatgtaaatatgtgtgtgtgtgtgtgtgtgtgtgtgtaggaacatagtatgtttaaggttcaattgtagctttggcttcatagtgtccatgacagtccttaactcatctgctgcttttgccctaaaggactgcttcagcatatgcccagaattcttttctccttttcttgactgtcctaaactttcttcttccttttggtcatccttacatatatcagattttttgggttgtttacttgctttttctcagagatttgttaagtcaccattctgtttgggattatttttgtaacattttattcttctgtgagttctgggtcttagtatccaatgtttccttcggcaacaacatgcagaacattgaccatcagccccttgtgaatgtctgcatctgtgcatattattacactatcgtgtggcatactttttatttaataataaatgccattattcaataaggaattacagctctagttataaattcatatttgagttgagaatatcaaagtattttctgattttttgtttttaaatagagatatggcccatgttttatttgccctttgtggcagtatattcacaatacatatggaacaaaagaagggacatgatggtttacttgagatttatcattattgttggtagaagttgagtgccttttaaaaataaaatgtttaaataactgtaatttttaccccaaagtttttagataagtcaggggatgtaacaataatttttgtgtaagattttaggtatttttaaatgtgttgttttgtttcagttggtttttctttccacttgtaacttggtaaacgaagctgtgaagatttccattccaataactaataggattatactaagtttgaaaatttaagtttagtatgacgggctggttctaattgatctgtggctaattctaaatttctatactattacatgtgatattagatagcaagaaaaaaatgtttgttttattgttttttttttaatagaagccaaatgattttgacttcttagttaatattagaggaaaaactaaaggctatctactagcccatgaacagactagactagtgcaaacatgcaatgtattgaatctcttgcttaatggtacagtgcaccttggaggttattatgtttataaatgcataagaatatgctatgtagttcttcacaaaaggaagtaacagcccttccctttgaacattttaggcaaggccatgtgaaccttcccccactggagttcaagccggcattaatgttggaaaccttcagcatcagtgctgttgtaatggaaaagtcagtgtgcactccgcaaaactctaccagtgccctttcctttcatgatctcaacaagcgctattacaacaccttccattgcaacttcactatttcctgccagtcaataagtcagcatgtggatatggctctggtccgtcttatccatcaattcagtacaatgatagatgacatcaaagcaactcagacagacattaaacttagtagatacacagctggatcagcttcccctacgcctaccttcaaaaccagaaaacatcgggatttccgttcatctgacttcagccgcagttcgagagggagtctcaatggtggcaacagagtaaataatgccaagaacaaacgggccaacaatgagaacaataaaaaagaatcccgaaacaaaaactcactaggaaggtctgaaagaagaacctcaaaagtatctaggaaaggttcaaaagatgtagtggatcatatgacgattcatatggatgattccgattccatcacagtgtcagagcaaagtgagccttctgctgaatgctggcagaatatgtataaattgcttaacttctattcacttatctcagatccaacagggatattggaaaagtcctcagaaacatttggaccagcaggtaacaagcattgttgtgatttacatttttctgtctagaaatgctaaagaagactgttcaccatattaatggtataaattattaaaatgcatagaaattggtagtcaccaaagagaaaatagtgctgacattcagatattctgtcagcatacttcctccttgaccctgacatagactgcttttaaaggattcagacaaacttaatttcaagtatctagattgatcatttacttcagtaggtattagagaagatgttgaaaattaattgagtcatctacgagggaaaagtctactttagactttgaaaccaagaaagctagcacagtatttagaatgttctttgtgctgtgttttttcaaatctcaaaccatatatctccatttactaaaaaggtgttcggagtcctacagagccaacatgtagagttgtgtttgagaatgaacaagacaacaacagcttgactaaaacacagaggaaacgtagtctggtaacctctgaacctcagcatgtaacattaattgtgtttgggattggcatggtgaaccgcacacacctagaggcagatattggtggtctgacaatggaatcagaactgaagaggatccatggcagtttcacccttaaggaaaaaatgaaaggtataacacttttctaatactttaatgttgctttgctgaaagaaatgtgtttctaatatttgaaaattcaagaaaaatgaaagttgtacaatatttgcttttccttattgccactatagaaatttataatctagtattcactttagtaccttttttaaaaattaagaacttcacaaaaattctattactggatataaaatttccctaaagtaatcaaaatgtgccatttatttctaaaatggtcacagaaggtgtgatagttcatgaaatctaggatagcatctgtttgaatacgctccatagctatgtatcacaagggaaataatgctgtcagatgaaattgcttgtaaaatataccccagtttcagaaattccaaaataaaattaaatgtttaagtcggtggataaagcagtatggaattcactttcatatcagtgttgttttcttcatggttgtattgaacaagaaaaggaacttgtgaattaacatttgttcttgttaactttatgattatccaacatacaaagtctaaatttttcattaaatactcttctttagctgttttgtttcataccctaagtatgaaacagaagttaagcactgatttttacatgaaaatttatgtgtgattaaagaaaattatgtaaagaagtgaaaaactataaaatgctgagaaaaatacaaacacacgaattctcaaatacaaggcaaaagatggctatattgaagtaaatttttaactttagtcgttttaagactaccaattttttcttctgttgttttagtaaacattaagaattacattggtgcttttgattagaatctggaaaatgggcattcacttctaaatgaatagatttaacatttgcaaagtttgataggtcttatcaatagtctctaagctatatttcttctttattgtagcaattctaattctacaaacctagaaagaacagaaaatgactgatgttaaagagctggtggttatttttatagccccaagacagtttaagatttacccattccaagttgtatcataggatttatttgtatgaaaaaattctaaaagagaaaagcaggcagaatgacatatttactttatttagatttacaagtaataaatatattaatttcataagaggtatatggaccaagagtagtagtttatctggtttcctttttttttctctcaaagcacatatgtggtatagaccatttaattccagtaaattatttaatgcatgaagtcatgttaaagtgcatttctccatatttctactttttaggtatactctgtatacatatatttatgcaaaatagtaagctgaggaaattttcttaaggtagtctgacaataattgagcacatttattataatttatagttatcatttgtcatcaaatatattgtaaataaagtaattttaatatcagatacaattattttcagaagtcagattacatttttttcatatttaagatgttttgcatcaaaagatgaccgagacctgtgctactgctcacattggtggggttaatattgtactacttgaagggatcacaccaaatatacagtaagtgtgcttatttttactgttttcttttattccttgttacaacttataaataacttggaattccttgaatgaagtcatcctatgtaaattttgaggattatactgtgtttctagatacaattggaaaaaacaattgattttgttacccctgcctatcctaaattcactccctctcatttaaataaatgcctgatttccagtatctggtgagattgtcttataagaaaaatgatcatggtacaaatttctatttagcatataggttgttaattttcctgtcatttaaatagttagctaaaatttcaaagaataagaactctcttaattttaagtaatcattattcacctagacttcagatttgtcatttagcatttaagaaaggtaacagtaaagcctttgaaatctgttacagtataaactaagcctttttaaagagaaagtatcaaaccaggtgaaatctgttacagtataaactaagcctttttaaagagacagtatcgagccaggtgtggtagctcacctgtaattccagcacttgggagattgaagcaagacatttgttacaaattagaggccagctttgactgtatattgcatcccatgctaccctggattacagagtaagaatctgtctaaacaaggaaacagcatcaacaacaaaaatcaaattaaaaacaaaacccatatactctattttagttctttgttcttaatttttttctgtaagttctgtacttgggtctgttctgattagaatgattctgatgttgataatatttactcatggtatgcatagcatttgcatagaggagtgcatctaaccatatgactttatatccttagtagtatttgccttcatttctaatttcttttcaatgggccagttttgtgttataactagaagtgttttaatagttaaggtcatattttgagactttgttcttctttgatagtataattaatgctatgctaatgtcctgaagcatagtcctcaggctagataaccactaaataggagatttgaccccttctttcaaagttattttagaaatctaaataatacaaaaacctgtcttgggcaatattttttttccattttttattaggtatttagctcatttacatttccaatgctatcccaaaagtcccccacaccctcccccccactcccctacccacccactccccctttttggccctggcgttcccctgtactggggcatatagagtttgcgtgtccaatgggcctctctttccagtgatggccgactaggccatcttttgatacatatgcagctagagtcaagagctccggggtactggttagttcataatttgttccacctatagggttgcagatccctttagctccttgggtactttctctagctcctccattgggaaccctgtgatccatccattagctgactgtgagcatccacttctgtgtttgctaggccccggcatagtctcacaagagacagcatattgatattgataaacaagccagagcctggtggaaagaagatctcagacttaactcttgccctagtggcttaggatcatttcctagaatcatcactgatcatttatttcataggcacttcctaggcacgtcccatcttttaaaaaaaaaaaaaagaccaggaaattcccatggttaaacagatctctctcattcattatggacaaacaagaggatgtatgaaactcctgttgtaggctaggaactgaagacctgttcatttacttaatccaccttgcaattctgtgagcccaggtaatttttatctccactttatggaataaaagaagtgagatttagaaacatcaaagtattagcataaactattttaaatggtccagtcagaagatctccatactacactgcttctgtctttcttgttcacctacagcaacccatcccagaaagcagactggtgattgttccattgactcagagccaagttcccttagatgccccaaaggctgactttttcttgtatcttctcgtctgttttacctcttaagagaatggcttcagtcgctcagcttgtagaacttaacatttataaaatgaaaatttaaataatatagagttgatatttcttatctttcccctttatcagctttttttgaaatataaaagttactcctgggctggtgagatggctcagcaggtaaaagctccgactgctcttccgaaggtcctgagttcaaatcccagcaaccacatggtggctcacaaccatctgtaatgagatctgacgccctcttctggagtgtctgaagacagctacagtgttcttagatataataataaataaatcttttttttttttttggtttttcgagacagggtttctctgtgtagccctggctgtcttggaactcactctgtagaccatgctggtctcgaactcagaaatctgcctgcctctgcctcctgagtgctgggattaaaggtgtgcgccaccacacccagctaataataaataaatcttaaaaaaaaaaaaaaagttactcctttgttactgtcaaaactcgtagtcttaagactttttgttaatactatttggatttattctttagcatttccaaatgcaattaaaatgaaatagaatgcggaaagtagtttcaaaaagtcatttgaaagaaacccttaggagctgggcattcgtgagcttcctgctatgcagtcctattgtaaccaatgtacctgtgaatgctgatttgcttcccttttgttttcctgcttctcttgaatctgcgtccgtagattggaagattttcctacatctcctacaagtacagccaaacaagaatttctgtatgtcatattctttttcatggcttgtgattaatactgactagtatagtacttatattaccattgtgggatatagttagtcaccatctcatgttctagtcaagcttaagtaagggctgtctcttaggtaagacagactttgttttcttgtgcttctgtgggcatattatttgatatcataatggaatttttcacttggtgagtttttgttaattaaaaattaattttaaaaaactaacagtgcatcagcatgttttaactttataattttgttttaatgggaaatttgttgttttatctatggcttttactctatgtgcatttgtgtttggaatatttgaattttaccattgctgtgtttgcagttagctgtacttgaggaatatgtgtaggcgctcaccacgtgagcctgtcattacagcgcgctagcatttagtttagcattagttatgtctttggacatttttaaaataaattttaaatatattgaatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntataatcatcatattttatgaaatttgtttcattatttataacaagccatagataaaacattattagttcaaagccatttgttgggattatgttctatttcacttcaatgatcaactaaaagtaatacaaatttaattttattactgaaaaatagcctgtataacattgtctttttatgaacagaaaagcaaaacaaccacaatttaattccaattttctgagttctctgggtatttaaccaaaaaataatcagtataaactttagagcgaattgtttagtggccaatgatcaaaattttttatgggcttgaatattatgtactagaaaggctctgcgaaggcagcaatggaaaactatcaggtaatggtctttgttgtgataccatcacatttggccacctcattccagtcccaagttttctgttaagagaaacagtcatgtataacacaattgccaagtgggaaagaaatcttttatcattgactaaatagcatatagccattcagcatattccacatttctattgtagaaaatttcaagcaaactgatttgagatagccagcacaaaacaagttatgtaaattaaacttttccaccttcctccgtcttttaagtttggagccagttcaaggcaggaaggccacggtagggccaggggtgtagagatgaaggtaatgcttctagatttgtataagactgatatggttattccagaggaatttgcaaattgccctttctaactcggtgaagaattgagctggaattttgatgaagattgcattgaatctgtaaactgctttcagcaagatagccatttttactatattaattttctctggaagatgactaaactttgcagcacacttggtatgcccactgtatgttaaaaattcatggcagatgtccataaagacaggctgaaggttcacaggcgtgcagtttacagagctctccagatttaccgtacttcacaacgctggggcctattcccacgccttttcctgtgctccagcactttcctttataaagtaggcccatgccttcaatctcaataatttggttttttgatgccattttagaagtacataaatggattttttttgtatgcagtttgtctctctttagatcccaaaactaaaatggaggggaaaaggttatgagtgagaaaaaaaatcaaagtaaaaaattttttgtgtgtgcaaatgttgctaatgtttgtagaattgttaatgtttgaagaattgagctggaatttttgagctaatgtttgtaaaatgttgctaatgtttgtgcttttacttaatatccatatattctaaagaaataatagacttttcaatgcagtataagatgagtatatcttaatatcttttagaataacttttcagactatgttttgacaaatgaatgctctcctcctaactcattgaataagaatatcttatattcttgttatttttccaaaaatttttctttgcttctgttttaatagtcttcctcctctgtttttagaactgtggtcaagtgtagtatagccaagtcccaagccctctacagtgcccagagagggctgaagacaaacaacgctgcagtgttcaaagtaggagctatcagcatcaacattcctcagcaccctgccactttacacagcatgatggtccgcagttctcaccagctgtccaagcagatctcagaccttattagacagccttccacagcgtgagctattttattttttatagcctgtgactatacagtaaggtatctcttatttttgctgtgataacaaaggttcgtaacaaatgagcagttcctgtgaacattgagtatcacagtaatggagctggtagagagtattcaaatgacatcttgggagaatcatagtatgtatcattaaagtattatattacaatggccaataaggtattaattatatcacattgaccaatactaaatatgaaatgtcaacagcaagcttaagaaagagattctagagatttattggcatcacaataaattctaataaaaagcaaattaatgaatttgagaactttcagtcattgtttaaatttaagaaattgcagcagtcatttatagcttgcataattttgcatattcctttattatgaaattactatatattttttaagacagtctacatgctagatagcattttaaagggcagtaaatcagacctttcacggtaaccttagtccctgtgcatgtttcactattcatagcatatgcttttctgacctgtgtgtgtgtgtgtgtgtgtgtctgtgtgtctgtgtgtgtatgtgagtatgtatgtgagtgagtgtgtgtgtatgtgtctgtgcatgcatgtgtgtgtatgtgagtgagtgtgtgcatgtgtgtatgtgagtgtgtgtatgcgagtatgtgtgtgtgcatgcgtgcatgtgtgtgtgagtgtgtatgtgagtgaatgtgtgtatgtgtgtgtgtatgtatgtgcagtgtgtgtnnnnnnnnnnnnnnnnnnnntattcgtgtgtgtatgtgagtgtgtgtgtgcatgcatgcatgggtgtgcatatgtgagtgtgtgtgtgtgcatgtgtgtatatgtaagtgtgtgtgtgtgagtgtgtgtgtgagtgtgtgtgcgtgcatatgtatgtgtatgtgagtgtgtatgtgcatgcatgtgtgtgtgtgtgtgcatgcatgggtctgcgtatgtgagtgtgtgtgtgtgcatgcatgggtgtgcgtatgtgagtgtgtgtgtgtgtgtatgcaccatgcatatgcacatgcttactttccccatcctataaagtgatgaaacagtgtcttgatgtctcagaaaccagtgcctatttttccatagttgttttatccaggtttttagttcttgtgtgataaattatggctcaagttattactctgcttttctaggtcatcattatttgttagctctgttccactgagaaatctagtaattttatcaataaagtagtagtttctaatagttttatggggtgtatgtgctttggtttgtagcccacagcctatgaaagaagatattgcaaccccactgccttctgaaaaaaccccaacaagtgttaatcaaactcctattgaaacaaatgaatttcctcaactcccagaaggcttagagaagaagcctattgttctcaagttcagcgctatgttagatggcatagccattggagcagcactcttaccatcactgaaggcagagtacaagatggggagaatgagaagccatgggatgacaggtaacatggaactttaagttcacccatgtgaaattaccctcccaacatctttccatccttttttccatttataaaatagtttactcttctttattggtttttccttgtcttaattccagtttttaaggtgtaataataattttattaatgattttaattattaaaattttatttaattattacaaaattaatgataactgcttaggtttttcatagatttcctttgtcacatttacaaaagggattgttttcttactctgctgtgaaatttctgtaaaaaataattggtgactaaatacaaatactttcttccatatctgttggaataaaaatgtctttttctcttttttgttttaacatggtaaattacattaatttttaaagcactaataaacctactcaaatacaatgttgtattaaggatatatgtattccaactctttacatttcagagtttgtttattaaaatagttttctgaacatttcaatctttataataccagaaatagaaacaaggtaaattgagcttttggatttggcaaagtaagaaaacatggactttcctgtatcagagcccagttctaacaatacactggctaatttgctcattttgaagtctactggaatccataggcttctgggaaaagcaagccagataggcactttcaaggtgaaaaagtagaatatctaagagtggacaccttgttgagtagccaaacaagaacccagaattctgtaaatgaagaaaaaggacagagccagtaaaagagtggcacattcatgaatactgatgagtggtaactgaggccttggattgctttgatctggatgtttttatttagtgatactggcaaaagaggtagtaggagaagaccctgcctcctgcagcttccaggagctagtcaaagatagccttgactgtaacaggtgttagaggagctcagggtagtcaggacctttgtggcatctcaaaggtatgatagttggagtatagcatttttctgtttatgagaggaacttgggtgtgtatatattacctacatcctgagcaataatatagttgatggtaatcttctgccaattcatcatacccacgtagctggacaatatcagcaaaataatgaaactaactctacattaatatttccttgaacaaccctttgccagatagaggacttaaaaaaataaacacattaaattaaactgtaacatattacttagtctcttaatagttaaggttaaaggaatgtgtgtttaatgttttagaatttgggactcgtttttagcttgagttgttttatcttgttgtagtataagcttctctacgtaaagggcagtgagtgtgtctttctgttctcccttctgtgataatgcagactctgtaagggtctctgcatctgacacaatgttggttcccagtaggcatcataaatgctgctagcttaatagtacttgctgactaattctttgtactaagtgtacttgtttaacgatatggagtaactcatgtgtaatttttaaatattacttctatatgatcaacataaactgtgggatgacaaaatgttttttcgtagacatcatttctgtaaaagtttattctttcagctctctgttccttacactgttctttcaggtgcacagacaaggtttacatttgagttaccaaatcacaggttgcgctttacttcaaaagtttctgcgacagatatgtcaactatccctccttctgcaagtcttaaccttccgcctgttaccatgtcagggaaatacattatggaagaacatgatagttactcagatcaagtgtggagtatagatgaactgccttctaaacaagggtactatttacaagggaattatctacgttgtgtggcagaagtaagtttactttcaaattactttttgcagtttatataagttttcaagatttcgataccaaactacataatggtccaaactttgaagattaaatgttaaattatttgttcctacacaaggctaatctactgaatttcaagagaaagggtgtgtgtctgtctctgactacctctcttctctgtcttttattgaaacaatgtagtaatcatctactaatttttatcttatatattaaatttcaaggtcattttggcaatatttttatggtttactttataaaagagaataaaagctaacatcaggagctttatatatttacttctgtagtccttaattaactttaagataaacgtactctctttaaagtgtttgtgtgtgggtgggaggggggtgatttttaataaggttatatagaattgaatactactagtcattattgaaaggtcacatggaaaggtaaaataaattaacagactcatttattatttaagataatgctaaaagctggcactcctgactgccacattattttcacttctgtgtataactgtcagaagctttcaaagcatgatacacctgtttcatatggtttgaaaatacataagaaagctctttgagcttttgatagaaatactgtaattggaggagacacatttaagtctgatatacctttttcagattgggcttgctttagtacctaagagttataaattcttttagtttttaattttaagagtgaatgtgtgtggcgctgctgtgtggttgaaggtgagatgtcacggtacacagggaaatcagatgacacccttgtggagcttgtgctttgcttctgctcttacctaggtttttgtagggacaaatctcaagaatctaggtttgcatggtaagcttcattgcccagcagcccagttctttgctggaagactattctttgtggggctttggtttggttagttttcttttttctttttttttttttaattagatattttctttatttacatttcaaatgttatcccctttcctagttttccatctgaaaatcctctatcccctccccgctctttgctccccaacccacccactcccacttcttggtcctggcattcccctgtactggggtatagagccttcacagaaccaagggcctctcctcccattgatgaccgactaggccatcctctgctacatatgcagctagagccatgagtcccaccatgtgttttctatgattggtggtttagttccagggagctctgggggtactggttagttcatattgatgttcctcctatagggctgcaaaccccttaagctccttgggtactttctctagctccttcattggggaccctgtgctctatcctgtggatggctgtgagcatccacttctgtatttggcaggcactggcagagcctctcaggaaacagctttatcagaatactttaaagcccattttcattgttcttatatagtatgtatataattatctcttttccctaaagttttggatgattggctttacagaaaagcagagctaacatactcaacaatacaatctcatagtctgattttgtttggcaggttggttcctttgaacacaatctcacaacagatcttctaaaccacttggtgtttgtacagaaagtgttcatgaaggaagtgaatgaagtaatacagaaggtgtctggtaaggctgtctggggctaggaatgcaagtttctatttttatttgtcatatgaggtttcatgatctaaaataagatgtaagtgacataaaattatattgataactagtgtgagtgtgtgtgagagagaaacagaaaggtgagagggggggatggatgcacactcataaagcaaaagagataattagctagtttcttttattttctttatattattcccttaagctggggtctctcattgaacctggaactgaccagttgtttaagacagtagggtcctttatttcaagaaagaaaatctgttgctatggcagattggagggttgggggcagttctctgtaagaatcaaagcccaccattcacttacaagctggagtaattatagggcagggagggaggatgaagtttccttcttggccagagatgggcgaaataaattgtgagtagcaaatgaaacaatgcgggtggtcactggacaactctcatggacagctttgaggtgtgccatatgtgccaggaatctagttcgggttcaaaatgaccatgattaacagtcttgacttttgtttccttgggtagatgttgttcatgtaattctctgctgtcaagattagcatccccatcacagtttgggggcagtttctggtgttgaaaactttggaggaagacattttaagggttgagtccttccccagaagcctccaagcctgttaatacctatctgtctaacattctctcctcacaagtggagaccctgaaaccatttagaacatggaagttgaataagtctggctgcttccaacaaggattgggagattagagaggaaaaagaggggaattagtgagactcttgatgactttcaaacatgggagaacagtcaaagtgaccatgagctggatcatctcagaactgtctgaatcaactgtcaacgagtatagacaaaattaagacagtgactgaatacaccatgtctagagaagagcatttacaactaagattatagtagatttaagaggattttgctgcagagatctatatgtaaagctggtcaccaatgagttggcagtctttggcatgtttttactcttattttgtagagcttgtaaagcaaaggagacatatgcaaaattatcaagtatacagaaaaagtatttatgtgatttggaaaaatatgagtcctttaatttgattaagagtcttaatttgattaagtcattgttttattatattattaccaactgttttaactttgggacataagtatggggataagtgaaaattatactagaaatggatatttttaacacatcacattggaaagaccaagtttttataagagtacatcaaggaaaaattggtaaatgagagctaataagaataaggactggagagatggcttagtggttaagagcactgactgccctttcagaggtcctgagttcaattcccagcaaccatatggtagctcccaaccatttgtaatgatccagtgccctattcgggtgtgtctatagtcagctacagtctgaagatgagctacagtgtactcatatacataaaatatttttcaaaaaaagaataagagtaattatgctaatgtgtgtagactaagttgcgtatatggcatattgcatgcactcagtaattcattctccttggtactagggtctgcacagatatctgtttagttgagaatgtagcaagtaaaaaagaaaagaatacagatggagggccagagttgcttaagaaaaggtaatccagagaatggtaacatcaagagagctatggcttaaaattcaaatgaaataacagtaatggtgatttaacattttagaaattgcactgaaatgtaatgtaaacatcctctgttagaattagttagcatgagactttcaaatgtgacagcagaaaaggccttacttgaagggagtaaagctatctaaaaaatattagtaatttatgtcacctgaaactttggtggtagctggatgatacagacaggaagaaagatggagtatttgatagctggctgcagataagttaatcactaattaagattggttaagaaaccttattgtgggtttcagatatgaggtagaaagtaggatctgctgatgagcagaagaagggaaagtaatgctgtaattgtagagcagctgttgagagagggaaagtgcaagcatttaagtaggcactcggatttccaggaagcatctagctagctagcttacagaaagtgtctgcttggctgctgttcactagtcctaacgattggggtcctgtctcatcacactactgttcctttttctctctctcaaactgaagattgatttgtcattaaagaaaaatgttttactggaggttttctttttaatacacaaaatatagtcagaattttgtgtgataaggaagctgtctagtctttcaggatttaaccttttctaggtggggagcagcctatccctctctggaatgaacatgacggaacaacagatggagataagccgaaaattctcctctactccctgaatttacagtttaaggtaaacttccataacactgatgctcttaggaccagctttctaattaattagtgtatattttatgtggaaattttgcatgatgcataattgcaaaatagtgaaaataaactgtattctgcttactcggggaaagctttaatgtctgaatcttctatcagtgctttttttctccttttctttttcatattgacactcccctcccctcccctcccctcccttccggtgatttacaagtcgctgcccaaaggtgagtttgtgaccatctccacttactgaacttccatctgaannnnnnnnnnnnnnnnnnnncaactatgaagtcctaactggcttgctggaactctctctatataaactaggctagtcttgaactcaaagtatccaattacctctgtctctctagtgctgcggttaaaggaatgcacaccaccatgcccagtccttctatgacaactactgctacaataatagtaataatgataataatagcaacaacagtaacaacattattattagcatgtattttgaaaaacttctatatctttctatatcagattattgagatcagctttatcttctgaaagcagtattatataatttaaacagtttgtttagcgatgttccagtgaacacttggtatttctaattacttcttttgtaatttactctgcaagcaacattttgaatatctgttcaattaataatagtcttttagggaggcgatggtagaatgcttgcccatgtgtacaattgcctgagtgaagcaaagctatgggtcttccttgccgccaaaggtgggagagcagggcatggccaaggagaaaaagaaagagctgtaatactttaaaatcttaattatctcctgtaaaaaagtaaaagtgctaaaatgatatgtattaactatagcatcctagtaataactgatttaaagaatgtgtgccttagacatcttatatatgctatgacttcttatcatatttcaaaagattgcatttccgtgagtctatattggttcattttcttactttcctcataatgtgtaatctgctagggtattcaagtgacagccaccacaccttcaatgagagctgtgagatttgagactggattgattgaattggaactttcaaaccgacttcaaaccaaagcctcaccaggaagcagcagctatctgaaattatttggtaaatgccaagtggacttaaatctggcattagggcaaattgtcaaacatcaggtttgtacagaatataatggtattggcactattgtctgtaaattaacttatgtgttagaattttagaaatattttaagttcctaaaatttgtattgtaaattctgatgaaaacttacttaggcctttataattttactttgccatttcttgccatttttgactatatactccctattacaagtttgtgcaagagcaatctcatgagactttatccaaaatctgtagaaacatttgcttgtaatatttcagtttcttaagcattagttacatcgcactgtcttgtgcttttattagttaatatgtaaagtgttaagtttacaccttccctatagaatgtttgaaattttcaaatgtaaagttttaagaaaaagatagcaactagtgtagttccctaatcaggtttactgtttatcagagatacttttttgttgttctaatttaattttgctaaatatgtctttttaatgtcccacctaattttgatttgaagagtcatttttaattgccagttgtggttttaaaaaaatcaatggctatattaactatttcaaattcttactagagttagaaaatgaattttttttcaaatggaaacatattttgagagaaatcttattaatttcaaacacttaatacattactaggcctacctctgctgggtaattgtgcttgacagctttatcacagagctacagcccagatccaagtttaccttttacatagttcttcataatttatattaatttttaagtacttatgttacaaataataaagaatctaccatttaatggctaaatttggaaagtatactgtaggtcttttggaaaacaatggtatataatgtttaaatgattttggtaaaattttccattgattttgttaagttttaaattttattttaggtttatgaagaagctggttctgattttcatcaagttgcctattttaaaactagaattggactaaggaacgcccttcgagaggaaatcagtggttcttcagatagggaagctgtgcttattactctgaatagaccaattgtttatgcacaacctgtggcttttgatagaggtaagtttatatcagccatgactgtcttctaggcggtagtcatgctcagtatgtatatgtatatatgtatgtataggtgtgtgtgtatatatgtatgtatgtatgtatatacatatgtatatatgtatatataccttggctttccagtgcagatacctgacagctaaaatgcctcctaaatctgaaatgtgagcagagcacctaagacgagtcttgctaactacagcttttaaagtcatttcatattttacaattattttgcttttgacataaataggattattttattccaagttccaatcttaaatgctaagttttttagttggattatctacccatttgtatttacaacatacactgattcattaattctgaaaaatgttttactgtgtgctggctaaaagtgggatacaatagataactggatcaggattcctgccttcaagtaatgtagtctgctgaaaaaaaaaaagagttcatatacacttgtcaatgagtcaaaaatctttttttcctagatctgaaagaatgtgtatcttcctttgctcttttgctctttagaggagaaacaaattcttcagtttcaacttagaatgtagagttcaccagggagataagcacatgagatcagctgctactcactttcttaacctagggctagacccgtcctagcatacagtagtacatacaaacatttgctaactgagagaattgagtgtttgtgagcacagtagtctaagagaagatagcaacagcttttagagaagaatgggaaagaaggctgactgtatggacaaactaatgtttaaattatttttcagaggcaataagaagatacttctgaatctgtgtaaaatttcagttctcagtggtcttagattcaccattaaatactttgcttttggcagtgcgccatagctgctttttgtttttttcctgagccctttactcatgctctgcatctcccatttcaccagccttcccttatccttcaccaggtcttagaacactctcaactggtgtgtggcatcattcttgatttttctcttctagtggctctccatttttaccttcttagacttccatactgtcttgaaatgaagattttcctttgcatgtttttcttactaacaaactcaaatgactttgaccatttcaaattgcattctttaagataatgtgcctagcattgtgtctttgtttttagaaatatttcaaagcaataagtacataatagttgatattctgctgatatgatgaagtactgtgaagaaaggtatcttgtagatacaaagtttatttgtgcatagaggccagtaggatagtccatgatggctgtagaggcatgacagtatgtagccccagcaggaaggtaagcgattatgtctagtcacactgaggaaagcccagtctgaactctaatggggtaatgcttcgaactctcattgcttctgcatttcccataacttctccaaatagtaacatcaactgggaaacaagtgtttaaatgcctgatcctgtgacatttctcagccaaaccaacacagaaggtaaactgtacagttaaggacaaggctcctgttttttcatgtattattccaaccaagaccaaattgtgtaataggaattctacaatattgaatggataagtggacctgggttttctttctgttgtcactagacagttgcttgctttctgtttctttcttttctttctttctctttttttttcatgaaaagtattaactgtatgactttagtatcattataattctagccaaatttttctggtagtaatttttactagaaattattgttaatcatcagaattttacagtagttgggatttactaactgtaataaatcacttacatcattgactttagttttttttctgcctgttcttaatttgcaaaagctgttctgttttggctgaattataaagctgcctatgacaactggaatgaacaacgaatggctttacataaggatattcatatggctacaaaggaagtggtagacatgctccctggtatccagcagacatcagcccaggcctttgggactctcttcctccagctaactgtgaatgatctaggaatttgcctccctataacaaataccgcacaggtacagaaaatcaaaacatacgaggctttattccagaattgaaagctagatattgctactcaccatttctgtgaacatggattataaccattttaagtagagctgtttataacttgagcaaggaagaactcctaattcttacctttgcaaataagctttagaatcatcttattgctttttttaaagtaagagctctttggattgatctttgtataaagtggaaacaggaatatttcaaaatgactttattacccccacatgtaacatggtagggaatttcaattttcttacaaagtgtagtatgaatattaaataattatttaaaaacttgcaagttatatatgtacttagatgaaaaaaagatgctatcttcataatttagggccagttttcagaaatgtattggaacttgaacttgtggttaagtaagaaaacgctgtctgcacttgtcagaccaagaagaaattgccctaagaatcatatgcagagatctgtcttattgttacagtcttctttcattgtcacttttaatagtttaaatgttgtggcagagttactaactgaatggagtaaacttctgttgagggttctgtttggttgaacagggctaagagaaacttggcattcaactgttgttggcgtctaaagacttgagatgtggcagctttttaatgacatgataagacggttcaggaaagccacacacataagaactggccatcgtagcccacgaaacaggggccagacaaacacagatattagctcttgcatattaaaaaggaaaaagtacacaggaaaatatatttcatttactcaaaatgaaattttattctttaaaaacctattttgctaatattgaggatttctagacttaaccatttctagactttaattatgaatataaagatttctaaagtttagaagtcatctggtctggagaaatgactcagcagtcaagaacacttgttgctcttgtcgagaacctgggtttaatttccaacacccatgtggtggctcacaaccatctgagccactctagttcagtggatctgaagccctcttctgatgtctgtgggcaccagacaagcgtgtggtgaacataagtataggcaggcaaaacattcatgcacagaaaataaatctttaaaaatgcattctaaattcacctttgcctcatttccctgtgatttttctttagtctaaccacactggagacctggacactggctctgctctagtgctgaccattgaaagtactctcatcactgcatgctcctcagagtctctggttagcaaaggccatttcaagaacttttgtatccgttttgctgatggctttgagacatcatgggatgactggaaaccagaaatccgtggagatctagtaatgaatgcttgtgagtctgatttattttctatataaggcttataattgtaaaaaaaaattaaaatgtctctgttgaaaattgaaggatgttcagatataggaatgctttagaaatgaaataagggttttttgtagttaaaggtagcaaactacatctgtaaaaactcttaacttcaggcttctggtaaggcagaaagacttacacatttgaagcctggtttttcctgtagttgaatgaccaaataaataatccttgttccatgatctgtaagaaagtggtaattgcaagacccaacttagtaagcatagaatagattgtgattctcctggactagaatttcagctttaattatagctgacacaggaataacccaacacacagcccaagtttctaggatttgaaagactcatagtggactcctctaattccactctgatgtatgtgatgatttgaaaggagaaaggtttatatcacttttaatatctttaggtatcacagcagagataactacagaattacttctttataacaaagcagtgtacatatatatagaatcttaaagatggtgaactaaaatcttcagtcaattctatgatgaaaatactctttagcaggtggtttgccatcatttatgtaattttctcctttctgaaacatcactataacttccaaattaaaggcaaaaattaatttaaacatgatttgttttgagtgtggcatctttgttatccatgcactaattaaaatagactatgattagaaagaaaacagaccattttcctagtaatttggaaaaaatatctcatagagaatataagaaataggcctagggcttagaattaaaacataattattaaaatgaatacattatttaataccttggtatatattcttttagcagtaaagaaccttgctattctgatttctgatatgcagaataacaagatttagattttgcagaaaatttacttttgtagctcactattgtttctgaggaagggaatcagaggaagagtaaaaagagtaattgtcttaatatgttatatgaattcaaaatgataaaatggacacattgattgagtaatttgtagtttctaatgggagagatactagtatgtaatttttatatctaggggtagaaaaagagatgatgttcaaattttaaagagttttcattatagtattcttgaatttggaagattattaatgtaggctttgttctgactgatatccttgactaaaaggttagcagagcctatcttaaccggaagccacatcttgccttgttttaatttagaattgaccagttagacattcatactttatggttgaaaaataaatttttctaagttactgccattgtatttttaagaccataatagggcagggatgtagctcagtgagcagagtacttgcctaccattcagaacaccctgatttagatctctagcaccacatacaattggcatggtaggcatgtctggaaccccagccttccacacaaagaggcagaaggatctggagttccgggttgtccttctaatcatcagctgagtagccagtgtgacgccagcctgaactgcaccgttaggcactaagagaggaactgatatttactcataaaagacagtgcgcctacactgggaatatttttctttctaggaaattttcaaggaaagacaaaaaacactccaaccttaagtgacatgtgaataccaatttagaattcacacaaagttataaaaggatatttcactttagactaatcaaatttagattgatatttaatttccattaaggcttattgaaagtaaccttaattctttttttttacaacttattttgcttagagatgatttatttcaaagatagcctaatcttcactaattaagtttaaggtaccaagttaaaggtaccaggcgttagcaacattttgcatttaagatcaaatatgtttcacatatacacatatgtgtatatgagtgtgtgtgtgtgtgtgtatgtgtgtgtgtgtgtgttgtatatacacggtgtcacaaaaattgtcatagaatcctagaggttagtagaaagcagtctagaaatgcccagatagtgtgtctctaataattacatgctacaagtaaagccaaaactttgagctaagttgctaaaatcataaaataaacacttcactttgtataacaagactactgaatccaaagtttgctcttttgtggggaggaattgaaacctagaagagctagaaatcctgtttacatttatgtaattgtctttgggaaaaaaagacatgtttaatatgaggtacatgtttaatcataagaacatttttattgacaactattttcgggttcattcttgtgcaggtgtagttccagatggtacctacgaggtttgttcaaggactacaggacaagctgcagctggtaggtttgctgtttactttgaaacagagttaggtgaaaatacgatgggaagtctcaaatgccacatttatgagttgatttattgatgactagggagagtagtaagtatttttgagtaagaaatcaaatggtgatagcatcaaaggaacacctcatggctgtaaagcataagaaaacagctgacatcacgtgcctggaaagagctcatttctgttctcatttcaacaagatccagctcttctcaagctcagagaatgattttggttttgtaactttgatgtttactgtgactacttagttacttgtaggtggtggatgcagcttataacggtttctgctgtatccatgggaaggttgagctcagagggaacagatagccgccatgctgttatacagaagaggtacatacacactataaacatggaaaccaacactctgtctggtgtttggagcaggtcttgctgtgaatggcagtgggtatctgatatggccatcatatagttcataagtgcttatactcctattcctaggaccttgaaaatgccacttctttatttaaacagaaagtagtagtgccggaacctggacactgaatgtattgtggaaaatgtgtgggattgatgtccacatggaccctaacattggcaaaaggcttaatgctctgggcaacacccttacaacactgacaggagaggaagacatagatgacattgctgacctcaattcagtgaacatagctgacttgtcagatgaagatgaagtcgataccatgtctcctacaatccatactgtaagtgcattcactgctaggaatttcaagactgggttttcctgagatagataactgattaacttgaggttatttcatgtgttgtggttgctgttgtagaggaagggagaaggcggtgatttctaggtctgcagtttacagtactgatgtgtgtttcatcataatgcctttatgaaatgtgccttaacctcagtgtaatatagtaacattgaaagtaaggtaaggtcaatctataaacacagaaagtagatcagtgggttttgagtctggggctggggatgaggtttgagaacagggaagggaagacctgctcttatgagaggagctttcctggctggtactaagagtgtggtagtgactgcttagctctggccatcctaaagctaccgagctgtacattctaaatggatgggtctcatggtctataatcgtatcttaggaaagggttttacaaataagtctttcaaaaagccaagtgtttatactgtgatatatacatttaaaatgtgcttttccaactatactgcttattctgttgtatcaagttatttagtagcaaaagagatagtgactttcagatttcattctggttttgatttgtagagattttaaatacattgatctgttgtattattaaatagttttgtcttgaaaagtaattttaaattaataatactgtttattatttagagttcagatggaagttcagtaagtggagatggtcacaaactcacctttgggcagcgacttgtaaatcacctactaggcctggcacctccaaatcagcgctattctgttcctgcagagtatctgtgtgattcagagatgcggggctcccctcagtctagccagtcccatttgaaagcatgcagagcacactcatggggaaacgtaggtcgcaactcagtagatgccttatgaaatgaggggcttgaatcagtggagaattgcaatcatcttacctgctgtagatggctttgattcttgcatgctctctttgatcgaggcattaatttttgtagtatagatggtctgtatgaactgaaagtggtattaacatatatactttgatttttttttttaaggaagctgtagattatcgaagacaaggaacatcttctagtcagccaggagaactgagaggaaggaagattatgaagcgcttagtggacatcagagaactgaatgaacaggccaaagtaatagatgaccttaagtatgtcattgtcttttacttactatagcattctctagtaatagaataataggatgctaaaggtggaagaaaacttttagtgtatcagtgaagacatcagttctccaagaagttcaataatttttctgagattataaggaataaagtgaaggctgaaatcctgattttctgtctttacaactcacttctgtgcagtgagtggcagaggagctcggtatgcatgttcatgcttcactgtattcatatgcgtggttgaatgtgcgtgttagtttgctaactttgtttatagattggagctttttttgaggagttaagaatcagtatttatgaaaggctgttctgtggtgacatgcagtaaacctcacagtgtatttgtgaggttaaatagcatgttccgaatggactcttaagaaaactggctcaggggtctggagagatggctcagtggttaagagcactgtctgctcttccggaggtcctgagttcaaatcccagcaactacatggtggctcacaaccatctgtaatgagatctgacactctattctggtgtgtctgaagacagctacagtgtacttagatataataaataaatctttaaaaaaaaaactggctcagagtaaagagctgagatttgtacttatataaatatgaattcaaagtctctctctctctgtctctgtctctgtctctctctgtgtgtaagtcttgatagttgatgttaacaggtttttgtttttttagaaaaaagggataagacagtaagcattagtaactttttttaaaatctcttgccagtggtattgtaattttactaagtacatcccatccaaggataaatattcttcttgctaaattttgaaactttgattttctttaagtggccatgcttcatcttttctagtcttcaaatgcttataactggggattttgttgttattatttgatcaggatttcccaaaatacaggagttttgaaatatacagggtatgacctttaagtttctctgtaaattttcatgtaataattcatattttccattaatttgagttttatcctcaaggagaaaaatgacttgaggtaaaaatatatgacttccaaaaatcatcctacatttttctgtagagtgaatgtttggttttcatgagattgcttgtaccttgagatacatcagtgggtagagagtgtaaggtgtgtccctaaatgttagtgtgtcctttgtaatttaccagatatgagcattaagtgtacaggagttgggctatccagaaaagaccctgggctttcctaagtgagagggctggaagaagcactgagaagtcacttgtactttcttgcatctttacaataaccccctattttggtggggtttttgtttgttttgtttcatttagaaaattgggtgcaagtgaaggaaccataaatcaggaaattcagcgttaccagcagttggagtctgtggctgtgaatgacatccgaagagatgtccgtaagaagttacggcggtccagtatgcgagtaagtccgtgcttcaggatgtcgtgagactttaatatatatatatatattcacactataattttattccttcctccctgcccccgtccaccctctgactgttccacatcccacacctcctccccacacccctgtctcccagtgaatgcccctgcccccctctccacctgacctctaaactccctggggcctccagtctcttgagggtgcattatctctgaatgaacacagacccggaagtcctctactgtttgtgtgttagggcctcaaatcagctggtgtatgctgcctggttggtggtccagtgtttgagagatctcgagggtccagattaattggaactgatggtcctcctgcagggttgccctcctcctcagcttcttccagcttttccctaattcaacaacagggagtcagctgcttctgtccactggttgggtgcaaatatctgcatctgactcttgcagctgctcattgggcctttcagaaggcagtcatgataggtacctttttgtgagtgctccatagcctcagtaatgatgtcaggccttgggacctcctcttgaactggatcccactttgggcttctgttccctatctcagatatttgtattattttcatttagttgaaaataatttaaacgttctcttgattacttctttgacacatgctatttagaagtgtgttgtttaatcttgaaccattttttccagataattttttaacacaaacatatacacaatctggttaaattacattgcagtctgacagcagtcattatatggtttcagccctttaaatgttatagcaaatcttagaacctagaatgtggcagtctgtttgggggagttttccatgttgacttgagaagactttgtacgtgctgttaatgaacaaagtcttgagtagatgttgattatatccatgtgacagatgtgcagctgagttggagtatgtccaagtggattttctgtgtgcactgggtccatttctgatgaaaggtctccaccatgatagtgaatccatctttttctctttgcatttctgttaggttttgccttgggtagtttaaatcattgatagtcaaactgattgttgatatcattggattaaacatctacctattttgtgttgcttcatattgcttttgttctctattcatgctttcatcttttttcttgtcttttgtagttttaactaaacattttatgattccattttctctttttttatttgtttacttattttctattgggtatttatttatatttcaaatgttattccctttcctggtttcctcccctctcccggaagtcccctatgccatcctccctccccttgcttctgtgagggtgttcctccactcacccacccactctcacctccccacctcaattcccctacactggggcatctatagagtctttataggatcaaggacctctcctcccattgatgcctggacaaggccatcctacgctacatatgcagctggagccatgtgtactccttggttgatggcttagtctctgggggggtctagctagttgatattgttgttcttcctatggggttgcaaaccccttcagctcattcagtcctttctctaactcctctgttggggaccccacactccgtccaatggttggctgagagcatccgcctctgtatttgtaaggctctggcagggcctctcagaagagagctatatcaggctcctgtcagcaggtacttcttggcattcacaatagtgtctaggcttggtaactgtatatgggatgaatccccaggtgggacagtctctggatggcctttccttcagtctcggctctacactttatttcatatttgctcctgggagtattttgttttccttctaagaaggactgaagcacccacactttggtcttcctccttcttgaacttcatgtagtctgtgttatttggagctttggggctaatatccacttaccagtgagtgcataccatgtgtgttcttttgtgattcggttacctctctcaggatgatattttctagaattgatttggaattttgatggggattgcattgagtctgtagattgctttcggcaagatggccatttttaatatattaatcctgccaattaatgagcatgagagatctttccatcttctgagatctttctcatcttcgatttctttcttcagagacttaaagttcttgtcatgcagatcgttcacttgtttggttagagtcacaccaaggtattttatattatttgtgtattgtgaagggtgtcatttccctaatttctttctcagcctgtttatcgtttgagaagaggaaggctactaatttatttgagttaattttataaccagcctctgggcctgtgtaccagaggctttccacggagatctctggcccgggctggttcaagagttctggagaagggaagcaagtgcgtgcagggaagggaggtcacttctaccacttctgctgatgcacttggccccacctccatctctgcactgagttgggtggggctgagcagactaaaggccaactagccagtgaggagtggagtggagctttaggcagcatattgggacagcagctctcttcccaagtgttacaactctttggacagaaggctcagtagttctcacacacttttaatccttcagaataggattcttatatacagttttggggtgggtaagggtctgacaacaggtacttctcattggcttggtctgagagctttaaggaaacttatttgcatgtgggagggcttgatgatggtcctacatgactgatggccacacacctctcttcgggggggctgtgggaagctgtgggaagctgtagctatgtgacagaagtcagggacccaggaggcatggccaaacacctgctgtcccatgcaggtgaaagtcaccaccaagcaggtcacctgatttccagatctttgctcaactagggtccaggcagtctgtgcacagcctactgccccacaccagacactttgctgaagttgtttatcggctttaggagttctctggtggaattttgggggtcacttaagtatatggtcatatcatctgcaaatagtgatatttttacttctccctttccaatttgtatccctttaacctcctttttttgtctaattgctctagctagaacttcaagaactgtagtgaatagatagggagagaatgggcagccttgtctagtccctgattttagtgggattgcttcaagtttctctccattcagtctgatgttgactactggtttgctgtatattgcttttactgtgtttagggccttgaattcctgatctttccaagacttttaacatgaagggatgctgaattttgtcaaatgcttttcagcatctaatgacatgatcatgtggtttttttctttgaatttgtttatgtagtgaattacattgatggatttccatatattgaacaatccctgcatccctgggatgaagcatacttgattgtggtgaatgatcattttgatgtgttcttgtatttggttggcaagaattttattgagtatttttgcatcagtattcataaggaagattggtctcaagttctctttctttgttgggtctttgtgtggtttaggtgtaagtgtaattgtgacttcataaaatgaattgggtaaaataccttctgtttctattttgtagaatattttgaagggtattggcattaggtcttctttagaggtctgatagaattctccaataaaccatctggtcctgggtgtttggttttattttgtttgtttgtttggttggttggttggtttgttggtttgttggttgttttttgggggattttttttggttgggagtctattaatgactgcttctatttctttaggggttatgggactgtttagatggtttatccgatcctgttttaacttggcatccttgtatatgtctagaaaattgtccatttcatccagattttccaattttcttgaatataagcttttgtaggatctgatggctttttgaattttcacggtttcctttgttatgtctcccttttcatttctgacttcattaatttgggtactatctctgtgccctttggttaatctggctaagggtttatgttatcttgttgattttttcaaagaaccagcttctggttttgttgattctttgtatagttctctttgtttctattcagttgatttcagccctgagtttgattgtttcctgctgtctacttctcttgggtgtatttgcttctttttcttctagagctttcacgtgtactgtcaagctactagtgtaagctctctctagtttctttttggaggcacttagagctatgagttttcctcctaaccactgcttttactgtgcttttattgtgtccataggtattgtgttttggtatgatgtgtcttcattttcattaaattttaaaaagtctttaatttctttctttttttcttgaccaagttatcattgagtagagtgttgttcagtgtccttgtgtatgtgtgttttccgttgtttttgttggaatttaagacaagccttagtccatggtgatctgacagggtgaataggattatttcaatcttcttgtatgtgttgaggcctgttttgtgaccaattacatggtcagttttggacaagggaccatgaggtgctgagaagaaggtatattcttttgcttttagatgaaatgttctataaatatgttagatccgtttggttcattctgttagtttcactgtgtctgtgtttagtttctgtctccataatctgtccattgccgagaatggggtattgaagtgtctcccactattattgtgtgggatgtgatatgtggtttgagccttagtaaagtttcgtttatgaatgtgggtgcccttgcatttggagcatagatgttcagaattgagagttcatcttggtagattttttcctttgaccagtatcaagtgtccttccttaacttttttgataacttttggttgaaagtagattttatttgatattagaatggctaatccagcttgtttcttgggaccatttgcttggaaaattattttccaaccttttattctgaggtagtgtctgtctttgtcactgaggtgtgcttcctgtatgcagcaaaattctgggtcctgtttatgtatccattctgttaatctatgtctttttggggaattgagtccattgatgttgagatattaaggaaaaatgacaatatcacccagatcaggttgggttctgtccatttggtttctgttaaggataagccacatgtaaaacagtgcagctgttagtctgtatttgtgggttccgcaatcctgagctaagatagcaacagatcaaaaatattttttaaaatgaataaataaagataattgcaaaataaaattttttaaaattgcttctgtactgaacatgtacatacttttttttgttacccccaaacaacatgctgtaataactttacctcgtgtttatgatcatactagggattttaagtaatctagacattcagactatgctagaaactatgtgttggttgtatacgagtactaaaccattttagttttttccatgacctaattatctcttttaatttttatttttatttttttaatttagtctaaattctggtactaacacattttaaataagagacttgcacatactaaaatttggccatactccatacaactatacttgattttcttttcttctcttctcttccttttctcttagttatgttaatatataaagccctggatctggtcctgagagatatctgagctgctcatttccacatggtcatgttctcatgccctcagggacagctcaccaggaaccccctcaaccagggccagctctaccctcgccaggcagggtgtagggcgtcctcttcacagtgttgcagttggtaaggaacatggcccattttcccactctcctgagcccagggcaagctgtcctgcctgccataggtggcgaaggatgagggtagaaggtagtaggatctctcttacccttacccatgctcctacacagcagacaagttgcaaatccagctttctcattcccatgctcaaacccgcagggtcttctcttaagtgctgcacctagtgaggggcagggacagctctcctgttcgtgtgaccatggggctaggtgtcctgcctgctgcaggtggtgaggggcaagcgtggagaaaggtatctctcccttccccacaccattgtataggagacaagtggtaggggcaactttctcatgctcatatcttcagagctggttcaccagcaactcccacaaggtgtggtgcctgttctcccaagaatttcagctgggctaggggcagggtcagccctcctgctctcaagctcccagggccagatctcccgtggtgcctaagtgagggggtgggacaagttctacattaacatgtccccaggctcaggctacagtccagtccagggacttacaactggcctttggtggtaacagactcctgctattacagggctacggacactcaatgggagcacagaccagggccccactgtggttccaggtgtcatcatggatcctggcattcacatcaagctgttcctcactatcctcaagtctccagttctgcctctcttcattgtgctcccatccttctgtttctctttctcttccatttctcccccacttacttgttcctcttagtggtgtctggggtctctgagtgtctggaagcatgtcagaagtagtctctgagtgctatgtgtcacttgcgcgttatgccactgagacagggttcccccacatcagtatacaattgccttgagtcactttgtttttcctctaccattttattaggctgcttccctcaaggataagtggggtttaggttacaaaccaagttacagccgatcgaagagcatttcagcttctggaagaccacctcttaagagaatggaaagagcaaggtaatacatattttaaccaatcaaccaagattcaatactttttttgataatatagaaatcacccttattagtaaaatagaaatcgctagttactttctgtaaacatcattggtttaataaaagctcaaaccttcattcctcagtgtagtaagaatattttagtaaggcaattttatttaggtatgctttatgtataaccttacagactatatgaaaaaatgaaaatttgaatactgttgtttttttctaggtaattaaataggaaagatgatggtacacattaaatttttaatatttgaatattaagtcagcactataaaaataacatgtatgaattcctgaggtgggttctagagtggttggtagagtgtttttgcctggcatgtatgaagccctggctttaattcctcctaccacacaaattgggtggtgcatacctgtaatgctagctagctcttaggatagataaggggatcagaactcaagagcattctctgtctcagctacatagtggattcaaggatggcctgggatacatgagaaacctatctccccaaaaatgaaaaagcataactcttttttataggtttaattttagaaaattggaagttaattgagacaagacttttctacagatgttgaaggttaatacatggaatgccaaaatttcagttatttgataaggttaatagttagaaatagaatgttaatgtcattaataagacatataaagccaagatttttttatagtgaccatattggggttttgtactttatttttgttgcatatttatgcttatatcataactgctttattttacttatagttctcgaataggagaaactgatgagctcccagaaatccgtgtggatgcagcatctcctggacccagagtaaccttcaacatccaggatacagtaagaaagacagcacttgttagaaatttgtgttgctaagtgctaagtattttttaaaaattacagacttgcaatattataattttaaaggtagatcacctgcaatgacaggttgcaacagctgaagtatctgcacttccagcaagcaggtgcagcccataagagctccattgcatgcacatggccaagtatatgcacagtgacgatcccatacctgcatgctcttagacgggattgggtttggttttttgttagacagtttttgttagtaaggacccatgttaaactgtcctctaagcagttgttactgtgaaataaatatttgtttatgtgttaatgtgcatgggatataaatagtagaaggcataaggaaggtcagcttcagagctgcacaatacagcatgttaaaatttatgttaaaatgtttatttgtggattgttcgcattgtctttatttttcacattttattttcttttcttattattttaattaagttgaaaaacacagtgtggggaagttcaccacagtccagatctccaggggaagggtactttcaggtacttatgaaaacaacacaaaatttgtctttaaaactaataaactgccctgaaattttgctttaaaaatgtcttcttttcaagctaaactgagacctcagaaatactttatataaatatttaagtttattggaattatattttaatgtgtattttataataccccatttgggttttatatttacatgtagcttaattttactttgaccttcaaatgtgaggaattttaatcagcttataaaatcaactaagccaaatttaaactctaaaactgcagtttactaaatcatttactattgatttgttgatcctaaaatcaatctctttttgatcctgaaatcaatctctttcccttacatttaactatggagtaaaccattttaaaatcaacatctttgttaattgctttaaatacaagtcaaatctaactccaaacaacaaactgattgataattgactactaattcttttaagtcactgtagtacattagtgttcattacatattacattcagaactgaatctgatggcatatgcctgtaattccagctacttgacagacgaggcaaaaagaagtgtgaacccaaccttttattttcagttttttccaggcatgttttcatgtggcctaggctggctttaaacccactgtgtcgctgaagagtgccttaattcctgatcctcctgcctctgcctcccaaggctgagattatagtcacgtgccactaagctcattctcaacctgaaaaacttatctctaaatcaaagcagtactaaggatattgctatcatgcataaaaccctaattttgatctctagcaccaaaaaataaaactaaaaagatccatttaaaaattgttatgttctgaacagtatgaaaatgtgctgcataatacttattagtacaattaacattttaagctagattttaccctgaatgtattattaaactaaacatataaactattaatataggtatgtgtatatgtatatattctacacatagcaccagacatctaatcttgcctagaaatgttcttttacattatagttaaaaaaacaaaaaaggaaaaggaaaagaaaactggcaatcattccaaatatgtttcattgtctttattctttcagacttaagtctcagtatacatcccacagttgcactgtgtttactcaaactgtatttgatctcaaagcaattagaatgtaatacagggcctggagacatggctcagcagttaagagcgcttgctgctcttggggaaggcctgagtcttcccagcacccacatggtgcctcattaccatatataactccacttccagagaatctgctatcttcttctaacctctgtaggctcctgcacacatgtgttacgcgtaatatgtatgctcaggcacatacacataaaaatttttaaaaaaaaaaaatgagtgatatactaaagatttaccatttttcaaaaaaaaaaaccttgaaaataaatcatgtatatgaattttaaatggatttaaaatttaaatggattttctagttaaatgactttttgggtttgggtttttgttttgtttttgtttttgtttttgtttttgtttttgttttttttttttttttttttttttgggggtactgaggattgaatccaaggcctcgcacataccaaacaagtgttctaccagtactttacatctgtagttataatcagagcattcttactggtaccaatttttggtgagccagagagatatttcagtaagggtgcttgctaccaagcttgtcaacttattttaatccttaggatccacataggagaaaaccagctagctcaaactgttttctgacctccacaagtacattttggtacatgtatgcactctgcccctccacacatacatacatacatacatacatacatacatacttaattaattaattaattaattaaaagtatgcgtatttgaaaataattctagtcctatttttaaatcatagtatattcctttttatttaaaaacacttaagttagataacatgaggttagatattaaacttggcagttggaaaatagattatggatatatgatttcatataaaataaatatcaagcaaagagattacttttacaaaaatttaccaactttaaaatttgaaagatgttctgaaaaaaatctattcatttgctcatttatcattttaagggaaaaaaatacctgatttctacaaatgtttgttttaccatgaatctcacagtaacatctactacttattagtaataaattaaattatcttgccaactgcattctatcagggctactcattttcagatgacactggagcatcactgtttatctgggaaactgagatcagttcatagcaagttttgcacacttcaaaactggcttgtccatcagtggtggcacacacctttaatcccaacacttaggaggcagaagcaagaagatttgcttgagtttgaggccaataggatctacagagttagttcctggacagccaggactactcaaggaaaccctgtcttgaaaaactaaaaaaagaaaggaaggaaggaaaaggaactgcagcccccagttatttacttaaaatacagcatggttaagtttgaataatagatacatgttttattactcaactgttcacatgtcttttgtcagtccatgaaagttcagttttaaagatttgtccacaaaacttcctctaaaaaatatctttactaacagtcactgtattcatcatgaattgttcttccattctgatttatatttgtttctttacacgtaatctgcttccgctttgtgtgtactaataaaatatgatgctttatgttcctataaagtaaaatttcactgtgattttttttttcgcgtgtcagtggtaccttactgtggtttgaccgtttccttccttggtatgccatttcatatgttcaagagtctgaccttcctttcagttcacagtgaggaaatcaactcagagcttctaaaatgtttagatgtacatctttcatatttttagtttttctctttttaattgagagagaacttgaaaaacaacctgatttatatatttttttttgtaatcagtttccagaggagacagaactggatcttttgtcagtaacaattgaaggtccatcacattattcatcaaatagtgaaggatcgtgttcagtgttcagctctcccaaaaccacaggcggcttttcaccaagtgttcctttccagtcagaagatggccgaagagacgacagtctgtcttctaccagtgaagactctgagaaggatgaaaaggatgaagaccgtgagagggaaagattctatatttacaggaaaccctcgtgagtagccatttactgtaagatctttaggtggtaagtcagaatctagaagtgagtctaaggtatattatccagcctcatatttaacaagctaagcatgacgtcccattcctatcaccccagcagttcagagatggaggcaggaggattaggagtttaaggttctcctgaactacatggcaggctctactccagcctgggcaacatgtggcgctgttttaaatataaaatcataataataacaataataaattagcaaaaaaagtgttaatctgtaagtaatactatacctagccataatttctaatgtgatttaactttatatggtgctgttttctcctaaatataaataggtttatttatattgctctaattatttctccatgataatacttgtcaataaaacaaaaatagagatatggttataggctatgatataggaaagaacaatattcctcctgggcttaataaaaataataggagacactgaaagatatcatacagttgaggaaataggaatagtagagggaagtgtgtatcagtgaatggggattttaagtcgttcttggaagaaatgagaatagagtgttaatgaaataaaaggcagatggatagataggtagctctatctatctacatatacatgaagtcttactgagaaatgtgccctcgtgaggagctagaaggacctttcaaatgtacctgcttctaaagcctggtccactgcaactgtgcagtaagattgagagtttccactgctgccgtctcaggctcttactgtgctcagagggttcctgcaccctttctgcagagtacaacaaattgctttggaacctttcatattagcatatttggcctattcctttacttactggaatatagataacttcagataactttcaaagaaaaattaaaattcaaatcttaaaggtttcaaaatatggagtaacttttatgtgctcatttaattatagcattgagtatagaattctcaaaatgtttgtcttccagcaccagtgtttagcatttattgtttgtaatcttctcaattctgtcagcgtaaattacccttccttttctaagtgtctgagtgtgtgtgcacttctgcagggtctagaagttggtgtggatctctggaactagaatttcttatggttgtgagctgtcatgtaggttctgggaattgaacctaggtcctctggaaaagtaatcagtgcttttaactgctgagccatttctccagcaagtgtattcttttttaacagtagccctcagagtcaaacaattgcttccactggacagaatgtcggaatctgtgatcttttccaagtgtccagcttggtcatttttatgttttcttttgtgaagaacattgagcatgagatgtgcccttcctgggctgtctgaatgggtagtgcagcaccatcctctgtggccagggtggcacaacaggttttctagagcctgtcctgagtaaatgagacttaatggtgtttgttggcagttccttacagtacctacaccattcctttctttgcttctgtgatttttgactttcaaagaggaaagctgtttgagtattttctatgagcttataaattaagaaaatttctttaaagacttattcatataacactgggaaatagttcactaagcagacttcaatttactataatgagtaattccttgttttctgcagacatacctctcggaagaaagcaacaggctttgctgctgttcatcagctacttactgaacgctggcctacaaccccagtcaatcgaagtcttagtggcacagctactgagagaaatattgactttgagcttgatatacgagttgaaattgacagtggaaaatgtgtccttcaccccactacccttctgcaggagcatgatgacataagtttaagaaggtaagagacagctggaaaagttatatggggttcattagttagaaacactgtccatatatcatgatttatcacaaatgttccccatccaacaccgcaaaatttaaaagtaactagttgaagttacagtattcatttgcataacacagtttgttaaaataaatatatcttttatggcaattagaagcagatagctgatttagaatctggtaaaattgttaattaaaatagatctatagaccaggtattttagctcattggtagattgtgtatatattgtataagcacaggatttaatccccagtagtagtatgtacgtacacacacacatgcatgcacgcatgcacgggcatgcagacacaaagatataagaatcctttggaattctttgaacaaacccaaatttctttctttgtattgattgaaaagattctgttttgaggataatgcaggactcttgattaggaattttgatatgtttacaaagaaagactggaagcagttatgcaaatagggtctacctagattgaacacaagtaagacctgcctaaattgaacacaaatagggcctagctaaatggaaattgtgatgacataaacagatttaacattagattttgcttatttgaggggtgtgggtatgtgtcatgtgtatgctctagtgtaaatgcatgtgtgtgcttttgtgtatggagatcagaatcaacctgggttattgactctcagatgatgtccactgtgttttctgcatcttagagctcacctcctaggcaaggtggctgaccagagagcatgaagtatctttctatttagacccacccagtactaggattacgagtgtgtgtcaccatgatttattttccagggctgtgtatctcaaactcaggttctcatggttgctattggaaatgcagtcctgcctgagccatttcctcagctctttctttgaatatttcttctccttttttccttcttttctggtcaaaaaaattgcttatgaaagtaaatgacagttcctagtgagtgaaaggatagaaatgtagataagaatagcagaatgtaacaactgttgaaacagatattgaagatttcctatctcattccctttatttttatatgtctaaaatgaagtattttaatgatcagtcaatgaaatttttataaaatgagagaataaaaaatactttagacaagtatagtatcttataagagtaataatggtgcctaaagaatggctggtagactgttttaattgaatgataacagactgctatgtttgcctgtacttggttcatcctattatgtttaagtgaagcaggtatgaacttaggaaggagtaaagcaactgtgcatggcacacttgtacttccagcattcagaaggcagaggcaggggaaggaaggaaggaaggaaggaaaactcacaccaataaatagagatagctagttttaaggcatataacattattatcattcctttcagacattaaccagtctaactagaagttctgtccttttcttaaatgatttctttttaaaatattttgaatttgatttttaaattcaccccccctttttttttttcctataggagttatgatagaagttctaggagtttagatcaagattctccttcaaaaaagaaaaaatttcaaacgaattatgcttcaactacccatttaatgactggcaagaaagtgccatcctctctacagacaaagcccagtgacttagaaacaacagtattttacattcctggagttgatgtcaaggtaaaaactgaattgtatagaataagagactaaaatattaacagtttattttctactagataattttcttttgcttactttgtaaaagataaaattttctgacttaatctaatatagtcatagtctgaatataagaatatctaaattgtgcctcaccgtttattcacagtaggcttgctaaacctttccatctataatttcaataagcaataatgtattttttaatttctaaaattattgaattttagaccattacgcttaaaaaactttaaagacaatttggattaagctctttaattttaaaaatgaaaaagttaagtacttctcagcccctcacagctgacttacaagcagaagctgagtcttccttcaggcttccaagccagtagtcctcccagctacatcttctgtttcatggtatttcctcatctgcaaaatttttattttgatttttctttaatacagctgcattacaattctaagacactaaagactgaatcacctaacgcctccagaggatcgtccttgcctagaaccctctccaaagagtccaagctgtatggtatgaaagatagcgcagcatctccttctccttctcctttaccttgcactgtgcagagcaagactaacaccttacttcctccccaacccccacctattccttcaggtatttaagaggctacactgtatttctgtcatgtttttcttaattttcttattttgctttctctgttgagattctttaatttctctgtttaagaaagcattgtcaataatgactatataaaatccatatgtgaaagtataggactactttagattctttcttatatttttattatgttagcatgttcttaataaataaaccacatttttagaacaatgtatatttgccagagggtagttcatgtggtttaagtttgggagctatgatcagctagggatcaaatttacacatatatgagcacactggtattatctgcagttattatttgttgtgacctaaactattatccaaaacttacagccttaatcacattgcctattgaaaaatgaacaaacaaacaaatgttaaacaaaaacaccaagaagagtttctagattaaagctaagatgctggctaggtcacttgaatacttgactgtactagaaagatcttccatcatgttctagtcatgtgaatggcttactggtgccctaattccaccccatgtggatatcaccactgagttgggaatatttttatgacatgacagttaacatcctttgggtggaatgatgaaaagaaaagcaaaacctgcaaagcttaataccttagctttaaaagtcacagattactacatttagagtttcttactgattatacaggccattgaaagccagcaagggttcttggaaagcatctgggaaatgcatatctcagcacatgcatgatacgctacacacacgcacacacgcacacacacatgcacacacacgcacacacacatgcacacacacacgcgtctaacatagggattgtaagaactaagcaagaattattgaagacgttttgtttagaaatttcccatgctatataagccctttaaagtagtcagtaaagaattatgacaagaatgcctagctagtgcttaccgcttttcaattgacatagtataggtagatccattaagaatgaggcacatactagtattccattgtataaatggagaaagttagggagtatagatttggggcactttcctatatttatacaactaattttcaaattggagattgaaaacaaagttagcaatgactttgttgggtactttagtgcattttatgaagcataagtacttgactaggaagaatgaatgagtcatggtctcctatgtaaagcactattgtatgaacatattaagcataagaaatccaaaagctgtgataccttcccttcacttcccactaattcatattagttgagattttctatctttttaagtgaacaaatggactagtaccagccaaacaagtgtaaagttgataatttggaacatagtgtgtgaccaagcacaagtaagaataagcatagtattacaaacattaataatatttagtctaacatttatgtatcatttctatcctatttttactcttttctcttgtagtcttagataaagtacttcacttaattaagttgtcatacaattctaacttctcattaactggtcatattttgttgggacattttattgtgttccattcagtacatcacatttatcaatattctagctaaaggaaaaggaagtggaggagtaaaaactgccaagctctatgcctgggtagcactgcagtcattaccagaagaaatggttattagtccttgtctattggactttcttgaaaaggctctggaaactatcccaattacaccaatcgaaaggaattatacaggtcagtactctccacatatgcattctgactttagatcttatttcatagagtttctcagtgctattacacgttgttatatattctatgaaacccccaacgcacatacagcacaggacttccaggtctgtgttcattcagagatgatgaacctaaccgtcaaaagactggaggccccagggagtttagaggtcaggtggggtggggggtgggggcatccacgtggagatgggatgcggtaaaaaggaggtgtgggatgtggagtagttggaaggtggatgggaggggcgaggagtagagtatggaatgtaaaaaaataaattaaaaataaaataaaatttaaaaaaaacaaaacaaaactggagaagaaccagggaggtcatttcagtcttactcggaggtagagaatccaagctgtggtaaagccatattacttttcaaggttacagcttgatagtggcagcactagtgattgtatgtcctatattaatgtgtttcttgtgctggactctgtttgtgggcatggcataagtgctgttttctgtgtatagtgtgtgctgtggtgggaagattgaatttggggaaatgaacatgagatttgagtaggtaaggatatgtagcctgacagacttgaaagcaagtttctgttattgatgcatcgtatatcaatactagttaggaataaggattttcccgcgatttgcccttgatataaaacttgaaactaaatattttaacagcagtcagctcacaagatgaagatatgggacattttgacatcccagatcctatggaagaatcaacaacatccctagtgtcatcttcaacatctgcatactcttccttccctgtagacgttgtggtttatgtgcgagttcaggtgaggagtgttgttacttcataaaggaaatattttattttaaattttagcattatttcctttcagattcttctgaatcataatctcatgaatgtttgatatctctacaatggcttagaagtttgctaagtcctgagaagtatatgtaaaaatttgaatgaatttactattctgatcagtttccattttgggtttctaatcttttatgaaacaaaattaaaatatttaagtttaaaccttttgaaagcattttatctttttattagtatggtaccatttactctcaccattacactttctggatggatttaccatataattaagatacaatagtatcttttaaggagtttgtgtaaaaattgtataattttaaaatattttgttatttaattcaatcttcttttaggaatatatattgtcctttgacttaatccatttgttaaagaggattagaaagatgactgtatccaaaatttaagttcagattaccagtcagataaaatgtttaaatcagtctgtaaaaataagaaaagtgctggtatcatttagtgcagcaattttctacagtaacagtttgtccagaagatcattagtctgagacgctggagttttgtactagcttatgttaaaagtctgatgaaaatatactaagtacttaagagtttataaaaacttttgttactaacacagcagtacttagtgttttaacatgtgagtacctcctttaaaagatctgacccttaacgaaaaatagtatggacataaatatgtttaaggttctgaattatccaaatgtcagtggatgttcaaatactttgtgttgtagacaatatctcacactctgtagcccagggtggcatataccctaagttggccttgaacttgcaataatgttcctcccctaccaccccttacagcaagtgagccctatactataatatttagcttcataaagattgttccttcctgttcatacactttggttctatgtcatccttctctttttatgagttgtggcattaaatataatttcttttaagtgtcagatgattaaacatatttagttgtgtatgttaaaaaattacatatttcttttaactattaagttcttaaaatctttttccccctcctttctacactttagccctcacagatcaaatttagctgtttgccagtatcaagagtagaatgcatgctgaagctaccatctctggacttggtattttcttcaaaccgaggagaactggaaactttggggactacataccctgcagagaccgtgtcccctggcagtaatgctcctcagactggagcaaagacctctgctagcaaagctggaatgccaggtatagagatgttaagccacctggtgcaaggccaagtactgttcttaatggttattcatctatattttaaatagttttagaaaagcaggatattaaaaatcgtgacatttgtaagaaaaaaatctatagcagaccaaagttgtaagtatatttcatgttagtagaatatgagtcctctttaatttatatgtttacctcagcagtaattagatagcattacagcttcagcttgcatgccactagaagcactataataactaatagttcatgcatccatgtacttttgaatgtttgtgtcacattggattatacattttaggaacaaagagttttgcaactggaaataaaagatatgcttttatgaagatctgtccttatcaaattttgccaagtagcacttgtatttttaaatggtaaattttgctgtctacgtcctttgtttcgttaaaggtttgattataaagtacagttgaggatttcttgatttctagcacttcttcctcactgaaagctctgtgctacaaatcatatagaaatacaaatttaagtgagagcgcagtgttggctagtttgagtggggagtgacagtagacttgtgtaaacagcagttcttagcaagggcagcagatgcctttcagtattggatttcacaactgagaatctctaactggaagatagtggggaaagcaggagcagtatgcagatatctggccaatctgaagacccttctttctagaaagaataatttgatttaaaatgttagaatggccaagtggaacacattaaagcaaaatatgtgaatgaactccgaaacaccagttccagagaagcatgaaaactgttaatgggaaatcatccttcagatttggaaggtgtcactcaggcttaggtcctggttttttgtacagttaacttgaattcaaaattttaccaaatagccttatgtttggcttttgagagagagcatgtttgtccttgtagacttctctgtggctgatgatgctggaatgtctcatttacaggctcttcaggattaggcagcccacttggccgaagtcgacacagcagcagccagtcggatctgactgggtccagcagcagctcatcgggcctgagcttcactgcatgcatgtctgacttctccctgtatgtgtttcacccctacggtgctgggaagcagaaatccactgtttctggtctcacatctggatcaggaggactaggtatatttgctcgtaggcatctttgttaattttttaagctttcttttcttagaccacatgactgtggctataagccaacatgagaaacttgtatttttcccttttgataatacctatcttacccctgttttataagtaaaactatgaaacaaattcagataaactgacgatacaagaatttaaaatttaagaatgcttattaaatgatatgtatagcataatatagaagagttttcttaaattattaaatcaaattcattaaaatattatcaaatcacgtataaaattatagtccataaaaagtaaaaaattttaaagtatgtaggttatgcttagtaattttaaatgagatcattaaactgtcatttagtaaaactaaatctgcatttcaaagttcaggtctcattagtgaatatttcttacagtcatataagtaaatactaccttttgttattggaatgagcttgtcatgtatatgggcttcaacctgtctaaactctgtgagaaatgcaaatgcttcttagattattctgtctaaattttcacgaatttaactcctgttaactggtggcatgttacagtatattggataatcttctttaactagttgtgtgcatatgcatacatctgtatgtacatgtgcatacatatgggcatttttcttgttttgtttttctcagggaatgtggatgaagaacccacttcagtcactggtcgaaaagactcactaagtataaacctcgagtttgtaaaagtgagcttgtctcggataaggcgctcaggaggcgcctcattttttgaaagtcaatctgtaagcaagtctacaagcaaaatggacactacattaatcaatatatctggtattctcttttatagtttttaattaaaatattatcattttaaacaatgaactctatttttaatagtgcttaaatattaagtatacataaacattaagcttagtgataaaggtaagaagttcagcctagcctacaaagactctcaactcaggctgttagtgttagaatgctttctaggtagacatatccaagggtaaaaaataccaaattaaagaacaaaaaattcttatttttttattttgcttcttcttggttatgagttcctaaaatttatgactttttatgtgtatcagcttgtcgatgtttacatcactaaaaatgggattgagtagctttaataataagtcctactttgtactagtaggtctttgcattgtaacttgagtacttaaaattaagtgaatataaccatcttggggaatttagggtactaagtgaaaatgtttacaacaataatctcactaatacagtattttcccttaaggtgataaccatttagcaaacacttttagtctatattttatagtaaacttttgccagatactatactagtgtgaacagatgtaatgcaggtcttacatgtgaacaaaaataataacacatattgatgtcaggaaaatacccttgaaagtagcaacatgatatttcgaatcatagcggtattgaaaagggatatctttggagcatctttggctactatggctgaatcatgaggtttaatcaaacagttgtacagagtagatggggcaagagggagaagtcctggctaaaggtaaaggtgatgaaatttaccagtagctgactgtggagtcagattgcactgcgggatcagatatttattctttaggtggtgagaagccattaaaggattggctaaaggactgggatgatgcttcagattggtgcttttgagagagtcagtagtaccgcaagccatggaaggaaaagatgcttgaggatgctgtttaatcagcagaagtgagtgaaaatctgatgcaacagtaaaaagagaaaggggggaacagcttcaaactgagagaagaaagtcctgaagttgcacaaggagcagtagaggacaaagggtggctgtgaacttaaatgacttggaggggaatggttgaaaccattaacttacataactataaaacaatctaaaagtgcttatagatctatcagtggatcagctggtcaccaggcctgtctgtatgtgctcagagtctctagcatgaagaagcttcgggagaggaacagaagagaaagggggcagaaaggaaaaggtgccaaagcagagcccctgaggagaaccataagggtgcttttcttgtgaaaatgtctgccctggacaaaaagggaactaagtgctcctttgcacacagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgtcttctactgttgtactagcatctggtccaggcaactcctgattccattgaaggagtgagccagcacctttctcccgaatcatcaaggaaagcatactgcaggacctgggatcagccaagccagtcagcctccttcacccatatgccgcagtcacccaatgtgttcaatgagcacatgaccaacaataccatgtcaccggggacagcagcacagagcctcaagtccccagcttccataagatcaaggagtgtttcagactcttcagtccctcgaagaggtaacttttgttggccagtatgcctccagtgttcctaagataaaaatcttactcaggtttctccccaattactagagatggattcttgaggaaaagaaaccaataagtaccaaacacttccaggtactacctacagaagagctctgtggctgtctagtaacttcacaaagggtaggaagtgaagagttgccatattgtcaatgtactctgtaagaatagctgcttttagaaacattctaacaatgttgtgaatgtaccaaaagatggttcaatattgaagaaacaaagtctttatattgattcaattgtttgtttatttagtctttttttttccacctcttgcatgctagtgttgtccttgtgctaatgcctgaatatatcaaaatgaatgatatagttcttggcacaaccaagaccaaagtacaatgagtaaggtcagtacttggtctgctcagagtccattggatgaatgccagccacccagccaatgcctgcatttctgaatggtttctgtctttgaggcttctgtttgactgaaacattttggcttttggcttttatgaagaaaatcctggagtgatgaattatctgtgcatctgtatctcatgtgcaccaaagccccctcatctcacctgttttagaagcaatgtgattattaaacatttggtctcatacaacaatatcatgtctacctttagattatagaaactagtgtgttttactttgtaataagctctgttttaagtgaataaatgtgcatttggttttttttttctgactttagattcaatttcaaaaacatcaactcctgttaacaaatcaaacaaagcagcaagccagcaagggactccgtgggagacgcttgttgtgttcgctatcaaccttaaacaattaaacgtccaaatgaatatgagcaatgtcatgggaaatacaacgtaagctattcagagaaaaatacgtcttttctaatagcactttaaatgttccttgcagtgttgtaaagcagttcaaacccttttaaatgcagtaatattttgaggcagttaaataggtgaaaagttttaaactttttaatctaaaaatggattaattgtttggacactataatacaaacaacatgaaatacattcctaatggagaattatcagaaaataggatacttttctagctacaaagcttcattagttttaatattcaaacatcaaccacatagtatttagttcagatatgttgagctgggtgtgtcgggtgcatgccaatcatcccagcactcaaaaagctgagatagagtcatttcagttccattattcaagaccagcttcaacaacacagtgaaaacctgactcaaaaaaaaaaaaaaaaaaaaaagggaactatttcattataaaatcagatctgtgcataatctgattttgctactggttttaattcatgatattaccagccacatatctaacaatcttttccttctttttagttggacaactagtggtttgaaaagccaaggccggctttctgtaggaagcaacccgtgatcgagagattagcatgtctggttggtctggggaaggtcacagttagattccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcgtttacattttcaatgctatcccaaaggtcccccatacccaccccccccaatcccctacccacccactccccctttttggccctggcgttcccctgtactggggcatataaagtttgcaagtccaatgggcctctctttgcagtgatggccgactaggccatcttttgatacatatgcagctagagttaagagctccggggtactggttagttcataatgttgttccacctatagggttgcagatccctttagctccttgagtactttctctagctcctccattgggggccctgtgatccatccaatagctgactgtgagcatccacttctgtgtttgctaggccccggcatagactaatttttatattatacaactaatacaaatgaaaaaggctgggcagggaaggataattacttttgctttatttatatcatctctgaaatttattatacaaattgtatttcatgctttagtgagatttttgtgcatggagatttgaaatgggatatttttcaagtaatgatatcaagatcaactacaccagacttgataaaaataggaatgaagctccaagagttcttcacacaacagtttgatactagtaagcgagctctgtcaacctggggacctgttccttatctgccgcccaagacaatggccaacaacctggaaaagaattcacaagaacaatgtaagatttagagcgttggtatattttttgtcttccctatatgttatattcttaagtaacacatttgtatgctgtacttagaaagtatcctgtgggctctccatcccgtccactcagcagaaaactgactgtgttcctagtaatggtgtcagctgctctttgggaaggtattactttttatcctccaccacagcttagctgcagcatatctactccgtgacaaagttaaattctgatatgtgacatgggccgaggacgcagaataactgagtctgtctgttaacctagtattaggcaggttatcatctttcacttagtaattaagaaattagcgtgtatttattgagcaacaactacatgctttcgtacttctctaggcacaagagttgcaagatatgccatcactaactcatgaaccttacattcaaataggagatggagactataattatataaaagtcatggtttcaggtagatagaagtgcttatgtaaaacacaaagcatggaaaggatatagagaaggttaaagtgaaatgatggctatttcagaaaagatgatcaggaaagccttgtctgaagtgacattttagtagaaatgagtcatttgatgaaagatatgagactgcatgttgggaaagttctgggcaaagggctgtggaggtctgaagctcctgttgttactcataaagttggcttatttgagaatcattactggacctgggatcttaacccttgggaaggtgaggcagtagactacagatcaagttcaaaggcagcttggacaacttagtgtaagaccctgtctcagaatgaaatggtcactatagtctggagatacaattcagtggtagggcccttgcctgacatgttctcaatggacgtggggatttgagggcaaatgagagtcattaaaataactgaacagagcagaatgatcagtaagaaaaatattggacattatctcaggtaaaaggcaaaaataaggtttttaatatgatgagtattgtagagtttttaagacatttggtatcatttggtttaccttggtgtaaaatactcctttgcaaataatcaccatggctactgtggggagaacagacatgtaggcagttagggatggacacaggaaggatggtacctttaactaggatgacagtggtaaatgtgatcagtagtaagcagaatgaggacaacttggtaactcgtagttgataactctttacttgtggttttggggttttctaggtacagggtttctctacatagcccaagctgtcctggaactagctatatagactaggctgacctcctaagtgctgggattgaaggtgtgcaccgctacacctgagctgtctccttgtgtacattgaaagcaagctagaaaatgtaaacaaaagtgaagggtcatattcctacctcagaatcatcactgtgaagcagcttagagcttaaacatgaacagattcctatatattctctacatatttgtacacttgtttgttttactttgctttgtttttcgagtcagggattctctgtgtagccctggccttgaccaaagtatcactatcccttttttacactcaaactttctactttgccagttacctgtctctgtcttccaggaactattcaaacttaatgactgacccacaagtaccaagcagtttgtcctgaccatgctcatagtttaaacctggttgttatctatctgtactctcctttagtttggcgtagttctttttgtatgactatacttactaaataaacatggccagttgtctgcaggataccatactctcttcagtgacctgtttgtggtatcattttcttattcctttatgcctttatagtctttataagcactgttgttagcaagcataagtaaattttggtgctgtgcaaagtttaaaaagtccttgtcaagaccagttaaatacaatgtatgatcctcggtagcactaagaaaaaaatggaaaccgtcaaaaaaggacattactggaataagtgaaaaaaatctaaatctgaattctgtgattgattagcccttttcaaacattcatgtgcatatataacacctggaaatctatattttgaaagtgctaagaagtgaactcagggccttccacatgccaagccaatgctctatcactgagctgtgctcagcctaggaaataatgagtagatttaagcccggggaattctaagaagctcttattgtggtgctgatggtgctagtcatctgaccttactttaagtagaaagcacaaggaaagaaacataaaacccctcattctgggttttttttttttttttttaacctgtgaaaagttgatagacataactgacagttgctgtatttcttgttgtgtagaatttgtgtgaaagaccatttaggctctttgtaagtcaatcagcattatagacatcgagttgtgagagttttgaacactagaaagttcataccttcccaagctctgtccatccttatgcagcatcttttcctactgtctattgaacagttgcttagcattccccattatttccactcattatcagaatggaaaccacacatcatacacatggctatagacccacctctggatacttgagacaatttatgacgaatatttcttcattttcttgtagtgcttgatgctgcacaccatcgacattggcctggcgtgttgaaggtggtatctggatgccacatatccttatttcaggttccattaccagaagatgggatgcagtttggaggatccatgagcttgcatggaaatcatatgaccctggcttgttttcatggtccaaatttccgttcaaaatcctgggccctttttcatttagaagaaccaaatattgccttttggactgaagctcaaaaaatctgggaagatggtaatatgacacatttccagcttttattctttgtgtcttctggcatgatcataaataagtcatttttctttgttttgtatgttgatttttgaggaatgtgtgtctatgtgtatggcataagtgtgtttgtgtatggtatatgtgtgtttgtgtatgctgtgtgtgcatgcatatgtctatgagtgaaggcatgtgaatgccacagtgcatgtgaagttagaggacaacctggggtgtaagtgctcaccctctgcctcctttaagactaggttagctgactcatgtgctttcagggactctcctgggcccacctcacatctcactgtcggagtcctgggactagaaacacataacactgtgtccagctttatattgattctggaattggagcgtcgggtctcatacttgtgcagcaaatactctacacactaagccatctccctgatctcctctttacttttgtttgtttgcagttgtttattttggaagggattcatttgtgctataacaaacatgtagaagtcagaggacagcttgaggagttggtcctcaatttccatcatgtggattttagggcttaaattcaggttgtcaggcttggtagcaagtgcctttatcccctgagtcatctcaccagccccttctgactttttttattggagaaatccatctctgtttgttatcctgtaagtaaaagatcggggagttcattgttagtgaatcagcatttataaagtatagacttgttaaagaaacatctaaatatacttctaaacttgccctcgtactccatgttacttaatttagtgctgctgtgatggccttagcatgttatctagaaatattccttataaaaacatgaagacaatgatggtgtgagaaaattctctgtcaaacaaacaaacaaaaaaaaacattgtgttataaaacttgagggaaataatagagccctgggatacctcaggaatatttgggcaacacaaattggccttggcaggttttttaaaaaggacaccaagacatacacagaattctcaaagaactaataaaaatgtaaaaagagcagttcctttgagcagtttcctattcaaatagtgttgccttgtgctttgctttttaacagtgtcttactcagttgcccaggttgtcctgtaactcatgatccccctgcctctgcttcctgagtggtataacactgactgacccactccgaggtttcttaacaagatggttgatgttcttcatttcactgggataaaaccagctaactgtgggctttctcacttatttagcctttcctactctatatagcttactctgttactctggtgtcatagttattttctaagccataaagacagtttatcacttttagaaacatacttatcttgtgttataggctctagtgaccactctacatacattgttcaaacactggattttcatctgggtcataataccatggttaccaaaccatgcggtgctctggaaagtcccatggcaacaataaccaagataacaaggcgtcgccacgaaaacccaccccatggagttgccagtgtaaaagaatggttcaactatgtcactgccacaaggaatgaaggttaaatatttagcctttttgggcttattttcttttttgttttattttgacctctgtcagct

SEQ ID NO: 236 - DNA, 6559 bp, Mus musculus
gcagctaaacctcttaagcactgcaaccccagctgttggagcatggctggttcctattgatcaactcaagtcatccttaaacaaattagagactgagggaaccttgcgaatttgtgctgttatgggatgcataatgacagaagcattagagaataaaagtgtacattttcctctaagaagtaaatacaatagacttacaaaagttgctcgctttcttcaagaaaatccttcttgtttattatgtaatattctacaccactacctgcaccaagcaaattactccatcattgatgatgccacgatgagtgatggtcttcctgcactggtaactttaaagaaaggattggttgctttggcacggcagtggatgaagttcattgtggtaacacctgcctttaaaggagttagcttacacagaccagctcagcccctgaaacctccagctactgtggaccaggagcatgaagagggacttggcctggataatggaggtggtctacaaagtgatactagtgctgatggtgcagaatttgagtttgatgcagccacagtcagtgaacatacaatgctgctagaaggaacagctaaccgaccaccccctgggagctctgggcctgtcactggagctgaaataatgaggaagctttctaaaactcacacccatagtgactctgcattaaaaataaagggcattcacccatatcattctctgagttataccagtggggacactgctactgattctccagtacatgttggacgtgctgggatgccggtaaaggagagtccaaggaaggagagccttctcagctatctgactggaagcttcccaagcctgcacaactttctggaaggcactcctcagagaagtagtgcagctgtgaaaagtagctccctcacaagaacagggaatacagtagccactgacatgctgtctgaacatcctttgttatctgagccatcatctgtgagtttttataattggatgtcaaatgctgtgggaaatcgtggaagtgtggtacaggaatctcctgttacaaagtcaggacataacagtcttccaacaggagttgcacccaatcttcctacaatcccgtcagcttcagatttcaacaccgtcttatctagtgaccagaatactctggatgggacacattctcagcacagtactagtcaagatgatgtggcaggtgtagaagaagcaaaccaagggtttcctgctgttcagctagctgatgcacaggttgtttttaaacctcttctgagtcatacagggatccagtcacaggacacaatgcccctttgttaccggatgtacttcggagaacacctttcattttcaggaactttagactgcctcagagcagatattgtagattcggacacagctaaagacaggaaaggaaaaagagcaagaaggcaaggccatgtgaaccttcccccactggagttcaagccggcattaatgttggaaaccttcagcatcagtgctgttgtaatggaaaagtcagtgtgcactccgcaaaactctaccagtgccctttcctttcatgatctcaacaagcgctattacaacaccttccattgcaacttcactatttcctgccagtcaataagtcagcatgtggatatggctctggtccgtcttatccatcaattcagtacaatgatagatgacatcaaagcaactcagacagacattaaacttagtagatacacagctggatcagcttcccctacgcctaccttcaaaaccagaaaacatcgggatttccgttcatctgacttcagccgcagttcgagagggagtctcaatggtggcaacagagtaaataatgccaagaacaaacgggccaacaatgagaacaataaaaaagaatcccgaaacaaaaactcactaggaaggtctgaaagaagaacctcaaaagtatctaggaaaggttcaaaagatgtagtggatcatatgacgattcatatggatgattccgattccatcacagtgtcagagcaaagtgagccttctgctgaatgctggcagaatatgtataaattgcttaacttctattcacttatctcagatccaacagggatattggaaaagtcctcagaaacatttggaccagcaggtgttcggagtcctacagagccaacatgtagagttgtgtttgagaatgaacaagacaacaacagcttgactaaaacacagaggaaacgtagtctggtaacctctgaacctcagcatgtaacattaattgtgtttgggattggcatggtgaaccgcacacacctagaggcagatattggtggtctgacaatggaatcagaactgaagaggatccatggcagtttcacccttaaggaaaaaatgaaagatgttttgcatcaaaagatgaccgagacctgtgctactgctcacattggtggggttaatattgtactacttgaagggatcacaccaaatatacaaactgtggtcaagtgtagtatagccaagtcccaagccctctacagtgcccagagagggctgaagacaaacaacgctgcagtgttcaaagtaggagctatcagcatcaacattcctcagcaccctgccactttacacagcatgatggtccgcagttctcaccagctgtccaagcagatctcagaccttattagacagccttccacagccccacagcctatgaaagaagatattgcaaccccactgccttctgaaaaaaccccaacaagtgttaatcaaactcctattgaaacaaatgaatttcctcaactcccagaaggcttagagaagaagcctattgttctcaagttcagcgctatgttagatggcatagccattggagcagcactcttaccatcactgaaggcagagtacaagatggggagaatgagaagccatgggatgacaggtgcacagacaaggtttacatttgagttaccaaatcacaggttgcgctttacttcaaaagtttctgcgacagatatgtcaactatccctccttctgcaagtcttaaccttccgcctgttaccatgtcagggaaatacattatggaagaacatgatagttactcagatcaagtgtggagtatagatgaactgccttctaaacaagggtactatttacaagggaattatctacgttgtgtggcagaagttggttcctttgaacacaatctcacaacagatcttctaaaccacttggtgtttgtacagaaagtgttcatgaaggaagtgaatgaagtaatacagaaggtgtctggtggggagcagcctatccctctctggaatgaacatgacggaacaacagatggagataagccgaaaattctcctctactccctgaatttacagtttaagggtattcaagtgacagccaccacaccttcaatgagagctgtgagatttgagactggattgattgaattggaactttcaaaccgacttcaaaccaaagcctcaccaggaagcagcagctatctgaaattatttggtaaatgccaagtggacttaaatctggcattagggcaaattgtcaaacatcaggtttatgaagaagctggttctgattttcatcaagttgcctattttaaaactagaattggactaaggaacgcccttcgagaggaaatcagtggttcttcagatagggaagctgtgcttattactctgaatagaccaattgtttatgcacaacctgtggcttttgatagagctgttctgttttggctgaattataaagctgcctatgacaactggaatgaacaacgaatggctttacataaggatattcatatggctacaaaggaagtggtagacatgctccctggtatccagcagacatcagcccaggcctttgggactctcttcctccagctaactgtgaatgatctaggaatttgcctccctataacaaataccgcacagtctaaccacactggagacctggacactggctctgctctagtgctgaccattgaaagtactctcatcactgcatgctcctcagagtctctggttagcaaaggccatttcaagaacttttgtatccgttttgctgatggctttgagacatcatgggatgactggaaaccagaaatccgtggagatctagtaatgaatgcttgtgtagttccagatggtacctacgaggtttgttcaaggactacaggacaagctgcagctgaaagtagtagtgccggaacctggacactgaatgtattgtggaaaatgtgtgggattgatgtccacatggaccctaacattggcaaaaggcttaatgctctgggcaacacccttacaacactgacaggagaggaagacatagatgacattgctgacctcaattcagtgaacatagctgacttgtcagatgaagatgaagtcgataccatgtctcctacaatccatactgaagctgtagattatcgaagacaaggaacatcttctagtcagccaggagaactgagaggaaggaagattatgaagcgcttagtggacatcagagaactgaatgaacaggccaaagtaatagatgaccttaaaaaattgggtgcaagtgaaggaaccataaatcaggaaattcagcgttaccagcagttggagtctgtggctgtgaatgacatccgaagagatgtccgtaagaagttacggcggtccagtatgcgagctgcttccctcaaggataagtggggtttaggttacaaaccaagttacagccgatcgaagagcatttcagcttctggaagaccacctcttaagagaatggaaagagcaagttctcgaataggagaaactgatgagctcccagaaatccgtgtggatgcagcatctcctggacccagagtaaccttcaacatccaggatacatttccagaggagacagaactggatcttttgtcagtaacaattgaaggtccatcacattattcatcaaatagtgaaggatcgtgttcagtgttcagctctcccaaaaccacaggcggcttttcaccaagtgttcctttccagtcagaagatggccgaagagacgacagtctgtcttctaccagtgaagactctgagaaggatgaaaaggatgaagaccgtgagagggaaagattctatatttacaggaaaccctcacatacctctcggaagaaagcaacaggctttgctgctgttcatcagctacttactgaacgctggcctacaaccccagtcaatcgaagtcttagtggcacagctactgagagaaatattgactttgagcttgatatacgagttgaaattgacagtggaaaatgtgtccttcaccccactacccttctgcaggagcatgatgacataagtttaagaaggagttatgatagaagttctaggagtttagatcaagattctccttcaaaaaagaaaaaatttcaaacgaattatgcttcaactacccatttaatgactggcaagaaagtgccatcctctctacagacaaagcccagtgacttagaaacaacagtattttacattcctggagttgatgtcaagctgcattacaattctaagacactaaagactgaatcacctaacgcctccagaggatcgtccttgcctagaaccctctccaaagagtccaagctgtatggtatgaaagatagcgcagcatctccttctccttctcctttaccttgcactgtgcagagcaagactaacaccttacttcctccccaacccccacctattccttcagctaaaggaaaaggaagtggaggagtaaaaactgccaagctctatgcctgggtagcactgcagtcattaccagaagaaatggttattagtccttgtctattggactttcttgaaaaggctctggaaactatcccaattacaccaatcgaaaggaattatacagcagtcagctcacaagatgaagatatgggacattttgacatcccagatcctatggaagaatcaacaacatccctagtgtcatcttcaacatctgcatactcttccttccctgtagacgttgtggtttatgtgcgagttcagccctcacagatcaaatttagctgtttgccagtatcaagagtagaatgcatgctgaagctaccatctctggacttggtattttcttcaaaccgaggagaactggaaactttggggactacataccctgcagagaccgtgtcccctggcagtaatgctcctcagactggagcaaagacctctgctagcaaagctggaatgccaggctcttcaggattaggcagcccacttggccgaagtcgacacagcagcagccagtcggatctgactgggtccagcagcagctcatcgggcctgagcttcactgcatgcatgtctgacttctccctgtatgtgtttcacccctacggtgctgggaagcagaaatccactgtttctggtctcacatctggatcaggaggactagggaatgtggatgaagaacccacttcagtcactggtcgaaaagactcactaagtataaacctcgagtttgtaaaagtgagcttgtctcggataaggcgctcaggaggcgcctcattttttgaaagtcaatct

SEQ ID NO: 237 - protein, 2186 aa, Mus musculus
QLNLLSTATPAVGAWLVPIDQLKSSLNKLETEGTLRICAVMGCIMTEALENKSVHFPLRSKYNRLTKVARFLQENPSCLLCNILHHYLHQANYSIIDDATMSDGLPALVTLKKGLVALARQWMKFIVVTPAFKGVSLHRPAQPLKPPATVDQEHEEGLGLDNGGGLQSDTSADGAEFEFDAATVSEHTMLLEGTANRPPPGSSGPVTGAEIMRKLSKTHTHSDSALKIKGIHPYHSLSYTSGDTATDSPVHVGRAGMPVKESPRKESLLSYLTGSFPSLHNFLEGTPQRSSAAVKSSSLTRTGNTVATDMLSEHPLLSEPSSVSFYNWMSNAVGNRGSVVQESPVTKSGHNSLPTGVAPNLPTIPSASDFNTVLSSDQNTLDGTHSQHSTSQDDVAGVEEANQGFPAVQLADAQVVFKPLLSHTGIQSQDTMPLCYRMYFGEHLSFSGTLDCLRADIVDSDTAKDRKGKRARRQGHVNLPPLEFKPALMLETFSISAVVMEKSVCTPQNSTSALSFHDLNKRYYNTFHCNFTISCQSISQHVDMALVRLIHQFSTMIDDIKATQTDIKLSRYTAGSASPTPTFKTRKHRDFRSSDFSRSSRGSLNGGNRVNNAKNKRANNENNKKESRNKNSLGRSERRTSKVSRKGSKDVVDHMTIHMDDSDSITVSEQSEPSAECWQNMYKLLNFYSLISDPTGILEKSSETFGPAGVRSPTEPTCRVVFENEQDNNSLTKTQRKRSLVTSEPQHVTLIVFGIGMVNRTHLEADIGGLTMESELKRIHGSFTLKEKMKDVLHQKMTETCATAHIGGVNIVLLEGITPNIQTVVKCSIAKSQALYSAQRGLKTNNAAVFKVGAISINIPQHPATLHSMMVRSSHQLSKQISDLIRQPSTAPQPMKEDIATPLPSEKTPTSVNQTPIETNEFPQLPEGLEKKPIVLKFSAMLDGIAIGAALLPSLKAEYKMGRMRSHGMTGAQTRFTFELPNHRLRFTSKVSATDMSTIPPSASLNLPPVTMSGKYIMEEHDSYSDQVWSIDELPSKQGYYLQGNYLRCVAEVGSFEHNLTTDLLNHLVFVQKVFMKEVNEVIQKVSGGEQPIPLWNEHDGTTDGDKPKILLYSLNLQFKGIQVTATTPSMRAVRFETGLIELELSNRLQTKASPGSSSYLKLFGKCQVDLNLALGQIVKHQVYEEAGSDFHQVAYFKTRIGLRNALREEISGSSDREAVLITLNRPIVYAQPVAFDRAVLFWLNYKAAYDNWNEQRMALHKDIHMATKEVVDMLPGIQQTSAQAFGTLFLQLTVNDLGICLPITNTAQSNHTGDLDTGSALVLTIESTLITACSSESLVSKGHFKNFCIRFADGFETSWDDWKPEIRGDLVMNACVVPDGTYEVCSRTTGQAAAESSSAGTWTLNVLWKMCGIDVHMDPNIGKRLNALGNTLTTLTGEEDIDDIADLNSVNIADLSDEDEVDTMSPTIHTEAVDYRRQGTSSSQPGELRGRKIMKRLVDIRELNEQAKVIDDLKKLGASEGTINQEIQRYQQLESVAVNDIRRDVRKKLRRSSMRAASLKDKWGLGYKPSYSRSKSISASGRPPLKRMERASSRIGETDELPEIRVDAASPGPRVTFNIQDTFPEETELDLLSVTIEGPSHYSSNSEGSCSVFSSPKTTGGFSPSVPFQSEDGRRDDSLSSTSEDSEKDEKDEDRERERFYIYRKPSHTSRKKATGFAAVHQLLTERWPTTPVNRSLSGTATERNIDFELDIRVEIDSGKCVLHPTTLLQEHDDISLRRSYDRSSRSLDQDSPSKKKKFQTNYASTTHLMTGKKVPSSLQTKPSDLETTVFYIPGVDVKLHYNSKTLKTESPNASRGSSLPRTLSKESKLYGMKDSAASPSPSPLPCTVQSKTNTLLPPQPPPIPSAKGKGSGGVKTAKLYAWVALQSLPEEMVISPCLLDFLEKALETIPITPIERNYTAVSSQDEDMGHFDIPDPMEESTTSLVSSSTSAYSSFPVDVVVYVRVQPSQIKFSCLPVSRVECMLKLPSLDLVFSSNRGELETLGTTYPAETVSPGSNAPQTGAKTSASKAGMPGSSGLGSPLGRSRHSSSQSDLTGSSSSSSGLSFTACMSDFSLYVFHPYGAGKQKSTVSGLTSGSGGLGNVDEEPTSVTGRKDSLSINLEFVKVSLSRIRRSGGASFFESQS

SEQ ID NO: 238 - DNA, 127369 bp, Homo sapiens
  misc_feature (1)...(127369): n = A,T,C or G
tcagaagtttgttaaagaaaagatcattgcccagtgtggaacacttcatcttggggtgaaggtggtgatgtggggataacctcagaaatgtttcccttgtataatttctaaatatgtggcttagacattctcatttcaatgttgagcaattgttgtacatattcagatggtgctacgtttcatgatatgtttacataaactaagttgtagaatcaacgacatttaaatatttcatttactgttttttcccctcagatatattgaagcaatggttcattgtgctagtacccgacatccagctgcaattgtagatgatcttcatgctaaagtcctcagggaagctgtccaaaatagcaagactaccttttcagaaaatgtaagaactttttaattcaatgggcatagcaaattgaatatttatcatggttacagaatattcaaacttgaaaaattttctttacaagttaaatcagaatatttggacatgttctaaaagcgtttatatgtcattggctctgtaaaagataggacatataactgtactatagatggaatagtagtaaaaatatttatttaaaaaatatattaatagctttctttgtttcttttatttcagaagcagcttagttccaagccttttctaaagtgctttggccctaagtgaatgaatattctttaggactgacaccttgcttttctaagacagctgtttatgttttgattttcctctatgattagatgacttgtatcttaatattacttttgagattttcctcgttcacttcagtgaatcaagtcactactctcattgtatgatattctacttacattgtggttccagccacgaagccagttgcttagcagtcatatcccagtgctcttccagagcttctccatttgattttcaaatttatctggattatacttagagtagggaccagaagagagatgaaagtgagactgattattttagttaactatttatttaatatatattggcatttcatgtgatagagtagaagagtgaaaaaaagaaatttgaaaatattcctagccaaaaaggggccaattatcagaaaccaagtttgttttcaagccagaagagtttagtgatcttaaaaaatgcctgtaattactgtaccattttttctgtctgcttctctgtaggctgatttcaatttaatgtgtattacttttctcaaccatgatgctaccagtctttttcctagcttatcgaaagtttggattttaaggtgggatataaaactagaacgcagctggcacatagataggcatagaggggcagcgtgaataagtgagttgctgttgtggatgatgtggaagttatgaaaagcttgtgaaataatttcacttacgatctttttagttatcttccaaacaagacattagaggaacaaaaactgagcagtctacaataggaacgactaaccaaggacaagcacagacaaatcttacaatgaagcaagataatgtaacaattaaaggtcttcagactaatgttagcataccaaaggtaacaatttaatatttaaaaattttttcctgaaagaggagagcattttgatggtgtttgtccttttcagttaccaacgtgaataatggtagaacagtgtgtaatattaaaaaaatatgttttatttctatgatctaatgtagatctaatggaatgtaaatagtttacttaagcagaatattaggtaatagtagaatgttccacatccatccagtaaaaatttaattatgattattttatgagaatctgtattcataagctttgtcttcactgtcaaatacatagatatgccattcttaacagtagtttttcatttttgtgcatattttatgtttaagtggtaatttttcacttgtcagttctgaaattttgtgtgtgtgttaggtaaacttatgtttgttacaagcctcagtggaagaatctccaactacggctcctagtaggagtgtgactcatgtttccctagtggcattgtgttttgacagaattgctacacaggttcgcatgaacaggtaagaaatactttattaatctgagccatgattatcttgctggatgtaaaagcaagccttgatcatcttttcttttaaaaatacatttctaagaatgtaatgttaaaactcagaactggttttggaatttcaaatcttaatttatagattagtaacatatgtctttaaaaaatttttactgtttctattcatagtatctttcagtaaacattgaataattttttactactattggtgtataatagtagagtgttttgttttttttaaaggaaaccttttaggtaaatgttttctctgaactgtattatttaaatgttaaacattttactctcttttttttcataaagaggtgtggttgaagagacttcaaacaatgcagaacctggtagaacatcaaattttgataggtatgttcatgccacaaagatgcagcctcagtcatctggatctctcagatcaaatgctggagcagaaaaaggcaaagaaattgcagctaagttaaacattcatcgagttcatgggcaacttaggggtcttgatacaacaggtaggattctacaacaaatatgttttttcttggcatatataaatgtaagatgattttgcagaagggaacatgtttttttcctttgactattgctacaattcggtattctataagaaagagaaaggtatttctccctatattgaacacgtggtatttagctacttgtcactcacattctgtacagaatagaaaataaactttggtaagaaaattaagtggtatggccccaaattaggaacttctatttcccatgtttctatttcccatgtgttttttccatgctatttacttgctcgttatagaacagagaagacatgatctttatagtctttcttattttttaagtcattctgtttgtaaaacagtgttagaaagaattaattgtaatattaatcaaaaccagagagtctgtaaaatacagcagcaataaggtgacacacattcctcttaaagtccctagttaggtaaaaggaaagtagagctgttatacatcattttaatatttttgattcttatttagcacattttatcatttagatgcttaaatgttttcagaatgtcagagattcaattcagaaaaagttagatttgctaatcgtatttgagatgattgctctgctgaaatctttatgtgggactggtgaccaattctgagtaaacaaatgaattccctgaatttgcttactgtattttataggttctgaagtttccatgattcctgtctgcattctgggtctgtgtacctgttttgactttctcaaggcttatttttttcatcccaggtgtgaggctgaaagcatttgacctgaggttttcaagggacttttcatgactacctaagatctgtagtcctaaaactggtgaaaaatgtggtggcttgagtgaagacacttttatcagctctgtagtttgcgtgggtaaccaatttgcactgggtattatacagaccataagcagaaccttatataattttgaaaggcattatcatgcagaaaacactctcattgaagacaaaactcccaacgaaattccaaggtggacatttctgtaaaaatgtagatgtctttgcttatatgtacattagttatctgccaaaggttacttaataacctcataatatttgttacccttatagggaggggaactaggtgtctggttgtggtgttagaggcttttcattgcgtactttttcataattttttgaactttgatacatctgaatatgtatgggattaaagacaaatacaaaaaaattaaataatgagaaaattataggaaaatgtaggtgaatgtttattctctgaataagaccttttaattataaatgcaaagaatgacatttccatagcatagaatattatatagctattaaaatgatatctttgaaaaaattttaatgacctgaggaaattatttactgttgcatgaaaatgggagccaaagctgggtttgcaaagtgatctctaaagggctagagtgcagtgtacttcaaatataaacaagttctccttgaatggtaaatttacatgtgtttttaatattctttttgtttttttatattcattagcaataatcagagagagaaatgaaaaaagtaagataaagtaaaacttctctcaggcacttggggtgttaatttccacagtgtatctgtaagcagtggaaccatgacaaggtctatgatgaattgtagttatgtaaaatatgtcagtataaaacagtcttttagtaaaagctataatttgcctagaaaataatgtttttcctaaggcttggtaattaattgaattttttttttattttgtgagatgatgaaagtatttaaaactactgtgaagataaattatttaggatatttttaactttatattttttagagtatcctgtaatcattcagaaacaaattcatactacctttgagcaacttgttaatcataaaatcttcttttcttcctcttaggcagcattattctaaaagttagctcatttgcctgtttttctatctttttgacagagcactaagatatcttttaaagacaaccagtgtgccatatgtccaaatgtttgtgttttttaatgtaagcttatgtctttaaaaatggtcattttgctctcttttgataatagacattgggacctgtgcaatcactgctattccttttgagaagtccaaagttttatttactcttgaagagttggatgaatttacttttgtggatgaaactgatcagcaagctgttccagatgtaactcgaataggtcccagccaagaaaaatggggatggataatgtttgaatgtggacttgaaaatttaaccataaaaggcaagcattttttattgaattctgcttaaggtggggacaaatatgtcctatattgcagaaatgttttgaacaatcatggctttcagtaacctgaatcaacataataaagcagaaagtgtggtatctgggattatttaccgggggtgagtgcctcataccaattgcttaagtggagcttttcctccattatgtgatttccaaagtaggtagagcttgaaaaacaacaatatgtttttccgaataaattcccaaataaaatataaagccacccaattttttgaaactttgcatctttgaaaactggatctttggtcagtagaattatgccatataggatataaaaactgtaaattctttattcagcgaaaaatatctacttagaattatatttgcttttttatatattcttgagtaatagctcaaaaaggaaggttgaaatgtgtataacactttttttaggtttagtaatatataatatagcaactactataaataatagtagttgtatatgcctacaattatttacctgataattcagtgatacattacttttatagattagggcaaagacttggtgagaaaaaaatagtctttatgaaattttatacagatattgtagagtacagcattaagacacttattcaccatttataataaatgcttttttttatttttataggaggaagacagtctggtgctgttttatataacagttttggaattatgggtaaagctagtgacacagaaaggggtggagtgctgacatccaataattcttctgattctccaaccggcagtggctataatactgatgtctctgatgataatcttccatgtgaccggacaagcccttcctcagacttaaatggaaattctgtttcagatgaacaggttagtgactttctaatagtaataataatggtgctttagaaaaataacaaagaaaactacatatgcaattcaaaattagtttctggagtgtatttgcctgtctttccctattttggatttatgatatctgcttaaatgttagtcaaagtgtgttggtgaatatactactagaatataatttccaaagtatatcatagatatatttatatccatcatagtcctagcattatgccttgctcaaattagatacctaataaatatttgttgaattaataaattaacaaaatttaagagaaatccacctatagggtgtggaggattttagcaggcagaagtcattttgttattggtagtattttatgtcagttctaaatatttttgtcagtgtttgcttatttcagttaagagttctgaatggcaccttatattcaactcactttttatttttattatggtagaattacatgggtggtgatgagtacagtaacagcaacaacaaaaatattccaaatttttggttgaagaaatgtcgtgccactaactggtgacctggggcaagttcctaaccttttcctaagtctctttacctgtaataggagtatggtcatgttattgaccttgcagcgttgtgaagactgaagcaggtaatacatatgaagggcttagctcagtatgtagtatgtaataagaatgtagtaactgttgttcttaaacgtatgtacatatatttctgatcactttgaaaattaggccaattggagaggaaaaagttccaaagaaaccactttttaattaggaagtctagtatgggtatctagtaatcatgggtatactcacctttaccccccagattcctagggatttatttttaaaacatttgtttttatttaatatgtagtttaatgagtttaatcacagttttattttggtgtctttggaaatgtttaggggatggattatcactttaattaaggaaatttaaaaatacaatagctactcactggacaaaagagctgagaaaagcctagctgttctttccttctccttcacctactaaaatacttgacagaaattcaggcatctttcttgatctctcagatcctactcttcttgctgaaagcccttgaattggctaacattactttctttgggttctctgactttattggtccatttctttatggaattttttcttcttcttaaatgtggtggtttcctcaggttctgttcttggctcttcctttcttcttgctatttgtctactactccctgatgaatttcatttcctaggtcagttccgtaatttaatgacacttctctttcccactggccacacctttagcaccagctcttcacctgagctccaggattgtgtttagtggccttttagacatcatcatttagtatttaacagagtcatgaagcctccattgcagaccctagctcctggacaacatttctagacacaccctaggccagaagggaacccactgcattgaaggaaaggacccagtcctggcaggatcaatcacctgctgactaaagagcctttgagccctgaataaccagcagcagtacccaggtagcatatcatgggccttgggtgaccctctacgatgtgctggtttaggtgtgacctagcacgttcctagctgtggtggctatagtgagagattctttctgcttgagaaagcagagggagaagtaatggggactttgtcttgcaccttagatgccagcacagccacaatgtgcagagcactaagcaggctcttggggtacctgatttcaggacatggctcctggatggcatttctggacctgccctgggtcagcagggagcccactgtcctgaagggtgagtttcaggcctggcagcattcaccacaagctgacagaacagcccttgggccttaagtgaacatcagtggtagtgtgacagtactccccatgggcctgtgatggtggtggccatggggtaaggattctctgcctgtggaaaggggagggaagagtgggaaggtctgtgtcttgtgatatgagtgccagctcagccatggtagaataaaacaccaagtagatttataaggtttttgtctccagttgttggctcctggatagcatctctagacctgcccagagcctggcgaactcgccaccctgaagggaaagacacaagcctggctggcttcgccacctgctgattgtacagctctaggtctgtgagcaaacgtaggcagaagccaggtagtggttacagggggccctgggtgagacccagtgctatgctggcttcaggtctaaccccacacagttccactggtggtagccacaggggtgcttgtgtcactgcaccagctccaggaagctcagcacacacagagagagactctgcttgggagaaagtaagggaagataataagagcctctgtctggtaatccagagaatcttctggatcttatccaagaccaccaaggtggtacctctataagttgcaagaacagtgatacagggcttgggatgccccctaatgcagatatgactttgctgaccagaaacttataacacccaagtccctttgaatacctgaaaagccttcccaagaaggatgggtacaaacaagcccagagtgtgaagactacaataaacacctaactcttcaatgcccagacattgatgaacgtccacaaacatcaaaaacagccagcaaactacgacctcaccaaatgaattaaataaggcaccagagactaatcccagagaagcagatgtgtgacctttcagacaaagaattcaaaataactgtgttgaggaaagtcagagaaattcaaggtaacacagagaagggattcagaatcttattagataaatttgacaaataattaaaaagaatccagcagaaattctagagttgaaaaatccaagtgacatagtgaagaatgcatcagagtctcttaacagcaaaattgttcaagcagaagaaagaattaatgagcttgaagacagactgtttgaaaatacatagaggagacaaaagaaaaaaggaatgaaaaagaacgaagcatgcctacaagatctagaaaatagcctcaaaagggcaaatctaatagttactggccttaaagagaaggtagagaaagacgggtggaaagtttgtttaaaggggtaacaacagagaacttcccaaaccttgagaaagatatcaatattcaagtacaagaaggtagagaataccgagcagatttaaaccaattaagactacctcaggatatttaatcattaaactcccaaagatcaagcataaagaaaggatcccaaaagcagcaagagaaaagaaacaaataacatacgatggagctctgataaaactggcagcagacttttcagtggaatctttacaggccaggagagagtggcatgacatatttaaagtgctgaaggaaaaacacttttaaaagaatagtatatctggcaaaaatatccttcaaacctgaaggagaagtaaagactttcccagacttgatttgatgaaaaggttttgcacttaaaacattagcctctgtgttagtggttttaaggggctgtatgttaataagtttttggcattctattttatataggatgaaggagtcgaatctgatgatttgaaaaaagatctacctctgatgcctcctcctccagattcatgtagcatgaagttgaccattaaagaaatttggtttagttttgcagctcccaccaatgtgagatctcacacacatgcattttctaggtaaagagtttttaaaatatagtagtatcgcttgatgtttctttattttaaatagtatacaattctgtttcatatttttaaaaattacttttctggtatatatagtattaaggttgcaactttttcatcattcttacttcatatgttctgtagacattagtcttaccttgtttgacccaatttctttcatagtactttagttttatttttatatgttcctctgccttagacttttgtttactctttttatctctgacaggcttttttttttctttcttttctattgcccatttttttttaacatttcttagttatgctttcataatttatcagtgnnnnnnnnnnnnnnnnnnnnnnnnnnnnnnnnnnnnnnnnnnnnnnnnnnnnnnnnnnnnnnnnnnnnnnnnnnnnnnnnnnnnctgttatgggatgcataatgacagaagcattagaggtatgtctttaaataatacaaggtattatacaaactttagtattgaaaatgaccccttattgttaatcattattggaaaatatcagatttacaagttcttaattactgaatgtcttttatttgtaggctctttcatacctatcactctaaatctattgttgtttcttgattttagaataaaagtgtacattttcccctaagaagtaaatacaacaggcttacaaaagttgctcgctttctccaagaaaatccttcatgtttactatgtaatatactacaccactatctgcaccaggcaaattactccatcattgatgatgctacaatggtaagttactgaaactacattagttttaaggaattctctattctgttggtggaccactgatacacagggtttgagatgcatgtgagaatggttagaaatacaagtctataggcctgtaatcccagcactttgggaggctgaggcggttggatcatttgaggccaagagctggccaacatggcaaaactctgtctctactaaaaatacaaaaaattagctgggcgtgctggctgtcacctgtaatcccagctacttgggaggctgaggcaggagaactggttgaacctgggaggcagaggctgcagcaaaccaagatcgcaccatttcactccagcctgggcaacaagagcaaaactctgtctcaagaaaaagaaaaaaaaagaaatacaagtctatagacaaagagtgtgctcagactaatgatttgggagttgccagcataaaggtgttagtagaagctgtagacatggatgagatttccaggaatgctatgttgggtaagaaattgctcagggatggaatcctgaagaaagccaaaattaaagggggtgtaggtggttggatagggatacaccaagtgatgggaagggaaagaaagaggtaggagaactaggaaagagtgatgtcttggaagctaaaggtataaagagtttttaagcaagagaataatcaccagagccaaatttcacatacagtttgatgaaacagggactaattgatgattgaggggagaatatacaatcacacaaaataaatacaatccatctctgcctctggaaaagcagataacatcatgattagagttttagaacttttaggatctctcttctccaagttgctggccaataggggacacacaagaatctttagtcaaattagggaccaatgtatcagtattattaatggccagtcaagccattgttcaggcaagtcaagaatctctagtaagtgttggatttgaaaaagacacttagacctaaggctggtgtagtactttttactccctccctgtgaattgaagactgggaaatctacagtttaagcctaacttgcctgtgtagttataggtagagaagcttgaacagagagaatggcaggtgtttcccatggatggatgctctgccagatgtgttttccatgtaagaggaagaggcacaacatggccgtcatgcaaggctgggaatgaaaggagaggctagtggacttggtgttcctcagaaagtaaacggggtgattcctgccttctagtaaatagtgctcttcaatcaaattaaccatttctcctaaaatgaggaatgataggaaacaggatggagaggagttagatatttttctctttctttaggctaaggcaaggtaattagactaaggtaacaggaaaagagccaaaagtttctttcttacaatcatcaccatgtggaataaaatgtattttaaactatataattattactgataatacagttaactttcaaggcagttacaaattcatctatgtctagcatactacataagttatagtaatttatttttttaaatgttaacacaatggtagttacctaatctttgaaggaaataattttacttcctctttgcttattgaatgttccaagtagctcaaaatgcattttgattcttcacttgggcaaaataagtaaagttgattgaatgcttcttaaggaaaattccaactttgcactccacatctagtatcatattgacctgtgctattgtgttgttttatgacacaaagatgaaacgttgtgcctagagattagattctgtagtctacattataattgaaatcctgactctcttgggtaactttgaacaaattacttaacatctaagttttaatttctttatctctaaatgagtattatgagatttgaataaatacatgcaaagcacttaaatggtaactgatattattacattagattacttctaaccacatgattattgttacagagcgatggacttcctgctttggtaactttgaagaaaggtttagttgcactggcaaggcagtggatgaagtttattgtggtgacaccagcctttaaaggagttagcttacatagaccagctcagcctctgaaacctcaaatagctatggaccatgaacatgaagatggacttggattggacaatgggggtggtcttcaaagtgataccagtgctgatggagcagaatttgagttcgatgcaggtagttttgtaagcctctattgagtactttcttacacctcacaaaactagggtgttttcttactcaacacaattactgtatgttttttgcttagatattatgcatcttttatcagtaagttaatatacctctttaaaaatgtcaagaccctttgtttttcctcacagttacaaataaattactaatataagcaattttagatattacatacttgttaatatggtacttgtgataattttaataattcatgtcccaaattggaaaatggtcatggcttaagtatacacgtatgatttttattggccaagtaagtgataatgattaggaatcttcatactgacctgattttataagttcagttttgtgaaatacagtagacttctcttgatctatccaggacaaagataatataagtagaacgttttgaatgaaacacataaacctctatttaaaacttgtatttgtctgtcatcttccctatgccacagtattttaaaggggcctttgtctttttacctgatgcctgcttgatcctgaatttatgtaaactttggggcctgcgctcagcctacaattttgtcaacaaaatggctgtgtcagaataaagatagtggatatacatttatgaaatgtacttgcataccttaagctttgccaaagattaatttttattatcatgacctatcatatttattgaaaatgcatgttatgatgttttgaaaaaaatattgaaagagtagtcttagagattttagaacattgatatataaaactttaccaagcttagttttaaaaataacttgatatttaacaaataaatgagttatgaggaatagggtagattttattacttattttagaaaatttcaaatctacacaaaagtttgaaaaccagtacactgaatatcccttccaattatctgcaaatccctctgttaatctatgagcagtctgtgctttcttgcgcttagttgaattgacttttggtccgagtatcatttgcatggaatatgtgaaagtctaataaaagccgtttgttcctttcttgaaactgagtgagaggattggggtgggggagaaaataataaatatttgtcaaggaatatgaaagttgagtgtcattatataactagaaacataggggctgatgtttcatgaaaatgtgtgataatctattgctcacttattcttttgaactgtttcagccacagtcagtgaacacacaatgctattagaaggaacagctaaccggcctccacctggtagctctggacctgtaactggagctgagataatgaggaaactttctaaaactcatacccatagtgactctgcattaaaaataaaggtatattattgctctttttggttagagttatccagacttacagagaaaacctaaaattttatctcaaatttaaatgttaggtgtccaccctaaatattcagatagcattttcgtgttgaaattaacttgatttgtaatttcagtgtaaatatttctttgaaaattgtatcatcagtaactgctgttgattaaggaccactataactaccaagccttagagctgtctccagtttattgaatactgtattccataaaatcccaaattgaaaatgttgataatcttataattatcagttttaatgagaagccttttaggcagtgtgtgatcaataggtggtttgggttagactgttttatgattttaatttttttggttttatgaatttaatggatgcttgataagagacatatagcaaagtggttagagtaccaccttgcaagccagactgccttggtttgaaacctgccccgccacttagttgctctctgactgaacaggctttaactgtacgtcagtttccttggtgtaagatggagattataatagtaaacttctgaagagggttgtgagaaataattgagttaattcatgaaaaatgcctagagcaatatctgacccttaatgaatcatttgttgttggttctttattttttgctagttattgttgttggtggttctttattttgtgctagtttacttttgtgagcactgaaaaagttaaaattttaactttctggccaggcgcggtggttcatgcctataattccagcactttgggaggccaaggcgggtggatcacaaggtcaggagttcaagaccagcctggccaagatggtgaaaccccatttctactaaaaatacaaaaattagccgggtgtggtggcaggcgcctgtaatcccagctactcgggaggctgaggcagagaactgcttgaacctgggaggtggaggttgcagtgagcctagatcctgccactgcactccagcctgggcgacagagcgagacgccatctcaaaaaaaaaaaattttaactttctttgaaagtctgtgtatagactcacattgatacccagaatctgtaaaatgataattttgacaatattaaataaaaatttctacacagaacaaagtaatatatagtcatgcatcacttaatgacagggatgatgcattctgagaaatggatcattaggcaatttgtcattgtgtaaacatcatagcctgtacttacacaaacctagatgatggtacagcctactacacacctagactatatgggatagatagcctgttgctcctaggctacaaacctgtacagcatattactatcctgaaaccagtgggcaattggaatgcaatggtgtttgtgtatttcaacacagaaaagatacagtaaaaatatgatattataatcttatgggttcactgttgtatacgttgcctgtagttcacttaaactgtaattatgtggcacatgactgtattgtaaacagaacagtaagacacatgacaaaaggctaattttctaaaatataaagatctcatccttatcagtaagaaaaaagccaataccaaatagaaaaaatggttaaatgatataaacaggtagttcacagaaaaatacatatacacatacaaaaatgttttcttataattaaagaaatgtaaattaaaatgagatttccattctcacttatcagattgaaagactaaaacttttgaatagtgtacattgttggtgaagatgtaagaaaacagatactcatacggcattgatgagaatcaaattggtgcaacctctttgaataacaatgtggcaatatgtgtcaaaatttagaaggtgatgctcttttatctagtatttccatattgaggaattcattctagagaaagtcatagatgtgcgaagacatgatgagtctaagaacgttctttgcagcactatttataaaaggaaaatagtggaaacaacacaaatgactaatcattagaggactaataaactagcgtacactgatatagatgcatactatgaaatcttttagatgaagtagatctgtaagtggatatggaatgatcaccgaagtacactgataaagtataggatgatatctatttgtgtgtttaaaaacggataaatatgtatgtacttatataggcctaactgatttatgtaaagatagataagaaacagttaagagagtctctgggaaagggatccagtatattggaacacaggacttactttctattgaatagtctcttgggctttcaaagtttttattctgtgtaagtatggctcttttagttaaaacattcaatgatagtttgatatactttaaaaagaagactgaactattgagcttattgtttccacagtatagttagacgcttgggacactttaatctgtcttagctttttttcctgatggacagttttttcaaccttctgaatcatatttaggtgttttcctgttaaagctgttcattttcagaattgttttgaacattcttttgctatgggttattaaagtcctctaaaaatgtgaaattccaaatgcttagtttccgatctttgcttttcaagatcttttttgcctgtgtagtctttttttgtactgtattttaaattgatcggccattctaatcatagatgtgacagaagatagaaatcgaaaaattctgtaatttttaattttttttcattaattgtggaaagtctttttggcatttcagagctctccagagaattaaatcttaacacaccttgattattagagtagtaggaaggataatttagtgttaagaatttgaaggtagaagttaggtagatgggttaaaaatctggctttttccttagtaagtatgtaagggacttttcttcatcctttaggacagaatatcttaccttggagaacttaaggattaaataagctaatacatgaaacatgcttatcaagtgtttaatacgttgtgagtgttcttttacttcctgtgtcaacacccttcctccacctttcctcatctaagtgaggatgactgggagggcattgaaaagggaataagcttttctgcttttcagaggaggttaagacatttaagggcttcacagcactggtatccattgcgtcaacatttcttgctattagcaaaaagcctctagtttccttccaggtagatgtctattctgactcccgtaaaaaaatgcagggaaggttgctgaagatagatagcttttctttctttagtttctttgagtacctagacttacttttgatgggatcagtcatgttacagatcctttgtgtgtgtgtgtgtgtgtgtgtgtgtgtgtgtgtgtgtgtatagtaagtttttctagggaatattttgtgtaagggatattgtgtctaggtatcagtttgctggttcagtaaataagcagtgatataaatatttcaggctactgtttttctttgctacccatatgaatgttctctggcacttccacaaacatgctatgtataactttctgaagtttcaatatactatttactgctccttaggtatgaatagtgcttcatttccaccatctatttgatatacggtgctatgtggttttatgtcttgtcaccagattccctcatcagattaagaagggaattaaagatccatggttaaaataagtggatgtgcttcattataatattgataataaaagtggctctttgtcttgtactatagagttgcaaaacatttttacctacatttaaggacgtatgtaaaaaggattcaccacaatcctagtatacatgatcagttttggtattaatgtgcaaagtagctagcagttatagcaacagtaatagtaatagtggttgtagttatcagctgtcatttttatatacataagaaataaccctaagttacactttctgtagggcattcacccatatcattctctgagctataccagtggagacactgccactgattctccagtgcatgttggacgtgctgggatgccagtaaaggacagtccaaggaaggagagcctactcagctacctgactggaagcttcccaagcctgcacaacctcctggaaggtactcctcagagaagcagtgctgctgtgaaaagtagctccctaacgagaacaggtacgtcctctagatttgataattacatgtttatatttacgggggaattgagatgaaacaggacttaagtttagttagatatatactttggtagtacaactaatctctcataccttatctttgagaaaaaattttaggaatccatttttctgtttgtaacttttcggagtcttcatgcccttagtttgcatttttaaattgcagctctgacgaatgtcaatgtaggcatttggtgtggggtactgtctagaccagcaacatagaatttcccccgttataataaaaataagctatttattaatgcattaatatccaaataccaacattatgcagtgagaattcaaaaccatctgcaaacatacattttaacttgattcttcaaatataggtatataaattacatttttttgctccttagtatataaataatattatactcagaaacattttattttcaggaaatacagtagccactgatatgttatctgaacatcccttgctatctgagccatcatctgtgagtttctataattggatgtcaaatgctgtgggtaatcgaggaagtgtgttacaagaatctcctgttacaaaatcaggacacaatagtcttcccacaggtattgagttatcacattattttgcttaactgtcttaaggggaacatataccaaaatcttatttttcaggggatgggttaaaaatcaaacaagtactgtttggttgaaattggtccatttatatttttaaatgcctttgataatattgtaattgagagagtagtaagcagtcactcagtgttcttgttgaaaggcaaatatgtcaaatgtgagattgtatataaagagtttaaagcttccttttaatgtggctggtttaagtggtaaatgaaaaaatgcaaagtgtaattacaacatcatatacttgatattacaaaagatagttttaatttatctagatccctctgagacctaataactatcattctaaacctttagttacttaacaaatatttaattaaatctaaaacagtatgtatgtataaggatagataaggatgacatgtgttctgaaaagttaatttcatttttcactaataaatcatgtctgtaaaataacctaaaagtatgcattattttttttcttttcaatttaatcagtcttgaaatggtactactatacaggcttcaaaagtttaccctgctgtacacttttatgtgtttctattccccaataatttacattttattcttaaaaatttactccattaggtgttgcacccaatcttccaacaataccctcagcctcagatttcaacactgtcttgtctagtgaccaaaatactttggatgggacacattctcagcatagcaccagtcaggatgatgtggcaggtgtagaagaagcaaaccaagggtttcctgctgttcagcttgctgatgcacaggtgagccagcctgctttttcctaattataataatacctccttaggcattgcttagcaactggaacctccaatagtacgcaccttggaattctagtgaggatataccttacctatctgcctacagccttcatgcaaaacaggaggagcctttaaaaagtacatggcttagttataaatgcaaattaattatctatatgtaatcattaaatagaagagtctcatatagtaacctttttgttattcgtaacaaattggctaagcaacatgaatagataatcataccctatggtttttagtgctacgttaagactttattgagcgagcagtggggaagcattgatgattttagagcagaggaataaagtaaaaaactatagatgtagaaatattatatgagtagcaaatgtattaaattgattgaaatagagaaactagtgttgaaaagatgaattattgaaatagttcacccagtggtaatgagactctaggcttagatgtttatggctttgaaaaggtaaatgaggatatggtgaaagtcttatttaattgcttaaatatggcgaataaagagtgaaaccctttaaaacatactctttggtttgaacagccagcaggcaagtgtgagagtgggacgtgggtgagaggaggcatcattttttcaggataaaggtgtcttgagcatatttacatacagctctccctcagtattcaagggattggttgcaggaccaaccccctacccaccctctgatccgccacccaggataccaaaatctgtggtatgcccaagtcccttatatagaatggcatatatttgcatacaacatacatacatccttctgtatactttaaatcttttctagattacttataatacctaatgcaatgtaaatgctacgtcaataattgttacactgtattgggtttttatttgtattttttaattgttacattgttatattttattggtttttactccctaatattttcaatgtggttggttgagtccttggatgcagaacccttggatatggagggccaactgtacttgagaaattaggaagctaatgatcaaaaataaaggaaagaacggttagcagatggagcaaaatcagtagaaaaatgagaagtattggaatttagagtcagttaaagagagagctgtcttcccaagcacacacaaaaaaatgaggtgacctaggacaatcggaaatacaggcttggctctcattgtgtaaatggcacttgtccatttagatatttttttgttgttgtttgtttgtttgtttgagacagagtcttgatctatagcccaggctggagtgcagtagtgcaatcttggctcactgcaagctccacctcccgggttcacgccattctcctgcctcagcctcccaagtagctggaatacaggcacccgccactatgcccagctaattttttgtatttttagtagagacagggtttcaccgtgttagccaggatggtctcgatctgacctcgtgatccacctgccttggcctcccaaagtgctgggattacaggcatgagccaccgtgcccggcctagatagggtttttttaagcttcaggaaaagatcactaaggtagaatgtgtagtgaaagaggaggctgagaaaagcactggatagcacctatatttagaatgtagaagggggaaaaggaaccatgtggcagaggatgagtagtcagagtgattttagtgctctagcattgaacacatgtagttctttctgttcaggttagtgctgtgtctgaaattcagttaactagagatttaaccagaataatgtatctccataagcatgtatgatacttaaaatgtaaaggaagttctctgaagataaatgttaaatgactattacaaccaagtgcttccatttaaaaataggtcagatattcataacatttataatgtttttatattaacacaggaagttgaaaagtcaactttgtgaatgtaatatatgtttttttttgtaaatggaaacacaataggaattcatacctgttttaaaagcaagaggtagaatgatttaactaattcataattttattttccttgtactttcagacacttaggtagggtcaaggaatctgtgtccttatttattattattaatttgaagatgagtggcctataataggtactaaaaatattaaattttaagtaaagttagagtcaattatatgagaccatttttgcttcacactatgataataataatatgtactgaggtagggtaagaaataaaagctgcattttcctacatgtaatttctacagtaaatgataagctgtaagttgagctaatatgaatgtttatgtcttttaggttgttttcaagcctcttctgagtcatacagggatccagtcacaggatacaatgccattctgctaccgaatgtactttggagaacacctttcattttcagggactttggactgcctcagagcagatattgtggattcagacacagccaaagagagaaaaggcaaaagagcaagaaggtgtcttttgcatttttgtgtataatttttgtgcaagaattataatacgtttgttttttaacgttactttcgtgtaatnnnnnnnnnnnnnnnnnnnnnnnnnnnnnnnnnnnnnnnnnnnnnnnnnnnnnnnnnnnnnnnnnnnnnnnnnnnnnnnncccaggctggagtgcagtggcgcaatctcggcttactgcaagctccacctcccgggttcatgccattctcctgcctcagcctgccgagtagccgggaccacaagcgcctgccaccatgcctggctaatgtttttgtatttttagtagagacggggtttcactgtgttagccaggatggtcttgaactcctgacctggtgatccacccgcctcggcctcccaaagtgctgggattacaggcgtgagccatcgtgcccagccaagaaagtaattttaatatgttaatcagaagataattaccttttagtaaaagtagtagccacattttcttattaataactagttgcatttatgaacagattatgaggcctatttttaggcatatttttgaaccacgttagcacatagatgagggtcatatatattgatatatgcactcaccatttatttacttggctcttgtaatagtggaatttttatgatcttaagggttctgggttgacgtgtcaggtagtattttgtattagaaatagggcagaagtcatattgagagtctagccatcagaaacaaatagaaatgtagcatggtaaaagttaagaaccatcttttgctgttattttatattgtcatggatggttcttcagtttctttagtgtttaataggaaataatatacccactaacaggatttgagtaatattttgggaacttgggattttattttcagtgggacttaaatcgatagaaatagtagaatatggagataaatggcatttatgacaagaggtttctgtagtattgtttctttcatcctttttgtgtttttgcaaggtggtaaattaaaatacttgtgtctgatatatagctaagtaaaatatatttttcatttgaaatatttctatttaaattttaaataatttaacaaaagttcttgcttttcacaatagtcttataccataacaatgaccgtacaagctgaaactacaaggcaattttaataatcggtgaaaaaaattacttttgtgacattgacagtatttgtaaaaacattaaaaatgttcttactatttattataaatgtatagggaaataaaaaaaagtaaaactaatatttagtacattggaatttaaaatgttagaaacactgagaattagactattttatttctttttaaaaacttatcaaagagtagtttgaatggtcctgtccttatgatataacatataatacagaacaaggagcttttgtgtgccttggtaaaatgtcgaactcctttgtatgtatggatcagttttcagcattttatcctttgcactttcaatgtcatgaaataatctttgattccctttactatgaagttttttgtcagcatcacttcctctgggatatcttcatcctttctgtcgtggccactttcctctttatgtcaataattttgcctccactgagtttttctggctagatattaagagtgtctcaaacagtggaagtatcaacatttccatggtcagctgtttcttctataacaccgttcaattgatcttccctaccaatatcttcatttttagtttctttgctgcattttcatctttgttgtccaattccctcatttgattattcatttttgtaaaatgttatggggatttattacagagagagaaacaaggaggcaacacaagtaactacatattgtgctttctgtgcatgaagtgaacaataggtatgcttcaactaatcactatcactgacacattttgaagtgatgtgactagtcaatgatcacagtgctcatctgttgttttgtactgacttgtgggctgaagagctagcagtaagtttgtgctttatgcagttttcacagtaagtctttgttacaaatttgtatcgccttattgggagacttgttatttaagtaaaccacagtaactgaaattttaaaatattggaaccatcaaatccagacccaaaacattaatacctacacatactctctagggttaaaatatctgagctaaatttatatttaaatttgcaagagacagctttcatacaaatatatccatttatatataaatatgtttatatgtatacatacagtctatgttttcatatatataactaggttatatataattcaattatatataatttatatgtaataggctgtatatagagatatagattatataaataaaattatagctgtagcctatttattggcctagtaaaaaccatataatactacaacagactagaccttcatttgagcacacaagtaagtctgttttgagtgagagcttctttgagtgattctgtgaacttcattgcgtttggtctagctgaacttgacattccttttaatttttctactaacgcgccagctccgatgctccacattcttacaactaactcatgatcagcttttatttctcagatctcctgtaattccatcttaagctcttatttatttggagaccttcaccgcaatatacttttcccagccattaatttcagtattgtctgggttttttgtttgtttttgtagcagattgttcattctgctgattgttgtatattagtttggggttacagtttcttgtatgaatatgtataactctcctactactttgtaaagccagggcagttactaaacatttagcattgagtctggcatgtagtaagtcctcatacatgatagtttctttgtctctttgctgtctctagtaaaagtagctgcacgtatcagggacttatattttaaaattttaattgtaactttggctctgcagtgcccatgtcaggcttttacttgtcaggcaaattgttatggtataccattttctttttctcctttatttgaatctcccctctttaagattttcttactacccttacatgttttagattcttgtttttgcaattgtggattattttcatctctttttagtcttctcctgtctgttctaattctcaaaatcaagtttttccatctctgaccatatgcttagttggcattgattgtacacttcctgtgagtttatgcatttacataaattacactacaatggggcatttttcttattaattaagaaatactagtattcattaaggaattattgctctgtagttataaattctttaagttaaatgcaaaatatcaaagcagcttctgatttttttctttttgttacagaaaaaactcccatgtctgcacattcatagtgtgcatggaagaagagggaaaaatacctttttacagttttggtgcttggggcttattgttattattggtagctggtttatagaaatttgagatatttttgactttctatattaaaatttactataatagtcttacatgaaaatctttagataagcaggaggatttgccaaaataatttttttatcagattttaaggttttgtgtgtatttctaatttttgtttcaattgcttttcctgtctgctttcaacttagcatgagggcttcctatctaatatcaaataaaattatgttaaatatgaatatattagatacagattgtaggagggggggatggttaagtgaggtatcctaattgatctatacttaactctaaattccaatactctacggcaataccatcaaatgacagtaaaagttgtgttatcacttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaataaggtggagaagaaaagagttctgaatgggggtaaaataaaaagtggaatgttgtgtgtctgtgtatgtaatataaaatatcttgttcatgtttttacttacatgtgagaatatacttattttcttctatagattcttcctattaaagaaattaaacactattcagtgcaaatagcataaaataaatatattaatatttttagataacattgtttcttcattgtataaacacataaaaatttttaagtcgtttcagttcattcagttacgagggggcttcacaaactgtggaaaatggaattaaagatataaaaaaaataaactttatttcccaacataaggtccatcaagttcaagacacttttctaatcagtgataccagccatttattccttcgctaatgaacagaggggtcccatgacaatgcagtctttttcacattattaactgaagagaaatgcgcaccctttaattttttttctttttaattaggaaacaaaaaaagtcagaaggagccaaattaagactgtgaaatggatgcctactgatttcccatcaaaactcttaacagaattgctcttgtttgacaagaggaatgagcgagagcattgttgtggtggaggactggtaaagctttcccgagcatttttctagtaaagctagggctacctttctgaaatcactctcttaataagcagatgttatcattctttggccctcaagaaagtcaacaagcaaaatgccttgagcatcccaaaaaactgttgccatgacctttgcttttgactggtccacttttatctgctccccatgcgggagtgcagtggtgcaatctcagctcactgcaatctccgtctcctgggttcacgcaatcctcccacctcatccttccaagtagcagggactgcaggtatgtgccactatacccagctaatttttatattttttctagagatgggttttttccttgttgcccaggctgatttcaaactcccgagctcaagtgatctgctcacctcactttcaaagtgttgggattacaggtgggagccaccatgcccagccatgactgatctgcttttgatttgactggaccacttccacttctttgtagccattgctttgattgtactttagttttagtattgtactggtaaagctatgtttaatctcccattacaattctttgaagaaatgcttcaggatcttgatctcacttgtttaaaatttccattgaaagctctgcctttgtttggagttgatctgggagcaatggttttggcacccatcgagtggaaaagtttgctcaactttgattttttagtcagaattgtgtaagctgaatcaattgaagttgtctatggtgttggctgttgtttgtgctgttaattgttggtcctcttcagttagacacaaagaagataaaatttttccttgcaaattgatacttggtttgccactgtgggcttcatcaacattgtcttgtcccttcttgagttatccatttgtaaactgctgattgctttgggatactatccccaaaggctttttataaagcatcaatgattttgctataattcgcccaaacttcaccataaacttgatgcttgttcttgcttcaattttagcagaattcatgttgttttgatgggggctctgtcaaactgatatcttatccttcttggtactttaaagaagatcatgttcacatgtttcaacaagtgaatatgagtttattttggtgcaaaataattctgaaatctacactttttttgtaatacacattttccatgaactttttgaagacctctcaaatttataagtatttttcttgctctcaatattttttcaaaatttctctttacttggctgttggctgtattttaatagtcttctttctctattgatagaactgtagtgaaatgtagtattgccaagtcccaagccctctacagtgcccaaagagggctgaagacaaacaatgctgctgtgttcaaagtaggagctatcagtatcaacattcctcagcaccctgccaccttacatagcatgatggttcgaagttctcaccaactatctaaacaaatctcagacctaatcagacagccttctacagcgtaagttattttatttgttcacattctgtgattccatatactacctcagggtattctttgctgcattaacaaaagtttggagggagatgaagggttacttctaagtatcgaccattatggacagtggagcaagaggagagtagccaattgtgatcatgtgagaatgacttttgaaagcattaaagtacagtgtcgtcagtgcaattgtcagtgttccatattgcataaacaaagcttaagagatcctagagatttgtgggtattgtaagaggtactaataaaaagcaaattggtgaattccaggaccatgtcaatccttgtttactttgaattcattggaaacttatgactgcacagatttaagaaagtatagcagtggtcatttatgtcccaaggcagcatttgaccatgccacataaatgttttaaagggcagtaaatttgagcattaacctttattccctatgtctgtagcctttgttcatacatcttcactgctgagccttattcctggtctccaaaaactgtaactaataaaaatacgtggtggcaggcatctgtaatcccaactacttgggaggctgaggcaggagaatcgcttgaacccgggaggcagaggttgcagtgagccaagactgcaccattgcactccagcctgggcaacaacagcgaaattccatctaaaaaaaaaaaaaaaaaaaacaaccatgtaaaaggttaaaaatttgtcttacgttttatttcccacatcctataagtgggaaaacattagtgtgtcttttgaaggtgcctcaaagctgatttttccaattgttttatctaaatctttaattctgatataatgtttaatcatggctgaagctaagtagtaaaaatttaaatgtttttcctctgaatagaaatatggaatccagagtgtatacttaaattttagttttaaaatgctccaaggagcttttccttactatagtatcagtagagtgtagtagttgaaaaatcagaccctggagtcagactgattgggttcaaatcctagtttcagcactctagctatgcttcctcattttgcaacgtggagacaatagtacctacttattaaagtgagataaatgagacaaagcacacaatgcactaagaacagtacctgccactcaaattgttattattgttattgttggggttggtgttgtcattcttaacagtagtagtagtagtaatgtcaataatatcagtagtagcgtgtaatagttaagtgatagaatttggaatcagacaaatctgagtttaaatcccagttttgtaataatgataagaatcaccttcacagtataacattctaagagtctcatattgttattactttttcttgtctacttttccatatcatcattgttcaacaggtgttttagaaagtctgaatatgatctgatattggaaagaaaacatctattcacagtatatatttgctatttttcactgagaaatccagtgattttctacaataaaatggtacgtcctgtgtttattttttaattattttttttttgctttctagcccacagcctgtaaaagaagatattgcaaccccactaccttctgaaaaaaccccaacaagtgttaatcaaactcctgttgaaacaaatgaatttcctcagctaccagaaggcttagaaaagaagcctattgttcttaaattcagtgccatgttagatggtatagccattggagcagcacttttaccatctctgaaagcagaatacaagatgggaagaatgagaagtcatggaatgacaggtaatattgaattctgaattcactctcttaaaatttatgatttgtttgagaaattagtaatattttgataaaaaggtaaatttggttttatagatattataagtaattttgattataacatttaaagttcattaatgatgttctctagtcaagtaaaaatatcaatcccccaccccaaaaccttgaatgaccagaatgaactcttttgaactccataaaattattcaactatggaggccatttctccaatttaaacttaagttgaagaaattaacccatttctacatctattaagtttttaatagactgaataacttggtttattttcacattgggttcatttagctcaaatcaggggtcatttgatttcttcaaaacagctaattctgtatggttttgtgacccttatattaatatatcctatctcaaaattccttgcttttaatatttatgaaatatatcatgtatacaaagcatgtaaattatacatatacacattttaaagaataattaagtactgtgaactcaccaacccacaatatagcctaagaattggcacattaccaatactttgaagccttctttggccgggcgcagtggctcacacctgtaatcccagtactttgggaggctgaggcgggtgtatcacccgaggtcaggacttcaagaccagtctggaaaacatagcaaaaccccatctctgttaaaaatacaaaaattagctgggcatgatggcaggcacctgtaatcccagctactcaggaagctgaggcaggagaatcgcttgaatccgggaggcggaggttgcagtgagctgagagtgtgccactgcactccagccttggcgacagagtgagacttcatctcaaaaaaaaaggcagtcttcacttttcatggaattactgctatcatgaattttgtcttacccattcttttgctttcccatatagttttaccatatatgtatatactcataaatgatttaaagtttgcttttagctgttttgaactttgtttatatggaatctcacattttttaactaggaatttttttatttgactaagagctccttacgagtttatatatataaaatgccagttgatggttctttttttttgctcactttaccattgagtcatttgtatttttcttgattcgcaataattcttcataaattctgtatattaactctttgatatcatgtttatatgttgtcacctagttggaggcttatcatttaactttttcttttgatcagcagacattcttcattttcatgtaattgaatttaccattatttttcctgtatgatgtgtatttttatgtcctgaagaaatgcttctcttcctaggataataaaaatattttgttacattttttcttgaatgttttgagttttgctattcatatttaagtttttaatctatcttaatcaattattattgttcttagatttggcatgggatagtatataaccagtgatcattgtatataaccagtgatcattgtatataaccaatgatctcagcatcacttattgattattctttttttccagtggcatataatnnnnnnnnnnnnnnnnnnnnnnnnnnnnnnnnnnnnnnnnnnnnnnnnnnnnnnnnnnnnnnnnnnnnnnnnnnnnnntcttaagtgttatttttaatgtgggagtctagttctgagttttctattctgcttcattgatctctttgtaccagtatcatgttgctgcctgactttttctttttcaggaattgtcctggctgtttttgatcctttgctctttcatatacgttgtttatttttattttttgagacagggtctcactttgttgcccaggctggagggcagtggcatgatcacagctctctgcagccttgacctcctcaagtgatcctccagtctcagccctgtgagtagccaggactataggcatgcaccaccacatctggctaattttaaaattttttgtagagatggtgggatttcactgtgttgcctaggctggtgttgaactcctggcctcaagcgatccgcctgccttggtctcccaaagtgctggtattacaggcatcagccaccatgcctggcctcataaacattttagaatcagtttaagttccctgaaaaagcctgtttagacttttgtaggaacttaattgaatctatagatttatttggggagaaatgacaactaaacaatattcaaccttcctatccttgagtaagtcttatttctctgttgtttaggtcttctttaatgtttttgtgtaaagtttaaaatttttctacttaaaggtttttgtgcgtcttttacaagatgtatttatttattaagatatctaggtatcttgtggtgttgtagctattacaaatgttatcttttgtaaaatggcatttttctaaactgttggtagtctacaagtgtgcttgatgcttttttgttaatctgatactcagcaaccacattaaactattattaccaataagttgtagattcttaggagttttatctatagacagtcatactgtttaaacagcaaataatgatacttttgtttctttccaacttttatttctttttcttgccttatggtgcttgccttgtctgattttcttaaaggaatcaacattacatgaataagtctgatgtctgctctaggtttctgctatcaggttaagaaaatgtacttattttcccactgtgcttaagagtttctatgaagaattattggtaaatgtaatcagatactttgttctgtatctaatgaaatgaaaatgtattgtctcctttattatgttaacataatttaaaaatatatacatatatatgaatatatgcagacatgtacatatttatgtaagtatgtgtatacagtagtccctgcttattcatgtgttttgtctcttcacgtttcagttacctatggtcaactgtagtccaaaaatattacatacaataaggtattttgagagagaccatatttacaaagatatttacagaacttttgttacagtataactgttctattttgttatcgttgttattaatctcttgttgtgcctgatttataaattaaactttatcataggagtgtatgtataggcaaagacatatatacggtttgatactatctatgatttcaggcatccactggggatcttagaacacatcttccccaaataaagggagattactgtatatgtgtactcccatctctaccattttaggctttctttattaagagtaattttgctgaacatttagaactttctattaccagaaagagaagcattttaaagtaaatttctagatttggcagagtcagaagtcttaggccttcagatattagagtccagggctgacaataagttacacacatttggtcacttattcagggcacccatgaaatacaggggtccacagaaacagcaagtcgaaagccagataggcagtttaggatcttagagtaaacatattgttaaatatccagagagataagaacccaaaattcttattgaaattgaaggaaagggataaaaacagtaaaagaatgactatactagtaataagggatgactcagtaactgaggcctaggattatttcaatcttggcgtttttatttcaatcttggagtttttatttggtggtgtgctagcaatagtagtggtggcagcgacagtggtagacagtccccaccccttgcagtttgtaaatgatagtcaaggagtctcttggttggagtagtgagaggagatcagggcagtcatgactcatctggccattcacagatgccccagttggtgagtgagcatttttctgtttttggctaactcattctaggtgcaaacattagttaatgaatatagtgaatgtgacatataggagatgacccttgattagtattttgaaaaaaagagaattatttctggctcagttgagagcagtagggatatataataaattatatatgtaggctaaataggcaatttgatgatgtttgagtggagagaattggtaatgtgcagaagaatatcagtagattttgctggtttgaaaggagcatgtgtatgtacattacatgtgtaaagggcaataacagatcttgattttaataaggcttctccttatgccctcataaacagttggagaaatatggactgaataatagtaaagctggtatatttatatttgtttgaataattatgtgctagattattgatttaagtgtttaaggtcaatagtaaactaaaattcataacatatccttatttgatatatggtcccatgaataattatgaaggtcaaagagacatatgtttgtataattttatactttatgaatgtttcagtgagtacaatttaattgatttggcaattttagctacttccacactgaatcaggatcagtagacatattgttaactacctactattctctgtgaataaagcactgtgtggactggggaaatttttttaacttgattttcttgttacaatgcttctgtaataagggcactttatttctgttctaccttctatgaaataaagaacataagtgtttttctagtgcctaacacactgccagtcttaataaataatacttgcttaataatactggcttaataatacttgctgattgacttgcgtatttaaagatagggaatattttataagcaactttaaaatatcctttcatatatttcaagataggtttgggaatatccatgcatttttcttagataccctttttggaaaaagtgaggaatgaatgagtgaatgaacactagcacaaacaataacttttctcatttcttacaggtgcacagacaagatttacatttgagctgccaaatcacagattgcgttttacttcaaaagtttctgccacagatatgtcaaccattcctccttctgccagtcttaaccttccccctgttaccatgtcagggaaatatataatggaagaacatgatagttattcggatcaggtgtggagtatagatgaactgccttctaaacaaggttactatttacagggaaattatctgcgttgtgtggcagaagtaagtttactttaaaattttcttactcttcgtaatttaggagtcttcaagatttatatgtaccaaaatatgtagtaatccaaacttttaaggtaaagtcttaaaataatttgttttcacagaagaattctataccaaatcaagtgtgtgtgtgtgggtgtatgtgtgtttttgtgtctgttagtctgactaccctgtagttttatttacacatgcttttaaaaatatgtattagttatgtattccatctctgcaatattttcatagttcaaatgattattaaaagcaaatcacagctaacattcattatgtgctttacacgcattgacttctgcagtgcttaagtaaatcctatgaggtagaaatatttgttctcattttgtaagtgagcaaactaagccttagcaaagtaacaaattcatacaggtatacataattattaagataatctaaaggtcatattgaaagataaattagacttacagattaatttctttactaaggttaagttgaaagtagcatatctaattccatcataattttttcactttgtatagctgtcaaaagtttaaaaagcatttggacacatttttcatttgatttgtggtaagcaggtcatctgttattttcctaatttgatataaacttgaagcggagaagtaaacacctttccttaagtctcgagacctagctatcaactgagagaggcaggagccacgccttagtggtctgccttcagacacactgtgctgtgtctcagcttaccttgtcagtttgtcaaaaactgttgcaactttatgaaaaagcaatgtgctatttgttttataaattttgttctccataacctgaagcatctataagaatgctctttgggttctctgatagaaatattataactgcgggggacatatttaagtctgatttaccttcttaggtcctgcttgccctggaagctctctaagagttgggatttctgtgtatgaaaaacaagtgtacgaaaaaatagtgttcagattctaacaagtcaaagatttaactgaaaatattttaaagtgtatcccacttgtactttctactctgaaaactaaaagccccaagctctattttagcaatactattattaatgttccatttaaaagaaaatacacgaatacagtgtattgtataattccttgctaatactagatattagaaaggtataagtttgtaacgaggtggaacacaatcccaaatttagtaaaaaatgtatttaatttcaaccatttcaaagactctaaaattgcatccctcttagagttgcctattttactatggcctgaaataaacatacctgaaaatagtttctggcaaattggtttattaactaattagtttattaactaatttgccagaaatttaataccttgtactaatcataggacacaaattataggacacaaattaaggacacaaaccttaactgggtatctctgatgatttactaattcactcaaatgtaagcctgagacccagaattttgttggtttttattcatagctgcatccttagcacctaacatggtacatagagtagacagtcattaaatatatatttgattaaataaatctatttttggctggacatagtggctcacacctgtaatcccagcactttgggaggccaaagtgggcggatcgcttgaggccaggagtttgagaccagcctggccaacatggtgaaaccctatcatagtggtgggtgctcgtagtcccagctactcaggagcctgaggcaggagaatcgcttgaacccaggaggtagaggttagagtgagccaagattgcgccactgcactccagcctgggtgacagagcaagactccgtctctaaataaataaataaataaataaataaataaataaataaatctatttttacttaactcgtctatgattctaagaccacaaaagtggccattaaaatgatcattaaaagtaaattttactctaggagaaaatttaatttcaaaattagcaagttaaatatataacttcgatttgctccccagacttctcataccttattaactactgttattaaaaaacaaaaaacaaaacccattttgggagtgtactataatagtttctggccagtaacgtattaggaacgctgaatatttttaacttttcttcaatatattgatttcaaatcatatagagataattatctcttttttcctcagtttagggtgatttatgtaagaaaaaagtgtaaagctaatgtaatcagtgttaatctaatatgattttgtctggcaggttggttcctttgaacataatcttacaactgatcttctaaaccacttggtatttgtacagaaagtgttcatgaaggaagttaatgaagtaatacaaaaagtttctggtaagatgatctagtaccttatagtataggtgtaggtttttattctcattgagcgtgtgatatcccatatatctgtggtataagtattgatccagcatttggatatagttgtcaaataactcctaagaaactgtgcattccttttatggcttttctacctacagtgtttgcttatcatttttgtcatgtataatatacacatttaagattcataaacttcagaaagctcctttatgtttcaccctgaaaaaagaaaagcttacagtatgtctattaaccaaattaatcatactcatttgggaacaacatttaggtaactactaagatttcaaccttttgtctataccagatgatggctatatgctggcagcatggtaaattgtctgtggaaaccctcattatatttttgctgttcctcaagaatagcttacagttgagcttagtcattgctctacatttttcacaagctaaagtattagggaattagggtgaaaagttgactgtataacagttcttaatgctgagtattttttgtatgaatgttatcatgttaaaagaatttttaagccacatccataaattggcatcaaaaggagtttcctttatgctcatggattaattcattcatttaacaaatttatgaagtatctaggtattcacttacaattttgatgagttctgcgaatgacaagaacagggtgctatgagtctgtgtcataggagaaactactgtagtctaaaggatcagaaaaggcttctcagaagaagtcgtatcccaaaacttaagaatgaagcctagtttggcaagaaaggagaggtagagaggacgcagacagagcatatgtaccagtatttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccaggcatggtggctcacgcctgtaatcccagcactttgggaggccgaggcgggtggatcattaggtcaggaggtcaaaaccatcctggctaacccagtgaaaccccatctctattaaaaatacaaaaaattagcctggtgtggtggtgggcgcctgtagtcccagctactcgggaggctgaggcaggagaatggcgtgaacctgggaggtggagcttgcagtgagctgagatggcgccactgtgctccagcctcggtggtagagcaagattccgtctcaaaaaaaaaaaaaaaaaaaaaaatacacacacacacacacacacacacacacacacacacacataatattatatatattatataacatactatataatatatattatatataatatataattaaaaaataaatagactcttacatgaactaatcttgtatttcttatggtaaaaaaaacaagtgttgtggagttcctagtatcagactgtcagggtaagcctctcttaaggtagttttgattaaagagaaaggcttttcttaacctttagattgtagtcaggagatgaaagtatatcccaaggtctatgaagaataagatggacaaagaggactggaaattaatatttctaaccatgaagacttgctgtttactgtgagagaatcagatgatagtgacaaaggagtggctagatctgctccttgaaccatttctttctgactttagcgacagccatgaaccttgagaaaatagctaaagtgtaaatcacatatgatttagctggccacagggcctgatggcgcataggcattcagttattctgtcaagaccaaggaacataacagaatattgagagggaatactttgaacccttgtagctcaaatttctcagtactctgatctctgtattgcttcttccctctcccataatcttcagttattttcctaattttttcttatattcttcatgattttccatcatgttacgtttagtgttaggacattttctgttatgtaggaagactaatgttcataacaatcatcaagtttgttaggaaaatacttttttaaaaaattgattaccttatttgtccacgaaggactttcaagaatgcttgggtttcagaaagatgtaagtaagcactgatcaagtaaacagaatagactatttttaatgtacagccatcttagaagcatataaggaggttaccatcttagaattgggccaggtatatatttgttgataaagacataaaatactatggaattaatgcaaataatataatagcgtctcttatggttccataagctaaaattattgtttagtatgttttgtgaatggttgagcttttgcttttaaattttaaacttttctttctgaaactagataaaaggtattcaaggttgtgataggcaaacaaaacaaataggcctttaaggtgtgctcatgcatcaaacagtttttttttttttttttttttttgagatggagtcgcactttgtcgccaggctggagtgcaatggcgcgatctcagctcacttcaacctctacctcccgggttcaggcgattctcctgcctcagcctcccaagtagctgggactacaggcatgcaccaccacacccagctattttttgtatttttagtagagacggggtttcaccatgttggccaggatggtcttgatctcttgaccttgtgatctgcgtgccttggcttccaaagtgctgggattacaggcgtgagccactgtgcccagcccatcaaacagttttatcttcagagatggattatcaaatgaacagacacaaagccattattttttttgtaaaacaacttgagtataagaaaaattagacagatgtgaatattcacaaagctctagacatttagagtattagtattacaatattcaaagtgaaagtgtgctaagcaatgtaaaaatctaagattatttcagatatgttaaaacatgtatttgtttagcaaaatgatttaagagaatatgaaaaagtgaaaggcttacatttagactgtcagaagaaaatagtatgttaacgaagtatactgttaggtaatataacatgaagatttcgctctacttaagtaagtgaaaattgaaaaagaatctgcttttaaccaagtgaaaaggataattaaaaagcatgaatattaagaaaatggaaattgatgagatatttgcctggttatgagaataactagagaaacaataagcctatccaaccaacttgtatataaatctacaggtccaaatgagacacatcgaagttatttaaaagaactaatggaggtcctcttggtacctctgagaatgtacttcagtaaatcatgggtatcaggagaggtctccaaacacaggaaaattggggtacctaacttaaagaagggttggaaaggagcctcaaggaactgataccccaaaggctaatccaaaaaaaaaaatctgatgttttttacttagtctagtctcccttaggaaataacctccttaataacacttcttaagtcatgctaatacttttcagaaaaatatgaggctagctataatttcaaaataatttaagcaagttaatagcttaatcaagtatagaggatatgatgcacttaaacttatatatttatgccatactatgaaataaaacttgattgacacaaaagtaggacagtgggccatatttatactatgaaataaaacttgattgacacaaaagtaggacggtagaagcagctgtagtccaggactctcacacagaggaatgaaaatggtgagtgaattcagcactttcaactgacgtattcagtttcttgctttgggagggactaggcagacagctccaccacggagggcaaggaaaagcagggtgaggtgatggcccacccaggagcagcaaaaagccagggagcccccacccccaggcaagggaggctatgtgtgactgtgtgaccctgccagggaaaaccaggtttttcccacagatctttgcaacctgtggatcaggagattccccttgtgagtcctaccaccagggccttgggtccgaagcacagagctgtgtggagtctcggtgaagcagccactcgggcacgcacagagacacaggagttttgcatactctggccctgggaattccagcaaggcaggaaatccatccatgcattcccctaggaaggaggctgaatccagggattcaagcagtgtcattttatagaccccactcccagggcaactcacaagttaagaaccactggcttggaattccagccggccaacagcagaaggctggagactgcctgagacggcccctgggagagctgccatctctgcagttcaagtcagcaggtctagcctgcctgctccagggagtccgggcagtccagactgggaggagttccctacaagacagcacagctgctatgccagattgtggccagactgcttctttaagtgggactccactatgccagattgtggccagactatttctttaagtgggactccggtccatccctcctcactgggcagggcctccctgcaggaatttcagcaactccaaccagagttatacatacagaactcacagaactctgatctctccctggggggtggggcgctgccatctctgcagttcagctgacttagccttttcagcctgctggctctggagagtcccggtggtctggatgaggggcgtttcccccaggacagcacacctgctctgccaaggggcagccagactgcttctttaagcaggtccttgaccccattctgcccaactggatgagacctcccaacaggggtctccagacacctcctgtaggagtgttcggtccagcattaggtcggtacctggggcagaggccccagaggaaggggcaggctgtcatctttgctgtttcacagccttcactgatacctggtgcaggaggaacctggtgcaggaggaactcagaacactagagtctggaggggacccccagcaaactgcagcagccctacagaagagtggccccactgtaaaaagaaaaataaacagaaaacagcaacatcaaccaaaaagccccacaacaaccccattcagaggtcagcaaactcaaagattgaaggtagatatgcccgcaaagatgagaaaaaaaatcaatccaaaaatgctgaaaactcaaaaagccagagtgtctgttctctcccagatgactgcaacacctctccagcaagggcgcaggactgggctgaggctaagatggctgaattgacagaagtaggcttcagaaggtgggtaataataaacttagctgagctaaaagaacatgttctaacccaatggaaagaagctgaggatcgtgacaaaacatacaggagctgataaccaaaatagccattttaaagaggaacataactgacctgttggagctgaaaaacacagcaggagaacttcacaatgcactcacaagtatcaacagcacaatagaccaagtggaggaaagaatctcagagcttgaagactgtctttctgaaataagacaggcagaaaagaatagagaaaaaagaaaaggaacaaacaaaacctctgagaactatgagattatttaaaaagaccaaacctatgactgattggggtacctgaaagagatggggagaatggaaccaacttggaaaacatacttcaggatatcatccaggagaacttccccaactgagcaagacaggccaacattcgaattcaggaaatgcagagaaccccagtaagacactccacgagaagatcaaccccaagacacataatcatcagattatccaaggctgaaatgaaagaaaaaaagttaagggcagccagcgagaaaggccaggtcacttacaatgggaaacccatcagcctaatagcagacctctcagtggaaaccctacaagccagaaaacattgggggccaatattcaacatccttaaagaaaaacatttccaacctagaatttcacatctggccagatgtacaaagaagagcttgtaccatttctattgaaactattccaaaaaaatgaaaaggagggactcctccctaactcattttataaggccactatcatcctcatacctaaacctgacatagatacgacaaaaaaagaaaacttcaggccaatatccctgttcaacattgatgcaaaaatcctcaaaaaaatactgacaaaccgaatccagaagcatatcaaaaagcttatccaccacaatcaagtgggcttcatccccaggatgcaaggttggttcaaatcaataaatgcaactcatcacagaaacagaactaaagacaaaaaccacatgattatctcaatagatgcataaaaggcctttgataaaactcaacatcccttcatgttaaaaactctcaataaactaggtattgaagatacatacctcaaaataataagatatatatgacaaacccacagctaatatcgtactgaatgtgcaaaagctggaagcattccccttgaaaactggcacaagacaagaatgccctctctttcaccactcttattcaacatagtattggaagttctggccagggcagtccggcaagagaaagaaagtgtatacaaataggaagagaagtcaaattatctttgtttgcagatgataggatcctatatttggaaaaccccatcatctcagcccaaaagcttcttaagctgataagcaacttcagcaaagttgtgcaatgtgcaaaaattgctagcattcctatacaccaataacaggcaagaagagacccaaatcatgaatgaactcccattcacaatcacttcaaagagaataaaatacctaggaatacagctaacaatggaagtgatggacctcttcaaggagaactacaaagcactgctcaaggaaatcagagaggacacaaacaaatggaaaaacatttcatgcacatggataggaagagtcaatattgtgaaaatggccatactgcccaaagtaatttatagattcaatgttattcccattaaactaccattggcattctttacaacattagaaaaaactattttaaaattcacatggaaccaaaaagagcccaaatagccaagacaatcctaagcaaaaagaaaaaagttggaggcatcacactacctgacttcaaactatactacaaggctacagtaactaacacagcattgtactggtacaaaaacagacacataggccaatgaaacagaatagagaactcagaaataagaccacacacctacaaccatctgatctttgacaaacttgacaaaaaacaaacaatggggaaaaagggttccctgtttaataaatggtgctgagaaaattggttagccatatgcagaaaatttaaactggacctcttctttacaccttatacaaaaattaactcaagatggattaaagacttaaatgtaaaacccaaaactataaaaaccctagaagaaaatctagacaataccatttaggacataggcaccagcaaagatttcatgatgcaaactccaaaagcaattgcaacaaaagcaaaaattgataaatgggatctaattaaactaaagagctgcttctgcacagcaaaagaaactaccatcagagtaaacagacagaatggggaaaatttttttaagtctacccatctgacagatgtaatatccagagtctacaagtaatttaaatttacaagaaaaaaaagctcattaaaaagtgggcaaaggacatgaacagacacttctcaaaagaagacattcacgtggccaacaaacgtatgaaaaaagctcagcatcactgatcatcagagaaatgcaaatcaaaaccacaattagatactatctcacaccagtcaggatggctattattaaaaagtcaagaaacaacagatgctggcgaagttgcagagaaaaaggaatgctttcacattgttggtgggagcgtaaattagttcaaccattgtagaagacagtgttggggcaattcctaaaaaatctggaagcaaaaataccattttgcccagcaatcccattactgggtatatacccaaaggaacataaatcattctattgtaaagatacatgcatgcgtatgttcattgcagcactattcacaatagcaaagacatggaatcaacctaaatgcccatcaatgatagactggataaagaaaatgtggtatatatacaccatggaatgctgtgcagccacaaaaaggaatgagatcatgtcctttgcagggatattgatggagctggaagccgttatccccagcatactaatgcaggaacagaaaagcaaacactgcatgttctcacttatcagtgggagctgaacaatgagaacacatgaacacagggaggggaacaacacacactgggacctgtcagcagggacagcaggagggagggcatcaggaagaatagctaatggatactgggcttcatacctaggtgatgggttgatgtgtgcagcaaaccaccatggcagacatttacctatgtaacaaatgtgcatatcctacagaacttaaaataaaaggttgaagaaaaagaaaagacaagagtagccaatattagatacatagatagatcataatagtagattcatattttcttcagatttgttttgattcttattacttagataaaatactatttattatttaattgaataaatagataagacagctaactttcaaaatcagaatcatgtagtttttatttgatcacctattgtgttgtgtttgttgtatctcatgatgattcctaaataacctgcaccatgctcttgcctatagagccaagagaaactaagaactctcttagcttaatttcacccatcctgttagaaagtgtcaagatatacatagagtcataaacaattttttgtggcagtattctaacaaatcctcaaaatgtagacattatttcatgtaatattttcctctctataacataactcattctgtatttcagagtagaaattgcaaccgtatcttagaaaatataaaagaagattctataatccattccatagttacttattcagaactttaaaaacatatgaccccaaactaggtgataagcaaattacaaagatatgtgggtaaaaattttacttacctgtttggacattatacttctgtttggaacattaggtatttaaacatataataataaaaagatttaaatgaatttttgatgaatgaagaagttaagtagtataaatagaggatgtattgaggcataggaatgattcgaactgatacttgagtaagttctactttttgatgattgagcgcctttcaagagagggacagtttgatgaaagaaaatagcaagaaactgggactgaaagacacatttatttgctgagaatgagataagaattgtgggagtatgaggaaaattataaagacttgcagtaattgttgtgaggagtgtgttggagaaatgacagaagatgaagagttggatcaccaagcaacacaggtgctttatacttgcgttcaggaaaagactgagggtcagctaaggtactgcttgctaggatccacatatatatggcccttccccttaagaattatttagggaaattgctgtgtagataaattaatatacagaaatgtgtattttttggcaaacatcatgtaggaaggaaggaccaaatgctgataagggtgtatcagaaagagtttgaataaacaaaatgtgataaagaacttagaagagcacttggcactcagtaagcactcaaatattaggtattagaattgataaatatatgcactcagtaagcaaatattaggtattagaatttacacataactacttaggagtaaaaaataaataagaacagaatgtaagtgaggggataaagtcatttaaggaaagtgagctcaaggaacagggatgtgtaagagggctgtggtttggaattcaaatgatgaaaagcagagacagtagtagtttaatgttttggaaatagcattgaaaagtaagctaaacaccatctgctgctggatcaaaggaatgaatgaatttgagatttccaaataataatggcaacaaaaagccatatgcaaatgaagttagagaatcagggaaatgaaaagcataatgtaagacagtggaagctttcctggtagtagatggaagatagagacaacagggatgggaagaggtagttgatagctgggttgggggggtgatattatatacacacaaatacacacatacatatatgtatgtatgtatatggctgtaggtagggttatcaatgatgaggcttaggtaagggatgattgtagatttgagttaggaggcagagagaagtacttaattataagttgaagaaaagaaaatgtaatctgtatgctgtatattttagagaaggatagctcagagaggaaaggtacaagcgtacaggcaggcactaagtgtacaaagacacatataatctacaaagacacatatagtttattcttccaaaatacaaatatatatttttttattttgtttttgagtcagtctctgtcatccaggctggaatgtagtggtgccatctcggctcactgcaacttctgcctcctcctgggttcaagtgattctcctgccacagcctctcgagtagctgggattacaggtgcccaccagcacacccagctaattttttttatttttagtagagatggggtttctccatgttggccaggctagtcccgaactcctgacctcaggtcatccacccatcttagcctcccaaagtgctgggattaaggcatgagccaccgtgcctggcccaaatatatgttaattaatatgttctggtataaccaatccacaaatccttaatactttactttccatctcttcatccatatcattctttcattccctttctggtgtatttattcatctttatgtacaaaggtcttttttggggggccaagttatgtccttgtctctcttttcttggtcttatcttggatgtaccttctgttgactgttgcctctattttcttcctattttctgttctagtagaaaactaaaaaatatttttatcatagtactaactaaatagatttttgacccctaaatttcaaaagcccaaaaaagattaatttctccttcaaaacaaacaaaatctgctttttatctatttggttcttagttattttgataatatctgtggtccctaataggggaagaaaacattccatcccacctatacagactccctgggatgatgatcaactcaacatatgtacaaaaagattaatcattgtaagaaagaatatttgaaagataggcaggcagaatgttttcaaatcaatggaaagagaagtggaaacagaagtaagatattaagatattagaacattattttctgtatgccacattgcccaggcaaaaaaaaaaaaaaatgctctcttaatagtaacttcaccaccaggggctctgcaacagaattcacattattagttgaagaaattagtccagtttacttttttccctcaaatgtgttttctgagatgtataaacacatgttttggttcaataatatatacagtgttttaattgaatataaaatgttattaataaatgtctacatatgcagaattatccctatctttcatatatctgtctcagttaaatgtaacttagctaaagatctctgtatcagtggtcagtaaaaagaaaatattttgtgaggatttttttttaatgcacaaaatagttattttttttctttaaaaaaaaaaattgtcccgaactcttctttcctttaggtggggagcagcctattcctctctggaacgaacatgatggaacagcagatggagataaacctaaaattctcctctattccctaaacttgcagttcaaggtaacataaatataatgatacttttataaaaatttttctaatcaattaatatatgcttgttatagaaaatttgtatcttacataaattaccaaacagaaaataaaaatgatctataactccatctactcagagaaaaagctttaacaataattatttgaatattctttaggacttttttcctgttagtatttttatatatgcatatatttatacatttgaaaaataattggatacctttccatattagaatatttagattagttttatcttcttgaacatctgtattgtatgttgtacagttgtaacaatttattcagccactcccttctgacgaacattttgtttttcttcaagtactgctgttataatttactctgcaagaaatattttatgcacttttccagttaactatattacttttagaaggctgatgcaggaggattgcttgagcccaggagtttgagactagctctggcaacatagcgagactttgtctctacaaaaaatttgaaaaaacaaaaaaattagccaggtgggtggcacacacctgtagtctcagttacttcggaggctaaagcaggaggattgcttcagtctggaagttcaaggctacagtgagctgtggttgtgccactgcatttgagcctgggcaacagagtgagacctgtcttaaaaaacaaacaaagactatattattttaatagaaaacttaatatttccaatatttaagatactggtgttcataaaagttatttaattgtatttaatgtattcaatccattgaatactaaattttaaatataaaatatcaaaatgaaacataatgggaaaaaattgctactaacacgagaaattaacgttgccagttttatcagttcattagacatatcctatacaggcataccttgttttattgcacttcgctttattgtgtttcacaggtattgaggtttttttatgaattgaaggtgccatttttccaatagcatatattcactttctgtgtgtcatattttactaattctcacaatatttcaaactttttcattagtattatatgtctgttataatgctctgtgatcagaaatctttgatgttgctgcgggaattgtttaggggcgccaggagctgcaccaatgtaggatagcaaactaaatcgttaaatgttgttgcacatctctcactttcaatcaaaagctagaaacgattaagcttggtgaggaagatatgtcaaaagccaagacaggctgaaagctaggtctcttgcgccagttagccaagttgtgaatgcaaaggtgaagttcttaaacgaaattaaaagtgctactccagtgaacacaggaatgataagaaagccaaacagccttattgcagatatggagaaagtttgaatggtgtggatagaccagccacaacattcccctaaactaaagcctaatccagagcaatgccctaattttcttcaattctatgaaggctgggagaggtgaggaagctgcaaaagaaaacttggaagctagcagagattggttcataatgtttaaggaaagaacctgtcttcataacataaaagtgcaaactgaggatcaagctagaataattgatgaaggtggttacgctaaacgacagatttttccatgtagccttctatgggaaaaagatgctagctaggactttcacagctagagagaaatcaatgcctggcttcaaaggacaggctgactcttgttagggtcaaatgcagctggtgactttaagtggaagccagtgctcatttaccattctgaaaatcctagggcctttaagaattacgctaaatctctgcctatgctctatcagtggaacaacaaagtcttgatgacagcacatctttttacaacatggttcactgaatattttaagcccgctatgggtctactgctcagaacaaagagtcctttaaaaatattactgctcactgacaatgcacctggtcacctaagagctctggtgaaaatttacaaggaaattaacgtttttatgcctaacacatttcttctgcagctcatgaattgagtaatttcaactttcaagtgtatgatttaagaaatacattttgtaaggctacagttttcatagatagtgattcctcagatggatctgggcaaagtaaattgaaaaccttctggaagagagaacactttgattcatgagaggaggtgctaatatcaacattactaggactttggaagaagtcggttccaactctcatggattactttgagggactcaagacacttcagtagaggaagtaaatgcagacagggtggaaatagcaagggaactagaattaaatgtggagcgtgaagatgggactgaattgctgcaatcttatgataaaacttgaatgggtgaagagttccttcttatgaatgagcaaagaaattctatcttcagatagaatctactcctggtgaagatgctgtaaacactgttgaaatgacaaaggatttagaatgttccataaacttagttgatgaagcagtggcaaggtatggaaaggattgactgtaactttggaagaggttctgctgtgggtaaaatgctatcaaacagcatcatatgctacagagaagtctttcatgaaaggaagagtcaatcagtgacacaaacctcattgtcattttatttgaagaaactgccacagtcaccccagacttcaacaaccactaccatgatcagtcagcagccatcaacatcaaggcaagaccctccactagcaaaaagattacaacccactaaaagctcagatgattgttggcattttttagcaataaagttttgttttgtttttgagacagagtcttgctctgtctcaggctggagtgcagttgcatgatctcggctcactgcaacctccgactccctggttcaagctattctcctgcctcagcctactgagtagctgggattacaggcacacaccaccatgcccatctaattttgtatttttagtagagatagggtttcaccatgttggccagggtggtctcgacctcatgacctcaagtgatctgcctgcctcagcctcccaatgtggtgagattacaggcgtgagccaccacgcccagccaaagtattttttaaattaaggcatgtacaatgttttttagacataatggtattacacatttaatggactgtagtataaccttttatatgcactggaaaacaaaaaaatttgtgtgacccactttattacaatggtctggaaccaaacccatattatctccaaggtatgcctgttcatggtttaaaacacgactattttatttatcatatactgaaagactacatttgagtaggtatatgttgttgatttaagattcatttttttcctcctaacatataatctgctagggtattcaagtaacggccactactccatcaatgagagctgtaagatttgaaactggattgattgaactggaactttctaaccgacttcaaaccaaagcttcaccaggaagtagcagctatctgaaactgtttggcaaatgccaggtggatttaaatctggcattaggacaaattgtcaaacatcaggtgagtacagaatatgttgatgttagaacgatggcttttaaattttgcacatcaattttaactactgtaacttatgtattattatatttacaaaaatatttagtttaatttcctaaagtttctgattataaattcagtgaaaactcatttaccttggcatttcattgaaaattgtagccgcatattgttatagtttagtgcagatgcactcacataaaacttaatccagtatcttcgtaatcatttgcttgtaattttttttattttgctaaacattttttatttcaaagtcttgtgctaacattactcagttcttaaaatgttaagtgtatacctttcctgtagaatattagcaagttctgcatatagtaatgttaaataaagttaaaaaacagcagttagattctctattttataaaaatgaatgttcacagcttattggagattttttttgtttttattttgccaaaaattattatgtagattttaatcttttttcctctttgaagaaccaagtagaaaaatgccagtcacagtttcaaaactgaatcgctgcattaaagatacgaggaaaaaatgaacaaaaatttcttgtcatctcttagaggttctaattattctgaaatatttaatacattgccatttagaatatggacctcatcctaacttttatataaagtttatctatgacttcatatttacttcttgcatggctattttgtatattaatttcaagtgtttatggtacagagtataaggaatatacattaacagctgaatttgagaaaaatgtattatagtttttttggtgaacaataccattaataatgtttagtttcatattaaaactttttccattattttattttattgagctttaaattttattttaggtttatgaggaagctggttctgattttcatcaagttgcctattttaaaaccagaattggattaagaaatgccctccgagaagaaatcagtggttcttcagatagggaagctgtgcttattactttgaatagaccaattgtttatgcacagcctgtggcctttgatagaggtaagataaagtcaatcactactatcctctgggatctaggaatgctttgttaatgctagataagaatcttgtagtttactggtgtaaatgcttgacagctaaatggttcctaaatctgaaatgtgtgtatccaaaaaaaaaatcttgctttttgccttcagtttttaaaagttattttacattttaaagttattttgtcttctggctggataacataagagtgtctgcttcagattatgtaattgtaatgctgattttttttgttttgataattaatgcacccatttgtgttttggcactgtgtttatttttatattctataaacatttatcaggtactgcctagaagtggaatacaaaaataaacaacagtatccctgccctcaaggacctgtcagtccagtggaaaagaaaacaaagtagactacacagtggagtcagagatgtgttcttggttctgaggaattctctacctttgcctatgcttcttagaggagaaactaattcttgatttgactttgaattaggagttcaccagggagataaggaaatgaaatttacttttatatcccagggcctagaacagtccctggcatacaataagaacgaaataaacattgagtaagagagaataagaatgaatgtgtttaaacacataagtctaagaaaatatagcagtaggtttcatagaagaaaataatgggaaagaaggctgaacaggtagacaaggtctaattaatgtggattgggcaaatatatttgaactgtattttagaagtaatgaggagccatttaagaagccatttaagatcttcatcagtgatggacataggctagtaacagaatcctgttagaaaattgcccttttggcagtgttacagatagcattttattttgctgaatcccatgtacacgtttttcagttctcattttactgacctctcatcagctttcatcagcttcttaaagtattttgtacccttggtgtccttgacacaaaacaggttgagtactggttttccaaagtaattgggacaggaagtgtttcagattttggattttttcagattttggtatatttgtgtatacataatgagatatcttggggctgggacccaagtttaaacatgaaatttatttatgtttcatatacaccatatacacatagcctgaagataattttataaaatattttaaataattttgtgcatgaaacaaagttttgacagcattttggctgcagtctcacatgagttcagatgtggaattttccacttgtagcatcatatcaacattcagaaagttttgggattttggatttcggattagggatgctcaacctgcatttgcttttcctcctacttctctggcctctccatctttatgtcctttttagaggcccctccatctatacactgctgtgaaatgaaggttttccttaaggtttgtttctgtttaacaaactcaaacatctttgacttttctctgtaaatcagatccttttaatggtatgttcctagcattatgtaccttaaagaattttaaaagaagtaacagctctacagatgaagttaagcaccatgtctgttttcatttgttattccatcccagtatctaacatataataggcatttcacaaataagttagagggaatgaacagacctggattttcttcttccttgtgccattatgtggttgcctgctttctgttttattttttcatttgttatttaaaaaatggtgactatatgtcctcttagatctttcctaattctaatgctacagttttctgggtgtaatttttattaagcaacaggattttgcagcttttgagttttacttaacatatagatttacagtgttgattttaattttctttctgccctgtcttaattatcaaaagctgtgctgttttggctgaattataaggccgcctatgacaactggaatgaacaacgaatggctttacataaggatattcatatggctacaaaggaagtagtagatatgctacctggtatccagcaaacatcagcccaggcctttgggactctttttctccagctcactgtcaatgatctgggaatttgcctacctatcacaaatactgcacaggtacaaaaagtcaagtcatattccaggattaagagccaggcatttctacataaccatttctaagtatttagaatataacagtacatttttcagtgtaacagtttataactgtttagtaggtagcaagtaagattgaattccttcaaccattactcatctcaatgtattaaatcttaatctcatgggacttttctctgaagcactcttatatgcttcagaatagtgataagattgataccccccagataactcttaatttttaccttcataaaaagaagcttagtttcagaatcattttattgttttcttttttaacaaggaagtcattggtatggacttgtttataagatggaaataaaaggacatttaagaatactgtttaatgaacttaacctgtaatagaatagggaattccaaaatgcttttatactgtaatatttaatggtaatgaaacttcaaagcagtgtgcacataaaccaggaattttctctttgcaacttaagaccaattttcaggaatatgtaactgcatgcacatgtgtgtatgagagagagaaaaggctatgaacacctgtcaggccaagaagcaacagttattaacaatagcatatagagatctatattttactgttacaatttaccttaataacttgtaaccagttgttgaattaatttatcttttaggattctgttcggtaagacagtgttaagaaaaacttcaggttgaggatgggtggcattggtatgtttgtgtttcaggaactgaaatatagtagttttttaatagcataatgggcactgcctaggaaggccataaacaccacaggtgggtggcatagtgagatcatctccccacaactaaaagagaggcttgagatagaaatgtagatagccctttgtatgttaagtaagaaaaaaaatgcacatggcaagtacattgcacttaagcaatttaatttttaaaaggcatctttctaagctgctctttaatgaacatatctaggcttgaccgtttctagatttctattcctatgaatcctgtgaggatttctaagtttaaaaaattgtcaccttttgtcttatttcttctttaatatattttgcagtctaatcatactggagaccttgacactggttctgctttggtattaaccattgaaagtactctcatcactgcatgctcttcagagtctctggttagcaaagggcatttcaaaaacttttgtatccgttttgctgatggatttgagacatcatgggatgactggaaaccagaaattcatggggatttagtgatgaatgcctgtgagtatcttttatttctatatacagtttagaacttaaaaaataaaacattaagtctccatttgtgaaattaaaagatgcttagatatagcaaatgtttttagactttgagaaagaagggctatttctagttacaggtaacaaaccatattcgtgaaaaactacagcattgagtagttttggtaagtaaaccaaccaggcattctttttggtactataacatttgaatgtttacacagtccctgatttttcctgtaattgatccatgtttgaccagataaagcatttttgacctgtcggaatcttgaaaaaaaatgataaatgtgcaatatccaactcaccataaaacacagaacaggttgtaaatagccaggaccaggaacgccagccttaattaatattgacgtgaataaatccacatgttcaaatttgtaggagtgcagagtgtaacatgaattcctgcaattccataatattcaaggttgggtataactaaagctgtgtttataggccgtattgaagatacggaatttatttgtatatatttttatattttaaatattatagcagagttggtaaagcatcattaatcttaataataaagaaaaattataaataaggagttaaaaggttatgaactaaaattcctcaatcttgtaaactaaattacttactttttagaaagcggtagcccattgtttatgtaattttttcctctctccactagagggaaatctttctacttcccattttctttgaggaatgagaaaatttctattatttttacaaaaattgaagttttagcattcaaaatgaaaaagtcttggttttaatgtgtagggaaggaaaaatatcttttcctactacccttttaggctatttgctggggggcttgtgtaataaaagaccaattaatgagagaaaagcatacaggtttatttaatatgaggtttttttgtgacatggagccttcataaggaaatgaagatccaaagaaatggttaaacctgagtatttttatgctaggtttgatgaagagtagagagttgtagagcaatgtgagaaaataaaaaggggtatgagttaagcgtagtaaactgggggaaactaaccaaggtctgtttgttcagattcatctcagtgtccctccactttggagatgaggatgctcctttcctctgggtataggaagggcatctctcacatgtggttcatatgacctacttcagaagaaagtcaaagtccttcctgcatctgctgcttctcaaattgcttcagtttaaaataccttccatatgacaaggtgccattttagaaggcagtgtgtactaaaccccatcaaatactttgcatttagataattataggtaaaataccagtacttatttgaaatacttcaggttactgagaagacttgatatggaaatactcatgcctattatccaaaagaccagtatcagcctacaacagaaatctttatagatttattattttacacaatagttatacatggctttttaaaaatcactaaaacatatcttttgtttttttaataaaagacaaaaataaatttaaacttagtgatttttattaaggtgacagctttaccatcattgtatttattaaaataagtagaatatatttggaaaaaaaggaagtaaaccatttccttaacagtttatcttaaagggcaaatgcataagatataaaatgagaaatacgctctgactcagaatcagaaacatgcattaaaaaatgaacaaataatttagcacctcagtatatattctgttaatacagaacactaacatgctggtaatcatgatactcagaataatttattttgggttttagaggggactaactgacatgcttctgtaacatgcttattgtttgggtttcttgggagggggccagaaggagataagcagagtagttatgtaactgacatatttataaaacttccaaatgataaaatggacaaattagtttactagcttatagtttttattagtaataagtatacctcaatatttttgaacaaaggtgatgtgtatagggcagagaaataaggaatgttaggattatgccttagaatttttttaacaggtcatttttaaaacatactctaaaaaaaaagtgacccagtaaaatttcttctctaggtgataatgtttattgagaaatgcattagaaattaacaaggacagtctataggaagagttcaaagaacgatttaagtagatagtaaatattaggacaatatcatgaatgtgtattcagacaaaataaaccatcagaagtttagatgtctgcaagctctctgtaaaacctaggtagcctttggtcatcagagcagaaaaattaccatcctgcattcagcctaatggttgctccaagtcatcattctgtctgtgatacagaaaccacaggtattatggggaagagactagttgatttcttagtcctcattttcaggattcagatctacatctaaaaatcgtaatattccttattaattcatcgtggctctatattctatgagtttatatattcatcttttaagcttaatgtttttgttgctttttagagacagaatcttgctctgttacctaggctggagtgcagtggtgccatcatagctcactgcagccttgaactactgagctcaagcaatcctcccgcctcagccccccaagtagctgggaccacaggcacatgccgccatacctggctaatttttaaatttcctgtatagatggagtctcactatgttgcccaggctggtcatgaactcctagcctcaagtgatcttgtggctttgacctcccaaagcactgggattataggtgtgagccaccacacctagcctttaagcttaatttttaaaaattctctactactccttgggataggaaatcctaaaagttttcttctccctttttatttactaattcttcctttcacttggcctcagttatgttattcagatttcaaagggttttcttttcattctagcattcttggatttgaaagggtaatgtgggtcttattgttcagatttgtaaccatgactacaaaggtgaattgggtgatactccaaaatcaaatctagttatttcttaattagaatttgtatgtgagacacaggtactatacagttcaaaggtataatttagatgttaaacttattggcagtctttaaaaaaacataataacaagtagatcctctctcacaaactaagttgtaatatttctaagttggaaagatttttcccttttgaaatttttcaaagacagaaatgtaataccaaattacctaaaatatgaatagtaagctcaaatttaagtaacatttgaataccaatttaggattctcagagtgaattacaaaaggacattaaagatatatgtactctggagtttaaattgatatttagtttcttctaaggatgactgaggaaggtcttaattctatgtttagagtttactttgtttaaaagttgtttcaacttttactatgtaaaattgttgaatttaattaacatcttttttgaagctgaagttaccagattaaagccagttggtagtaaatgtttcaaagttaaagtagatatattctggagataggtccatgatcttgagattgacatcatagccttcagccattttttttctcataaaatgttccatgtcaaaagagaaggtaagactgatgaatcatgtgtctgacctaatgtggcagctcttagttaccaaaattctattttaagtcatttgcattctcaaagtgccattcatttatgataacaaattgtcacagcatcctggatattagtagataagccatctagagtgtcagagttggccaggtgttgtcactcaaataaggaaatcacatgcagaaagtaaagctaaaactgcagttaaattatttaaatcatagaataaaatattgtgaaatattttatttcacaataagaatcgatcttatgagtcattaagatagccctttcattccaaagattaagaactaaaatctaggaaggatagtaatcctctttgtatttagacaataatcttgtgtgaaaaattaaagagtacaatatatagtcacaaatgtatttttattgaaaactatttttggggtgatttttgtacaggtgtagttccagatggcacctatgaagtatgttcaagaactacaggacaagcagcagctggtaggttcacatgcagcattattttatgttagatagaattctgcctttattttaatggcaagagaatcttttggctaagctaattctggtgttcactaatttaaaaaaaaactattttgtattagaacatttgtatttatttaacaattattaatcagacacctactgtgtgtttatatatatatatataaatatatacatatatatatactacaagatgttttagaaaagattaaaatgaataagatatactttctatccttcatacttttaaatttttacaatgtagttaaggcacatgtacaaaattacattgaaatatgtgatatgtacaataaaacataaaattccggttgctattgaaatgtataaaaagaagagaatattttcaaatatgggagaatactgggatcagagaaaacttcatggagggacaaacatttaaacaagcactcaaaggacaggataaatctttcttaagcaaaaactgggagatgtgggccagggaaaattcaggcagagagaataatgtaacatgaatcatgatgttaaagcgcagtattcagatttgtccaatttagctagaatagagttatataaaaaaaaagatggaaaaatgttaaatgccaaattaaggagtttgatttggtgggtagtgagtaggctagccattgaatgtttctgaacaagaaggcaaatgacgacactatcaaaggaacactttcaaagattagagggcaaaaaagcctaggaaatcagttaggaggtaactatgaaagtggtaattgactaagatgatagcacaatataaatttttattgttttgcttgttataaaattggacagggacagggtgagctacagagatacttatttaagggctcttaaaatgttgagagaggtagaaattgattaaggttagtagattgccagtctctccttaccattctgttttcctccccaagcctagccttagtgctcatcctaagttaccttagaaagcaccaaggcctagagtctgacaaagaactggaaaagttagagaattttcaactgaggtcacaaataaatcttcgtcaggacttttaagtgacaacaacccacttagactagattaaccaaaaggggatgcttattaaaaggatattttcagactacagttaaacttaggaatggttatttcagggaagagaaggaaccaggtcaattcaggagcccttaggaactactagaaccaagatcccaactgtcaccaagactctttgtagctcttgtctttgcttctttgctcccctcttggctacttgtttttcttcttcttctaacttgtaacctctttcttatacatggcaagaaacacagtggagtctcgtttctccaccctcagtcattagagaacgaccaacctttcctcaagtccaggcaaaatatcttatttttccaactttgaccttcacctggaccaattaacctaattaattctgtctaatgagctaaggtcatggcaattcctactgtagctataggatggtggatcaacttggggtcagggagtgaacctgtagttcatagggaaaaagaaaataggtgctatacagaggaaacagtagatgcacactgtacacatagagaaatcaatcctgtagtctgatgtttctgacaagtttagcagtgaaagacattagttattatatgtggccattattactttgtaaagttatttcaatttctatacccaggacttaacaaaaatgcaacttctttatttaaacagaaagcagtagtgctggaacctggacactcaacgtattgtggaaaatgtgtgggattgatgttcacatggatcctaacattggcaaaaggcttaatgctctgggcaatactcttacaacactgacaggagaggaagacatagatgacattgctgacttaaattcagtgaacatagctgacctgtcagatgaggatgaagttgatactatgtctcccactatccatactgtaagtaaactcactgttagaatttttcaggattggcttttaccctgagacagggatattttttgttcagtgttatttagtatattatagttgctatttgtggaggaagagaagggaatggtggttcactgtgtctacatttcataatactgtcttttaatcgagttctgtgctacatgttgactgtcatccaacttgtgctttaacctataggtaaaataataatattaaaactgaaatgagtagggagtggggcagggtggggaatgggaagaaattgctaacaggtatgaggtttctgagtgatgaaaatattcccaactaagattttaatgatggttgtacaactttgtgaatatactaaatgggtgagttttatggtacgtgagttatatctcaataaagatgttcaagatgaatttcaaagcaaagtgcatatacaaaatgaaatgatacattttaaaaatacgtattttcatctatactatacactctgtagtttcaagttattttgtggcaaaaagaaacttattctttgatttcattctggtattgatttttaaaaattattttcaatatcttttaactattataccatgaaatagttttgttcttgggaagaaatttttttaaatttaatattactgtttattacttagagttcagatggaagttcaataagtggagatggccacaaactcacctttgggcagcgacttgtaaatcacctactaggcctgacacccccaaatcagcgccattctgttcctgcagagtatctgtgtgacccagagatgtggggctcccctcagtctagccagtcccatttgaaagcatgcagagcacactcatggggaaacgtaggtagcaactaaatagattccttatgaaattgaagggatttaaatcaatggagaattccaaccttaatatagatggttttgattcttgcatgctttgatttaaggtgttaattttgtgatagtatagatttgctgtgtgacttgagggtggtattgacagatacacttttgacttttcaggaagccacagattatcgaagacaggcagcatctgctagccagccgggagaacttagaggaagaaaaattatgaagcgtatagtggatatcagagaactgaatgaacaggccaaagtaatagatgatctgaagtatgtacaatgatttttaatttaatataatgttccctaattttagaatcataagatgttaaaagtggaagaaactgtatttggtctaatacaaactctttagtttatctgtgatatcaccagggtccagagttgtttaataatttggtcaagattatacactcattagtgataaagttaggcatgaggctgggcatggtggctgatgcctgtaatcccagcactttgggaggccgaggcaggtgggtcacctgaggtcaggagttcaagaccagcctgggtgacatggtgaaaccctgtctctactaaaaatacaaaaattagctgggcgtggtggtacatgcctataatccctgctactcgggaggctgaggcaggagaatcgcttgagcccgggaggaggaggttgcagtgagccaagattgcgccattgcactccagcctgggtgacacagcgagactccatctccaaaaaaaaaaaaggcatgaaatcctagtgtcctagtgtttttcacaacttatttctgagcactttatgactgatggtttatatcacatatatgtatctttacatgtgtatttactcttatatgtatcttcacaggcatatataaataaatccattaatctttatctgttgcctgctggatattactaagtaatacttcttctattacagtaaatattcttgttgctaaacttcgcaattttattttcccaaaaggtaatggtcatgcctcatcttttctaatctgcatatacttgtactggtgctttttttttttttaaacaatcaaggaccttacacaactatatgcattttgtatagcaaaatgtattgtctgaaacttgtctgtaagttatcatgcagtgattcacattttcctgttgacttacattacaatttgagttttggtctcaggggaaaaaatgacttgaagcaaaatatacctttcctccaaaatcgtacccaaggcttatattatatgtagaattttacatccagacattttttttgcagagtgggtctatggttttcatgagattgccaaagagactcttgatgcagcaatggataagacacatttcctcaaacattagagagagatgttttttgttttcttaacagttcgccaaatatgagtgttaagcttattgagggttttggcttgtctgtatataatcatctttggtattctgacaagaattaaaaaggagcaagtaaaaaatcagtcttactttgttatttatttacaataattgccatatttgttttgcatccagaaaattaggtgcaagtgaaggaaccataaaccaggaaattcaacgttaccaacagttagaatctgtggctgtgaatgacattagaagagatgttcgtaaaaaattacggaggtccagtatgcgggtgagttctcttttttctttcaatgctggtgacaaaaccacctgactttttcctatcatatctactgcgtaccaggtaccatctaaagcacgttacatgtaatcacccattaaatcctaacaacaaacttaggaggtagcttgtgttattttcctattttaacgatgaagaaactgagacacaggtcaagtaatttgaccaaagttatacagctagtaatcctggggaagacaatagtcaaacctaggttgtaggactcgatagtctatgcccttagacactgtgttttgtctgtttttcatgaaatcactcttctttttagtctctaatgtgaactctgcaaaaaatgtgaaaaattttaagatgtctgttcttcacctatcccattctcccaggtcagaatttacctgtcagctactgtgcattgtaatgcactttataatctttattttttgcaggtttagtcggtcccattagagtttgagtctaggagtagaaaactttttttaaaaaccattttgcccttttgttgcttcattttttaaattaaaggtaacttgttaagagttatcgattcacaagtgtacccacctgggcctgctgctttttgttttgtaaagttattaatccagtcctttaataaatgcaggcctatttggattgtctttttcgtctctccattttagaaaattgtatgtttcaaggaatcggtctatttcatctaggtgatcaaatctgtgggcatagatttgttcactgtattcctgtattctttaaatagccatagggtctgttgttgtataccctcctttattgctgatgttagtaatttgtgtctttctttttttcttagttgtcctggctagaggcttatcaattttattgatcttttcaaagaaccagctttggttttgttgatttttctctattgatttcctgtttgttttatttcttctctaatttttattattacttttcttatgcttaatttggatttaatttgcccttttttttctagttttctaagatagaagtttagataattgattttagatcttttctgatgtatgcattcagttctataaattatcctctaagcactgcttttgctgtgtcgcactaattttgataagtgtgttttgattttcttttatattttaaaatttctctttagatttttttcttcaactcatattcaggtatctttctgttgttgatttctggttaaattccactgtggtctaagagcagacattttatgatttataattttttttttttttttttttgacacagagtctcgctctgttgcccagattggagtgaagtggtgtgatcttggtgtactgcaaccaccacctcccgggttcaagcagttctctccctcagcctcccaagtagctgggattacaggcacccaccaccatacctggctaatttttgtatttttagtagagacggggtttcaccatcttggccaggctggtcttgaatgtcttacctcgtgatccacccgccttggcctcccaaaatgctgggattacaggtgtgagccaccatgcctggccatgatttataatttttaaaaatgtgttaagttatgctttttggtccagaatgtcgtctctcttggtgaaagttccacgtgagcttgagaagaatgtgttattatgatgttgttagatgaagttgtctgtaggtgttgattatatccaattgactgatgatatgttgagttcaactatgtccttattgatttttttgtgtgctagatatgtccatttctgataaagggttattgagtctcaaactgtaatagtggattcatctgtttctccttgcatttctcttagtttgggcctcacatagtttgacactcagttgttttgtttttaagaaatagggtttcactctgttgcacaggctggagtgcagtggtgcaatcatagctcattacaacctcaaattcctgggctcaagcaatcctcctgcttcagcctcccaagtagctgggaccacagcacatgacaccatgcctggcaggattttaaaacattttttgtggggacagggtcttgctatgttgcccaggctggtctcaaactcctggcctcaggcaatcctcctgctttcgactctcaaagcactaggattacaggtgtgagccaccatgctcagcccactttgttgttaggcatgtacacattagggattgttatttgttcttgaagactagacccctttatcatttcataatgctcttctttttctttatacctgataattttctttgctttgaaatctgctctgtctgaaattaatatagctatccctgctttcttttaattagtgataggatggtatatttttctcaatctgtatacttttaatctatgtgtctttaaatatatatgcttaaatatgtatatataagtgggtttcttgtagcaacacattgtcagatcttttttaatccactctgacagtctgtcttttaagatcattttacaccactgacatttaaagtgattaatgatagctttgaattaatatctactgtatttgttactattttctactttttgccttttctctttgttcctgtctttgtcttctcgtttttctgccttttgtggttttaattgagccatttatataatctcattttctgttttttcttagcatatcagttacacttctttttttactttttcttttcttttttttttttttttagtggttgccctagagactgcagtctacagattcttctcggcttatgattgggttacatcccaataaacccataagttgaaaagtcaaaatgacttatgatatcttcaacttatgacaggtttatccagcttgaaccccatcataagttgaggactgtactgaatgttacctcttttgtgccatcataaagtcaaaaaatcgtaagtcaaaccattatgagtcaaggaccatctgtacacgtataattaatccaagtctactttcagtaacactataccactttatgggcagtgggagtaccttaaaacaaaataatcataatccctccctcctgtctcttgtatcattactgtcattcatttctcttatatttaagcatatataagcatatacataaatgcgtgtgcacatatatacacacacatatatacacatgcacacacatttatacatacatgtgcacatatacatgcgatttatatatagtcatacattattggtattaaatgtgtgcatgtgtatatatgtgtgtgtatatatacacacactcacacacatgtgatatatatagtcaaatacattattggtattattttgaacaaacttacctgttaggtcgattatgaataagataaaggttttaccttcatttcttctttaatgctcttccttttttaaatagagatctatatcattttccttctctctataaaacttcttttaacattgcttgcaaggcaggtctgctggcaacaaattccctcaatttttgtgtctgagaaagtcttcacttttcaagaataattttgcaaggtatatgattctaggttgttggggttgtttttttcctctcaacactttaaatattttactccactgccttctacctggcatagtttctgaggaaaaagtcaggcttttttcattatcttttttttttttttgtagtttgataatgatataactacatgtaatttttttttttttttttttttttttttttttttttggcatttatcctgcttggtgttctttgagcttcctctatctgtggtttggcatctgacaacaatttgagaaaactctcagtcattattggttcagatatttcttctattcctttctctttctcttttctttctggtattccattacacatacttacacattttgtagttgtcccacagtccttagatatactgttttgttttgtttttttagtctctgttctgcttttcactttttgcagttcctattgatatatcctcaagttcaaatatcctttcctcagccatgtccagtctactaataagttcatcaaagtaattcatttctgtcacagtgtttttgattgctagcatttctttctggttcttagaattgtcatctttcaacttacagtgtccagctgatcttgcatgctgtccactttatctgttagagcccttggcatagtaatcatagttggtttaaatttctagtctgataattccaacatcccttctatgaggttctgatgcttgttctgtctctttagattgtgttttttgctatttgatatgccttgtaattttttattgatagccagacatgatttaccaagtaaaaagagctgctgtaaagaagctttagtgaggtaatgttaaggtgtcagggtaagagaagcattttatcgtcttttaatgagcctatgcctctgaactgtgaacttcatgtttgtcagttttttcctcccaacttagatggaccagtatggatagaactgactgcattggtattgtatttcccttccccaggtcagttatactctgataatattcccactggttaggctctggttagctaatttctcctaagggcattttttcttattcagaaaaagaaagtactcttagtgttttttcaaaatgtttccttttcccttccccgtgttggaagcctaggggacttttctcctgaggggatttttttcccctgacattttctgtgggaacctggtggaactactgaaaggcgatctcacaatattgcaggggcaccggtgactgggtccccctggagtttttaactctcagacttgtctgcactgaaccttccagcaattcttcaattacagttcaggtgttcctaccccagtgttggttcctgcagcagtttttacttgtgcatctctgtcctggtaagctgtaactcactgtatttactggtctctttctccaatgtgaggggcagaagttgtccttccttgtcgcctttcttacagctccaagaacagctgttgattcttaagtttgttcagctttttacttcttgttaggatggaatggtgacttccaaactccttacatgtgaaactgaaaacaaagtctaaaaaccacttaaaaggaaaaaaaaagtaattggttttaaaattttttaaaccaacagagaaccctctttttttttttttttaaccaggatgagatttttaggtggtaccccaacacatgaaaaacatattaaatcagagctgcaggtgtcaaaggaaaggggaaagtttgatgcagggttccaggagctattggcttgacctgcccttccttgatcacttcttaactcccagagaatatagtttgaatactgctctccaatttatttgtcactagtctctgatagtaataatggatagtgagatctgtaacatgtaattttatattttaaatttttgctgtctacacaacagtcatacaatataattaaaatattacttgtgtcctgttacaagtcatatttggtaattgactgttaaaaataaaactagatagaattagggaagttgttaaaacatctgcattcttaacacatctcattccacatattcccctcaattcccattatccatcttagactccaaaactccactgtattaaaatcttttaactatctagcaccatcacgagtttctagaagagggacttagagacagggagagtgttaagtcattaacactcttactttcctttgttgtaatgaagagtcctacaaacgggatgcccttggagaaaagtgatcttttgtctccactgccccgaacttagctttctcccaaaactttaattctcagtttctttctccattcttaattttaaaatcatttcctttcttctcaccatgtttctgtaccctcatccctacccccaaactttctcttttcttcttttttctcaggtcagctggtggctcctgttttcattgcgcctcctaattggtgttagaaccaaagaatagctgattcctcctctattttgactcatattgttaagtaacattaaagtcccctggggaaaacaacttatttaatagtagaatattttcttttatttgaagtcaaatacagtaaataatcacctatagtcacccttttttctctcccattttgttaggctgcttccctaaaggataagtggggtttgagttacaaaccaagttacagccgatcaaaaagcatttctgcttctggaagaccacctcttaagcgaatggaaagggcaaggtaatatatatttcagccattgaaacaagtaataaaattgttgactcttttaccaaggtcaactacttttttatgttctaattataaaattaagataacaaaaattaattttattagtaaaatagcaataacagtggatactatcaaactcagaagtttatttaaggaatctctcatcacatttataaccacaatgcggtaagtgctttttagtaatgaagtacgctgctatttagacaagtttctgttttatttacataaaactgtggtttagaaggatagacaagttttatgcgtaaacttatagattatccaaagaaattaaaaggtgcatactagtagctactgctctagatttgtcagtttagaaaaggtatagtcacacagacatttagcatatgaaaaaatggaaattttacattttattgaagtgaatacagttttaatagtaaatcagcactataacgtaagaagtataaattctttttatatgatttagttttagaaaaatcttgagttaaccaaaacattgactcttttttatgggatgctaaaggttaagagaaagttcaatcctttgattaggtaaatacttacaaataaaatgtcattgccattaatcagacttttataaagtccaggaatttttttaatgagaatattggtgttttataactttatatttacttgcagttctcgagtaggagaaactgaagagctcccagaaatccgtgtggatgcagcatctcctggacctagagtaacttttaatatccaggatacagtaagagatatataatttgttagagatatacattgctaagtagtttttacaaattacaaaattatggtattatactatttcaaaatactgatttcttactataatcaaagtatggattgtgatgactgaactgtgcatattaccaagtagtgggcactgcccttataacattttctgagagccatgaagcaggtgttagtattttacattttacatgcacaataaaggctccataactgctttctcttaagtagaaaggtttttgttgaataatttttctttcaagtgagaatccatattaaactacatcttacacaaatgtaaacgtggaatattgatactcatttatgtattttatttatagatagcagaaattagaaggaagaagatcagcttcaaagttgtattctaatttcatagcatattaaacattatattaaaatgtttattttgttttttgtgtatttacttttaagtcattgttatttttcatgagttttttttttttttacttttctcattattttaattaagttgaaaaatacagtatggggaagtacaccacaatccagctgtcctggggaagggtattttcaggtacttactaagaacaatataaattttgctttaaaactaatcaaccacactgaaaatctactttcaaaatatcttcctctcatttcaaacttaacttagacctcagaaatattttacataatggtttaagactgtttgaatctcataacctcttgcatgcatttgtcttggtttttacttctgtgtagtttaatactattaaagactaaatcagctaatcaaatcaattcaaccaaatcataaaaaaaactacaatttattatttcctaatccctaagtgaagcagtttttccttatattcaactacaaaatgaattttttcataaacaaagatcagttcaaactagaattaaatttaattcagaacaaacattaataattgaacattcttttgagtcactggtgtaaaagaacatttatgaaactatccattttttaaattattctcttgttcaaaacaatgtggaagaatgaatagatcttttttgtcaaggtacatttaaaaattagcacttatccaaatatattttgtttcccttttgtcactctcttcaagcttgagtctcaacatgtatctcatactgaatttagtcaaactggattttttaaagaactatttaattgtaatgtagtgagcttgttctttttttatgaagaaaacttggaaagaaagaatttacacgaatggagtgggttctgctaactagatgattctcaaagggattaatatttgaagtgattcaattcaagtcccattttaaattagccatgtactgcttgtaaaaaaatggtatataaaaaatcatgaattatataatagctatgagattaaatattagatttttctaatcataaattagaaaataattaaagcatggttaaatataaagtaaatatgaaacaaatatttattgtctcttaccaaagttttaaaaattggctgttctaacagtctaatttacttgttaactcagtaacatgtatactatataaaatgaagaacacctggatttgaaattttcaatgtaggacttaactgtatatggaatagcagcatccagtagttttaataacaaattgcacataaattaccttgcacattaaactttataaaggcttattactgctcaagtaactctgtgactctgtgaagctgggcatcaaaattaggtcataggggggtgttttgttttgttttgttttgttttgttttgttttgtttgacctatttaaatgcagtggcctcctggtgaaatcctgagttagtgacatggtgtttatacaaactgtagtcatctctcaatatctgtgggggattggttctaggacccttaccaatatccacaaatactcgagtcccttttataaatggtgcaatatttgcacataacctacatacatcctcccatatacattaaatcatctctagattacttataatgcctagtagtacacttcaaatgctattgtaaacagttgttaaatcttttatatgtattattttttattgtactattatttttatttttcccccaatattttccatctgcacttgattgaatctgtaggtgtttacagagagccggctgtatttaccttaaaatacagcattcttcagtttgattgatacatgttttattactcggctatttgcacatttttctttaactcatgtggggctcatttttaaaagatccacaaaaagcatccacaaaaaagcatctactagcttttaaaagatccacaaaaagcatctactagcatttaaaagatccacaaaaagcatctactagcatgatgagaaaacaataaactttgtactgatactgcatgctcttccatcactaattgctcttgccattctgatttaatcatgtttcttttgcttccacatgtttaacttctgctttaaagaattacagtgttattgatacagtaatatatgtttatattaagtaaaatttcattctgatttttagtatgtcagtagtgtaactttctgtggttggcccttttgcttccttccttggtgtactatttcatatgttcatgaatctgacctttctttcagttcagagtgaagaaattcaactctgagataatttttaaatgtttaaatttatatattttttctttttttaattgaaatatgaatctgattcatgttttttctttttacaatcagtttccagaggagacagaactggaccttttgtcagtaaccattgaaggtccatcccattattcatcaaatagtgaaggatcatgttctgtgttcagttctcccaaaactccaggaggcttttcaccaggcattcctttccaaactgaagagggccgacgggatgacagtttgtcttctaccagtgaagattccgagaaggatgaaaaagatgaagaccatgagagggaaaggttttatatttacaggaaaccctcgtgagtaaccttattttaagatcataatgtagtatttcagaatctagaaatgagcacaaaatgttatatataactcagcttttacaaaaaacatttttaatgtgcctcgcttgagtgagactaacagactcattaaaataaaatttattttaataaaatttatcacatggtttattgtgatgtagctccatataacattattttttaaatttaaatttttttttcatgtcacctaagtttaattatctaaaataaaatggaaataaagatgtggttacgagtaaattaaaggagagggctgtattcctgtggcattacattaacagattgcagcaaggagatatgtaatagtgaaggctagttaagaaaagtagtaaagggaaatggttagcaatggatgaaagacttaagcaaattcttagaagaaagaaataacatgaaatggtgttaatgaaataaatgacatatgtgaaactttgctctgaatatgccctcaagaggagcggcaaggatctttggaactggtctatttaaaccgccctcaagtgaggttgtgacaataatagtaagagtttctaataatggtaataaataatgagaaattggcttagcacaagagtgtaaccaaaagctgatctataagaaactctctgtcttcaatcttctacattttgagttttagggattctttcctccctttcctagactgaagccactgactgctgaatcccatacatcagcatatttggttttattccttcatttttctggagtacattctcaaataacttactatgaaaagttattattgcagatctacttcattttcttcatgtctaaagtagctttactatttttgtgtttattattgagttgggaacagaattctagtctaatatgtatttcttctcctaagtaagaaaaactgttctgttatcttccagcatccatattcggcatatgctggttatctttttcagttctgtcaatgtgacttaagtttttttgatattttatatctgttttcttcctggacatttttagaatcttgtcattatatttaatttcatggtggtccaagtttgcgtcttttctaacaatttttctaggtattttggtatttcttagaatataaatttggttataggaaatattactttatagttgtgtggataaattcttcccttttttttttgttttgtcttaacagtaatcggacatttgccttcctggacagatgatctatatctctttactttttatgttttacgttgccttcgtaaaaactattttgtcagttttattgagatataatttacattagtgtaaccatattttccagatatacaatttgataagttctttaaatattttattttggtaagatcacttagcatgagatctaccctcttaacacctttttaagtgtgccatacaatagtgttatctgtaggcacaatctctagaacttattaatcttgcgtaactaaaactttatacatgattgattagcaacggccaacctcccccagacccttaacccctgacaaccaccattctattctctacttctatgagttggacaattttagatacctcatgtaagtggaatcatgcagtatttgtccttctgtatctggcatacttcatgtagcataatgtcctcaagttcatacatgttgtcacatagtgcagcatttccgtcttttttttaaggctgataaaattccattgtatgtatgcaccacattttttaattcatttgtctgtcaatggacattttaggttgtttctacatcttggctgttgtgaaaaatgctgcagtgaacttgggagtgctaatatctctttgagatcccgatttcaattcttttggataaatacccagaagtgggatctctggatcatgttgtagttctactgtaatctcttgaggaatctccatactattttccctagcagctgctctgttttgcattcctaccaaaatatgcaaggattctgttttctccatgtccttgccaacacacttgtttttgctttttgtttaaataatagtcatgttaccaggtatgaagtcatatttcattgtggttttggtttgcatttccttgatgactggtaatattgaacaccttttcaatatacttgttggctgattctttggagaaatgtgtacttaagttcttagccaattattaaaatcggatttttctggtttctgaatgctaggattttgttacatactttgggaattactcccttgtcagatatatggttacaaatattttctcccattccatgggttgccttttcaccctattgtttccattgctttgcagaagcttttttagtttgatgttgtcccacttgtctttttttacttttgttgtctgtgcttttggtgtcaggaaatcattgccaagaccagtgttatgaagccttttccctatgttttcttctaagagtttaacagtttcaggtgttaagtctttaatccattttgagttgatttttttgtatggtataacataagggttcaatttcattttttttgatgtggatatccagtttttccggcaccatttgttaaagatcacatggcattatttttctttccttgttgttctgtctttaataaaatctggaaagtaacatttaaatgttataatttgagaaaatgaaatattttccaacatacacagtatattttatatactgatattcagactccttaaaagtggtgattatgtctgtgtcctcatcacctagcaaatagcctggcatataatagttattcagtacatagtagctgaataaagtgtggctccattaaactcactcatgtgaatttacaaaatagtaaaatttatttacagactgttgctcacataacatgttggaaaatagtttgttaaaaagaactctcattttactacaatgtaatgatcaattgttctttctgtagacatacgtctcgtaaaaaagcaacaggctttgctgctgttcatcagctatttacagaacgctggccaacaacaccagtcaatagaagtcttagtggcacagctacagagagaaatattgactttgaacttgatatacgggttgaaattgatagtggaaaatgtgtactccacccaaccacccttctacaagaacatgatgatataagtttgagaaggtaagaaattgattggaaaaggatacatgaaactttatctattagaaatactattcatatatcactgaattataacaaacttctccatcccaaaatgcagatttgaagtgtaaatgtaattatagttataatggtcaagtgtatatttcttatacagtttcttataaacaagtgcataatattttctggcaactagaaatggatgtctgacttagatttttgcaagttttttaattaaaatagttatatctttggaattcttttaacacacatgaatttctcagtgtctgtccctgtattatacatatttcagttttaaagaacaacacaatgctcagaagtatcttggttattgagagtttgataagttcataaagaaataagaaagactgggagacagttacacagacctcagtagactgaaattgtgttcaggatataactgcagctttactatttgtttacatcactaactaaatgatgatataaacaggattaacatttttttctttaaattttgttttccttttctaatctaaaaatgaactgtaaaaaaaatagttataattgagcggatgggtggagatgtagataaaaagaatgctgacaattattgaaactgggtagtgggaacatggaggatcattaatgatactattctgattattttttatacattcaaagatttccataataaaatatttaattgaggcttttataaaatatgagaaaataaaaaaggtactataaacagttaaaatgtcttacaaatgtagtagtgatgataaaaaggatgactattagtttatttttgattgaaacataacccataataaattgctaatatttagctgtatttttactatataaagggcagtttcatttggttcaacctaatatattcaaatgaaagtcacgaccttaggaaagaataaaggtaactgccctgtatagttacggaacatacaacatttacatcactcatgcaaggcattaaccagtctcgctagagatactgatgaactttacttttttcaacttcttaaatgaaggattgtattccatttactgtaaaaataaaagtttgcttttttttttttttttattatactctaagttttagggtacatgtgcacattgtgcaggttagttacatatgtatacatgtgccatgctggtgtgctgcacccactaactcgtcatctagcattaggtatatctcccaatgctatccctcccccctccccccaccccccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggatatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatactcatttgggtatatacccagtaatgggatggctgggtcaaatggtatttctagttctagatccctgaggaatcgccacactgacttccacaatggttgaactagtttacagtcccaccaacagtgtaaaagtgttcctatttctccgcatcctctccagcacctgttgtttcctgactttttaatgattgccattctaactggtgtgagatgatatctcatagtggttttgatttgcatttctctgatggccagtgatgatgagcatttcttcatgtgttttttggctgcataaatgtcttcttttgagaagtgtctgttcatgtcctttgcccactttttgatggggttgtttgtttttttcttgtaaatttgtttgagttcattgtagattctggatattagccctttgtcagatgagtaggttgcgaaaagtttgcttttaaacaaaaagataaatgtgtcattttttaaaaagataagaacatttttctgttcacaggagttatgatcgaagttccaggagcttagatcaagattcaccttcaaaaaagaagaagtttcaaactaattatgcttctaccacccatttaatgaccggcaagaaagtgccatcatctctacagacaaagcctagtgacttagaaacaacagtattttacattcccggagttgatgtaaaggtaaaaacccaattgcctagggtaagggattagactattggtagcaatgtttattttctatcatatatgttcatctttttctcattatattaaaatgagacttagtgacttctttgtctaatatagccatattctggacagaagaacatcaaaactgcaggttcccacttcatttatgtagcattttccatgaaagtttgatggaaagaagttcggttttttaataaattgatattcgtaacaaacttgctaaaccttgctagtgcaacttcattaaacaacagttttttagattctggaattatagaatcatagactattcagttcgaaaggacattaaagattatctgaaatgacctttttattttaaaaaatgaataaaagcaaagaaacttgccaggatcacaaagctaacttttaaaagttaaaacagtcttctgacttccaatgttctttctaccacatttttctatatttcttgattttcctcatcttcataattttaattttaaaagtttatttatttcaatacagttgcattacaattccaagacgctaaagactgaatcacctaatgcctccaggggatcttccttgccaagaacactgtccaaagagtccaagctgtatggtatgaaagatagtgcaacatctcctccttctcctcctttaccttccactgtccagagcaagactaacaccttacttcctccccagcccccacctattcctgcaggtatttaaggagtatatactttattttttgtcattttaaaaatttttagttattacctacttgctcttttgagactttccaatgcacatgtttaagaaaaaaggacatacatttgtcaataatgactctacagacttcatatatggaagtgtgggccaaccattttcacctgtttttgaaattgacattactttagaatatctgttataaaataaataatataccaaatagtttacgtaattaaatttttaggtctgtatatataaaaagagtagttttatgtagctcaaatttgggagcttatgagcagatggaaatatcaaacttgagagtacattgggtttaaccacatttattacttctctgttgtataacacattacccagaatttagtggcttacaacctcaaccacaggttctgctgatcagaaatgtaggcacagtttggctcagtggatctaacttatggtcttttacaagattgcagtcatggcagatttttcagccccagtcaagtattcagatgacaatacttgactggggctgaaacatctgcctccatcatgtctcagtcatgtgactggctaattggtacttcccttcctctcatgtgggcttctctactgggcttcttgagtgttctcatgatatggcagttgacttcccttaaaaggagtgatccaaaagataccatggctgaagctgcattatctcttatggcttagccttagaagtcacacaccatcactgccacaaggttttactcatcacacaggtcagtacggaagtaaactacacaagggcatgaataccaggaggcaaggatcattgaatgtcatcttggaatctggctaccatagcacatgaatgataccgtacatacatggcaggatttccaaaaaaaggaatatcagactagacaagaattatttgagaaagtttcatttgggagacaaaacttgatatataaaccttttaaaatagtaatcatgctgagaatgcctagtatcacttttcagctaacaaggcacatctgtgtccattaagtgcatggcagctattaaccccttttataaaggaaagttaaggctcatagaagttggatgtctttcctggatttgaacaactaataaatgttaaaagttggaaaccttagccaaagctaactaagtcttagatgttttactcattctcctgaagcagatatatttagttaggtaaaaggaaagagaaatggcatcccatgtagggaagcattataaatacatgcaagctaagcacaggaaagcctgaaaacagtgacgtttttcttcacttgccactaaatattgttaaagttctctatatcttcttaaatggacaaaaggactaatgctaatgagagtctaaccaaaatataaagctgaaaaactggaccaaaacttgtgacgcagagcaagtaggaataaccaacttattatatgttattaatcgcctctgtattctaacattaacatatcattcctatcaacctgctacttttattattttcttgtaaggccttaaatgtgaggtactttgcttgattaaactttaatataattcaaatttctgtttaattggaactttttataaaatccattaaatggaatttataaatgttctagccaaaggaaaaggaagtggaggagtaaaaacagccaagttatatgcctgggtagcacttcagtcattgccagaagaaatggttattagtccctgcctattagactttctggaaaaagctctggaaactatcccaattacaccagttgaaaggaattatacaggtaagcatccttcttatatacctccccataacatatattttgggatcttattatatagaaggttttcttaatgctattatacattattacataatatatgcaattataaatgttaaagaattataaactgtaaaagaacttgagagatcatctaattgtcatttacaaatgaagaaactaagtcctggtgaggttacataactttcccatggccccacctagttaatgacaaaattaacataagttctacatccttagtgtgtcccttggactggaatctctttgagggcaaggatataatcactagtttctttgtacagtgtttggtatagcagcaggaaaatttgagtttgggggaatgagcaagaggtgcgaacagggaaaaacgtatagaatgaagggctacagaagcaaatgtttccgggtgttcatacctttcatctcactctagtataaacaataaggatcttttaataaatagtttgcctttgatctaataataaaacttaaccaaatattttaaacagctgtcagctcacaagatgaagatatgggacattttgaaataccagatcctatggaagaatcaacaacatcactagtgtcgtcttcaacatctgcttactcttccttccctgtagatgttgtggtttatgtacgagttcaggtgacatacttcatttctttctttttgttttaaagagaaatgtttttcttaagtttatttgaacatttcaacattattactgtttaaaagttttcttaacctcaggttcatgaacctttagtatgtttgtgatggcttggaggttgccagaatatgtgtgaagtatgtgtaaaattttatgtatatacagatgctcaagttatgatgctgttctgattaacccatcacaaactgaatagcgtaagtcagtaatgcatttaatacacttaacttactgaacatcatagcttaaactagcttaccttaaatgtgctcagaacacattactcttcagttgggtaaaaccgtctaatacaaagccttttttataataaaatattgaatatctcatgtaatttattgaatgttgtactgaaagtgaaatgcagaatggttgtatgggtcctcaaagtacagtttctactgaatgtgtatcactttcgcccagcctaaattggagatcatctatattcacttttctaccaagaagtttcatagatctttgggttttcaaaaattaaagctcatacttctgtgacaaaaataaaaatatttaagttaaaacccttttttaagcattttatgcctttattttggcaccttaatttcttgccattatagttctttctgggcagatataaagtgtaattgagatataaagtcacaatagtacctttgttcaaatttttgctaagtgttacctagtttttatttaatattttattctaaaatgcagtcctaccaataggcctttgggagtatatattagcatatatactataccaaatatattagtatatattatatataataaaatatatattagcatatatactatacaaaatatagtacatatttaattaaatctgtttatcaaggaggatttaaaactacttgtatcaaaacttcagggtttagttgatcctcaattaaaatctaataatcttaagagtaaggaaacactaatggtcatctgttccaactatcttctataacagtaatgtggccaaaagagcttcagtcttacattccagaatttttagctagcttttttaaaggtctgatgaaaacagaatgaatgagggtttgagggttataaaacctttgggctgggtgcagtggctcacacctgtaatcacagcactttgggaggctgaggcgggtagatcacttgagcctggtagatcacttgagcccaggagtttgagaccagcctgggcaacacatggagaccccatctctaccaaaaaaaaataaaataaaattagcgaggcgtgattgtatgtatctgtggtcctagcaacttgggaggctgagatgggaagatggcttgagactggtaggttcaaaggctgcagtgagccataattgtaccactgcagtccagcctggacaacagagtggtctctaaaaaaacagagtgtctctaaaaaaacaaaaaccaacctttgttaattatgaacaagtttaatatgagcataaatttttttaaggttctgaactatctaaatatctaaatacagtccctccgtgtacttaggagactggctgtaggactacccctgccccctaccatgtataccgaaatccacacatactcaagtaccgcagtcagccctgaggaattactaaaaaaagagacacccctctgtatatgcgggtttttcatcccaaatactgtattttcaatccatgtttggcggaaaaaaattcatatgttaattggaccagcacagttcaaacctgtggtgttcaagggtcaactgtcttattgttctgagatggctcctcaaatatttaggtttttaaaaatgatagcattttgtttatacattttgatttttatatcatgcttctgtttaaaaagctaggacaatgaacacaaaatcttaagtatcaaatgagtaaacatgatcaatatatgtagacagaaatggaaattaaatgtaacttttgaaatccaaggtgaaatttcttaactttcctgtagatgttgtggtttatgtatgagttcaggtgatatactttatttctttctgtttaaaaaaaatgtttcttaagtttatttgaacatttcaatattatttctatttaaaacttttcttttatccagttcctagaaaccttttgctgtctgttatttttagccctcacagatcaaatttagctgtttaccagtatcaagagtagaatgcatgttaaagctgccatccctggatttggtgttttcttcaaaccgaggagaactggagactttagggactacatatcctgcagagactttatcccctggaggtaatgctactcagagtggaacaaagacttctgctagcaaaactggaataccaggtatagataatgttcttttattcctctagtataaagccaaatactatttttaaatcaatattttaatagtaattaatacatattttaaaatatatttggaaaaggggaatatttgaggattatttatagaaagaaatctatagcagaccaatgttttgagtatatttcatgtgttatttgaacttgagttaccctttggtttctatttttagctgaatggcaattagacagcattttgaatatggcttgaatgtacatactacaagcgctatgacataactactatataataatccacatgttcaagtacttttgaatatcttttatcttaagctacatttgacattaaggagtaatcagtattataaatggaaaataagaaacatagtgttaccttacagggatttcttatcacactgggtgaaaactgtatcaagtagcagtagcatatgtatttttaaatggcaaatttggttatacaactcaaatatgtgtttcataaaggttttgtttttaaaatataattgatttcctgagatgataggcattcctcactatgttaaagctgggtgccacttctgtcctaaaaatgaaatagagatcacacatgcaaatggtaaaaattttattgaatacctctgaaaaaaagagactagactgaatgaaaactgataagaagactggaatgtcattaaaatattggttcttaaccaggagctatcttgttggcaatattaggagacaattttgatagtcgtaactgagggtgtacagctggcagctagaagagaaaccagagatgctgctaaacattctatagtatatatgacaaccccctccactcccaaataattatctggttgaaaatgtcaataatggcaaggctgagaaggtttgcattaagcgtgaaaaaaataaaatcccaaattccatttttgagagaggcatgaagacagtggagggggaaatacctttctgatttgtaaggaaatacagcttaggttttgggtcctatttttagagagtcatcttagattcaaatctttattctaacaatctcatcaagcatcagttggaaaaattattacaaactggcttgtgagaaagcatcccaaaagtcatctttgaaaaactgaaattatatctcttaacacagtatttacttgtattaatggggaaatggttataggaaatcatttgttttgctgtgtgaatctttgaaagttttcacaacaaaattggaaaacaaaaaggctgataccttagaaataaagcttttgctaatgtggtcacccattatctagtacttagcttcaaaatattgctgttggagttgtgttgtcaacaaaatattgtagtggtagtgttggtttttgaaaaacattttctgattataaaagttacactcactattcattatagaaaatgaaaagtactaaaggtgaaatgaaaatgagaatatccctttatcctagataactagtgttgtcagcgataacactacaacatttctgtagtgataccatatttttccaaggcaaaaattgaaatatggcctcttctgctatgtaactttttaaaatttaaagtatcataggtattttcctaaattattaaatattcatctctaaaattaatggctataagatattccattgtttggatcatatacttgagattctgtgggttattttgctttcaaaataatactaaaatcaacatctttgtatgtaaatatttttaaacaaagatatattcttaggagaaattcttaaaagtggaatttctaggttaggaagtatgaacattttgaaagtgtttgatacatttgctttctggtaagactgtaagatttctacactctcatcacagtgtgtatggacaccagctcactgtattcttcccaacactgctttaaatttaattttaatcattgtcaatgtgatggattaaatttggattttattattttaatctgtactctattactttattagctatttcttgggagtggtaaatatatgcccatgcccatttctcttttggaatgttaatcttttaatgacaaactgtcataatgtcataaattattagcacttaaattaatatagcagtatatatgcaccatgctaggaataggtagtgaaaggaatatgaaatgagaaattttttatgcccaaattttatgattccttagaaaacaacataaatgaatagcacccctcattttatcattatttattcaaggaatgatgataagaatatataggttgcgacaatatccattctttcaaaggatctttactttgtggtctgggtcagtgctagggcatagtaatagtgaacttagctagtagatgtggtccatacttactaatgtggagcctaaactgaatttggagaaacaagtaatagcccagcaaacaagtttattttaaatggaaacgtgaagtaagtatgggttagcgaagcagagaactgggggaatggacactcccaggagagaatacaaaatgcacgaagaagaaacagtttgtcaactctgaataacaaaaaggaaaaaaaagccattgttaagtgtggagactggcataagaaaggtttagagagataggaaagagccaactcatgtgggaaagccactgaaaggttaagcaagggagtggatatgattcacacacatacttttagaataccagtccagctgcagtgtggcagttgattggagtagcatgaggcaaggagagccatttctgcagtccaggcagagttaataattgcttaagctagaatggcagcagtgagatggaaggaaatggacagactttatatgcctgagatatagaaatgatgaatgataaattgcatgacagagtcaggagcaggaaggatgacggataactcccaggttttggttgagctattttctttttatttatttatttatttatttatttatttttttgagactaagtctcactctgttgtccaggctggagtgtagtggcgccatctcagctcactgcagcctctgcctcctgggttcaagcaattctcctgcctcagcctcctgagtagctgggattacaggtgcgtgccaccacgcccggctagtttttgtacttttagtagagatggggtttcaccacattggtcaggctggtctcaaactcctgacctcgtgatctgcccacttcggcctcccagagtgctgggattataggcatgagccactgtgcccagcctggttgagctgttttcatggaagtattcatttactggagatggggaccactggaagaaaaacaaattcaaggaaaaagatcaagagtgcagttcagtttaaatgcctgtgacccattctaataggaggtcaagtaggcagttgtaatatataaatccaaaggaggtctggtctggacatacattttggaatcaccagcaaaatcatttaataatctattcaaatggtctcatattttttatgtttttggaatttacctgtccatccctagtaaatgttaccaacaaggacacttggctctctaacagatttttttactttctgcttttgcataccttgccctgtttccactgcacctactgaaatgtggactccaagtatatgatatggatttttttacagtatgttctcccccactttgcttaagccctagctattttgggcctcttccactgcctgcttctagtagtgaaggagaaaagaaataggaaaccatgcagtaggccaaacatatatataaaaataattgttttaaggatgaacagagtattcaaccctggtgtaaattaattggaaaatacatctaagtctttatttcagttttaaggatttaaatctattgatctgttaaatctattgatctgatgtttgagtgtttccattttattctgaagtcatgtctggttcttaagaacatattattgactggcctttttttcttgtagcttatattttcaatttcctgtgctcactgtaggttcatcgggattaggcagccctcttggccgaagtcgacatagtagtagtcagtcagacctgaccagttccagcagtagttcatctggcttgagcttcactgcatgcatgtctgacttttccctttatgtatttcatccatatggagcagggaaacaaaaaactgctgtttctggcctcacacctggatcaggaggattaggtatactttgcatgtttatgtctttttcagatttacagcatcttttcaagctttcaagctttattttcataaatcataaggacatagccaagatcagatgctttttgtatttttcctctttgataatacctatctcatatttacgtaataagtagacatatacaataagtaattcaggtgaattaattatacaagaattttaaaattcagaatattttctaagcggtatacacagcacagtaatctctggatatcagagattacttatgttattgaaatatttaaatgtcttagcaaatcactgtccatttatacaacaaactacgtagaaagtaaaattttaaagtgcatgggtcacaattgttaatttaaaaagagactataatttaagtcagccatttcgtgaaattaaatttcattgtcactttgaagagcagataaaacactgcaaatgcataaaagcttcttattagtaactaactcttgacttgtatttaaataaatgatgaaaacatatattccacgtcaattctagtttctattgttggagaagggttgtaaaaatcaccaattatgtttgtgggtttgaacctcttaaattgttgttagaaatgctaatgctcattagatccctctgcttaaatttttacctcaagtgattttaattcatggcatattacagtatattagataattttcacctaactagacagctgtgtgtatatatgtatatatagatgtgggggttgtgtttgtttgtttgttttaaagggaatgtggatgaggagcccacttcagtcactggtcgaaaagattcactcagtataaaccttgagtttgtaaaagtgagtttgtcacggatcaggcgttcaggaggtgcctcattttttgaaagtcagtctgtaagcaagtctgcaagcaaaatggatactacgttaataaatatatctggtactcaattttatagtttttaaattaaaatactgttttccaaaattaaataatggcctctgttttaatagtgtttaaatattaagtcacttaatgttaagctttcagtgataagttgatataaaggagaggaatgcccagcctacggtactgtgtcaatccaagtaataaatgttaggaatataatttctagataaatagacatatcacccaagggccaagtatgcctaattaaatcagtaaaagttgcttcttttcttcactttttctccaccatgaattggtacagtttctttttgttcttctaattgtaaatgcttaaaacactaaaacgggatgagtgatgtttaaaaatgtttacttgatgtcagaaaaccttgaattgtgtgcatgtatactgctggttttataaacatctatataactatgggcaagtcatttcctttacattgcgatttgagtgtttaaaagtaaatgcaaatagacattctgaagaatccagaatactgagtaaaaactttcataattatgaatcaaataaatatggtatgttcacttaacccaatattctgaaaatatatattaagcctgtgttttagggtaaacttttacctgagattgctaggtgattgaggggagcaggcatgaataagacaaggtcttatgtgtagacaaataaatgagtccaggataataaatgctataatggagctttctacaaagagaaggaaacaataaattctgtcttgtatgagaaatcagaaaaggcttcacataggaaatgttatttggcccacattttgaaaaatgagtaggaatattcttggaggtagcaacatggtattcaatggcacagaagcatcaaaatgtatgcttctggatcatactttgatttgctgtggctgaagcacagggtataagtgaacatttaattggttggagccaattaaatgttgaacatttaattggtttaagtggatggagccagaaatagagaggctagaggtaaagctgataaaataggacctgattgtggagggactcatatcatatgccatgataaagaattgggttctgattatttcggcactgagaagccattagaagttaagaaatgggttgatgcttcagaatggtgttttagaaagagagttgagggtagcctgaaagacaggaaagaaaagatgcttgaggaggctgctgaagtagaccatgcaatagtagatgagagcatgaactgtggcagtaaaaaaaggagaaaagggaatgaggagtgggttcaagagagatagaagagaatccataaacttaagtataagttgtattaggggcaacagaggagacaagaatgcctcaaacttttagcttagatgactgaaggagcagtgaagccattaacttagaaaataaagaaggaaatgtctataggacatttaggtggaaggttctggtagacaactgacttagcgggtatcgctatgtaggtatgggctcagacaaaaacagaaattttagctgtgggagtcattggcatgtaaaccctatagaaactatggtagaagaatagaagagcacatacaacaggagtagaagaatgctccagagcagaactctggaagaaggccatcaaaatgttttttgtctaaagtcactgctattagtctgataggaaaatagtagtccctgccacacagctatttggtttacaattccttttgagaaaatttgtataccagctcatcctgatgattcattttccataatagaaaagactgctgtgttaaaattgaaagctggctatcagactgatctttagaacttctctgaggatttcatgataaagtgataatagaattccaacttgccatcacctcaaaaaagggaagtggtactaacagtgttagaatgtgctgtttttgtaatttgtggaagaatgtaacactaatcataatatgtaacttaagtataattcagctgtgtaataaccctgtcttatacctaccatgtgaaaacattaaaggttttagaaatctgtactaacaaatgttatttatgtatcagctgtttgtgatatagggtctgcctcctttaaatatgatatgcgccgactcagtgaaattctggcatttccaagagcatggtatagaagaagtattgcaagacgtctattccttggagaccaaactataaatttgccaagtaagcttgttatgtaattttaattttggttactgtagcagcaagacctacaattgataacacaaacgtgatcttacttggcagggtgtaccatgtgatgcgttcagtcattcaagaaatgtccattgggcccctctaatatgccaaccacaagggatatattagcactgaggatatatcagagaaccaaaaagacaaaaagttttgtcttctttgagattacattctggctgaataaatatagtttattctataactatcctaacaaattagtaaatttataagttagttaatttgttagtaaatttattctataatgattactctgtaatccttttaaatatccaagttaatcatggttagcgaagcatgggaaacagaagatgctggggacatgttactagcttgcctgcatttgtctgctggatttagatattgttgtaggtaatgaaatcaagagatttttggaaatgaaaactagagtcagttacatagaggtaaatttgagaaaccctaagtctgagtgtattccctcacctgtaaactgagaccagaggtcctgttttgctcttttcatggagtttaaacaaaacactggcatgttctttgcaaactgtaaattgctgtacagctgctaaatagagaactagaaggaatatgtaatgtgattagaaatgatggatgggtgaacttattttataacatagggattttaccctgttactttggattttttgtttgttttgtttgttttctactagcatctggcccagggacacctgattccattgaaggggtaagccaacacctttcccctgaatcatcaagaaaagcttactgcaagacctgggagcagccaagtcagtcagcctccttcacccacatgcctcagtcacctaatgtgttcaatgagcatatgacaaacagcaccatgtcaccagggacagtaggacagagcctaaaatccccagcttccataagatcaaggagtgtatctgattcttcagttcctcgaagaggtaacactgctctttttgttatcagtagccctacagtgttctcaggataaaatcttagttactctcagatttcagccctaactataggaaaataaattcttgaggtttttatgacacgtcaaaaaaaaaaaaaaaaatccccaacacagtaaaaacaacaaaacaaatatttcaaagtattgccatcaagacagctagatggccagtagctttacaaatagataaggggagaggaattagcatattgtttgtgtgctccatatgggcttggccttgtacttgtgcctgattgtataaaaatgaatgatgtagttctcgtcaaaagattaaaatataatgagcaaatgcaggattcaagatatatactaagtccataagaacacaaaagacaggcaccccaaccggcatctgcatttcagaatggtttctgcctttgagtcctgtatttggcaacagcaccttatgattttcttctttgttaaacagaatcctagggtgatgcatgatctgtgctgctatatcccatgcacaccagaatttcctcatataaaatgggggccatacataattttatgagctttcaagaggtaaagctgccagcacttataaacatttagtaagtggtaactattattttagaggcaataggataaccattaaacattagattctaatacaagaatattatatttttactttttggattatagcaataaaaatagtttttgctttgtaactagcttggcatttatgtgaatgaacatgtatttgatttttctatttttagattcactttcaaaaacatcaactccttttaacaaatcaaacaaagcagcaagccaacaagggaccccatgggaaacacttgtcgtgtttgctatcaacttgaagcaattaaacgttcaaatgaatatgagtaatgtaatgggaaatacaacgtaagctattcagatacaaaggaaatgtatttaatcatttttgtaacttttcttctactgtagtaaagatattcagaaccttttttgaatgctaaatatttgaaaaagaagtagataaacgatataaaatgttttatcctgaaaatggcttaattctaaggatactgcaatataaaacatcatgaaatatatgttctataaaaagggaatcaattataaggagaacagggtaattttctagcttttctagctaggagtaaagcttcattatcaatgttaatattcaaatatttaccacacagtttttatataaagtatgttgtttcattgtcaaacttgaccttttaaataatctgatttaactcctttttaatttaaatcctgttttaattcatgacactggaagctatatatataataacctttttttcattttttagttggacaactagtggtttgaagagccagggccgtctgtcagtaggaagtaatcgtgatcgagagatcagcatgtctgttggtctgggaagatcacaattagattctaaaggaggagtagttggagggaccatagatgtcaatgctttggagatggttggtatgttgaaattttaaaactgacctaacatatccttaagatatatatatcaaaaaaaatgcttttggagatggattctcatgagtttttcccatggacatgtctgtcaaaattaattattgtttctattttagctcatatttctgaacatccaaatcagcaacccagtcacaaaattcagattactatgggttctactgaagctcgtgttgattacatgggctcaagtatcctcatgggcatcttcagtaatgctgatcttaagcttcaggatgaatggaaagtaaacttgtataatacattggattcaagcataactgataaaaggtatttattaaggattactttttggacactttacatgactgttctcaacatattgtctatcatctggtgagaaaacagcaatttttcttacaaaactcttatttattatgcaattaatacaaattaaaaagctgggcgggggaagaaaatgtttcttgtactttttgagtatctgctgtaagacatctgacaaagattttgttttatgctctagtgagattttcgtccatggagatttgaagtgggatattttccaagtaatgatatcaaggtcaaccacaccagatctgataaaaataggaatgaagctccaggaatttttcacacaacaatttgataccagcaaacgagctctgtctacctggggaccagttccttaccttccgccaaagacaatgactagcaacctagaaaaaagttcacaagaacaatgtaagaattagaagtaagcttttatatatgctttatctttcactaaatatgttacatttttaatttaaaataataataatctgtatgccccacttagaaaatagcccacaggctctttatctcactcagttagcaaaggaccagaatttctacctgccaatggaattagaggccatcatttaggaagacatcatttgttatctcttccccctgctgcagtgcatctgcatccatacccactccacgctcttgaatagtgtttatgagaatatcatgttctggtttagaatgtctgtggagtcagaatatctgaatttggatttattaggtgataagcaggtcattattttcacttagcaattcaattggcaaatatttattaagctacaaccatgtgcttaggcactattctaggcacaggagatctagtggtggacagaatcactaccctcatgaagctcagattctaatgggagagaaagaccataataaatttactaactaaatatataagataatttcagtaagagagaagtgctaagcaaaagaacaaaacgggaagaatatagagaatgattaaatgtgaggatagctattttagaaagggtgatcatttaggccttttctgaagtgacattttagtggaaatgtgaatgaaagaacaaggctaagatgtgggggaagagagttccaggcatcgggggatactgagtccaaagttcccctagtaggaacaaacttggcttgaggatcattaaggttgccactgtggctggaacagaaatgagcaaggacgaaaatgccggacatgaattcacagaggtctactacaggtaagatttttaatatgatggttagctatcagagagttttaaacagatttgatatcggatttatcttttcaaaaaatactcccttttaaagttcactctggctactgtgtgaagaacagactataggcagttaagaatggaaggaaaccattgcaataattaccattatcattgttatgtacatagttacatcattattgtaaggaagccattgcaagagtccaggcaagaaatggtggctttcactaggatgatagaggtgtaagtggtgagaaacagtcagaatgaggatagctttttaataactttattatcacagaagtaatacgtatacattgaaaaaaactagaaaacacaagagaagcaaaaaataaaaccatcacattccactcagaaatcactgtgaacaccttagagcatacacctccagatatttttctgtgtatctgtatatatgcgtacattttaagaaaatatcaaaattcataccattttgtaggtcaacaatctccaactttccattttgctaattatctcctttagctttcaaaacacattcaaatttccatgattgatctaaaaatgtcctctataatggttttgtccaaaccagtttatccaatccaaagtcacaggttaaatatggttatgttcctttgccttcttttaatttagcacagttcattttttatatgaactgacttattgaagagatgtagccaactgtcctaaagaattccctaccttctagatctttttcagttacttctttgtggtgtcatttatgtttttcctgtagtccatgtatttcctttaaactagaatttatattaggcatataaaaattgagggatgttctgcaaaatgcctggcctggattcttcaaaaaaactcctcgtcacaaaaaacaaacataaaggcttagggaattgtttaaaggaaaacataataaatgaatacaattcatgatctttggttggattatgggtgagaggtatggaaaacagccaaaaggaacattattggaataaatggaaaataaacgttgtatgtttgattagtgcttctcaaacttaacatgcatctgaaacccctggagatgttattaaaataaagattttgatatagtaggtacaggtgggcttaagagtcggcatttctcacaagctcccaggcaatgctgattctgctggccctctgacctttgagtagcaaaggaatatgagtttaaaagcagtacttaaaataagggggtctgcatttgatttctaggtcttccagttactggttcacttaacctctttgttcttctgcttattcacttgaaatcagtcaagatgaaatatctagtttacaaagttataatgagaattgagaattacataaaattccatgcaagtactttgtaactcattaatcattacagacatattaggttttggtttttcttttttttttttttttttttttgagacaggttctcactctgtcatccaggctggagtgcagtggcacgatctcagctcactacaacctctgcctcctgggttcaagcaattctcctgccttaacctcccaagtagctgggactacaggcgtgctccaccgcacccagctaattttggtatttttagtagagacagggtttcaccatgttggccaggctggtctcgaactcctgacctcaaatgatccacccgctacggcttccaaaagtgctgggtttacaggcgtgagccacagcacccagcctcagacatattagttttaattatttttagcaagttactactttccttagctatatccatcctcatgcagcatcttttcctagaatgtctctttattagctattgcttaatgtttaacaggcactggacactgttttcatccctcacctgagactgtagaaagtagccacttgctgcctcactctaccctatccaagggtactcattaggcacttcaggatatgtgttttttggttttcttgcagtacttgatgcagcacatcatcgacactggcctggagtattgaaggtggtatcaggatgccacatatccttatttcagattccattaccagaagatggaatgcaatttggaggatcaatgagcttacatggaaatcatatgacactggcatgttttcatggtccaaattttcgttcaaaatcttgggccctttttcatttagaagaaccaaatattgctttttggactgaagctcagaaaatctgggaagatggtaaactgacacatttccagcttttactttctcctatcttctgttatgactataaatgacaattgtatttctgaagtccatctctgtttgttatcatgtatctgacatgttaaggagttcactaccaataagtcaatatttataatgtctggaacatgttaatttctgaacttgccatcttactccatgtttcttacttaggcaattaaagtttctgctgctgtggctaaacataagtcatggtaatagttactgtaatctttcttataaaaacatgaagtgaaggcaacatagtggtagtgtgaggaaattatttgccagtcaagactatattataaaatatataggcaaggctgtgcttttatctctacagtgataaacccatttcctttgagctttacttttctacttggtggtttctacattgagggaaaaaaatgtttgatgtttgatgctttcttcatcttactagggacaaatccaattaccactaatagaagaattatttgtgaattatttggtttttatcctcatttattcttcatttttatagccttcctatatatgacaactgaatttatagctctgaggccacaattatcatcttgaatctaaatatggtttattactttaaaaaagtatttttattttgttgtaggctccagtgatcattctacatatattgtacaaacactagattttcacctgggtcataatactatggttaccaaaccatgtggtgctttggaaagtcctatggcaacaataaccaagataacaaggcgtcgccatgaaaatccaccccatggagtagcaagtgtgaaagaatggttcaattatgttacagctacaaggaatgaaggttaaaattttgagtctttggagagatttattttgttttttccattttggattctgttgactgtgtttagaatttaaatggagatggtgttttcatttccttaaacaattttcattttaatcttgctggctgacacaagtaataattatttaataccaccctggtaatgtggcatctcatggactcaacttattttagatgttattgaaaacattctaaataaaattggctttaaataaaattaagtttattacattgagaaatattttaggaaatatttaggaaatgattctggaaaaatatttttctagtaatgctaaaaaatggaagtttggggaggttgttacacaactaaataaaggaataccacaaacttaaagttcgaatagctagaacaaaatgaaaccaaatattatcattctatcaagttgtaagtttaaaagaaagtgcttttgatagttttttttttttcatttgattagatacaacagtcttgtgatagtgtggtcatgataacttattttgtggtgcttttgggatttgggtttatagtattgcttttaccaattatctctgtgtattggaaagctgactagattgacaggtgttgagacttttcaatgttttacataaaaatgaccttttttcttttctttttttttttttttgagacagagtcttgctctgttgcccagactgaagtacagtggcatgatcttggctcactgcaacctccatttcctgggttcaagcgattctcctgcctcagcctcctgagtagctgggattacaggtgtgcgccaccacgcccggctaatttttgtatttttagtagagacagggtttcaccatgttgttcaggctggtctcgaactcctgacctcgtgatacacccgcctcagcctcccaaagtgctgggattacaggcatgagccaccatgcacagccaaaaatgaccttttttcaaaatggaaaagattaggccccatgagaacagttaccatggaataggccatctcatggattgaatagagactgttaaaaatgttcctagaacaaaggagaataagaaagtgaatcagaagattatgcctgtactgactattttaccttccaaacagggatttgggggaagggggatctttatggctggagtgtcctaaagcgtctattagcataatgaactgctgtctgaagaaaaatactaattattataattctaagacctataaaaggtctttataaaactaagactctatagtttaatcatagcacatatgttggggaaaatcagtacttctacctgatttcaagaccaggatcctatttaatctcaaattctttaagagtgaagtgttcaatctatggagccctttgggcttagtgaaattccaacttcagacatgaattcagttgagaataatattcattttaaaatcccagaaaccaaagctagaatgtattgggtttatacaaatcccattataaagctttggtcttgacaacagtgagctactgatatagatatactacatatatatctatatcatatgtatatatataaatatatgtatatatacatatgtatatatatacatatgtgtccatgtatatgtatatatctgtatacatagatatatgtagtatatctatatataatgtgattctttccaactttggaaataatagttctgtatattatagttgtcttgaaagctatataggcttgtcaatgcctattgttttaatttgactctctctttatcattatgcatgtagagctaaatctgcttcgtaatgttgatgctaacaacactgagaatagcactactgtgaagaattctagtttgttgagtggattcagaggaggttctagctacaaccatgaaacagagactatctttgcattaccaaggatgcagcttgactttaaatccattcatgttcaagaaccacaggagccttcattacagggtatgtagaaaaacaatttaaagttaataagaaaattctaaaggcacttcaaactactgctgtgttcccatggattttttgttaatactaatatctaatgaaattaattttctaggcaaaattgatttattttcttatcagctatatgacctctggaaaattatttaaccaacttatacctctctctcctcagtaaaatgaagaagaataattggacttcatttataggactattatcaggaataaatggcatatataggttgagcatcccaatccaaaaatctgaaatgccctaaaatccaaaatattttgaacactgacatgacacaggaaatgctcattggaggatttcagatttttggattggggttctaaaaccagtaagtataatgcaaatattccagaatccaaaatttgaaagacatctgatcccaagcataattggataaaggatactcaatctgtactagggaagtgcttaacaaactatcatcatcctgtaaatcacatacagatattactcatttctttacagttgcatttcatgtggatgcatttacatagacctatataaatccttattaatgggaagatgactcattttattaaatcttttaccatattattgcagatgccagcctgaagccaaaagtagaatgtagtgtggtgacagagttcactgaccacatttgtgtgactatggatgctgagctcatcatgtttcttcatgatttagtatcagcttatcttaaagaaaaagaaaaaggtgggtggaatactctttttcttttaggctgcaagaatggcagctgtcaatgccatttacatgaattgttatggtctaatgagaaaatgagtggaatatatctcccgtgagttgaagatatcagtaaatagcgttagtaagactatcacagactttctgagtacttgctatatatacagcaccaatggtgttttatactttacaaagtgtttctgtatacattatcttatgtacattttcagttagatcttacaggagattcttgaaaaataggaaaatgtgagaaaatactgcaaatcaaagtgaaatgactaaagaaacaactacataataaagaagcatgagttatttacctaattgtgaaaactgaattgagaaagctgataaatgtttggaatgcagaaaacattttctttttaatacataaattatttaaatctcagtggtggtatttgggttcatgagcttgctaacattggtttacacactggtaacttaatgtttacccattaagaaatgtatggtggctgggggcggtggctcatgtctgtaataccagcactttgggatgccaaggaggatggactgcttgagcccagggctttgagaccagcctaggcaacaaagtgagaccccatttctacaaaaaatacaaaaattagccaggtgtggtggcacatacctgtagtccccagctactcgggaggctgtgaggtgggaggatcgcttgagcctgggagttcaaggctacagtgagctgtgagccataattgcaccaccacactccagcctgggtgacagagatcctgtctcaaaaaaaaaaaaaaaaagtatggcagccctaatatctggaattagctaatacattatagtactctctaactgtttaaaagaatgaggtagtttgaaatgtaatgatttggaatgcttacaaaatatatggccatttattcattcaatatttattgcaccgttatgaatatacaatggtaaaatcacatatgtgcttcctaataaataacttggaataaatgtaatttgttcaagtcacactataatactgtttcattttcttcatgaggaaaaaatataaaatttgtcttgacttttaaaaataaagattatcaaacgaccatgttgaaagagtacaaaggtagcatagcatacattgaaatgctcttttattaatattcaattgagatgtgcccaaaattcagtgagagagtaaaatcaataatgatggctgggagaaatctatatgacctcagtagaaacttcaagtaaaatgacagaaactgtataataggcaatcttgtatattatatataagtagataaaatcttcacatacagccccaacagataccagtcactggcaatcctttttgtttttatgccttaatatttaaacttaatgtagaaaaaaacagattcaagacaaacctgtgaagttcagaattattttctagtctacctatatttgaaaacctgacaaatttgtttctcttgggtatgatgtgaaacatttgtcattttatgaaatagtgtgttggtcttggtctgccacaaactacgtgtatttctaaaaaacaacaacaaaaagaccgttttaatataaactgttataaaacatttcaatgggaaaagggggtggatttacaataacaaaatatgtatgtgaggatttcaattataaataagttattacaaacaacaagcacttcgttttggccaaaatactcaaatatacctgagaaaatgcttaacagcatgtcagactataccagaatcaacatatttagagaacatcaaaataaattgtagcactgtaaccaccaccagtaataaacaaaaacccagcaactgagcaggccttaactgaacagggcatctgtgttcttacgtagtgcgttactatggcttaattttgaggctcattcccaatcaagttataaccggagctatataacacatattacctaattattcaattatttcacgtccagtttgtgtattgaaactaatgccctaagaggaaagctgtattcattaaataagatcatatgaaaatattaatggcaaaaactgcaattacttttgcaccaccctaatacctatgttgcagattacactttatatataattattatagccaattaaaagacttgtctttataaagagtgaaaagtctgcttaaataaaaacctctttagtaccactgttcaaatatatatacaactagccattagcatacaaaaaccattgaattacacagcttaaattaatgaatggtatggtgtgtgaattatatctcaaagctgttaaaaaaaaaaacaaaaaagggagcggggagggatagcattaggagatatacctaatgctaaatgacgagttaatgggtgcagcacaccagcatggcacatgtatacatatgtaactaacctgcacattgtgcacatgtaccctaaaacttaaaagtataataataataaaataaaaaataaaaaataaacctactacagccattctttaggaaacctacaactatcaatttcagtgccataggcttgctatcaagtcaatgatctcagcattttttatcattaatgttgacactgttaatctctaagaattatcaataattggtacttatggcttattttaaaatattatttttaagaaatgcaattaaatgaggctttggccaggtcatagataaaatgagaaatgaaaccaattctgttctaattcttatggtgatttaacataaatgtatcatactaatctaaattttccttatagccatctttccacctcggattttatctactcgaccaggacaaaaaagtccaattattatacatgacgacaattcctctgataaagatagagaagatagcatcacttatactactgtggactggagagattttatgtgcaatacatggcatctagaacctactcttaggtaagtaatgagtatatacatttacccatatgctaagggattactatgagcaaaaagttatgaataatgtaagttacatatgattatcaaaaaatatattcagaagttagtctcctgtaatgtctatagcttctgtgtgctgtctttgctgcttctttctgtatttgtttctaggtaaggcgaatgaagtacaaatgttgagaatagctcagcactgatgagttgtccaatgggtgacattactaaaatatgagaataattgtccttccactgttgccactagtttttcaccttctcaccaagatgttattttcagggtttgaggtagctactgtaaactgttttgttacttagtatggcaagatgcagcagaagtcatatttaattgttaaggaactattttaatttcttgctgtatatatgtcataacactgtaataaaacctgcagcatcacagtgcccctctctttgcatactaagcattataaaaccatgcctaatatctcaaatttaacactatcagattaaggttcccttactgagtcatggtctactacaattatcccaattaaatcactatcccaaaatttcaaaagtattttttagtttcagttatatttatgatagtttctataactagtggtgcttgctttgtgtgtccttgtttgtgattaacactaacagccttcctgttttttttcctttcatctcatctgctttgttaatcctgttgtaactgtctgaatcctgaaataacactatttttaaaaatccattacatcccagcacaacattctgcaaaatgatatacattttatttagataaggtttttattcagacatatttatgtcacaaaataattccaaaataaaatctccattatgcagtgaggactcttgtataggcagaaagtactgacttggtgtgttaataaataattggcatacagtaaaatttgttgtaactaaataagcaaaacactttggtactaatagtgcatatacccatgagaaatattaactgttaaaatactgcagaggtcctaatgcagaaaactatttgtaaaatctgttttgtatttgcaaatttaaataataatgtatttaaattgaatacaaaatgaatttagtttcaagtgagcataaaaatagttaccatattcctttttttagcaaactatcaagagtatctagttaagtaatgtggtatagtggtagagagcgtggtttaagagctctggctgtaagcccagctcttttgcatagtagctgactgagctaggccaaaacacctaacccctctgttctctctgcctcagttgactcatgaaaaatttggaaaatggtattacccaccttgtaggatcgttacactggttaaatgaattaacgcaaaatgcttataactatttgagtttgaggagatcaatgcctaaccacccccaacccccaccctgagttcagaaccaattgaaatagtgggagagattaatatggataaagctgataacaagacatgtggcttagatatacggcaacaatagctttctacaaagttcgggtttggtcctacctgcagggcatcgatgcagaacttaacttcggggaagggcgggatgggggttgctggagttgtacaatcagcagctctatgtatgtactcagccacagacaacatagaatactctggggctaacctgtttaggggcttgctcctgaaaaacctgtggtatgaaggaacagactaaaatgaagggctccatgagggaggagggtactgaactgttacttcctctgttaactttgcctgttggataaatcatcaatacaggggcagaaggtggccaggagcggttcagtaacagctgtttctccacgtataaggaaatagcaagaatagggaaaaaatggttctcccttcaaatatgtttagcacatagcactcagtaaattttagcctttttctcccattatgccacatgcttatgaaatctactaaaattaaccagatgtccttttatatgtttaagataactgtataacaggcctaaaatattcaggatgaaatatagtaaacactattgctgtgtttaggttgtcaaagagatttataatcatacatatattattttttgaatgctattattatggtgaatccaggaattatgggctcatttatacaaatgtacctactgaaaatattttgtcttgagtatattatagaggcttagtgatgttcttttcctaccattagaaccatgctttagggcattacactccttaataataactgtaatttttattttagattaatttcttggactggaagaaagattgatccagtaggtgttgattatattcttcaaaaattgggctttcatcatgctaggactactattcctaaatggcttcaaagaggagtcatggatccactggacaaggttctgtcagttcttatcaaaaagctcggtactgcactacaggatgaaaaggaaaagaaaggcaaagacaaagaagaacactaaaaaagtaatttgatctgtgaacaaattatgattgtgtctgttttattacactggagtgtttttttagtataataatttgaaatataactttaaaataattctaaatttgtggctataattaaaagtttgtaagttaacctgttctagttccatcattctgtgtacagtgaagtattgcatgataatgtaaattttgtgaaaaactagattaaaatatataactgcttgttatggtttataattatataatgtgcaatacaattcctgcatctttaaaatgtctgcagaataactgtgaatttttttgttattggattggccgtaacttttagaaaaaaatcttgttgatgataatgtgattttggggaggtcattaattgctttttcttttttaaatgtagacttatataaatacctgtttgtatatagcttgagtaattgtgatatgattgtataccactaaaatattgttaactattataataaagtcacagtaatggtttaagtctgtagtagtttttcaatctttttctcctttttataattaatagatgcccatgctgtgtcacagctgatcagatgctttcatagaagatgatgatttatacctatattagagttgggccataggttctacctctgtggattcaatgaactgcagatcgaaaacaaacattcaggaaaaaaaaaatattccacccaagttccaaaaagcaaaacttttgtatttaccaagtacattaagtccacatgaatgaagtgatgtgtaggcattttattaggtattgtaaataatctacagatgatttttaaagagtatccaggagaatgtgcgtaagttatattcaaacactacacaattttacatgaggaacttgagcatctacggatgttctggaaccaatcccccaagaacacaggaagatgactatgtttataaaaaattagggacaggcacacaagaggtatattaataatacctacgagaaatattaggtattgttctttcttaagctaatgggaaattcacagcaagtaatttttattatactatattccttacgtgtttgtattttttgtgtgtatgaagttatatataatgtatgttatatattacagatacatatgtgtattatgtacacacattaagtataaaaaatttaaaatggcaagatctaaaataatactcaaaggtagctataattacctcaggttggaaattagccaagtcagtatggccagtttaaagattgggtaaacagtagaattgaagagctagagttagaaaacacctaaagaaagcctctagtgcagactcttagatttaggtagataagacagttttacctctaacagattaaacaacaaaaaactccagaagagctggggtacttagccaagggtgtagatctagtaaatgttagtaggggaattaagatttgctgtctaatgtcacaaagcaacttagtcacacaaccaaaaccctagtgttttaacagtcctaattttgtattctttctgctaggccatcatagctgtcatctatctgatctctgaatctgacccccaaatctcttaacattggtgcatataaaataacaagtataaacttaccctatttctggcactaactgataacgttataaaaagcaaaaggacaaatctgtaactacttaaaatttctatgactgttggacaaagctatgagaaaactagcacatctgtgcactactgatgagaatgtaaattggtacaactcccatgaaggacaattaagtaacagctgtcaaaataataaaggcatataatttttactggacatacatacaatacttccctgtgtgaaataattatacaagcatgtatatttgcggtattctgcaacagtgcagtattgtggaagtatgttgcagtattctttgtaataaatggctggaaacaattcaaatgttcatcagtgtaagacaggttaattaaaagtgacatccattcagtagcatagtatgcaaccatgaaaaaaaagatgatctctaagatttattcctaaattaaaaaacatggtcagccgcttagattacaaagcttccaagtggtctattatagttattttttgagtatcacgtaccttgttctattccagtaaatcacacggtgcatccagataacttgtaaaatttcaataacatgtaaaaaaaaattacataaaggattttgctttcctatcggcaaatattgtacttctaggcttactagagatctgtgatttgcaaactgtctatagtgaagaacccttttttagaaaaagttgaacatgatataaatcaataatcttgtaaaatatagtaacaattattcaaaatgaaaaaaattaaaatacacaaagctcaaatttttaattattaggtttgatttactagattcaaatgttccatcaattgctgtaagaatttctagggtatttctggcaacatagcccaataggaacagctccagtctgcagctcccagcgagactgacacagaagagggtgacttctgcatttccaactgaggtacctggttcatctcattgggaatggttggacagtgggtacagcccacggagggcaaaccgaagcagggtcgggagtcgcctcacccgggaagcgcaagggttgaggggatttcccgttcctagccaagggaagctgcgagtgactgtacttgggggaatggtacactcctgccccaatactgcactttttccacagtcttcgcaaccggaagaccaggagattccctctggtgcctggctcggtgagtcccatgcccacagaggccagcaagctaagatccattggcttgaaattctcaattctagcatagcagtctgagatcgaccggggatgctacagcttggtggggggaggggctcggccattgctgaggcttgagtaggcagttttatgctgacagtgtaaacaaagcctccaggaagtatgaactgggcggagcccaccgcagctcagcaaggctgcctctctagattctacctctgtgggcaggacatctctgaacaaaaggcagcagccccagtcggggacttatagataaatcccccatctccctgggacagagcactcaggggaaggggcagctgtgggcacaccttcaacagactttaaatgtccctgcctgacagctctgaagagagtagcggttctcccagcacagcgttcgagctctgataacggacagactgcctccttaagtgggtccctgacccccgtgtagcctgactgggagacacctcccagtaggggctgacagacaccttatacaggagagctccggctggcatctggcgggtgcccccctaggatgaacgttctagaggaaggatcaggcagcaatatgtgctgttctgcagcctccactggtgatacacaggcaaacagggtctgggtggacctccagcaaactctaacagacctgcagctgagaggcctgactgttagaaggaaaactaacaaacaagaaggacatccacaccaaaaccccatccataggtcagcaacatcaaagaacaaaggtagataaaaccacaaagatggggagaaaccagcacagaagggctgaaaattccaaaaaccagaatgcctcttctcctccaaaggatcacaactcctcaccagcaagggaacaaaactggacagagaacgagtttgacaaattgacagaagtaggcttcagaaggtgggtaataacaaactcctctgagctaaaggaacatgttctaacccaatggaaggaagctaagaaccttgaagaaaggttagacgaattgctaactagaataaccagtgtagagaagaacataaatgacctgatggagctgagaaacacagcaagagaacttcgtgaagcacacacaagcttcaaaagttgaatcggtcaagtggaagaaagaatatcagtgactgaagatcaaattaatgaaataaagggagaagacaagattagagaaaaaagagtgaaaagaaatgaacaaagcctccaagaaatatgggactatgtgaatagaccaaacatacgtttgattcatgtacctaaaagtgatggggagaatggaaccaagttggaaaacactcttcaggatattatccaggagaacttccccaacctaacagggcaggccaacattcaaattcaggaaatacagagaacaccacaaaggtattcctcgagaagagcaaccccaagacacataatcgtcagtttcaccaaggttgaaatgaaggaaaaaatgttcagggcagccagagagaaatattgggttacccacaaagggaagcccatcagactaacagcggatttctcagcagaaaccttacaagccagaagagagtgggggccaatattcaacattcttaaagaaaagaatttacaacccagaatttcatatccagccaaactaagctttataagtgaaggagaaataaaatcctttacagacaagcaaatgctgagaaattctgtcaacaacatgcttgccttgcaagagctcctgaagaaagcactaaacatggaaaggaaaaaccggtaccagccactgcaaaaacataccaaattgtaaaggccatcaacgctatgaagaaactgcctcaactaatgggcaaaataaccagctagcatcataatgacaggatcaaattcacacataacaaaattaatcttaaatgtaaatgggctaaatgccccaattaaaagacacagactgggaaattggataaagagtcaggacccactggtgtgttgtattcagaagacccatctcctaatggagatggagaaagatctaccaagcaaatggaaaacaaaaaaaagcagaggttgcaatcctagtctctgataaaacagactttaaaccaacaaagatcagaaaagacaaagaagggcattacataatggtaaagagatcaatgcaacaagaagagctaactatcctaaatatatatgcacccaatacaggagcaccccgattcataaagcaagttcttgaagacctccaaagagacttagactcccacacaataatagtgggagactttaacacaccactgacaatattagacagatcaatgagacagaaggttaacaaggatatccaggacttgaattcatctctggaccaagctgacctaatagacatctacagaactctaaaccccaaatcaacagaatatacattcttctcagcaccacatcacacttattctaaaattgaccacataattcaaagtaaaacattcctcagcaaatgtaaaaaagcagaaatcacaataaactgtctctcagaccacagtgcaatcaaattagaactcaggattaagaagcccactcaaaaccacacaactacatggaaactgagcaacctgatactgaatgactactgggtacataacaaaatgaaggcagaaacaaagatgttctttgaaaccaatgagaactaagacacaacatacaagaatctctgggacacaattaaagcagtgtttagagggaaatttatagcactaaatgcccacaagagaaagcaggcaagataaaaaatagacaccctaacatcacaaataaaagaactagagaagcaagagcaaacaaattcaaaagctagcagaaggcaagaaataactaagatcagagcagaactgaaggagatagagacacaaaaatcccctcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaggcttcatgactaaaccaccaaaagcaatgcaacaaaagccaaaattgataaatggatctaattaaactaaagagcttctcacagcaaaagaaactatcatcagagtgaacaggcaacctacagaatgggagaaaatttttgcaatctatccatctgacaaagagctaatatccagaatctacaaagaacttaaacaaatttacaagaaaaaaaccccatcaaaaagtgggcgaaggatatgaacagacacatctcaaaagaagacatttatgcagccaacaaacttatgaaaaaatgctcatcatcactggtcattagagaaatgcaaatcaaaaccacaatgagataccatctcacgccagttagaatggcgatcattaaaaagacaggaaacaacagacgctggaaaggatgtggagaaataggaaagcttttacactgttggtgggagtgtaatgctcaatatcactaatcatcagagaaatgcaaattaaaaccacaatgaggctgggtaccgtggctcatctggccaaggtgggcagattacttgaggtcaggagtttgagaccatcctggccaacatggtgaaacccatctctactaagaatacaaaaaattagctgggtgtggtggcacacacctataatcccagctactcaggaagttgaggcatgagaatcacttgaacctgggaggccgatgttgtggtgagccaagatcatgccactggactccagagcggactctgtctcaagaaaaaaaaaaaaaaaaacaccacacagtgagatatcatctttacaccagtcacaatggctatttattacaaagacaacaacaaatgttggcaaggattcagagaaaagagaacactgtttcactgctgaacacttattcactattggtgggaatgtaaattagtacaacctctatggaaaacagtgtggaaatttctcaaagaactaaaaatagaactaccatttgctccaacaatcctactactgggtagcagaggatttcttttcctctttccaaaggaaaaggaattattatgccaaaaagatacctgcactgttatgtttatcacatcactattcacaatagcaaagatatggaatcaacctaagcatccaacaatggatgactggataaagaaaatgtggtatatatacacaacagaacactactcagccataaaaaagaatggaatcctattctgcagcaatatggatggaattggaggctattattttaagtgaaacaactcagaaacacaaagacaaatactgcatcttctcacttataagcaggagctaaataatgtatacacatggacatagagtgtggaatggatagacaatggagactcaagggtagagggctggggagaatgatatttcccaattgcttaatggatacaatgtacgttatttgggtgatggatacactaaaagccctaactacatcactatgcaatatatccatgtaacaatattacacttatcttctacgagtaaaatgcggaacatttattggacagttaagaggggcaagagtgggaagcaggaagacctgttcataagctatcacagaaatcccaggaaaaggtaatagttgtttggactagggtggcagcagtggaagtggtaagaagtggattcatttgggcaatgttgtggagacagccaacagaactaactgatggaatgggagttgggggaaagaaaggagtcaaggataattcttgggcatggtcagataacttatattaattagattagaaattaggaagagcatccattcctcaagccaaggcagccccaaaccaaggtatatgtcttgcttagcagagtaaagctgtacttcagccccactcactcccttggcttggtgttcttgttcacaaccttatactctggccttgcttctgaggttctggctttagcaactgagttaatgagcaactgagtatcatgtactgagatgaagaattcactatcatgcccaattgcccactgccttgccaaatcataagagtcacataataaaaagatgacagtaatatagttcagcagttgccaaaacatcctgcaactcattgggccatctgatgtcaagttaatttacaccagtattcagaaatatgtggaaggaagtatttaaaatctggtatgttttcatgtatccattagacaatcaatcatttgttaataaatatatggtatcgaatctgaggcagtttactaaaaccaatacagaagcaacattcagtgtggtcttgaaatatgaaacatatttaaattacactgaaacatcttaaacactaaactactaaacatattattttacaatataactcattagaaattgttatgcaaattatgtggattatctgcctcatagcctaaattggataaacctcaaccaaaattatcaggctatgactgtatgaatattttaagcatattttaaaaataagaaccaaaacttcattatctctccagtcttcacatgctaaacttaacacgttg

SEQ ID NO: 239 - DNA, 7735 bp, Homo sapiens
  misc_feature (1)...(7735): n = A,T,C or G
nctgttatgggatgcataatgacagaagcattagagaataaaagtgtacattttcccctaagaagtaaatacaacaggcttacaaaagttgctcgctttctccaagaaaatccttcatgtttactatgtaatatactacaccactatctgcaccaggcaaattactccatcattgatgatgctacaatgagcgatggacttcctgctttggtaactttgaagaaaggtttagttgcactggcaaggcagtggatgaagtttattgtggtgacaccagcctttaaaggagttagcttacatagaccagctcagcctctgaaacctcaaatagctatggaccatgaacatgaagatggacttggattggacaatgggggtggtcttcaaagtgataccagtgctgatggagcagaatttgagttcgatgcagccacagtcagtgaacacacaatgctattagaaggaacagctaaccggcctccacctggtagctctggacctgtaactggagctgagataatgaggaaactttctaaaactcatacccatagtgactctgcattaaaaataaagggcattcacccatatcattctctgagctataccagtggagacactgccactgattctccagtgcatgttggacgtgctgggatgccagtaaaggacagtccaaggaaggagagcctactcagctacctgactggaagcttcccaagcctgcacaacctcctggaaggtactcctcagagaagcagtgctgctgtgaaaagtagctccctaacgagaacaggaaatacagtagccactgatatgttatctgaacatcccttgctatctgagccatcatctgtgagtttctataattggatgtcaaatgctgtgggtaatcgaggaagtgtgttacaagaatctcctgttacaaaatcaggacacaatagtcttcccacaggtgttgcacccaatcttccaacaataccctcagcctcagatttcaacactgtcttgtctagtgaccaaaatactttggatgggacacattctcagcatagcaccagtcaggatgatgtggcaggtgtagaagaagcaaaccaagggtttcctgctgttcagcttgctgatgcacaggttgttttcaagcctcttctgagtcatacagggatccagtcacaggatacaatgccattctgctaccgaatgtactttggagaacacctttcattttcagggactttggactgcctcagagcagatattgtggattcagacacagccaaagagagaaaaggcaaaagagcaagaaggactgtagtgaaatgtagtattgccaagtcccaagccctctacagtgcccaaagagggctgaagacaaacaatgctgctgtgttcaaagtaggagctatcagtatcaacattcctcagcaccctgccaccttacatagcatgatggttcgaagttctcaccaactatctaaacaaatctcagacctaatcagacagccttctacagccccacagcctgtaaaagaagatattgcaaccccactaccttctgaaaaaaccccaacaagtgttaatcaaactcctgttgaaacaaatgaatttcctcagctaccagaaggcttagaaaagaagcctattgttcttaaattcagtgccatgttagatggtatagccattggagcagcacttttaccatctctgaaagcagaatacaagatgggaagaatgagaagtcatggaatgacaggtgcacagacaagatttacatttgagctgccaaatcacagattgcgttttacttcaaaagtttctgccacagatatgtcaaccattcctccttctgccagtcttaaccttccccctgttaccatgtcagggaaatatataatggaagaacatgatagttattcggatcaggtgtggagtatagatgaactgccttctaaacaaggttactatttacagggaaattatctgcgttgtgtggcagaagttggttcctttgaacataatcttacaactgatcttctaaaccacttggtatttgtacagaaagtgttcatgaaggaagttaatgaagtaatacaaaaagtttctggtggggagcagcctattcctctctggaacgaacatgatggaacagcagatggagataaacctaaaattctcctctattccctaaacttgcagttcaagggtattcaagtaacggccactactccatcaatgagagctgtaagatttgaaactggattgattgaactggaactttctaaccgacttcaaaccaaagcttcaccaggaagtagcagctatctgaaactgtttggcaaatgccaggtggatttaaatctggcattaggacaaattgtcaaacatcaggtttatgaggaagctggttctgattttcatcaagttgcctattttaaaaccagaattggattaagaaatgccctccgagaagaaatcagtggttcttcagatagggaagctgtgcttattactttgaatagaccaattgtttatgcacagcctgtggcctttgatagagctgtgctgttttggctgaattataaggccgcctatgacaactggaatgaacaacgaatggctttacataaggatattcatatggctacaaaggaagtagtagatatgctacctggtatccagcaaacatcagcccaggcctttgggactctttttctccagctcactgtcaatgatctgggaatttgcctacctatcacaaatactgcacagtctaatcatactggagaccttgacactggttctgctttggtattaaccattgaaagtactctcatcactgcatgctcttcagagtctctggttagcaaagggcatttcaaaaacttttgtatccgttttgctgatggatttgagacatcatgggatgactggaaaccagaaattcatggggatttagtgatgaatgcctgtgtagttccagatggcacctatgaagtatgttcaagaactacaggacaagcagcagctgaaagcagtagtgctggaacctggacactcaacgtattgtggaaaatgtgtgggattgatgttcacatggatcctaacattggcaaaaggcttaatgctctgggcaatactcttacaacactgacaggagaggaagacatagatgacattgctgacttaaattcagtgaacatagctgacctgtcagatgaggatgaagttgatactatgtctcccactatccatactgaagccacagattatcgaagacaggcagcatctgctagccagccgggagaacttagaggaagaaaaattatgaagcgtatagtggatatcagagaactgaatgaacaggccaaagtaatagatgatctgaaaaaattaggtgcaagtgaaggaaccataaaccaggaaattcaacgttaccaacagttagaatctgtggctgtgaatgacattagaagagatgttcgtaaaaaattacggaggtccagtatgcgggctgcttccctaaaggataagtggggtttgagttacaaaccaagttacagccgatcaaaaagcatttctgcttctggaagaccacctcttaagcgaatggaaagggcaagttctcgagtaggagaaactgaagagctcccagaaatccgtgtggatgcagcatctcctggacctagagtaacttttaatatccaggatacatttccagaggagacagaactggaccttttgtcagtaaccattgaaggtccatcccattattcatcaaatagtgaaggatcatgttctgtgttcagttctcccaaaactccaggaggcttttcaccaggcattcctttccaaactgaagagggccgacgggatgacagtttgtcttctaccagtgaagattccgagaaggatgaaaaagatgaagaccatgagagggaaaggttttatatttacaggaaaccctcacatacgtctcgtaaaaaagcaacaggctttgctgctgttcatcagctatttacagaacgctggccaacaacaccagtcaatagaagtcttagtggcacagctacagagagaaatattgactttgaacttgatatacgggttgaaattgatagtggaaaatgtgtactccacccaaccacccttctacaagaacatgatgatataagtttgagaaggagttatgatcgaagttccaggagcttagatcaagattcaccttcaaaaaagaagaagtttcaaactaattatgcttctaccacccatttaatgaccggcaagaaagtgccatcatctctacagacaaagcctagtgacttagaaacaacagtattttacattcccggagttgatgtaaagttgcattacaattccaagacgctaaagactgaatcacctaatgcctccaggggatcttccttgccaagaacactgtccaaagagtccaagctgtatggtatgaaagatagtgcaacatctcctccttctcctcctttaccttccactgtccagagcaagactaacaccttacttcctccccagcccccacctattcctgcagccaaaggaaaaggaagtggaggagtaaaaacagccaagttatatgcctgggtagcacttcagtcattgccagaagaaatggttattagtccctgcctattagactttctggaaaaagctctggaaactatcccaattacaccagttgaaaggaattatacagctgtcagctcacaagatgaagatatgggacattttgaaataccagatcctatggaagaatcaacaacatcactagtgtcgtcttcaacatctgcttactcttccttccctgtagatgttgtggtttatgtacgagttcagccctcacagatcaaatttagctgtttaccagtatcaagagtagaatgcatgttaaagctgccatccctggatttggtgttttcttcaaaccgaggagaactggagactttagggactacatatcctgcagagactttatcccctggaggtaatgctactcagagtggaacaaagacttctgctagcaaaactggaataccaggttcatcgggattaggcagccctcttggccgaagtcgacatagtagtagtcagtcagacctgaccagttccagcagtagttcatctggcttgagcttcactgcatgcatgtctgacttttccctttatgtatttcatccatatggagcagggaaacaaaaaactgctgtttctggcctcacacctggatcaggaggattagggaatgtggatgaggagcccacttcagtcactggtcgaaaagattcactcagtataaaccttgagtttgtaaaagtgagtttgtcacggatcaggcgttcaggaggtgcctcattttttgaaagtcagtctgtaagcaagtctgcaagcaaaatggatactacgttaataaatatatctgctgtttgtgatatagggtctgcctcctttaaatatgatatgcgccgactcagtgaaattctggcatttccaagagcatggtatagaagaagtattgcaagacgtctattccttggagaccaaactataaatttgccaacatctggcccagggacacctgattccattgaaggggtaagccaacacctttcccctgaatcatcaagaaaagcttactgcaagacctgggagcagccaagtcagtcagcctccttcacccacatgcctcagtcacctaatgtgttcaatgagcatatgacaaacagcaccatgtcaccagggacagtaggacagagcctaaaatccccagcttccataagatcaaggagtgtatctgattcttcagttcctcgaagagattcactttcaaaaacatcaactccttttaacaaatcaaacaaagcagcaagccaacaagggaccccatgggaaacacttgtcgtgtttgctatcaacttgaagcaattaaacgttcaaatgaatatgagtaatgtaatgggaaatacaacttggacaactagtggtttgaagagccagggccgtctgtcagtaggaagtaatcgtgatcgagagatcagcatgtctgttggtctgggaagatcacaattagattctaaaggaggagtagttggagggaccatagatgtcaatgctttggagatggttgctcatatttctgaacatccaaatcagcaacccagtcacaaaattcagattactatgggttctactgaagctcgtgttgattacatgggctcaagtatcctcatgggcatcttcagtaatgctgatcttaagcttcaggatgaatggaaagtaaacttgtataatacattggattcaagcataactgataaaagtgagattttcgtccatggagatttgaagtgggatattttccaagtaatgatatcaaggtcaaccacaccagatctgataaaaataggaatgaagctccaggaatttttcacacaacaatttgataccagcaaacgagctctgtctacctggggaccagttccttaccttccgccaaagacaatgactagcaacctagaaaaaagttcacaagaacaattacttgatgcagcacatcatcgacactggcctggagtattgaaggtggtatcaggatgccacatatccttatttcagattccattaccagaagatggaatgcaatttggaggatcaatgagcttacatggaaatcatatgacactggcatgttttcatggtccaaattttcgttcaaaatcttgggccctttttcatttagaagaaccaaatattgctttttggactgaagctcagaaaatctgggaagatggctccagtgatcattctacatatattgtacaaacactagattttcacctgggtcataatactatggttaccaaaccatgtggtgctttggaaagtcctatggcaacaataaccaagataacaaggcgtcgccatgaaaatccaccccatggagtagcaagtgtgaaagaatggttcaattatgttacagctacaaggaatgaagagctaaatctgcttcgtaatgttgatgctaacaacactgagaatagcactactgtgaagaattctagtttgttgagtggattcagaggaggttctagctacaaccatgaaacagagactatctttgcattaccaaggatgcagcttgactttaaatccattcatgttcaagaaccacaggagccttcattacaggatgccagcctgaagccaaaagtagaatgtagtgtggtgacagagttcactgaccacatttgtgtgactatggatgctgagctcatcatgtttcttcatgatttagtatcagcttatcttaaagaaaaagaaaaagccatctttccacctcggattttatctactcgaccaggacaaaaaagtccaattattatacatgacgacaattcctctgataaagatagagaagatagcatcacttatactactgtggactggagagattttatgtgcaatacatggcatctagaacctactcttagattaatttcttggactggaagaaagattgatccagtaggtgttgattatattcttcaaaaattgggctttcatcatgctaggactactattcctaaatggcttcaaagaggagtcatggatccactggacaaggttctgtcagttcttatcaaaaagctcggtactgcactacaggatgaaaaggaaaagaaaggcaaagacaaagaagaacactaaaaaa

SEQ ID NO: 240 - protein, 2575 aa, Homo sapiens
VMGCIMTEALENKSVHFPLRSKYNRLTKVARFLQENPSCLLCNILHHYLHQANYSIIDDATMSDGLPALVTLKKGLVALARQWMKFIVVTPAFKGVSLHRPAQPLKPQIAMDHEHEDGLGLDNGGGLQSDTSADGAEFEFDAATVSEHTMLLEGTANRPPPGSSGPVTGAEIMRKLSKTHTHSDSALKIKGIHPYHSLSYTSGDTATDSPVHVGRAGMPVKDSPRKESLLSYLTGSFPSLHNLLEGTPQRSSAAVKSSSLTRTGNTVATDMLSEHPLLSEPSSVSFYNWMSNAVGNRGSVLQESPVTKSGHNSLPTGVAPNLPTIPSASDFNTVLSSDQNTLDGTHSQHSTSQDDVAGVEEANQGFPAVQLADAQVVFKPLLSHTGIQSQDTMPFCYRMYFGEHLSFSGTLDCLRADIVDSDTAKERKGKRARRTVVKCSIAKSQALYSAQRGLKTNNAAVFKVGAISINIPQHPATLHSMMVRSSHQLSKQISDLIRQPSTAPQPVKEDIATPLPSEKTPTSVNQTPVETNEFPQLPEGLEKKPIVLKFSAMLDGIAIGAALLPSLKAEYKMGRMRSHGMTGAQTRFTFELPNHRLRFTSKVSATDMSTIPPSASLNLPPVTMSGKYIMEEHDSYSDQVWSIDELPSKQGYYLQGNYLRCVAEVGSFEHNLTTDLLNHLVFVQKVFMKEVNEVIQKVSGGEQPIPLWNEHDGTADGDKPKILLYSLNLQFKGIQVTATTPSMRAVRFETGLIELELSNRLQTKASPGSSSYLKLFGKCQVDLNLALGQIVKHQVYEEAGSDFHQVAYFKTRIGLRNALREEISGSSDREAVLITLNRPIVYAQPVAFDRAVLFWLNYKAAYDNWNEQRMALHKDIHMATKEVVDMLPGIQQTSAQAFGTLFLQLTVNDLGICLPITNTAQSNHTGDLDTGSALVLTIESTLITACSSESLVSKGHFKNFCIRFADGFETSWDDWKPEIHGDLVMNACVVPDGTYEVCSRTTGQAAAESSSAGTWTLNVLWKMCGIDVHMDPNIGKRLNALGNTLTTLTGEEDIDDIADLNSVNIADLSDEDEVDTMSPTIHTEATDYRRQAASASQPGELRGRKIMKRIVDIRELNEQAKVIDDLKKLGASEGTINQEIQRYQQLESVAVNDIRRDVRKKLRRSSMRAASLKDKWGLSYKPSYSRSKSISASGRPPLKRMERASSRVGETEELPEIRVDAASPGPRVTFNIQDTFPEETELDLLSVTIEGPSHYSSNSEGSCSVFSSPKTPGGFSPGIPFQTEEGRRDDSLSSTSEDSEKDEKDEDHERERFYIYRKPSHTSRKKATGFAAVHQLFTERWPTTPVNRSLSGTATERNIDFELDIRVEIDSGKCVLHPTTLLQEHDDISLRRSYDRSSRSLDQDSPSKKKKFQTNYASTTHLMTGKKVPSSLQTKPSDLETTVFYIPGVDVKLHYNSKTLKTESPNASRGSSLPRTLSKESKLYGMKDSATSPPSPPLPSTVQSKTNTLLPPQPPPIPAAKGKGSGGVKTAKLYAWVALQSLPEEMVISPCLLDFLEKALETIPITPVERNYTAVSSQDEDMGHFEIPDPMEESTTSLVSSSTSAYSSFPVDVVVYVRVQPSQIKFSCLPVSRVECMLKLPSLDLVFSSNRGELETLGTTYPAETLSPGGNATQSGTKTSASKTGIPGSSGLGSPLGRSRHSSSQSDLTSSSSSSSGLSFTACMSDFSLYVFHPYGAGKQKTAVSGLTPGSGGLGNVDEEPTSVTGRKDSLSINLEFVKVSLSRIRRSGGASFFESQSVSKSASKMDTTLINISAVCDIGSASFKYDMRRLSEILAFPRAWYRRSIARRLFLGDQTINLPTSGPGTPDSIEGVSQHLSPESSRKAYCKTWEQPSQSASFTHMPQSPNVFNEHMTNSTMSPGTVGQSLKSPASIRSRSVSDSSVPRRDSLSKTSTPFNKSNKAASQQGTPWETLVVFAINLKQLNVQMNMSNVMGNTTWTTSGLKSQGRLSVGSNRDREISMSVGLGRSQLDSKGGVVGGTIDVNALEMVAHISEHPNQQPSHKIQITMGSTEARVDYMGSSILMGIFSNADLKLQDEWKVNLYNTLDSSITDKSEIFVHGDLKWDIFQVMISRSTTPDLIKIGMKLQEFFTQQFDTSKRALSTWGPVPYLPPKTMTSNLEKSSQEQLLDAAHHRHWPGVLKVVSGCHISLFQIPLPEDGMQFGGSMSLHGNHMTLACFHGPNFRSKSWALFHLEEPNIAFWTEAQKIWEDGSSDHSTYIVQTLDFHLGHNTMVTKPCGALESPMATITKITRRRHENPPHGVASVKEWFNYVTATRNEELNLLRNVDANNTENSTTVKNSSLLSGFRGGSSYNHETETIFALPRMQLDFKSIHVQEPQEPSLQDASLKPKVECSVVTEFTDHICVTMDAELIMFLHDLVSAYLKEKEKAIFPPRILSTRPGQKSPIIIHDDNSSDKDREDSITYTTVDWRDFMCNTWHLEPTLRLISWTGRKIDPVGVDYILQKLGFHHARTTIPKWLQRGVMDPLDKVLSVLIKKLGTALQDEKEKKGKDKEEH

SEQ ID NO: 241 - DNA, 33097 bp, Mus musculus
  misc_feature (1)...(33097): n = A,T,C or G
catttacatgatttaatttatgatactgagttactagtgagcctgtccaggatgagctattttggtaacagttttctggtgggttttcatttcacacatgtaattggacatactcgttccatgcaagcagcctgttttcactcactataaaatgccgatatttttgcattcatttttcttgcctttgctagagaataactttttttaccttttgtagtgatgcttaagattcagcttgttatatctattctttgttaaccacctttcaaatgctttttaaaaaacatgtagcatatttgcatatttgagctgttctgtgagaaaaattaccagttctataatgtcacaagttctcatgagacccaaggtaaattgatggtttttcaatctgtcatatcatttaaaaactataaattattaaagagaaggattaaaatgtactttaaacatttggaattgaagagtcagtatgatgtcagagagaatataagtgtggaaacactgtttctaagtttgagaagacaggactaatttgtgtatgaggcatagtttcttgaatttagagactgtaatgtctgaaagcttcttgcaccattgtgatgcgttctgagagatgttctatcgtttgctgtggtggcccagacagcttctgttttctttccttgtttcaggtggatggcctttgttccaggtgctgctgttctgctaaacaaggaaacaaccaagagcctgcaaatactgttaagaaagatcacgggggacaatgcaagagacctaaaatttattttgggacgcggacacacaagcagattgctcagattaccagggagctccgtaagacagcttactcaggggtcccgatgactattctttccagcagggaccacagctgtgtccatcctgaagtggtggggaatttcaacagaaaggagaagtgcatggagctgctggatggcaagcacgtaagtaaaacagctgtgacttcaaaggaaaacactcagactgcctgatgcgtgcgctatgtattttttagtgaccattaaggaatatgaaaatcaaagtaattactggttgtgatattttttgaaaaatattttgctgtaagaaaatcttgactcacatttaaactgatagattttggttttaaaacttatagatattagtttctgttgtattcagatataatctttttttttttaaatccctctatccaaaatagttgaacatgggtaatgtcagatgaaggggtaaagatgttttaaaaatcttatctaattagatctaattagcatatcttatatatttaagtatagtttaaacagcaaatgttgaaaattttaatattgagatacataattattctaatttctaattctaattagtacatattttttcaaaaattatatgagattattaagtttaaaacaatgtcacacacggtcttaagtttttctagggaaattggtgtggtatgaatttaagataggtagaatgacataagacaccactttaattctgggcagtattattttgggagtctataattagtgtagataatgtgcttaaaaattgaagttgtaagtatgagattatactcaggaatattcagcaaaccagtgtataaagtgagcaatagcagtatattttgagaatttttttttgtctgttattttatcagagttgattctacatagaagactatgagtccgagtcccaagaattttgtttcattgatggtcacctcctacaatagaatatgaataaattatgttttattgttctttctctctcagtgttttattttaaccagatcagcgtttactaagctttttggggcctagtgaagacactttgacagctatttagctttgtagtagaagagactgtacagtataagagggactatggacaagcttgagtgacttgttcagagtaagaaagagaacaaaggcttaatcagaatcattgttgaaattgctgtagtcgtatttgttgccattcaagtactttctcattagctgaagaattgtgtggaatctcttcactgtttatgttttaaaggtactcaagaaaaagggttttgtggtgaaactgcaaataccatgtttaaattgttctctatgagttactaatggttttgctaaaatcaagtgctgactgccattgtcattaagactattttcacttgttcctgaccaagtatgcatttgtaggaaatatataagttaaaatatattggcgaaagcaattaaaaacttaaggcagtcttttgtataatctagaatcctgcatttaatcttttatcttcaagtttgagtcatgtaaaaatagtagacttcaatgctcagaattttccattggcttgaaatgaacatgtattttgtttttgaagattagtgatgaaagtaaacaaagatggttgctgtggctttctctatcttcgctccgtgtaaaacacttaccctctgggtgtacatgagcattcttttccttgttcccaagcccttagagtaatttggtattgtaatgagggccaattacaaagtcaccataggtgtctatgtttagtatggctgatttaccaaagcgaaatgataaatagataactgacactgagtgaaaggagtttaaagtgtgataacgctccagccagcagactcctttctgggttctgttacagagctaaaagggatgcgcctttggcttcactatcagcctgcacagggctgtcgttctaagagcccttcaagtgtaaactttctgattatttggcttgatctgaaggcacatgtgctttttgttcaccgtctctttcaaagtgcctccatgctggaaagataggcacctgtctgccaaaattaattatttgtttcaattgagaaaagaaaattaaagttgagccagaaatgccaattctttaaaaagttttaaatatagatcatcttatttttaaaaaattcaaatgaagtagttggaaggatggctcagaagttaagagcgcttgctgttctttcagaggatcagggttcaatttccaacacccacatggcaactcacatatgtctgtaaatcaagttttagggagtcaaatacccttatgggcaccagaaatgcatgtagtgcacatacatacatgcaggcaacacgcacctgtaaaataatgatgaacaaataaataaataaaatctgagtattatgttgcacaactataatcctagcccttggaggctcgtacaggaggattcaaatttaaggctagcctgggctatataagaagatcctgctttccctcacccccaaaagaaaagaaataaaggacatggataaaagagtcaaagctagcccaagacgaggagtcctgttgtccagttcccctgtactcaaacccttcaaggaaaccactgtaaagttgtatgtttattttgccagaatatctcagaagaaaagtcattatttgctagagtacatgtgcatatttattctctgagcaagaacactttatataaacttaagcatactctactctatacattcaatgcctatttttcttattataacatcattagagaacctaacaaataatccactcactcaaaagggtatatatcatttggtttgctagttttgagacaaggtctcattatgtagctttggctggcctggaactcaatctgtagaccaggttggcccccacaaaagattcgcttgcttctgcctcctgagtgcagagattaaaggcctataatgtcatctacagccttaaagggtataaattttgtataaatttaattaacatgtgtgctgttggtcatagaaaatgagtttacagattttttttgtttgttttggcttggtcttttgctattaaattcttccctgtacagtcacattgatgataaaagttagaattttttttaaacttgctatctttttttttaaaaaaaagttttatttattttatgaatgtgagtacactgttgctgtcttcagacacaccagaagagagcatcagatcttattatggatggttgtgagccactatgtggttgctgggatttgaactcaggtcctctggaagagcactcagtgctcctacctgctgagccatctctccagtccctaaaaattagaattttgaggtcctggcaaattgcacattttcagagcttaaaccgttgttaaatttttggtgatgtaactattagtttcatacattttattcattcacctaattaattaagttatttatgttaattggaaaatattgctgtggcactcaggtagacctactaccttactgtctcaggctcccaggttctggaattatagatgctggccgccattccaggctgattttacacactgtttatttctttctaaaatttatgtatatgtgaggagcctgcatgcacactactacatggaggtcaggaaagggcatcaggtgccctgaacaagagttaaggtggttgtaagttgctgtgtgtgctataaaccaaacccaggtcttctgcaagaacagtaagtgcttttaaccactaaggcttcactcttgcccccatttttatacagttttttaatatagaactttcatacttggggtaagttattaaaattttaataacttacaaaattgttttacttttgataacataataacaaagacattaatagataatcatcaaaaaataagggttattgttggacatcttgaatgttcatataaggactgtgactcagtggttgagtccttacctagaatgtgcgaggccctagactcagtatccagtaccacacaaacaagaacagccactcaaagaaacgtcacaccttaatggaaactacaaaaagtacaagttaaaagaaatgtcataccttaatggaaactacaaaaagtacaagttaaaacagatttttttctccacgtgtaaaatagggaaagatggagacggaataatatgattttgaatcttggggatattcttatattttatccttgtaattatccttctttatttttctctcaagatagtcttccttcttccctttccccctcctctccctttcttgtttccttacttccaatattgtcacatggcttaaatttgaaaagggacaagagagtgaacagaaaatttctctttgtttgtttgtttgtttgtttgttcgtttttttcagactgggtttctctgcgtagccttgattgtcctagaactcactcagtagacccagctgaccttgaacttccagagttatgcctgcctctgcctcctgagtgctgggattacaggcatgctataccactacccagcctcttaattctgttctaaaagcaacaagagataccattgatttgttcatcctttcagaaatgttatggctaatgtcatgactatatcaaacaatttaagaatatttttctcatttattttatatttaagttctctctcactctaagacaattactataatttaaatggttttgaatatggcctgtacttccagctccacgagataggaggatcacccgagcccagaagttcaaggtcgatatgggcaacatagtgagatccctgtgttttggcaggaagatatgattgtgattataaatatggaagtatttattttccctataaagtattagcttttgggtttagtaatgttttttaagttctgagataatcttattttactcctttgattccaaagttggttcacatatcacttatgtttgttttcaggggaagtcctgctatttctatcatggtgttcataaaattagtaatcagcagacactgcagcaccttcagggcatgtccagagcctgggacatagaagaactagtcagcctcgggaggaaactgaaagcttgtccctactatacagctcgagaactgatagaggatgctgacatagtgttttgtccctacaactaccttttagactcacaaataagggaaactgtgagtatatatagagattagaacttactgcttactgagataagtggtgaatggaaaagcttttggtgttttatgtctttttttcccctttgtactgaatgtacctaaacagagaaacaaaaacatgttgaaaggtgaattaagaggtgacttttaaacccagacttgactgagtcacatcaggctagattaatcttggttgtgctgggctgtttgtgctttgcgatgtttagtggcatccctggggtttgtctctgagatgccaatagaatcctcacagttgttaccatcagatatctagatactgccatatgtcccctgtggagcaaaattgttccccttataagaccattagataaccatggttctctccactcatgaagttgagttgtttgtttgtttgtttgtttgtttgtttgtttgtttgtttgatttttgagacaagatttttctttgtagtcctggctgtcctgaaactcactctatagaccaggttgggctcgaactcagagatctacctgcctctgcctctgcctcagcctcccgagtactgggatcaaaggcatgtgccactaccacctggcaaagttaagaattattttaaaaacatttctctggcagggggaataactatcttcaagaacttatatacgtactatgaaagttgtacattgtaaatttttttagtaatgaactttaagttttatttgttcgcctgattcttattataattattatagcctaagacaaagagtaaagttaggtgtagccagttactgctttctttgtatgtgactgtacagttcatgcttgctttctgctctttttttctgttccagggttgttttgtgttgttttgtctttgggagaggatttcatgtagcccagtaaattagccatgaacttgctatgtagctgaggatgaccttgaacttctgatcctcctgcttctactgtccaagtgcaagtgctgggcttgcgggtgcctgctgccacactcaggtcttgcagttctagcaatccagctcagggcttcatccatgttaggcaagtactctcccagctcaatcgtagctgcagctccagtttttaaagttcaaaattaataggcacttaaatttttgatatttcatttattttttttttattttacgtgtattggtttgcctgaatttgtctatgcctgtgcaaaacatgtgtgaggtgtccatggtccaggagacgttgttagacttcccgtgaactaaaggtacagacagtttcgagccctcatatgggtgctgggaactgaatgcagatcttctggaagagcagcgagtgctcttattcacagagccatctctccaacctcaattaggcattttatatgctaccataccgctaacctctgctactgtaccttttattggttagctcatttttttagtcactttacacccggctcactgccccctcccactcaccccctcccacaatcttttctcccatcccccctcctcttctcctctgagcaggtggacctccctccccaggtatacccccatgctggcacatcaaatctctgcaaggctaggcacatcctactgagaggccagacaaggcagcccagctagtagaacatatcccatagacaggcaacagtttttggatagcatctgctctagttgttctatacccacatgaagaccaagctgcatatctgctgtgtatatgtggggaggcctaggtccagcctgtgtatgttctttggttggtgattcagtctctgagagccccaaaggtccaggttagttgactctgttgctcttcctgtggagttcctatcccctttcgggcccttaatctttcctcctattcttccatagagtccccaagttccattcactgtttggctgtgggtatctgcatctgtctgaatcagttgttgggtcgagactctcagaggacagccatgctaaactcctgtctgtaagcataacagagtgtcattaataatgccaagggttggtgcttgcccataggatgagtctcaagttggattagttattggttgtccatctctcttgtttctccctacacctgatcctgaacgcacccccattcccttccccttccccttcccctttcccttcccttctcctacccagctccctccttcttcctgccccttatgactattttttaaagatttggtcatttacttattttatgtatagtgttctgtatgcatgtataccaacatgccaaaagagggcattagatcctattacagatggttgtgagccaccatttgggtgctgggaattgaactcagtgcctctagaagaacattcaatgctcttaaccgttgggccatctttccagcccctcttatgacttttattctctgtactaggtgagattcaagcatccttacttgtgccttctttcttgcttagtttcttagggtctgtggagtgtagcatgggcattctgtattttatggctaatctctattcataagtaagtacatatcatgcttgtccttttggtctgggtcacctcactcaggatgatgttctcaagttccatccatttgcctgtacagctcatgatgcctttgtttttagtcgctgaatagtattccattgtgtagaagtgcctcattttctttatccattcttcaattgagggacatctagttgtttccagtttctggctattatgaataaagttgagcaagtgtctttgtgggatggtggaacaccttttggatatataccccgttgtggtgtagatgtaacaatgttagtgaaggtagtctttgtgttatttttattctatcattcccttacttgaaaattgatttctccctttgctctggcataggatccatatatatatgctttattttcaagatgctcagtagtctggtatagaactgcccttcaaccctcattaaaactcctgtctgaagcccttgagcaccttgccctgtcctacttgctgaagtgctctgccttgccctgtcctacttgctgaagtgctctgccttgcccctgtcctactggaatttctgcctttgatactccgtctagttctgttcttctgtagttctttttcagtcactttcagacctgtatatgttattactttctcaaaataatttattggtgattactttaatagaaattccatgttttattactcaggattctcaattgtaaattacacaaacccaacttgaaaagagttttaaaagaattagctttctcttcattatgatggctttgtcctcaggaagtccttttcttgtgggatcaagaacaaccacaagcagttagctaatctggagaaaagagcatgagcttgctttaatcccaccagtcactctgcttggcccagcctggatggcatatccattactgtatttgatctggtctctgaccacagagccttggaatacttaaactgatgagcctgcttatgagctgtcttttacccttattgtaggaaacatgatgtctcttgatttacagattcatgatcttctaggttcatgctggagaagaagggttcaaaatgaagggtcataggtcaggcagaaatgagacaaacatatatattgttttagaattattgaatctgcctttttgtttctcttctaaagattttctattcagcgatacagatgtatcctcatttattaaagtgcttacataacgagcatgaagccttgtgcttagtcatggcaccacacacacacacacacggtgttttggtaatcatgttaaattttgtattgaaaacttcctttttatacagttgtataccctctgtgtagccattggtgccttgatccaaagcacattttcattgagagattggctgcttggtgttttagagtgggatgtggtgggctctggcttgagtgtcaactccttaatagaaagtgcacaagcaatattggcctatattgtgaatttttaaatgaaatctttaacctattaaatccactttatcaaatgttttaatagaaaattattttatcttacagatggatataaagctgaaaggacaagttgtcattttagatgaagctcacaacattgaagactgtgctcgggaatcagcaagctacagtgtaaccgaagttcagcttaggtttgctcgggatgagctagatagtttgatcaacggtaacataaggaagaaaagccacgagcccctacgagatgtgtgctataacctcatcaagtaagaatttttgtctgtcagtgtgttcatattgtctttttgtatgaaagacatgtgtttttgttttggttttggtttttcgagacagggtttctctgtgtagccctggctgtcctggaactcactctgtagaccaggctggcctcgaactcagaaatccgcctgcctttgcctcccaagtgctgggattaaaggcatgcgccaccactgcccggctttaaagacatgttttattatgtcagggtactttaaatttagtaaactcaaggatgctgaagagatgactcggtggctcagaggtcctcgtacttgtgcaagccaatacttcagccactaggccattcttcccccaacttattccttgtgtttatatgcagttgcatcccagtctgagagctgtggggttgagaattgtccacaacattgcttaagcctaagtctgggcctctagtcctgacctcgccctgcagtatgagtctcataaacagttattttttttatatctgttaagatatctaatatattttaactttaaatacagaatgaacttcttccctttgctctatcctactgtctcctcacgctctatattcatctttctcatctaaagaaacagcctgtcagctcctcaagtcaaatactaagtattgtcttggatcactgtttcacctcatcctccagttaggtagtcattgaaccctagagtcaccacttgtacagtgtgcttcgagtcaccctgtgtccatggtctcagtgttaccgacagcttcctcatatgactctgctttcgttcttttctttctctcataatccattcttttttttgtttttgtttttaaagacagggtttctctatatagccctggctgtcctggaactcactttgtagaccaggctggcctcgaactcagaaattcacctgcctctgcctcctaagtgctaggattaaaggcgtgccccagctctcataatccattctgtgtgggaagtctgaatcatcctttgaatacttaaaatactcactttctttctttttttaaaaaaaagattttatttatttatttatttaatatatatgatgagtatgctgtagctgtcttcagacacctcagaagagggttgtgagccaccatgtggttgctgggaattgaactcagggcctctggaagagcagtcaatgctcctaaccactgagacatctctccagcccccactcattttcttatttaaaactttatttcaaactttggataaatcccagatttcttgtcctcgtgctgaccagtcagtctgtttccagtttaattctgcagcactgtttgtaccattatctctactgcccattgtgattcccacactggctttctttcaggccctcaaaggagcaaagtttaactttgtaccagctattctttctgttttcaaacattttttttaaatcccctctgggactggccacttttctgcattcagttgttagaaaatcagttccaggagaacctcacagacataagattacagtaaccaccaagatgtgattagctttattttcatgtgcagggctacctgctgtgtgctggggactgagcctacagcctcatgggttacgcaagcactctgccccgggctctgtcttttgccctgatattccctttcttacatttttgtttgtgtttctgactccttttaatagactcggatttccagagtagtgaggactttgcttaccttgagtactgtcgtcacttttactcagatctttgctataaaatgacattcaagcttttattaagtgagtgtgcatatcaatatatattattttcaggtaattcttttgttgtaaatgtgaaccataaatacctgtttcacatccattttatgtgatttgatataaacacctcatacctatgagacttagtaaagcagtgcaaatccacaaaaagctcacacttgtttctttcttaataaaagctgacttctactatgtcagtgcttgttttacagaatggaatgtgcgcttgtggagatgggttacatgcgtatgtcctaacaatgtcaatggatgcatacagatccatgtatgagtaacagttctccccttccgctaaaacagtacagctaaggatgacactggttaattgaattgttttgttttaattccagttggttagaaacaaattctaagcatcttgtagaaaggggttatgagtcgtcttgtaaaatatggagtggaaatgagatgctcttaaacttatacaggatgggcatcaccacggctacttttccagttttgcaggtaagatgctttttctctaccatgatgtttatttagctaactaggtgtcatttaggagtgagaaaagccatagcatatccagtaaaatgtctagaattttaaaaattaatagtttaaaattgttttaaaattttcttatctaaatctgataatctttaggtgatggcacaaatatattatttagtttggacaaagtaagactttaaaggagttattcctttattcacagctaaaagaaatcaatattgtagggccgtgaaaggcagcctggtccctggttgagtacaggcttgaaaccctggtgaccttgcaggaatggtaggtgttttgccacgctcctggacaacaggtcctggcctgaggccacagctctccataggtttgtgactatcaggccgaaatgccccaaacacctccacaggtagaggatgtgaggtcacttagcctcaagacagatctccattttaatgaggtacctaaaggcctagaggcttaaccagtaaacttctcttcccagacactcttctctgcaaaaggtgtttgtttaaccttgggcccaccctgagaacgtggggtacaattttactcatcgccactgtcctccgtgacaataaatagagtcatagaatatacttcttatagttcatgaatcagcattagtgtgttattgtcacccaaaggccatggtttttctgacagcttagtccccatgttgtttagttcaactaggatttgcctagtcacccaccattaaggcatcatacagaatagatttgctgtcctaaaacatcctctatattgtacttcttcattcctcctgtaccctttgacactcctgaaacccagacaagcactcatctccttgctgactctatggctttgtcttttctagaatgccttgtgattggaatcatactatatataaatcttccctgtagcaatatgtagttaagtttcttgcatgtagggtgtgcgtgtgcacaagtgtgaatctgcgtctgcatctgtgtctgaaattggtgttggataaacgattggtgccctcctccttggaagactattctcattttccacagttctttgtgtaggattgaggccttctgccctgtccttctacattagcatgcctattatccttgttcagttcttgtttaggccttcatgttggtgagactttatgggtatggcctagcacacaaaatctcacagcaaatttttgtttctccagttttatagtctttccacatacccattgtcttctacagtgatccctgacttaggtgcaagagttaccttgtagatgtatcctttgggattgggctccataactctgccttttgattcattgtggttttctgtgatggtctctgactgttgcaaagagaagttttcttggtgtgaggtaaggtctacatttaatgggctaaacctagaagagggatttcaaggaggattctttttttgttatttaagatttatttatgtatgtatatatgtatatatgtatgtgtgtatgtgtgtgtgtgtgtgtgtgtgtgtgtacccatggaggcaagaagaaggcttcggatccccctgaaacgagttacagacagttgtgagctgccacatgagtgctggaaactaaacctgggttctcctccagccttgtttcttttcttttcttttttcttaagacttaatagtattgtatatgtttttgttttcagttttgtagataaggtcttatgtattatagtctggccttgaacttgctagataccccgattaacctaaactttcatcactaaccatatccttacttttcctcatggaaagatttgtatgttgaggaattcttgggtcactaatagcagtctatgcttaactcttcaatgcctctggtcttagttttatttccttttttattgtttctctaaactatttaaattttacttatcaggtctgggtgtggctcattagagtccctgcctagtagtagtctttttgttgttagtcagttttgtttttgagaaagtttttctgtgtagtcttggctataaaccaggctggcttcgaattcatagaaatccacctgcctctgtctcctgggtgctgggatgaaaggctctcaataccatgccctgctcttactactgttcttgaagacctgggttcatctaccaaaataatagcaagaaaaatgaatattagtaaaatatgtttatcatatgatagcctcattaccagacttacttcctatatataattcaggcatttagggaaaaaaaaactttattcaaatccattggtacttttaaattttagttcattgcttctgaaaggtactaaagagcatgctagttgcctgaagaagttattctcctaaatgtctttattaaagtgtctggctcagaggaatatttgttaacatggaaatccaaactccattgctgggcttgggtaggtcagttacagaaaagcagaaagccctggagttccatcctaactactgtgataggtaaagaggcaagaccagaaatgcaaagcgatttgagtttttgcgttcatgaatacctgcttcattttggtttgtattaatactttgcaaaggattttccttctgtcaaccctctacccacttaatgaatgatacggtaatttcttacagaggcatctctcagctgttcttcaaaaagaagagaaagtcacaccaatccatggtaaagaggaggcaatacaaatccctattatcagtgcatcaactcaagtcgtgctcaaaggactctttatggtgcttgactatctctttagagaaaatagcaggtaagcctgttttgttgggatgttgttgatgttgttgttgttgttgttgttgttgttgtgtttttagcctttggtcagtgtcttagtcagggtttctattcctggacaaaacatcatgaccaagaaccaagtcggggaggaaagggtttattcggcttacacttccacattgctgttcatcactaaaggaagtcagaactggaactcaagcaggtcaggaagcaggagctgatgtagaggccatggagggatgttccttactggcttgcttcccctggcttgctcagcctgctctcttatagaaccaagactaccagcccagagctggtaccactgacaaggggacctcccccctagatcactaattgagaaaaatgccttacagctggatctcatggaggcatttccccaactgaagctcctttctctgtgataactccagcctgtgtcaagttgacacaaaactagccagtacagtcagtaagatgtctcagcaggcaaaggtgttttttttttttttaatataagatggcaaccagagttccatccccagagctacataaaagtggaaggagagaacaagttccacaggctgtcttctgaccgccacgtgcatactgtagtacacgtgcacacatgcatactgtagtacacgtgcacacagtaataaatgaaaaaaattttgttatggttttagagctttattgtagaaaggcagagatgaagagagaaggtaaaaagagggagagagaggctggccatggccatgtggagggagtggggaagggagagagagaaggagggctagagatgagagtaagaaaggtgagagcttatagagaacataaatgaattttttaaaaattagctagatgagtgttgtttttaacttagtagggaaatcttaaatgttacagatatatatctgtaacatatatatatgtatgtatgtatgtatagattgttattgacagagacgtggatcaattgaaatgtgtctttttctcattaatgaaaataaatattgaaatcagttagtaagtgcacttaattagcttgtagtcctccagtgctaagtttaagcagtttcatttccttttaagtataattaggatctgtgtctattagtattcaaaagttcttttcttgtgtgttttgcttattttttccccctttcctttctcacgcttctccctctggccctgctcactctgcccccacccccaccctccattctggcccataggttctttgttttctcattatgggtggttgtgaactaccatgtggtttctgggatttgaactcatgacctctggaagagcagtcggtgctcttaactgctgaaccatctctccagccctgttttgcttgtttctatttaagacaggatgtatgtatcgtatcccaggctggcttcaaacctttatgcagcagaggatgatcttgaactcctgattatcttgccttccactccccagtgctgcgattacgggcctgtgtcactgtgccagcccatctcttaaaagttatagttcccggggcctagcaaacacagaagtggatgctcacagtcagctaatggatggatcacagggctcccaatggaggagctagagaaagtacccaaggagctaaagggatctgcaaccctataggtggaacaacattatgaactaaccagtaccccggagctcttgactctagctgcatatgtatcaaaagatggcctagtcggccatcactggaaagagaggcccattggacacgcaaactttatatgccccagtacaggggaatgccagggccaaaaagggggagtggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagggccccatctattataaatggttatgagccccatgtggttgctgtgatttgaactcaggaccttcagcagagcagtcagtgctcttaactgctgagccatccctctagcccccaattgtccgttttttcatttgcatcttttaattgttggtttgtatagttattatgcaattgggatatgaatcctctgtgagatataatactctgtggttccttttactgtgttgtgagttgcctttttacatcttgattgtctttttttaatataaggaaattattttgttctggtttttgttttgtttttggagaatttttggtctcattgtgtagccaaggctttcctaactttgcattgttctgccttaccatcctgagcccagggtctgtatatgagaaccacccagttgagcagatattttttttagttacaaagtcttgtttgcttaactctttttaaatgtatcttagagttttatagttttgggatttaaggatatttataaaatgctcttcacaattcctgagttcctgatttaagcttaaagatctgatttctctagcgatgaacttaggggtgaagtgccatgagagcatagttgaggatgacacattttatcaggagtaagcttgggcgttttatagattcttaggagcacaggctggggatgggatcatatatactctggtccagtaacctcatgaaaagaaacgcaagatgaagatccagtaaggtggcttggcaggtgaagatgctacagctaaaggtgaagactgcggacccaagcttgatccctgagatacacatgggagaactggttcttgcaaggtgtcctctgacctctacatgaggtcatatgcagatcctggagaaagcatgcccacacatacacaaatcaaaacaaaaacaatttaagttttataattatttcctaacacttttaaaactttgactaaaattaccttatttcctcatacaataaaatagcataacttgtctatgactttctttaactataattcctattttctacttagcagatataagttaaaaggttctgccatgatttattttacatcatgtttaaaaatgaaattggaaaagtggctaatgaagttagctgattagatttttaatatttcttgtaagaatttgttgagttttgtgatttcatggcttagtttacatcagaattcctgagttaactagtgatggggacagcattttcttctgtgggaaggcatgacactgttcagttttgaagttaccaggtttgatatgtatctagcttgatcgttatgttttatgttttgtagttcaattagcatcgtctttccatttagatttgcagatgattataaagttgctattcaacagacttactcctggacaaatcagattgctatttttgataaaactggagtcttggctgtaccaaaaaataagaaacattcacgacagaaaattggagttaatgcgctaaacttttggtgtttaaatccagctgtggtaagctcactctgtccaaagtgcaacttgtcttgactaggaccagaaattaaatggctatgtttagctttttaagaagatgatctcatctgtctggtgtttccttgcaggccttttcagatattaatgacaaagtacggaccattgttctaacatcaggaacactctcacccctgaaatccttttcatctgagcttggtgtcacatttagcatccaactggaggctaaccatgtcatcagtaactcacaggtaagctgttttgctctaccttattgatgctctcactctttttacctgagtgtaattccatataaatataaagaataccataaattcttataagcagagtctgataggcgattcccatgttagttttagagtcaaagaaaatcttgtcagctgcttaacagactcacagggtctgtgaaagggcacactgacgctgccctggaagcgttattgcattgcgtcaatgcctgcttcaaatgcttcctttgagtacagtttaggttctctacaggatctcaagacaagaaaatatttgcttttgtgtgatagttcctacttgtaattatctgtttctcttttctgttagactatggtatatatatttcatttattctttgttttgttttggtttggtttttggttttttgttttgttttgttttttgagacggggtttctctacagccctggctgtcctggaactcattttgtagaccaggctgtcctcgaactcagaaatccacctgcttctgcctcctgattgctgggtctaaaggcatgcgccaccacgcccggcatattcttttttttttttttttaagttattttgtaaggataccttcatgaatttatgtgtgctgtgttcatgcagcatgttcatgtgttccatgcctgcatgaaacagaagaggaatcccagcaactagaggtgcgagcagttgtgagccagatcatatgggagctgagaaccaagctcgggtcctttgtaaaaccagtacatagtcttaatcagtgagccatcaatcaccgctttgttttgtttagacagcatcttttatggcccacactaacatcaaacttgctatgtggtcaagggtgactcctggtcttcctacagtcacctttcaaatgctgatcttataggtttgagctagtagtacttctagctctgttttatgagtaatttaatgttagctacttacttaacatcattcttatatgcctaacatggctctagttctttgtgtgtgtgtgtgtaagtacagctacagtgtacttagatacaaaaataaataaatcagccgggccgtggtggcgcaagcctttaatcccagcacttgggaggcagaggcaggcggatttctgagttcgaggccagcctggtctgcagagtgagttccaggacagccaaggctacacagagaaaccctgtcttgaaaaacaaatcaaacaaacaaacaaacaaacaaaattatccatgtagaataaaatcaacatctgaccattttcaagtgcagagcttaatgttacatatagtcacttgttgcacagtcaatctcaagaacttttttgtttgtaagcagaatccttgtctttttgtgattggcattttgttttgttttggtatttacttggcataacattttgaagctttgttatactgtagatgatgttttcagtgttcatctgcagcagtgtgtatcaaattttcttgttaggcaacataatatatcactgcactgtatgactataccaaaatttgtttagatttctgtctattgatttttcttaactttttctttagaaaaattgtaatttttaaggctggagagatacagctcagcagttaagagaactttctgctttttcagaggacccaggtttagttcccagcatccaccttggttggtggttccccaacctgtaactccagctacaaagggatctgatactctggccttcatggaacctacacataaacatatatgaaattaaaaatagtaaaaataaatgtttttaaaaattataaatttaagaaaagttgaaataatgctcttaccatcttttgtttgttggttgttagcatttaataatgtttgctactcttccccttcttcctttggatgtgtgtgtagatgtcaatggagaagaaatatattgtctacagagagtaggaggtgggttgcgccctctgttatgggttgggaaggaagaggatttcccaaggctgaataaagtgttatgtctgccaaccctgtaactaggacttggatttgcttttgacagcttgatctttctggctgagggagagaagactcctccaggcacacttagaaacttttcaattgtttagactcatctggaaccagttaattttatcaccaaacttattcttctccattttcactttacccaaaaatgcaagaagcaacagccagcatcattgctttcttgtttttctacaaattgtcaaaaaatttatttgtagagttattaaattccttgttcctcccaggtggtgagtcagaaatatgcagtatgtttatctcagtaagttctttaaatagtacttactttagggctttctatgaaaccagtagtgtctctagtaacttaagtttcattgagttagttagccaccttcagacacaacaagcccactagagaaattcatccttaaaattctgtttctctataactgctccctactcctggtgttataatctgtgttgatcttggttttctaaagggagaaaattgctaagaatgaatataaattttaaagggagatttacaaattggcttactcatatggtctaggtagtctgacaataaccatgtcataccgagaggctgagaatctgtagttgctcagcccacagggctggatgtctccatagtcccaatctgaagctgaaggcctagggaggtcctggagagctgctggctttaggtctatattagaagcccagataacctcgttttaatcagtgaaggaatgccacagcaacaggatagatcaacttgccaacaagattgaaaccaaacaggcaaaaaagcatgtttgtttgttttttaatctgggctgccaccagaagttgccattcatatttagggtgggccttcctgcttcaaataatctggccaagcaagtccttccctggagtgtccagcaccttgtatgttagttaattccagatctagtcaaggagataaccaagattatctatcacatgtacagttttttaaattgttcatgtgtgcgagtatttttgcctggatgtgtaagtgtgccccatgcctgcagaggccaaaagagagcatgggatcccttggaactggttatatctttgtagttactgtgaggattacggtattattcaaaagttatagtaatttgattttggatcggtaccaacctaattatactcaattaattaaagatattaaagaaaatttctagtttcaatgtaaatttctgctaagtttgtttgatcatctttttctataaatcactcccaattaaatattaattttcctgttttatttagacataactctaatactaagatattcatttctaggtttgggttggtactgttggctcaggccctaagggtcggaatctctgcgctacctttcagcatactgaaacatttgagttccaggatgaagtgggaatgcttctgttatctgtgtgccagactgtgagccaaggaattctgtgctttttgccatcttacaaggtaagaaattgtttattgtttttgggggttggttttttttctctctctctaaaaaaggtatcagattaccatgataaacttcatagagtgagaaacaacaaggtaattataattcctccagtatcatgttattttatttatgatgattgttgcctgattatcttattactgcttcacttaaaattttaacataacttaggaaagataagaccttttttgttttgctataaaacatgttagttatattagaggactattcatatgcgatttttattctttcaggcagtttgtaactttcacgggtgaaggagagaggagcatgctttttgacttgaggaagtgaatctaagtgtcctttgtgcccattgttttatatcacgcctctctctggccagaggtgattgtgatcttttctccgcctccccacggcttcgttgtgctgggagcggggtcagtctcagaactgtctacatgctaggcaaatattgttccattgagctacatcctgggctttcagcctttaagtctcttgatctaacattgatcctttgtcctcactgtacagttggaccatggtggtttaagataaattctttcaatgtctgcactttggttgaaaagtttactttgtgtatacataaagcatttactattaaggaaagagctctgtgttgtgtttttgtttttttgttttttttttcttgagaaacggtctttgtatccctggctatcctgaactctgtaccaggctagcatcatactcacagaggtctgcctacctctgcctctctaacctgtgagtaaaggcgtgtgccaccacacctgccactatgcctgccaccatgcccagttgcttctgcctttgttttttttggttttctcttgcccatctctgtttgctcaatcattgatgtttttttcttttgtgctgacatgcagtgattttcttcttgttttgtctcatgtgtattttcagtaactttttagatttattttatgtgtatgaatgcattgtctgtatgtgtatctgtgcattgcacgtgtgcctggtgcccaaggagggcagaagagggcatcagtcttttgaccactcttctatcgttggcagcatgggtgtagcccataacttatagaacccttttctaatagtagaaatgactacacagagtaatgtattcttttccagctttagtaccacaaaataccatgtatgggatgacttaaacagaagaaatgtattttcttttagctttggaggcttgaaaccctagatcaggtgtgtattggcagtatattttgttcagaaatgtctgacctagacttgtggtagctacccttttgctgggttcttacacagaacttagcttgtgctttagtgtccttggtatttcttagtgttcaaatttcagccttttaatatcagttaaattgagtagaatccaccctgaagaactcattgtaagtggcttagtgtccaaagacgcgatcacattctgagggagtggtgattcaggcttcactgtagaaacttacagaaactgatagtaaaagcatgtgccactactgcctgacttaaattatatcttaagaaagttttttcaaattgtaaaatgtcagcccaaatataacaattttatattgtaagcttcattacaatgtgtttttctggaaggaatttaaggttttcttacctaggaacgtggcacgttcatataccttactaaagttaagtagtgagaccaacaatacagtgctacctgtcacttctcctggaaaagtgtacagacccggctggagagacggctcagagtttaagagcacggatagcttttgcagagatgggagtttggttcccagcactcatatctggcagcttacacttccctgtagttccaactccagggaatctggcatccttttatgaccacaaacacctacagtcatgtgcacatctctacacataaatgtaatcaaaaataagataagacttaagaaattaagtttcttttaaaaagtgtatgaactaatacatcttatccttcattaaaatagctaatatctcagtattgataaataacaaaaaataatagccttttgatattataatttatacacatagatgcaatacaaagtgagccttaaaactaatactgagacttgtatacaagttgacacacttcattttcaggtaggtcagttttgtagtttacactcccagcagtctcctacttcatgaaatgcagtgtttgtacatcacacatcggagacaagcgggggtttagtgagcaaaatatgaggaagaattgaagtcatagtattaaagatttttaaatggccagtgtttctaactagggataataatatctatcgatgacagcttttcaaaatgttcttagcatactggtactaaacaccattccctaactgtgacacaattggaatacctaataaggcattattctggtctttgatcttgtaactcagagttataaatcctgtttaatcacattgtggacagaggagaggtcagtagccgtgagggtgatactgagtattaatttttcatggaaggaaggcagtggctgcatcgtaccatctgcctaccagcccagctgagtcttactacagacatgctgttaacatgactgctgctgttttctgtcttagccatatttaaatgcaccctacatttctaagcaatttgtccttactcttttttaaaaggttatttgactaccattaacattgatacttttatcataaatagactctttcatgtactttccctttattttctgaccactgaaaattctgaaaatgtcatacattttaacatgtaagacatatgtaagactatagtaaaaatattaaagttttttacagatatagaacaggaagaggaagggcctagagagaaatgatggccctacactgtagttaaaaggtaagtgctacccacttacttttaggaagaccttttgcattgcaaggcttcacaagttaaatactaacttctgggatacagcatctcagagcatgcagagatgcctgggcttctcatggcctaggcaagttgatatatatcataaatacagttcccaaataaataaaaatcaaagttaaccttataaatattgactaaaattcaattgtacttgtaaattttacttttaaatacattttttgtgtcatgtagttgtacagttggcccacactatgtgttatttttttctatgtagaaagctaaatgatatgctaaaaattaattcatctttaggcttgtaaaataagaattcaagaagctttgagattttggtgtcatattcatagcaatgactcgtgttttaagcaaagttattccttctgtcaggaaaaaatatgcttcattaactcataaacttaagctaattccctaactacttgttttgatcactattagtttatcaaaactttgaatttttttaaaatatagaaagcctactaactacttttcccttaaaaattttttttatatatatcaatctcttgttacagtatgaatggaagtatctgtcacaggctcatgtactgagcccattttccagtcactaggaatatttctagaggcctttggggagtggagcttagctggaggaaggaggacatgctggggcatgtgcacaggaagccaggcagcctgttgaaccatgagctaaaagaaatagtcctccttttacaccgccgcaggtacttgagtcatggcttcataaaataactactgtagacaagtcctgtcagagatccaggtcgctgctttggctgactctgatcatgtggtgctttatcttctgaagttgatttgtaggagacatttggaagcaggtcaatgggcaattccagaaggagcttagaagaccagaatacctaagagaaataggcagaaatggctgcaggacctctgttggtaattggcctagagaccttttaaattgtgttcaagacttttaaacatttttttcacatcctaagactgtctgattataacaacaatgaaaaaattaatttgttgaaaggaatttcaagacaattgttttcaggctatggcatttttattcctgggacctttggattgtagaaagatttgaataatactcagtttggtcagaaaatgaacacatttaaattcatgaaaagagagcatgatacttgattcccactgtaaaccaggctaaaagtaactagggtccaggaagtagaaattcaactcatctgaaaactttctcttgagaagacagcgcactactcaagaaagagctgcctaagaaagcatcttctctgctaagcctcagggcttctcagaggctgctgctctcgtggtccttaggggcagctactgcttgatctgtcaacagatacttcagttgctgatttgatactcatcttgaaggattacaaaatacaagagtgcagggtcattgtacgagtcagtgttggctcaggacaccccaagaccaagttctcagcacaaagatttatttgccccagagggacgaagtgcagaaataagagagagacaaagacagaagatagaggatgagagagaaggggaagggaattatggagatggggtagaagtatttgtcccaaataggacaaaagaccgcctctggatagagaagagacagacatggcctgtaggcaaatgacagtttataaaggcatcaggagagactctttgttaggatgaggtatttaattttaattgggcatgttaattagatgagccaaagtgggtttttggttgctggacttaaatattttgatagcaggaacttggtaggtgctacaggaggaggaagcgataaataagggaatagaccttggtggctagcttttgtaatgtggtttttagcaaggcagaaagaatcaggaagatgggccaggcctgccagagcagagccatgtttgccatgctcaggccagccagagtccctttgtcatgaaggattctgtacttgtttctctttttcttgcagtgctggtaattggccccaggcacttgtggtaggcaagtgtccagtgaggccccactatatccattgagacaggtttttgcccaagttggccttaaacttgtgatcctcttgcctttgtctcccagatgctaggattataggcatgagccactatatctggcctcttccatccaccaatctttcaaaataattcctggaaagtaaggcaaatgtgaacagagttggatcccttgaacaatgtctgagatatgtgcagataagagtgtggaatctaagctatagtggaaactccaggattttaggagattcaaagaacaaaaatattttccaaagatagccatgaatgtaaccagccctagcgggtggccatatcaagtacaagacatagaactacaaattttaacatttgccttgctaggaatcatggtcctctttgagtcacattctttcttcctatgcccagattccttccatttgtactatgaattttaacttagtattatgtatgttgatagtatggaacttggcttttaaaatttgtataagcacttgtagctaagagtttgacctgactctcgggggaaactgaatttgaatttttgaacaatgttggaactgttaagactctgcagtcccttggggatgaactaattgcattttgcattatgacatagccatgagccttggaggaatgggacagggatgttgtgatcctcaagtgaaattcccctaaaggcacacattgtgcacagttggtctccagttggagaagcaattgtaggtttatgaaacattaggaggtggagcctagtaggttcctctctccctgtctctgtttcctttcagctctcatgccacacattcctattgccgtgatgttctgcccgagtgcgtgagaccaggcagacatggattaaacctcctgaaactataaactatatgccaaaataattattctttttaaaccatcctttcagccgttttgatcacagctgcacaaagtaactaatagagtcttcttttaaaatgtttttacagtgtaagtcccaaccatataattcacttgtttaaagtatagaattctgggctggagtggtagtttaatggttaaagtgcttactgctcttttaaaagacctgcgttccattcccagcacctttatcaggagaatatgattctctatatttgcatgcatgtggtgcacataaacttatgcaagcacaaacacataaatgtaaaaataagtctctgagtctggagctgtgtcccagtgattaagagaacctgttgctcttgcagagggcctaggttcagcttccagtacccacatggtagctcccaacgtttataactcaagttccagacgatctaataccttcttctgacctccatgaacaccagacactcacggttcatagatgtacatgcagggaaaacattcctacacataaaaataaacatgaaaagtaaagtgtaggactcaataattactaatacttacagtcacaaaattgtgagccatcaccactatcacaaaatattttttcttactacaaaaagaaattcgttacaatcattagcatatctaatttcaccttctattccctgtaaatactctcctattttctgtcttaacagaactgccttctttggcattttcatataaatgtagatatatagcatgtggccttatatgtttggattcttgacagcatgtttgcagagttctttgcaatagaatgtcaatgtatttttagtggctgaatgatgctttattctttcaacttgttaaggactgtagctctatagcacagcagtagagcacttacctagtttcagtgtattcaattgctactttttccttctgttcctcccttactaccttttgtgttaactagctattctctagtgttccgggtaaacttttcttactatgtttgtttgtttgtttgtttgtttgagacagtttttctgtgtaacactagctagctgtcctaaaactcagagatccacctccctctctctcctgagtgctgggatcaaaggaggacaccagccctagcaggccaagtaaatttttctaatgtgccatttcgattcccttggctttgtttctttgttgtttgtttatttaagacttgctttccttgtgtaattctgatcagttgctactgtctatgtagagtgtctgttcttgcaactgtctatgtagattgttcttagggcagtctctgactcagcttcccagatgctgggagagcaggcatgtacccagtctcaaacccttggggttttttgtttgtttgtttgttttattttgggggttgtttattttttaagatagggtctcactatgtatccctctgtcattcttgaactcactctgtagaccaggcttgtctcgaactcacagagatctgcctacttctgcctcccaaatactgtactgaaggcatatatcttggtttttgttttgttttgttttgttttattagtgtgtgtgtgtatgtgtgtgtgtttgtgtgtacgcatactcaggcacgtgtgcatgtgactgtatcaccttaccatttagtgatatagtttatattaatactaattaaattattatcagtaatatacaaaggctttgattctactagctttgttctgtcccacttacttgtatattactgttatacgactaaattgacttacactgcctattaaatttacttaagtacttatctgtgccagtgcttttatactctttttgttttgctttgtttttgttgttgttgttgttgttttttgaggagtttgaaggtttgcttgtttgttcatttgtatgtttttgagaccggtctcatcatgtagccctgaaattttcctcattgatcatgctggcctcaaattctgagagatctacctgcctctgcctcctggctgctttttaattcttatgaggatttgagtttctctataaagtcccttgatccagggtcccacatatgtacactcacaggggaactacttccccagtcctaacatgggctcttaagagtcagtcttgtggcagtagttcagagctgttccactggagcccagctgcagtgttgggcatagggaacgcagacttagggaagaggagcaccctctgacctttcattgtgccatttgcttggaccatgatcccgtgctgtaaccttccaagtgtttcagtgttcttcactgatctcattagatgacacaggaagtctggaggaagctggacttgaggtaattttccccacctcatgctgggtgaagctcttataaagtcttccttactagtgcaccacccttaggtttgggggatgatttgagcctattttaaaatggttagtttcccccttttcttgccaggaacaggaaggtttttcttggctctttattttcagagctgtggggttccaggaagggaatagctttaagaatgagagagccttcccagactctagaccccagagcttgctttcagtctacatttgtctccagcagtttctcacaatcatctttcggttgttcctgtcagcttatggttttagtttagtgccctactaaatacagctcagtggcagttctctgtatgtcccttttgcttagtttcaggatggcaactagctctatgcccttatttctcaattggtatccactaaaaattactgatttttggtttgcttagctttttgcttttttcttttttcttttcttttctctctctcttttttttctgtttttctttttttttggcttttttggtttttttttttttttttttttttggtttttttcgagacagggtttctctgtatagtcctggctgtcctggaactcactttgtagaccaggctggccttgaactcagaaatctgcctacctctgcttcccaagtgatgggatcaaaggtgtgcgccacagctttttttcttataaggcaggcgttgatgacttcaagttttttatatattggagctgaatttgtaaatcctaattttatctttgggaaaaatacattttttcagttgagttttataatgttcttatagtttacctgaaagatcagagtgcacttcctcagtcacccagcacagtgagtacatttatcaaatgtactgtccttcaacggagattaacaccgaccatgtagcagacaaagaacgtctgtattaaaatttccttcagagcaatattagggaccagattgaaatataaaaagaggaattgtattggttttctgttgtttcatagcaaacgaccactagcttagtactttaaaacagtgtacattatctctgagtcaggggtctgggcatgacatggctattttcttcttagtgtatcaaaagtccatgtatcagaggtcaactggagcagcagtctcaagagttttaattgggggaagagtatcacaggcttaatctttcaatgcagaaatgatgtggaataagtgttcactactatggtaatgagagtgattttgaggtgttagataacaaaagctaacagaattgctctccataaatgtttttcaacacgcgaatgggcagatactcaatggtctgtataccacgtctctttgtcttgttttatctgacagtcttcatttgtggcccaggatgttgagcctcagcaggcagttcatgcagcctggtttcttgatcatcttgctgtaggcaccacagtgctgagatttcaggccctcaccaccacaccaggcctgtttgaaatgagagatatttttcaactacaaactaaaattctctgtagttcacatcatcgatcagtatatcttaattccatatactaatatttattctattctaagaaagaacttttagtattttaattggatttctttgaaatattgaactatttatactgagaactgtgtttatagtactttctgaaaatctaattttatatctctctttttaattttttgaggaaataatttttggttgcatactttgtattt

SEQ ID NO: 242 - DNA, 995 bp, Mus musculus
atggatataaagctgaaaggacaagttgtcattttagatgaagctcacaacattgaagactgtgctcgggaatcagcaagctacagtgtaaccgaagttcagcttaggtttgctcgggatgagctagatagtttgatcaacggtaacataaggaagaaaagccacgagcccctacgagatgtgtgctataacctcatcaattggttagaaacaaattctaagcatcttgtagaaaggggttatgagtcgtcttgtaaaatatggagtggaaatgagatgctcttaaacttatacaggatgggcatcaccacggctacttttccagttttgcagaggcatctctcagctgttcttcaaaaagaagagaaagtcacaccaatccatggtaaagaggaggcaatacaaatccctattatcagtgcatcaactcaagtcgtgctcaaaggactctttatggtgcttgactatctctttagagaaaatagcagttcaattagcatcgtctttccatttagatttgcagatgattataaagttgctattcaacagacttactcctggacaaatcagattgctatttttgataaaactggagtcttggctgtaccaaaaaataagaaacattcacgacagaaaattggagttaatgcgctaaacttttggtgtttaaatccagctgtggccttttcagatattaatgacaaagtacggaccattgttctaacatcaggaacactctcacccctgaaatccttttcatctgagcttggtgtcacatttagcatccaactggaggctaaccatgtcatcagtaactcacaggtttgggttggtactgttggctcaggccctaagggtcggaatctctgcgctacctttcagcatactgaaacatttgagttccaggatgaagtgggaatgcttctgttatctgtgtgccagactgtgagccaaggaattctgtgctttttgccatcttacaaggtaagaaattg

SEQ ID NO: 243 - protein, 332 aa, Mus musculus
  VARIANT (1)...(332): Xaa = Any Amino Acid
MDIKLKGQVVILDEAHNIEDCARESASYSVTEVQLRFARDELDSLINGNIRKKSHEPLRDVCYNLINWLETNSKHLVERGYESSCKIWSGNEMLLNLYRMGITTATFPVLQRHLSAVLQKEEKVTPIHGKEEAIQIPIISASTQVVLKGLFMVLDYLFRENSSSISIVFPFRFADDYKVAIQQTYSWTNQIAIFDKTGVLAVPKNKKHSRQKIGVNALNFWCLNPAVAFSDINDKVRTIVLTSGTLSPLKSFSSELGVTFSIQLEANHVISNSQVWVGTVGSGPKGRNLCATFQHTETFEFQDEVGMLLLSVCQTVSQGILCFLPSYKVRNX

SEQ ID NO: 244 - DNA, 198522 bp, Homo sapiens
  misc_feature (1)...(198522): n = A,T,C or G
aatgtcaaattatggagacagacaacagaaaaacaactgcatgtataataaaatgtcaggcagtgataaataccatgacaatataagcagttcaactttatatttagaaaagttttttggccaggcatggttgctcatgcctataatcccagcactttgggtggctgaggtgggtggatcacctgagttcaggagttttgagaccagcctggccaacatggtgaaaccccatctctactaaaaatacaaaaattagccgggcgtggtggcccaaacctgtagtcccagctacttgggaggctgaggcaggagaatggcttgaacccgggaggcggaggttgcagtgagctgagatcgtgcctctgcactacagcctgggcgacagagcgagactccatctcaacaacaacaacaaaaatcaataaaataaatcaataaaataaatctgttcctaggagtttcagataagggattgaagatcataaaagctaacatctgtgtagtgcttaccatatggtaggtgctagcctaagttctttaaatatattagctcatttaatttttataacctacctatgaggtatagagtattatctccatttttacagagtaggaaaatgtgacccagagaagttaagtgacttgctcatggttacacatttagtaaatgtcagaaccaggattcactcctaggcactctggctcctgagtcaacaacaacaaaagaaaacaaaacaataacaataacaataaccaaaaactcctttccccaagaaccatgattataaagtagtctaacctcactttataataagttcttaatcacttagctcaagtaattgttttctctaccttaggcagtagctgtctatcagaggtggatgtcatgtattcatttttattttttacttctttctgctagatgagagtgattttagctctcctttatatataggggcctcaaatatattgccattacccctcaagctactgctctgtgcaatgatgctcaagcctgtagactgagcaatgagttgtgcaggtggaatggatggtaaggtagactctttccttgtgaaaccagagccttaaacaggttgaaaaaaagggaaatcaggatagcatactgggaaaagtaggagattaagaggaaggaaaggacattctggtagaagtcatttttgcctagggcctgttttggatgtaactgaattcatgatactcttctagtagatattcttaaactggagtccatggatctattttagagatatgtgatatcattatgtaatgatgtttgtttatgtatgttaatttttatcgggagagggtacatagttttctttagattcttaaggggttcataatcctaaaaaggtgagaaccactgctctacagattgctcagttctgctcttagaagtacctctttgtgtatgtgtgtttaagaaattagttattttatcatatctgttcatgtgaaaataaaatctgatttgttttttaacttcttagaaacttcttactttttctatgttttgtttgcttataggatagtgcagctgtccagattctcttagagatttgcctacctactgaagaggagaaagcaaatggtgtcaatccagatagcttgttaagaaatgttcaaagtgttattaccaccagcgctccaaataagggaatggaggaaggagaagacaatttgctctgtaaccttcgagaagttcagtgccttatctgttgtctcttgcaccaaatgtacattgcagatcccaacattgctaagcttgttcactttcaggtctgtttccaaagaatgatgctttgtgtttgaactttatttttcttgggggctttgaatactatattaacagggatcatttagaaaccagagaaaacacaaatgatccatgggcttttgcaatatggagaaaaatccagatttttagttgtttttttttttaacctaatgaaatgttcgatagtttaatctctattctagtgcatcagaaaagtgaaatgccaggttacatatggggcactatagccttctgagcaatttttacagaaaggaaatgaaatctttcatttgtatttttatctgtacttttatagttattttatttctgacttttttcccgtttcttgttgagatagggttatccatgtgaacttttgcctctgacggtcgcaggtattccatctatgcacatctgtctagatttcatacctgagcttattgcacagccagaacttgagaaacaggtaatgagcattttggagctttaggacaattgatctctctctccagtcttactagttatacaaaacattttataatttttaatacctaaagatattcttgagaaacatgtaataactggattttgtattgcagatatttgctatccagttgctttctcacttgtgtatacaatatgcattaccaaagtcacttagtgtggctcgtttagctgtcaatgtcatgggaactttgttaacaggtatgtagccaatcaacatcaacaaacatctgacataaattattatagttcctatattttctgcatttagtgatgcaatatgttttttctgtcactctgagacagtatgatacaatatgtgttaaatactagtttaacttatgccgtcttttgaattcttcttttggaaacttctgtttacaaatgtgatttatagtgtagtgggaatgaataggtaggcaaattgtatttttcattttgtgaatgagtatatatagatttgtaaatataagctttctgtattttataaatggaaaacaaatacactttcagaatgtaattgtatcagtagataacaaatgttcatttattacaaatgctcagagttccagaaaaatatcatcatatgtataaatgaaagataaatgtattagatgtcttcataagttctaaaacatattctgatattttaaccaccttctggtttgtagaataaaatggtctgaaaataaactactttaaaatatatgaactataatgcaacccttaatgtaatggcatagttaacttagtattctttctcattataatatttccataataccctgttgtttttcttttcatcgtatttatatcctgttataattatttgtagtgattaagagtttacactgcctgaattcaatctcagccccaccactaactggcttgtgatctttaacaagtttcttaacctctctaacctttttttaagagttttctcatatataaaatgagtgtcataatagtactttggtcattcataagattgtaggaattcaatgaaataatgcatgtaatgtacttattgcaaaacttgtgcataataatttgtatcttggataaagactgagactactagattgtgagctttctgaagacgggttggctgtgtttagagaacttcatatctccagcacagagcatagttccccttagtatgttgtgtaagctgtgttgaatttatatttgtaaactaaaatattgtttcatttttttccaacagttttaacacaggctaagcggtatgctttttttatgccaactctgccaagtttggtctctttttgtcgagcatttcctccattgtatgaggatattatgtctttgctgatccaaatagggcaagtttgtgcctctgatgttgccactcagacaagagacattgatccaattattacacgtaagtggtaacttattttcaagggttatcttaatatctcaaacaaaaaggccaaattcctttccaaatttcttggccttaatgttttttttcccttatgttgtaggtcttcaacaaataaaggagaaaccaagtggatggtctcaaatctgtaaagattcatcttataaaaatggatccagggacactggaagcatggatcctgatgtacagctctgtcactgtattgaaagaacagtaattgaaataataaatatgagtgttagtggaatttaaaacaaaatttaaaacaacaaaaagttgtttgctgcatatacccaacatgaatctgcatattagtaacaactctaaactgaatgggaacagtaaagtattgtcttggaatcactaaaacaattcaattcaacatgagtatagtttagaactttatgagaattatgcttgcttgtttctgattggcacatctttggatctactttgctgatatgtttctattgtagcagctgagctttttttttttccactgggaacacatgtaagaaactcattattggaaagggaatttggccttgtatttagcttttgaagtgaagactgccatgcctttaatttcttataaaaatgagtctgtgggtagccctagtgtttattttaactgtgagcttgtaacagaatgtgacaaagatgcaaagatgggagaggaaaaaagggtaaagggaaaggagaattaaggaaataataggagttaaaaacacaagtagaaatctcaaagatttgcagtgcaagtaatagtaatgcaagttggaattctagttctcaagaaagagtattgagaagacttttaaaaaggcaagtagcttttgtaaatgatttctgtggaaatacagatgaggatttaaagatttcacatatttgcttcaatttttattaatatatgaagccatatgtttaaagagatacttgaataatttggaattttaagatactggtgtaaaagtgtttacagaaacatctttgttcaaagaagaacctgagagatctcatttagttttatgttttaaatttatttttataatgctttattaacttacctaatgctcagaggggggaaatatgtatcaaattaaatgaaggtagagcaataaaacccactggattaaagagctcttggtttgtcatcaggattataattcatatcttactttgagaagatctttgagtaagaaaatgcagtgtttgaacctgaggaaaagttaaagtgtagaaaatattgtcttgccgaaggattttgcagtcctctgtcagtaacttccattgattaggcagacatattcaggtaaaccctaatcattaaaaaaaaattatcaatgtagaaagtaattcccttttttctctctgagatatacctcaatcacacacttccccacccccacttgaaacagacctcttcacttgtgttttttttttttttttcctgaggtggagtcttcccctgttgcccaggctggagtgcagtgggatgatcttggctcactgcaacttctgccacctgggttcaagggattctcgtgcctcaacctcctgagtagctgggactgcaggcacgcgccacctgtatttttgtatttttagtagagacgggggtttgccatgttgcccagactggttttgaactcctggcctcaggtgatctgcccaccttggcctcccaaagtgctgggattacaggtgtgagccaccgcacctggccagaccgcttcacttgtaaaagaaattaggctaataagaaggtgtagtttttgagaaatgaaatttaactttagccttttcactagtaaatagtcacatctcattttcttcctttgtaaaatggggttactactggccctacctcatattctatgagaatgagtttgtagctgtttcaaatcatgaagtgcatagtatcacatgtgatagaatatttataactttttattagatgcttaatgttcaattaagtaattttgatgtgaaaaataaaagtaataaaagtatcttaaaaatagcataagaattttcatatttttaaacaaggcagttttgtagtcccttaagattaaatacaactgctccttttttttttaaactgaggccttgcgatattttgtgtgaatagatatgccctaggagttcagaaaaagttaaaagtatgttttctaattaaatgcagtgcacattcctggatcaatattcaaagactggtcataacctgctgtgttaaaataatcacatatgctctttttcatcagatttgttgatgatgtaaataaaatgtgtaaatatattagtaaatgttaatattcatgtattttaagttaaggttataaaatttgtcacaatgtgtttttttattcaagtgaaaacagatgtgtgcagctattttgaatattggtttataaacattcatattctttatcaaacgaacctgtagtttttgtgtttcattccactagagttaacctgaagggaacggttcaagggactgtattcgaggtctgtatggctccagggcctacgtgtatccctttctgttatgccacatacattaaatggcaatgcaaggtgagagccagttgaaactcttagtaatttaggagaggaaaatgagagtagttatactagagcagttactcaaaagagttgattttttttttttttgagacggagtctcgctctgtctcccaggctggagtgcagtggcgccatctcggctcactgcaagctccgcctcctgggttcacgccattctcctgcctcagtctcccgagtagctgggactacaggcgcccgccaccacgcccggctaattttttgtatttttagtagagacggggtttcaccgtgttagccaggatggtcttggtctcctgacctggtgatccgcctgcctcggcctcccaaagtgctgggattacaggcgtgagccactgcgcccggccaagagttgatgttttaaaaattataaaagagaaatgacaatttgaaggtatttttaaggatttatttttaaacattatccttcctttcattgtcttaacagtaaattacttcatctttgctcattcatatgtattttcacattactgaatccctaacacccagtttggggtttgctttgccttttttcacttaaccttatatgggattttttcttgcaagtttaatttttataagtttattggcttcataatgtattgaattcatctgtcataaccacctccatattactagactgggaagttcataatttttttcagtattaccaatagatattattgtcaattgcggtatcacattttctttcgtttagattacgtctttaggataaatatctggagctcagattactaggtcaaagggtagagtttatttttatgactacaagttttgtcatttttggtaagatatatcacaattgacaatgaggcaaacaaatcaactagccccctcctgctctttcttcccagcaaactccttccccaaactagttacttgaatttgagaaacagtatgaggttttgccttttggagacattattatttgagccaagtttaggttatacagattttttaaaaaaataacatgatttggcaagatcatgatgaacctccttttctttgagtaaattaaagtactactggcaaataataaactggtcttaggagggatggaaggcggataagccttaatggaagtagaagtgatctgatactggagaccctgagagcttgtctctggcttattttagcatccgggaaagccttgaatattatgaaagatagattgtagcccgatgtcacagagccttcttacttaagtttggctcagcagtctggcaattcccgcctgagtcttcgctatcctggctactgcaaagctgggtaatttaaattgagtggcactgataaatgctcaaagaacttggcaaagcttaaagatacttcctttccgctggtctacggacgtgaagaatgagacttccagtttccaaggaatttgctgcatagactctatcgccggtttcaaaagtcaaactgagacgactttctactttaaacaaacactagggatttgctggagtggcgacaaccttccgccgcgtaccttgagcccttgtttttttttttttttttcggagacttccattggatgccgaagttctcgccccctcacctcgcaccgggactggttgattcctggccttggcgggtgattggtcgagctcgctgggctattgggcgctgggagtcgagggggcgggaggcgggaattcgtctcgggttgtgtggttgaggggtctggtgggtcgaggaaaggtaacggcggccccagtcctgcacacaaggccggggaagtagcagcacccccaggaagagggaggaggaagggctcgtgccctttcttctcttccagggctccgctttatttgctctcagaagtcggtttcctttccttttcttcagtgaatcggagctcagagcgttgcttcggtttccctccagacaggcaagtcggagggaagtccacggaaagggcttgagttcttctgcacagcctgcgggcccatgggtggtgactggatcaccagggtctcggggatctcaactggctgggggaggagggagatacggggcagaaaacctgaggagggagcctatccttacctcctttgagcgcaggcctgttcttagcccgggcgctgcgttaattcttggcgggaggcagaggggtgtgtttatcctttatgcaatgtttgggggaagctaccccattttgacactattgttgccacagccggggtacaggacgggctgatttctagattatatctgagtaactaggccagcgttgagttgttgattcatattaagaggttagattccaccatacctcattctcagagctttacagatagaatcgcaaaatgttagagctggaaaataccctagaataatggttcttcttttggagcacacaagcagtggtgaatgttattattggcttcataatctattgaattgctattttaaccatctcttcgtccccaggttgaatttacaattttttcccacgactgcaaataattccttatttaataacagtgcatgtaatttcccccgctattttgatttccttgagatatatttacgggaagagaaatctatggactttttcttcagaaaaatgcaatcatgtacagaaacttatgcttgcaatttcaagaggtcattgtctctgaattacatccgtggatcctaggttaagaaaagtggtttagaagaggtgaggattaaagtgatcctcatctgtatcagatcctgggttaggtacattctgccctggctaattttcataaaaaccctgtcaggtaagtagtagtatttcaattccatatatggagaaacaagctctgagaagttaagtgattcacacagtggaattcaaacttaggattgccttactccaaagcccatcctgtttctataatactctactgatcttcaaataacatttttgagtgcctactatgtgccaaggcattctctttcttataacagcctttaaattaaattaggggttatcacaggtaaggatcttagactagagaagtaaaaagatatgtcaaagataacatacctgagtcaaagataacataccaggcagtataccaaaacctggtatagaacctatgcttcctgacttctggtcaacagcttttttcttctaactggaggactgcagaaaggggtaacacaaaggggaagaactggagaaagagtgatgctacggagttgtagagagagaggcctcaggaacttatttgtttctgtaggttgattacatctgatctaactgttacaagagctcatgtttaatctggtatgtactttatcatatttgcacattatttcacttaatcattaccacaatcctatggggtacatgcagtcactgtggcttagagaaggtaactaactttcccgaagtcacacaactaatacctggcagagtgaaggatacaaatctagatttgttagactctaagacatgctcttgaccgctgtgatttataagactaggaaattattttgtttccatttgttttgtttatacttttattaattccagtttctgtttccagatttctcccttagttttggttctctggttttctttgtaaggcgtgtctcaatatttgacattttcatttctgttgtagttaggaatctgaaataaacaggaaagcactatgtcttcaatgtggtctgaatatacaattggtggggtgaagatttactttccttataaagcttacccgtcacagcttgctatgatgaattctgtaagtatttttcagcagttaagtttttattaagatatagatacttatgacccataaagtacattgagtatttgactgcattcatattctcagtaaatggagaatattttctgggttcacttggaagaatatctaacctctgggaaactactgattgcagctaaactgtatatatctgtggttaaggcaaagaagaacattctgaaaaatgttctcagctcatttggaatttctatacttttaatgaaaaactgctatacttttaagtaaaaacagagtatttactatcttttacacagaatactatttttctcaccattgttttgtttggatcatgtagaaaattaatatacaaatttgagtaaaccagctttccagttttgttacagctattttgccatatgtacttcatatcttatttactggtaacaagattattagtatcctgaatttgttcttttcctttcctagccatgtttttatacttttattacatatatatgtatccataaacaatatagaatattattttacatatttgaaactgtgcattgatgtgatacggtaccttactttttatgcagaacttgagttttttaacttagcattatttttaatgtatagccctgttgattcttaatccattttaattgttgtataaattccattggatgaatataccagaatttatctgtccattttcttattggtagacatttaggttgtttacattcttttgcagttacaaacaatgctgctgtgaacttccttttttctttttgtttttgagacagcgtctcactctgtcgcccagattggagtgcagtggcgcgatcttggctcactgcaacccctgcctcccaggctgaagctattctcctgcctcagcctccccagtagctgggattacagggatgcgccaccacgcccagctaatttttggatttttagtagagacgggttttcaccgtgttggccaggctggtctcgaactcctgacctcaaatgatccacctgccttggcctcccaaagtgatgggattacaagcgtggctgctgctgtgaactttcttatgcatgtttccttgtgttcatgtgggaaaggttttgggtgtacacatagaactggacttgctggagctgggcatcttcactttataagaaattgtttatttctctaccaagtagttgtaacaatttgtactctcactagcagtatccttcattaagttttcatcaaatatattgataggtagtaatgtattctggttttacagaaatcattgatgcttgcataattctggcacagattcctcttttcatttcttctcttgtgcttgatattttagtaagataatcttagggagaggtgtaaaggaatacagtttggatttaactaaatatgagttccttctgctattgttgtgttccctggagtgcaatctcacttttccttgctgttctatttaaacttcagatggagagagacctttataaagttaatatgtttattattttcattggtttctgtgttcatagattctcagaggattaaacagcaagcaacattgtttgttggagagtcccacaggaagtggaaaaagcttagccttactttgttctgctttagcatggcaacaatctcttagtggtaagtagttgcttgatatcttcaggttacttactgggatctgagaaaatataatacagtattctttatccagactggttcagccatgctgtcgctaacttaaatatttgtttaaagatgtttctttgaaataagttataaatcttccaaaagagtttcaatatagcaaaatatgtttaattaatgctaaaatagtattgaacataatttagtcttttgatgagtcggaaagtacataaagacttggcagcctgggcagcatggtgataccccatctctacaaaaattgacaatcaattagccaggcatggtgatgtacacttgtagtcccagctacttgggagactgaggtggtaggatcgcttgagcccaggaggtcgaggttgcagagagctgtgattgtgcactccagcctgggtgaaagaaaacaaacaaacaaagttttggatgcttagagttattataaaaataattagatgataatttgtatgtaaaagatgcaagagatgggctgtcatgatgctgtaacacatactaattgctttttttggggggggaaatcctttaatatatttgcttacctgttcctttctcataacatcagcacatggaatatataaaaaagaatacattctagttgatctttctacttgtttaaatgccagataaacagaaatttagtataatattgtttgtatgaatttatattacttcccactacttttcctttttttttttttttttttgagtggcgtcacctgggatggagcatagtgatgtgatcatagctcactgtaacctcaaactcccaggctcaagtgattctcctgcttcagcctcttaaatagttgggattataggcatgagccaccaggccaaactatttttactttgtttgctaacaaatgcctattaatatttacttctatgaaagactatataaactacataatgaatcagaaatataatattggatacattttagttacattagatggctttaacctaaagtattaggagaattgaggttaaacatggtatgtgtatgtatgtatgtatgtgtatataggtatatagatacatttttaaaatgaaatgtttgttactaataagagtatattaaggctgggcacagtggcgcacgcctgtaatcccagcactttgggaggccaaggcaggtggatcacctgaggttggaagtttgagaccagccagaccaacgtggagaaaccccgtctctactaaaaatacaaaattagcctggtgaggtggcgtgtgcctgtaatcccagctactcgagaggctgagacaggagaatcacttgaacctgggaggtggaggttgcagtgagccgagatcgcgccattgcacttcagcctgggcaacaggagcgaaactctgtctcaaaaaaaaaaaaaaacagtaaatacttcataagcttttggttgttcattttgattctcactgacgttaattttgggaaaaatgagtttatcggtactaacttcaggtcttaatggcagatgtctggaaaatagaattaggaatatttatatggtacaaatgggaaaacaatgtcaatactgattatttttaaaaataaattatttagcttttttgggggtatatgaattgtacatttgtatacaatgtaggcacacaatgtaaacttattacaatttggtattatatttagcactaaaattacctattttattgatttgaatattgaccttaaaatgtattttgatgcaagtatcagaattaatacatcaaaaaacatgtttctatttgaaatagaagtataattgggggaatgatttaacccttatgtgttagattattatctaatatattgaactttcaaattcttcatttagggaaagagtagtaattaaggatatactttatgtccttgtttcaatccattcttgaattttagataaatcttaatataaatgaatacttgagtagttgtacttttattacattattaatcttagattattagatttttacagattacataaatgggtgataatttccctataaatgtttttgttttggtttttgaaacagagtcttgctctgtcgcctaggctggagtgcagtggcatgacctctgctcattgctacctctgcctcccaggttcaagcgattctcctgcctcagcctcctgagtaggtggtattacaggcgtgcactaccacgcctggctaatttttgtatttttagtagagacagggttttaccatattggccaggctggtctcaaactcctgacttcaattgatgtgcctgcctcggcctcccaaagtgctaggataacaggcgtgagccactgtgtccaaccaaatgtttttggcttatttctctcctgtcctaatttgatgctgcagataaagtgaccagcttgtccaggtttgccaggtaccttcctggtgttagccctaaaaatcttttatcttaggaaacctcccaatcctgggtgaactgggctgtagagaatgattgatgtttatttaattagatatattataaatagatgttctttcatttttagggaaaccagcagatgagggcgtaagtgaaaaagctgaagtacaattgtcatgttgttgtgcatgccattcaaaggattttacaaacaatgacatgaaccaaggaacttcacgtcatttcaactatccaagcacaccaccttctgaaagaaatggcacttcatcaacttgtcaaggtaatttatattttgcctgggtcagttgatatctgtaataagagtcttaattattactgttataagccctaatttatataagtttggttagcataactgattatatatctctatctagtttctctggaatgattttaaaatagcacagagtggtcaaaaatccatagacgtttttaaattcttggtttgacttttaatttattgagacattttgttgtcctaaataattttttaaggaaggcaaggcaaaataaatgattttccaaaattgatgttatttgtagccattattgttaattatatgttagaattctataaaacaatgtttgtatcctaagacgaaatctaattagcctcattgattcattcttgataagtttgcctggccttctgaggccagtatcctacataagtatcaggtatgtttatgtgtgatctttaaataatttttactaattttagagaaatacattaagagtaacataagattattaataatatatttaaaaaatatttcacctgcttttggctgtatagaaaggatagactattatttacctaagaaacctagggaacatcctggacactttgctctttcttatttcttcatgtacatctccatatccattggtacctccatagtccaaactaccatttcttgtttagagcatccaataacgcttttttctgcttttactcatgctattcctttaccagtcactggcagggagacagaggttgccatgattgacttaagtcaaaacaaagagtatccatttcctaaaatcaaggatggagtcagcttcctctaaagcatgtgactatatagaggagggtagatgattgaacttctggtaggaatgaggaaagagaagtggaacagttattaaataggtgaccaatagtgttgtctacattgttttgattttggccttttggatttcttccctttccttcaaagatttatgctttctccttcctcagagcctttgcttctattagtgtctcttctgagcaaagttccatcttcaatttattatccttttcttcctcagtttacatgtgacttccttggggtatccatcactgatttttctgtcagagtagatttgattttcctattatagtctgtcttctccttgtgtacctttcctttatagcacttgttacagtttgtattatatgtgtctgtctaaatcttttattaatctctgcttccttggcagactacttcatgaggttaggaatattgtcaatttgcttaccattgtatccctagaactctagcagggtgcctggcatatggtaggtgctagataaatatttgttgttaggaatgaatgggattaattttcagctaattataggaattctggtgtataatatttatatacaaccttttaaaaacagctttattgacgtttacttgacataacaaattgcatatatttaaatggtactttttttttttttttttttgagacagaatctcactctgttgcccaggctggagtgcagtggtgtgaccttggcccactgcaaccttcacctcctgggttcgagcaattatcctgcctcagcctcccaagtaattgggatgacaggcgcctgccaccacacccagctaattttttgtatttttagtagggacaggattttaccatgttggccaggctggtctcgaactcctgacctcaagttactcacctgcctcggcctcccagagtcctgggattataggcgtgagcgaccacgcccagcctaaatggtacactttgatacattttgacatatgtacctccatgaaactttcaccagaatcaagacagtgaacatacacaccaaccccatattcactttatccaaaactttttaaacatgctcactttcccaaaaagttttctcatggacttttgttatccctctttcccacccctacatgactcacctccccaaccaaccacctgtctgatttttgttactatagattagtttgcattttctatagtttatataaatggattcatacaggatgtatacttattttgtctggcttctttcacttatgacaattattttgagattcctctatgttgttgcatgtattaatagtttgtttctttttatttctgagtaattgtgcatggatataccacaaattggttattggctgtttatgtatatttgggttattgctagttctgggctattacaaagacagatactgtgaacatttgtgtctacatctttgtatggatgtatgttttcatttctcttgggtgaatactaggagcagaatgaccagattgctttgtaggtgtgtatgttttaacttttttttttttttttttttttgagacggagtcactcttgcccaggctggagtgcagtggcgcaatctcagctcactgcaacctctgcctctcgggttcaagtgattctcctgcctcagcctcccaagtagctaggattacaggaatgtgccaccacacctggctaatttttgtatttttagtagagatggggtttcaccacgttggtcaggctgctctgtagctcctgacgtcaagtgatccacccatctgtgcctcacaaagtgttaggattacaggcgtgagccaccgtgcctggccaactttttaagaaatttccaaactgtttcatgaagtggtcataccattttatattcccatcagcagttatgagagttccagtttcttcacatccttgtgaacccttggtatggtcagtccttttaattttagccattcttttttcctggagatagggtttcattctgttgcccaggctgggtacagtactgtgatcttggctcacttggctcattgcaacccctgcctcctggaaccaagtgatcctcacacttcacactccctagtagttgagactactggcatgcaccaccacacctagctaatttttatagtttttgttggttttactgtgttccccaggcttgtcttgaacccctgggctcaagtgatctgccttcttcggcctcccaaagcactgggattataggcatgagccaccatacctggccttaattttagctactctaataggcatgtggcagtatctcattgtggttttaatttttatttcccatattttcatgttcttattagctatccatgtatcttgtttgatgatatgtctgttcgaataattgcctattttttattagtttgtgttcttactgttaaattttgagacttctttaaacattttgaatacaagtctttgatcagatagaattttaggtttacatttaggtctaagatccattttgagttaatatgtgtatatggtgtaaggtatggattcaagttcatttttttgcatgtggatatccagttgttcagcacctggatatatcgaaaaggctatcctttatccactacattgcctttgtgtctttatcaacaatgagttatccatatgtacacaacttgattttgacattactgtgagtcagtgttatttagaatagtctaaatgggaaaaatcaaggttgtattctgatacgctctttatatttgtaagtaaatcctttaatctgtaacctaaatatagaaaaatgcaaatcctaagtatataacttgatgaattttcactgtcataactactacatagattaaaaaaaaaagagagagacattaccaacaccccagaggccctcctcatcttctttttcagtcactgtcccttctttccataggtaattcttgtcctcctgtgaccattgatgagttttgcctttttacagaaatagagtgaaactccatctcaaaaaaaaaaaatggaattatatatgtaatcttgtgtctgtcttctgcttaatattgtatttgtgagattcattcatgctgttgcatatagtagtacttcttgtttctgtgtattatttccttgtatgaatataccacagtttattaatctgttctacagttgttaggcattgggttgttttcagtattgtttaatagtgctgttatgaacattcttgttcaaagggtgcaaataggtaagtattgtctgtagacacatacctggtcatagtatatacatatgttcagctatagtagatactgacaacattttctaaagtggttgaatcaatttatgcgtccccggtcagatccctccaacccctgcagcagtatatgaaagttgttcaccatttttgttagtacttgatatttatagtttaaaaaaaaagttagtcattcttgtgtatgtgtggtattctcattgggttttagttagtatttctctggtgacttcatatgtttattggtcatttggataccctctttagtgaattgcctaatcaagttgtttgccatttttcttttgttttttatttgaggtggggtctcactctgtcgctcaggctagagtgcagtggtgcgatctcaactcactgcactggccagctcccaggctcaagcaattctcctgcttcaacctcctgagtagctgggattacaggcacctgccaccacgcccggctgatttttgtatttttagtagaaatggggtttcaccatgttggccaggctgatctctaactcctgacctcaaatgatcactcgcctcagcctcccaaagtgcttgaattacaagtgtgagccaccgtgcccagcctccatttttctattgggtatttcttaggtttcttgaagattttaaaaaaacataatcgggagatatcttctttctttttaactttgtatcttaaagattttacccctttgatgaacttccttcaaactcccttgctatcaagaccaggaagataagcctttttgtatgtgatgataatatgatttttatttttatgaattggggttacccttatttggcacatggcagttcagttttctaaaactaaatgatcattttgggtggacattccctaccctcttaataggcccatgtcagtttgccccgtatttatttgggacagagtttctccacagtggcactattaacattttgagtgggataactctttgttgtaggagctctcccttgtgagatgtttagcaatacttctggcctttatgcactggatgctagtagtatttccacctctgctctttttgtgacaacgaaaaatgtctccagacattgcccagtatgcctgggatgagaagtggtggtgttaaaattggcctggttgagaatcactgatctaggtttattttgtggttattttactggttgcctggacatgcagagctcaaaattacctatcttatctaaaatatatatggaaatgcaaaggactaaggatagccaggatgcttttgaagaagcaggtcaaggtgagagatttgatccaccaaatatacggatttattgtgtgtaaatatagagtaattaagacagactgaggttagcacagtgatagactcatataaaagtatagagaaccctaatttggtcccacatgtatccagaaacttgatatttttatagaagtgcccctacagcttgtaggggaaaggaagaacttgggtggtgctaggcctgttagatgtccatatggaaaaaattgaaattggagccctactttataccatatacaaaagcccattcaaggtagattaaagacctacttctgataggcaaaactattaggatttttagagtatagtggttttcaaactgtgtttctaagaaccttataaagaaagaaacatgactcataagggaagggggaaagtggatcagggaagttctgggtctttcatccctattttggaaattttaagcaacatttctttttttttctttttttgagatggagtctcgttctgtcacctaggctggagtgcagtggtgcgatcttggctcactgcaacctctgcctcccgggttcaagtgattctcctgcctcagcctcccaagtagctgggattacaggcatgcaccaccatgcccagctaatttttgtatttttagtagagatgggctttcgtcacgttggccaggctggtctcaaactcctggcctcaggtgatccacctgcctcggcctcccaaagtgctgggattacaggtgtgagccaccgtgcccagctgcaacatttctttaagaagaaaatattcctacactttagaaaaaacttgaaaatcagtgctatgtggcataggttcatttctgagtttatgtaatctcaagctttcttttttttttggagacatagagtcttgttctgttgcccaggctggagtgcatggcgcgatctcagctcactgcaacctctgcctcccaggttcaagagattctcatgcctcaacctcccgagtagctgggattataggcctgcaccaacatgcacagctaattttcgtatttttaatagagatgggatttcgccatgttgcccaggcaggtcttgaactcctgggctcaagtgatccactcgcctcggccttccaaagtgctgggattaaaggcgtgagccactggggccggcctcaaatttgtgttttgaaaacagtattggacctgctcatgtaggtctttctctgctgtaaatcctttagggccaaggattctctttttcactgtttttccatggtgtctggccatgggttagactcagtgtaataaatgattgttggctgggcacggtggctcacgcctgtaatcccagcactttgggaggctaggcgggtggatcacctgaggtcaggagttcgagaccagcctgaccaacatggagaaaccccgtctctattaaaaatacaaaattagccaggcgtggtggcacatgcctgtaatcccagctactcaggaggctgaggcaggagaatcgcttgaacctgggaggtagaggttgtggtgagctgagatcacaccattgcacttcagcctgggcaacaagaggaaaactccatctcaaaaaaaaaaaaaaagatggttaaaaaagattgttaaattaattcaagccatgggagtggagagaatgcttagagagaagcaaagaggaaggagggtacctttaagaatatttatatttaggaaaagggagaaaccaatgtatgagaatagttaagagcagtgttacagacattaaggaagaagaaaatgtgtttgctgtgttccaagaagacagtgttggctgtatgcctaagaggttacatgtatggatgttggagtcacacagcaggattcagtcatgtctaggctctaccatttaataactgtatgatactgggcaagctactagacttttaaaaacctagtgttcacatttgtaagattgggataattaatgttatttggtgattaagaggtcctggatgaccttgagaaggagctttcaggattatgggattaaaagacagattatatgagcttgattctataatcaatggttttgctctaaagaacgtggagaaacttagtagggaagaaacgttgatactgtaaagaaagatttttacagacatgaaatatattttcttcagagatccttgcagttatacattttaaatcatgttattgggagtagtctacaagtacataaggcgatttaaaaaatcaaattggacttttcctattgaaagcatgtttctcagaatctttggtaaagtaaactgaatggtagagaagtactttttaaacatgtttaagtttcatgttttagattatggtatgaaatttctagaaataagccttacatcctggttccagttttcttctagaaaaattgcctacctgtaagttatttatgctgttttttttaaattacttatataagactcccctgaaaaaaccactctggctgcaaagttatctgctaagaaacaggcatccatatacagagatgaaaatgatgattttcaagtagagaagaaaagaattcgacccttagaaactacacagcaggtaaacagagtttattggcagtaaataacccagttagttacagctgaacatggtagtcaagtatcatgtttttaatgcacttgtggagattagttgggtcatgtgacagccataaattaataatttgttgtaatttcattttgtagagttacttgttacaaaggagtttattatagcagattattcacagtaacatgtcgttcaagtgaaactgcatggtgtttcttatatatgaggaatttgatagtaaaatatttacttaaggcatatcttagtgatatactactttgtactttttaactcctccattgtttttatcttaaaatagcatttccttttggctaaaatacctttgatatgattattcatgttatggatattttggaattgatagttttaatgtaatgacaagatgtattcttactgagtttttaagattgatacatgataaaatatgtatatttatttctaaaaattactaaaaggcttgaattaccagatattttaaatgaaatttggatgcagatgaacacaatattttctcagaattcatggcagtgagataggaaggctgggattttaatagatttagttacaaataaaaaagataattattaggctgaatacagtggctcacgactgtaatcccagcactctgggaggctgaggtgggaggatctcttgagtccagcagtttgagaccagcctgggtgacatagcaaggctcctgtctccacaaaaaagtaaaaaaaaagaccgggtgtggtggcatgagccctacaggctcatcagacatgtagccctacagactactttccagctacttgggaggctgagataggaggattgctcaagcctaggagttgaaggctgtggtgagctaagatcatgcaattatgcttcaaccttggtgacagagcaagaccctgtctctaaaaaataaataaataaaaacataaaataaaaaaattattaattaggatgttatttgtaggtaagtaactgggtacttttaattgagtatactcaaggttcttgaagtcttatgtagtttaactgttccacttacagtctttataaatttctataattcagccttgtttttagaaatagaatgaactagtttattttatcaaagtaccaatgacaaatgaggtgtgaacctatagagatttccccccgacaaaatgtattcatagatttgcatgtcatcaggtagggctcaacataaaacatttattccctcacttcactggttctcatttcatttttggcgggaatgagattatcaatagaaatgcttttctccccaattatatagtgaatagatttttcacaaataggaaaagcatggatacagtttggaaagaaaacttagtggtatttataaaagaaatttaatcaaaggcaacttggtttatcaaatatctagtaagtaacagtgataatagtaatcgagtaatttattccatcctgtaggaaatcatgactgtttacattaaaagttttattctgagttcttttcaatgtagaattatgcttaaattttgatttacttttattttccaattagatataagattggactttccaatattgctatatttgatgtccatatgatgggactattttatgagaagttcattttacaatactctaattttgatacatcactaattaaagatagtttggctaagattcatgagtcactactatgttctatttcctttaagtgttgtaatgaggtgcttatttgcatttttaaaatttcttttattattgcctgttagaaatagtctttttttggatgcaggaaaaaaatacatagagctgttttggcctttgagaacaactagccagttaaacttctagttcaccttaaacttcattttggttctgtgtttacagattagaaaacgtcattgctttggaacagaagtacacaatttggatgcaaaagttgattcaggaaagactgtaaaactcaactctccactggaaaagataaactccttttcgccacagaaagtatgtattaatgccattgttcagttttaaagaaggaagatatggaattttctaaaccaatttttgacaaaagaggaacaatagtataatacaaaggacagtagcaacccactcagaagtcctcaatgctgtcacatctctgttactaatgtgtgagatggcaaagcctattctctctatgcctcgtttccttatttataaaataagagaattggactagagagagatctgaaagtcatttttttctgttctgtattttaatgtttgtaaattctccaactccttacagttctttcaggattcttagggcaacagttctcaaggagtagtccaaggagttctagatattgagatttttttggggagtgatctgtgaggtgaaaattatttttgtaataatattaagatgttgtaggccaggcgtggtggctcacgcctgtaatcccagcactttgggaggccaaggcgggtggatcacttgagttcacgagtttgaaaccagcctgggcaacatggcgaaaccctgattctacaaaaaatacaaaaattagccgggtgttgtggtgcacacttgtagtcccagctacttgggaggctgaggtgggaggatggcttgagcccaggaggcaaaggtgcactgagccaagattgcaccacactgcactccagcctggatgacagagtgagaccccgtctcaaaaaaaaaaaggaaaaaatacattattgccttttggattgtcttgacatttgtactggtggcgcaaaagcaagaatgggtaaaactgttggtgccttagcagaaatcaaggtattggctccaacctctctctctctctctttctctctctctctctttttctctctctctctctctatatgtatataattttttaaatttatttattttaatttttttttgagacggagtatcgctctgtcacccaggctggaagtgcggtggcgtgatctccgcccactgcaagctccgcctcctgggttcatgccattctcctgcctcaacctcccgagtagttgggactacaggcgcctgccaccacgcctggctaattttttgtatttttagtagagacggggtttcaccacgttagccaggatggtctcgatcttctgacctcgtgatccgcccaccttggcctcaacccaacctatgttaataatagttttccagcatcattagatcacagttttgaaaaaaaaccagtttcatttaagaatgtctttgatgaagcagtaaaaattactaattttatttaatctcagccgtttaggtttttaacattctgtctgaagaaatgaatagaactcataaaacacttttgcatacagaagcaggatggatgtcctggggagaagcgcctgtaggatagtttggattgtgagctgactagccactttttgtcatggaacatcatttttgcttgaaaaagagtgaatgatatactaaccatggtaattctttatgataaaatgagccagataaaatttgagctttcaagtgaaaatcagaattttaaaaaatttgtatatactctgagcttggcagctttgtgataactacagacttttctgatgaaattggtgatattacagaatatgactttttatatttatataatgaaatgtgtcaacatttgtaagatctgtaaaactcaatgaacttaaactcagcgaactaaatattatttaaatgaccagtgcatgatattgcaaaatgatgcctagaaaaggtccatcctaagtgcaagatagactgatggaccttttttctgccctgtccccccattcccaggcaaccacagatttgttttcagttactgtacatttaatttgtgttttgttggtgatcttcactgaagctttatattaatagttggagaaattatgtagaagcttcttctgttaaattgcaataatcatcaacatcattataatgtaagctatatgttgagctctgccacagtgttttctcattcattttctttcctttccttcatgggcttactattatctgaaattacttgattacttgtttattatttgtctgtcctattacgatgtaatgtcagtctttttcatgtgtgtccctcatgcctagaatagcatatggtgcatattagttgtctaataaatatttatttgttgaatgttactgagttcttacaatgattatgaagcaggtatattggtattcccatcgtacagatgaggaaactctgagaaggaagaaactggcctaagatcacaaagctagtaaatagtagagctaaatcctgcctaggcattctcatgttctggcaaatgccctaatcactttattttatattctctctaaaatgcctctttgcagtcctggagccacctaaatagggttctaacaccaagataaggaaagaaatatgtagaagctcacagataaacaaatcaagtatagagtcagctgtgattaagatttttttttcttgggaattgtttttgtttgctttatttgtagacacagggtctcaatgtgttgcccatgttgtaacgcagtggtgtgatcatagcccactgtaacctcaaaatcccaggctcaagtgatcctccaaccccagcctcctgaatagcaaggactacagctgtgcaacaccatgcccagctaattttttatttttattttttgtagagatgaggtctcactgtgttgcccaggttggtctcaaactcatggcctccagtgatcctcttgcctgggcctcccagagttttgggattataggcatgaatcactgcacctggcttgttttgtttttattggttaagagaatggactttggacacatactgcctgatcttaatttttaaataaagattgggccaggcatcatggctcatgcctataatctcagcactttgggaggccaaggtgagaggattgcttgaggtcaggagttcaagaccaacctgggcaacataacgagaccctgtctttataaagaatagaagaaaaaaaatagctgtgtgtggtggtgtgtacttgtagtcctagctactcaggaggctgagggagggggatcccttgagccagaagattgaggctgtattgaactatgattgaaccactgtactccagtctgggtgacagagcgagaccctgtctctaaaaaaaaataaaaaataaatacataaaataaaaattatatatattttaggtgtaaaacatgatgttttaatatatatatacatagtgaaattattactacagccaagctgtgatagtctgtttgaattgttataaagcaataccagaggctgggcaatttataaagaaaagaggtttattttcactcacagttctgtaggctgtgcaggaagcatggtgtcagcatctgcttctggtgagggcctcaagaagcttacaagcatgccagaagacaaagagagagcaaacttgtcacatggaaagagaggacagaggagagagcagaggaggttccacactgttttaaataaccagatctcgtgtgacctcagagcaagaactcaactcattactgtgaggagggcaccagccattgatgacccaagcactttacactaggccccacctccaacttgggggatcacatttcagcatgagagttggaggggacacacttccaaatcatatcacaagctaattaatatattcatctccttacatagttaccttttgtgtgtgtgtgtgtgttgagaacacctgaaaattttaaagccaatatcgaaatatccagcctagaatatagtattattaactgttgtcatgatgctgttcattagatctctagacttgattcatcctatgtagattcaactttttactctttgatcaacatctcctcaaatcccccacctccctgccccagtaaccattgttctgatttctgtttctatgtatttgacttttttagattccacgtataagtgagatcatgtagtatttttccttctacatctgacatatttcactttgcataatgtcctccctccaggttcatccatgttgtcacaaatagcaggatcttttttagggctaatattccattgacatacacatacacaccacattttctttattcatccattgacagacacttaggttattttcatatcttgagactgcttggattttaatcatagctctactctttattaactgtataaccttgattttttaaactcttggtattatgtttagctatttgttaaatggggttagtaatagtacctatctcacggggccgttaggaggattaaacaagttgatatctatacagtgctgagagtatctggcataccttagagtttaagcgccaagtggtagtagaagtagcagcagctgtagtagtagtaacagcagcagatggatacatatttgtagttcttacctttagctgctgctgataaaagattctatataataccgactaataatattacatatttgtagttctgatctttattttttgtttatttttgttgacacataataattatacatacttatgggattcagtgtgataattttcatacatgtatatgatgtgtaatgatcaaatcagagtaattaacatatccatcgcctcaaacatttgtcatttctttgtgttgcgaatattcagaattctctcttacagctttttgaaaatatgtaagaaattattgttaaccatatttaccctagagtgctatagaataccagaacttattcctcctgtttctccaatctagctgtagttatgaatttgtaaacccacctctccttatcctcccctcccctcaccccttcctaacctctgataaccacaatttactctacttctatgagctcattttttttagctcctacatatgagtaagaacatacagtacttacctgcctatgcctgacttatttcacttaatatcttccaggcttacccatgttgctgcaaataacaaggtttcaatatttttctatggctgaataatattccattgtgtatatgtgtcacattttctttatccattcatctgttgatggacatttaggttgatgccaactccttgtctattatgaatagcgctgcaataaacatggtgttggctgggtgtggtggctcacaccagtaatcccaacactttggaaggctcaggtaggagaatcactcaggccaggagtttgagaccagccccggcaacatagcgagaaccccatctgtacaaaatttttaaaaaaattagccaggcgtggtggtacgtgcctgcagtcctagctacttgggaggctgaggcatgggcgatcacttgactctaggagtttcagactgtggtgagatatgatcatgctactgtactctagattttctttcctttggataaatagtagtaggattgctggattatatgattatatggtagtaatatttttaggtttttgagaagcctccattgctgttttccgtaatgtctgtactaatttacatttccactaatagtatatgagtttcttctccacatcgtcactaacatttgttatttttttttgtcttttcgatagtaagccattctaactgagtgagatgatatcttattgtgcttttgatttatatttccctgatgattagtgatgttcagcattttttcatgttcttgttggctttatgtatcttttgagaaatgtttattcacaccctttgcctattttaaaatcagatttttttttttttgctgttgagttccttgtatattctggatagtagtcccttctcagatgaatagtttggaaatattttctcccattctacaggttgtctctatactctgttgtttcctttgctgtgcagaagctttttagtttgatactgtcctatttgtctatttttgtttttgttgcctgtacttttgaattcttacccataaaatctgcctagatcagtgtcctgaagcttttgccctatgttttcttctagtagtcttatagttttgggtcttatgtttaagtctttaatctattttgagttggtttttgtagatggtgagagggatctagttttttccttttgcatatggacatccagtgttctcagcaccatttattgaagagggagtcctttccccgatatgtgttcttggcatctttgttgaaaatcagtcaactgtaaatacctggatttacttctcggttctctattctgttccattggtctatgtgtctatttttatactaataccattctgttttggttactatagctttgtgtagtacatagcgtggtgcctacagttttctttttgcatactattactttggctattcagggtctttgtggttccatatgaatcttaggattgttctttctattcctgtaaagaatgttattggtattttgatagggattacattgaatctgtaggttgcttggagtaatatgtagttcttattttcattttatttatttggttaacttttttagagacaaggtttcgctatgttgcctaagctgctctcaaactcctgggcttaagcgatccacctgccttggcctcccaaaatgccaggattataggtgtgagctactgcacctggccttgtagttcttatttttaaatgctgctgaaagctattattaatgttattgttgataatactgatcaacattataaattttgaggagttaggtttagagtttagtagaaaattccttttctttttttttttttttttttgagacggagtctcccctgtcacccaggatggagtgcagtgggcgatctcggctcactgcaacttctgcctcctgggttcaagtgattctcctaaatcagcctcttgagtagcttctcaagtagcacctgacaccacgcccagctcatttttgtatttttagtaaagatgaggcttcaccatgttggccaggctggccttgaacgcctgacctcgggtgatctgtttgcctcggcctcccaaagtgctgggattacaggcgtgagccacggaacctggccaaaaattcttttgatatctgttgaagatgtttatggctgaaatcttttgagtctaaaccgcttgaccataagcacatctactgtgcccttggttgagtaccttaattttaagcctaatgctttgattgatttctccttttggttatgtagtatgctgatatatgttgatcattgattatggtctgctcattggtaaaatatagctgtatctataattgtatatctgtatctttatatctgttttatttttaagctagaaattgcatattttcttccttggctttaggtggtataactctacatatctctagaaatggaataatttttcataagtgggtgatttattactcataacattaagatataggcctctgacaatttctcataagtctgaaaacttcttgaacaagttaaatctctcaattaaatctagtccctcaaatgataacatttcactagtgtgacactgaatttttgtttgcaagaagatgtaagagatatatgtcatactaattaaacatgcataaagtaaatttaacagacatcaaagcacttttgcaatgcaaagaacatatggttgagctctaatatttgtttcttttcatggtagtctatgatgaaaaacatgacgtataaagtaattttatgtgctttctgaaaggttatgggaaaaaaaaacccaaaaatacataggtaaaatgatttgtattttcaactttatttttttcttcctaacataaaaataggataagtacttataatagaaatataattattataaaatgtatagttttagtgagcatgaatgtttctcctttttgtatgttaagtaaatttttagtaaatttctcatggatttctagcattaaataatacatctaggttttcagagaacaaggactaattatttccaagaatgtaatataagaaaaaataatggggatatgagtagaggtaatttatttaaaaaatgggatttttgggtgtcataggggagtaaatatttttccttgtaggaaattactttggtttctgctgtaacatttcttagtctttgcaaagtgacttattataaatcataaaagtattttctgtagattttgggataggtggtttcatgaaaagtagaagaaaaatagtttcatgtgtattaatgtcgtaagttttaatatttattatacagcagcttttgaaatgagtttattgccaaaacttttggataaagtaattgaaaaaaaagtagtccatatattagaacttttcttatgctgacagatcatatgcctcacttttttttatatttttttatttttgcttttttcttcagaccaaaatgcctcacattttatctgttgtattttaatctagaccttgtaataatcttgaataaggtaaattgatagacttgggtaagtaacttttttgtgaaaaccagttccttcatatggaaggaaaaagaatgggagactagatttaatgatgctttatttatttatttatttatttatttatttatttatttatttattttttgagagggagtctcgctctgtcgcccaggctggagtgcagtggcgcgatcggctcactgcaagttccgcctcctgggttcacaccgttctcctgcctcagcctcccaagtagctgggactacaggcgcccgtcaccacacccagctaattttttatattttagtagagacagggtttcaccgtgttagccaggatggtggctcactcctataatcccagcactttgggaggctgaggcgggcggatcacgaggtcaggagatacgttatatctaattgaattctaacacctttaaattctaaggacgcttttcctatcttgctttttattatatgatactagggagtacagtattttttaaatagaaatatttatttggattcataaattaatggtttaattctcatccctgcaaaggtgtgtcttagtcttcacgtttttcaaatctgcagttgcattacttttgacaaaccttcttccataaattaaatggtaaattagtttgatgatttctgttttcccctgaatttgacattaaactttttaggttcttcaaattttcttagtttttatgaaaatcatttagtttccacctagtggattggagaagtagattgttgtctctttatttttctatcatttctagtctcctaactctcttttcaagtcggaagatagtgtcagtaccttttcttatataattaactttctggtgtcccctgcttgatccctttccttacagttcagatttattttcttaatctgacaattcatatgtcaaagttctagtgaagcatctgtctccacatggtcaaaatatagttaagaaaaacattgttttttagaatagtatgttaacgttttgatattactttgttctatcattcataatcattttctctagatttatttatattctgttctttttttagtaaatcctcacaatagccagggttgtcttcagatatattcttatgcttatacctgctttttatttattcattaaataaatgctaacattctttatatactttaattaaagtaattatatttgatttaatgtagcagtagcatattattttaattcataacttgggcctggtgtgtggaagacacttgggtccagcagagtgcgctgttgaccttcttacaaagtgttaacactggggcgatccttaggctatttttcttcctttttcttcctcccataccccatttttatttccttccttcctacccttctttcttttactttatggttttaatttacttttatttaaaatagctatttaacataactgcatatatatgctgatactggtgcttactgtgttatgtgccagacactctgctaagcactttagaaatattaattcacctggcaaatacaggttcatgtgagttgatgcttattgtcatgttcttttaacttttctttgggtttgacagttttcaaaataaaagaatttaactcaatctttataacaaccgtatcaggaaggtattaatattttccgcaattatagctgaggaaactgagccacagagtatttgaataacttgttcatgtcacaaacctggtgagtagaagctggattaaaacccaggcagtctggctctggaattgatcctctaaaccacctcactattctgtctctgaataaactcttccagatgactttttgatgacagttcatttttatactgttacaggtcatattatatgcattaccatgcaggttatttattcaagattcgtcccttttttagtgtctcaacaccaaatctaagcatttacaatgcttacccaaatttataattatttatttatttgtaggtttaactgttttttgttttgtttgtctcattaccagactgaccataaggacaagtgtaatgtctctttttttcagttttttataaccagcatctggcacagagcctgcacctagtagctacttgtattatttgttgaataaatgaatgaaaaaaatggccatagttaagtagatgtatgattcaccactgtttcttgtagcttacaatttttactcagatccttatacctaagagggtatgacagtattgttaaatacaggtgacttaatgcagatttaaaaatagtttttggccaggcatgatggcttatgcctgtaatcccagcacttggggaggctgaggtaggtggatcacttgagcccaggagtttgagatcagcctgggcaacatagcaagaccctgtctctacaaaaaacaaacaaacaaaattagcttggtgtggtggctcatgcctgtggtcccagctaccaggaggctgaggcaggaggattgcttgagcccgggaggtagaggttaaagtgagctgtgatcatgccactgcattccagcttgggtgacagagcaaaacctgtctcaaaaaaaaaaaaaaaaaaaagagtaataacattttttgaaaaacctttaacattataaaaaccaatacagaataaaaattaaaatgttctcccttatgttaaccccatctccctttctgctttccagaaggaaacaccatgaacactttcatgaggatctttctagatccgtttctataaatttataaggatatttttaatagttcttttacagttttgtttgtgcatttaactctcttgtttatgggatttattttcatgcatgtatgaggtcaggctctaattgcatattttcccaaatagttgatcagttgtcccagtgtcacttaatcatttttccagttttgaagttttgctgttatcatgtactaaattgttatatgtacttggattggttcctggacttttttttctctttaattttttttttttaacagtatgtgtgaaaaaatatgtcaaagaattccacttggcttcaaacagaaaagcagtagacccctgccctaattctattattcaccaattcccactatctgaagtaaataattttcaattatttatcctttgtattctgatagtttttgaagtagcatgcatattttgcttttctcttgagttttcggttttagatactttctgttgtcttcctcctattcttttctcctttctcattacttctacccttcagcctgccagcatttggtatttgtattgttataattctataaatatttaaacttattacagttctttccccaaaccagtatttattttttttggtgctagtagttgtcttgtcctttgcttagtttcctatgtacctgtaactatttatctccaaactctctgttagaaagtaaaatctatcagttcatttaaatacatcaggtcaagatgtccatatttttagactttcaatatttagtggaaataatgaaaaatactcttttatattgaattaaattttatatttctaaataacttttttctgaatataaaagcatcatctaagagaaaatttgggaaccaccaaaatgtgtacttaaattattaacattaatccttaattaaactgtctcctcaatatcaacccctgatattctgcctgctgtctattcttaagtgcgcacatgtgcgtgcacacacacatgcaatgttatctgttgctgtaacaaaccaaccatttatttagcttactgttgtgggggtcagcaatttagggtgggctcagctgggcatttcttctgctgatctcaggtggcctactcatgtgtctgtggtcaactgcaggtcagctgtaagtcagcaaggcagccctgcttcagggagttgattggtagtcagctgggaccatgaggtgggtctctctcatcatctagcaggctaattctggtttatgtatatggtggcctcagggttccaagagcagcaagagaacaagccccagtgtacaaatgccttttgagtctgtttgtgtcaggtttgctaatgttccagtcaccaaaagcaaatcacatgaccaaatccagactcaaggggtaaagctcacatcttggtaggaagagctacaaagtaaccttgaaagggagcttatatacaaagataagtagaatttgttgccatttttgttacgtagtatatattacatatatacccagtatcaactgagtatatatgtaaacatttccaccatagagaacactactatgttttctccaggctctcaaaaaaatcgtaattattgggccgagcgtggtggctcactcctgcaatcaggtgttgtacagagctcaacccctgtaaaggggttgatactgtagtatatattacatatatttgttatgtagtatatatgacatatattacacatatattacatatatactccctccccacacacaaaattaggattatagtatatagcttttatttttcacctaatatatcacggtcatagtaaaatttagcaggtctattttgatggatacttttttgtcgtaatcttttttcctatgccagtggttggcaaactatgacccatgggcagaatacagcctgctgcctgcttttataaataaagtttttttgaacgcattttacatttgtttatacatattgtctgtggaacttttgcgttataacagtaaagttgagtagttgtgacagagaccatatggctcacaaaacctaaaatatatactctgtctatttatgtatttttcttttctttcttttcatgttcagccagcaggaaaatctctggccttttagagaaaaagtttgccagcccgttctatactattgtaatcttggttaagttaggccagaggttagtggagttagtgtgaatctcttgccttgtctgcaaatttgcctaggggtaggatgatagaatggatgactaattgcttgagtatgtccttcagctccaataattatggctttttttttttttttttgaggtggagtcttgctttgtcacccaggctggagtgcagtggtgcagttttggctcactgcaacctccacctcctgggttcaagcaattctcctgcctcagccgctcgagtagctgggattacaggtgcctgccaccatgcctggctaatttcttttatttttagtagagacagggtttcgccttgttggccaggcatgtttcgaactcccaacctcaaatgatccgcttgccttggcctcccaaagtgctgggattacaggagtgaaccactgtgcctggcccagtaattataattttttgagagcttggagaaaacatagtattctctatggtggaaatgtttaattctcaaaagtttcaaatcttctttatcatattgagtgaacttggtgaatatttcagagaaagttgacaaaattcagccactcctctaagttttcttgatgtgtagatacattaatgaaataaatatgtatagcaacccatccgacatgagtgtagctattcagtggtgatagtatctgcaattgtcatgtagaacgttttcattcatggatactgggtgtggaaagataactttacctttgaaaactacttcgttaattgaccaactgtctgcccagtaaatttatctttcggttattttagctttttaaaagtttggctgtcacaaaattatagagaaattggaagtacaatccaaatatctttttttattgagccatttaagagtatgttgttgccctgatgttccctcaccctgaaatactttagtgtctatgtcttataagcaaagacattcttatacataatcacaatataaccataagaatcaggaagttaaaattgattcattgttgccatctaatactcagaaccggtttaaattttagcagttgtcttaataacgcttttataaaagcaaaagaatccagtcagaaccatgcattgcatttagttatcactttagtaacttcttcagtctggaacacttcttcagtctttccttgactgtcatgattttgacacttcagaatattacagcttatctagaatgtctcttaatttgggttttctcattagactgaggttatttatctttggcaggaatgtcacagaagtgatgccttctgctcattgcatcttataaggtggcacgcagtttcattttttctcattaatgattgataacttgattaatatgatatctgctaggtaaaaaatataactttacagttatctttttgcctttataaaagaggactttatggggaagaactctgaaattatataaataacatgtccttacaaaaattcagtttactcattttatttatatctttatggacttgtgattttccattttattcggtgagttataattattatatgatttgttttggtactcaagtgggaaaccagttaagttgcttgtgtctttctgacatatatcaatcattcttggaacgcttccttattttttggcaaaagatagtgttccaggctcaccttatattttccctgccctagtctcggattcagacatttctccaaggaaccctggttccatttagtgaaaaataacatttgaacgctgtgttctgggagttagttttgctcattgctgttggagttgctgctccaggccctttcagcagacagctagagaatatacacaatgtattgtgtacacaaacccagactcatagacatatacatttatgtctatattttttctgtatctgtctgtctgtacactgaaaattatgagtgtttataccaatacatccagttccattccagtaccagagggcccattctaattttcttcctttctgtatgtttaactgaaaaaccttgttcctgattcctctgaaagttaaaaacagaattaccatatggtccagaaataacatttctaggcaaatatccaaaagaattgaaagcaggtactcagatacttgtacaccagtgttcataggagtgttattcacaatagccaaaaggtggaaacaaccaaaatgtccattgataaataaacgaataaacaaaatgtggtgtatacatacaatggaatattattgagcctttaaaaggaaggaaattctgacatgtactacaacatagatgaaacttgaagacattatgtgaagtaaaataagccagtcataaaaggacagatattgtatgattccacttataatttccttccagttattcattactattatagaagtagaattcatttttgtatatttaccctgtaacctgcaacttgttatatcacttattggttctagttgatatttttggagtttctttaggactttctaagtacccaaagttgcatgtttcattctctagtaaatactgttttacttcttcctttacagtgtttacctttcatgcagtacaaggctgaattagagtgatgagagtggatacccttgccttgttcacaaccttgtggtggaaaacattctggtccctcactgttctgtatgacatttgtgctaggtgttctgtctatgccctttgtcaggctaaagaagtttccttctatcgctagttggctgaacatttttataatgagtggatgttggattttatatttaaagttttactgcattccttggtaggattatatgttttttctcctatatcctgttgatatggtaaattacattgattagtttttgaatgttggcctgactgtaaattagtggaataaaacccacttgatcatggtataggacccattttatataattgttagatttgacttgctaaattttgttaaggattctttccatctatgttcataagaatattggtctatagttttctgtaatgtctttatctggctttgatatcaaggtaatgttggctttataaaatgagttgggaagtattgatattacttcttccttaaatttttgatagaattcaccagggaagccatcttgcccttatgtgttatttttgggaagacttttacttttaaatttaattttaaaaatgagtataggagtattcacattttctgtttctgagtcagttttagtaattagtatctttcaataaatttgtccattcaagtttttgaatttattggcataatgttcaaaatattctcttatttctttaagtgtctgtaggatttgtagtgatatgccctctttcatttctgatattcataatttgtgaatttgtgtctatctccttttttttgcttaatctagaattcattttgctcaatctgtaataggtagtagaggtttatccattttattgatcttttaaaaagtttttgttgactttctgtttttccattttctattttgttggtttctgcttttttttttttttaattaccattgttttactttctttggatgtaattttctcttctgctagcttcataagattgaaacttggccaggcatggtggcttacccctgtaatcccagcactttgggaggctgaggcgagcgtatcacctgaggccaggagtttgagaccaggctggccaacgtggcaaaaccctgtctctattataaatacaaacaattagccaggcatggtggtgggcgcctgtaatcccagctactcgggaggctgaggcaggagaattgcttgaacccaggaggcggagcctgcagtgagctgagatcgtgccattgcactcaagcctgggcaacaagagcgaaactccgtctcaaaaaaaaagaaaaaaaaaaagattgaaacttaaatagttgataactgattttggacctttttttttcctaaataaaacaccaatgaaagctatacatttccctctaagcacttctttatctgtgtcccacaaattttgatgttgttacatttttttctgatttcccttgtgatttcttctctgacccaagatttatttagaagtctaaataaacactaactaggtgttttttcctagatatttttctcttactgagttctaatttatttttgtgtggttagagaatagattctatatgatttcagttcttttaaatttgacgatctgtcttggcaaatgctctgtgagtttttggaaagtatgggtattcatttataaaaatcagttaggtcaagtttgttgattatcttgctaagatcttctgtatccttgctggttttttttggtctacttataaattaattagagaatactgtaagggtcctataattgtggatttgccttttctttcaattctaccagtttttgcttcatgggttttcatggtctgttattagctgtatacacatttaagattattatgtcttcttgatgtattaacccatctgtcattatgaaatgtctttgttctgagatctattttggctaacattgatatagccactccagctttcttaggattaatgtttccatagtatatatttttcatccttttatttttaacctatttgtgtctttagatttaagataagtttcttataaataattgtcttctttatttatccaatctgacaacctcttctttttaattggaacacttatactatttacattcagtgtaattatcactgtggttactatttgttttctgtttgttccaacttttctttattccccttttctgtcttctttgaattaattaaacatgttttaggattctactttaccttcaccactgtcttcttaagtatacctcttagttttatttttgtgagttgcttcatactttgcatcttaaacttatcacagtgtaccttcaaataatatttcaactcacaaataatgtgtaagaaccttctgccaatatacttccgtgtctactctcccatgttttgtgccatttttgtcaaatattttacttctacatttgtcatagccctcacagtgttttgttatttttagtttaaatcatcagctatgtacaaatttacaaatgaggaaaataatttctttcttaaccctccagtttttcacttctggtgcccttcattttgtaggtccaagtttctgtattgtgtaacttttctattagcttaaagagctttatttaacatttgcattgcaaatattttttcagctttttttcttaccttcatgtttttaatggtaaaatatatataacataaaatttaccatttatctgtttttaagtgtaaattcagtggtattatgcatatttatatactattatctagtgccagaaccttttcatctttccaaactgaaacaccatacccatgaaacaatatctctgtatttccctattgtccagccccaggaaaaatgccgttctcctttccgtctctatgaatttgactactctagatacctcatgtaagtggaatcatgcaatatttgtccttttgtgtctggcttattttactcagcataatgttttcaaggtcatccaccatgtagtatgtgtcagaattttatttctttttatggctgaataatattccattgtatggatataccacattttgtttgtccgttcatctgccagtggacatctgggttgtttccatctttttgctattttgaataatgctgctgtgaacattggtgtacgtatctgtttgagtctctgttttcattcgtttgggtatacacctaagagtggaatttctggaccatatggtaattctatatttaagtttttgaggaactgccaagctgtttttcacagtggctgtaccattttacagttccatcagcaatgcacaggggttccagtttctccacatctttgccaacctcattatctgttttgttgtcctttttaaagaatagccatttttaagggtgtgaagtggtatcttgtgtttttgatttgcatttccctaatgattagtgatgttgagcatcttttcttctgcttattagccatttgtgtattttctttggagaaatgtctattcaagtcctttgcccttttttgagacagggcttcactctgtcgcccaggccggagtgcagtggcactatctcagctgactgcagtgtccgcctcccaggatcaagcagtcctcccacctcagcctcccgaatagctgggattacaggtgtgtgcccccacgcctggctaattttttgtatttttaatagagatggggtttcaccatgttggccaggctagccttgaacttctggtctcaagtgatcctcctgccttacctctcaaagtactgagattacaggtgtaagccaccactcccagccccattttttttaaatttaatttttattttaagttcaggggtacatgctcaggtttgttatataggtaaacttgtgtggtagtggtttgttgtacagattattttgtcacccaggtattaagcctagtacccattagttatttttctgatcctctccctgctcccaccctctaccctctgataggccccattgtgtgtttttcccctttatgtttccatatgttctcatgatttagctcctacttataagtgagaacatgcagtatttggttttctgttcctgcattagtttgctaaggataatggtctccagctctatctaagtttctgtaaaggacacagtctcattttttttatggctacatagtattccacagtgtatatgtaccacatttttaaaatctagtctaccattgattagcatttaggttgattccatgtctttgctattgtgcatagtgcttcaatgaacatacgtgtgcatgtgtctttataatagaacaatttatatttctttgggtatatacccagtaatgggattgctgggtcaaatggtgtttctgtttttaggtctttgaggaattgccacactgtctactgtcttccacaatggttgaactaatttacattcttaccagtagtgtgcaagtgttcctttttcctttttctctgcaacctcaccggcatctgttttttttttttttttttttttttttactttttaataatagccattctgactggtgtgagatggtatctcattgtggtggttttgatttgcatttctctaatgatcagtaatgttagcttttttccataggattgttggctgcatatatatcttcttttgaaaagtgtccattcatgtcctttgcccactttttaatgaggttgtttttcctttgtaaatttaagttccttatggaagctggatattagacctttgtcagatgcatagtttgcaaaaaattttctcccattctgtaggttgtctgtttactttgttgatagtttcgtttgctgtgcattaactctttaattttattgggtgtcatttgtcaatttttgcttttgttgcaattgcttctgttgtcttcatcatgaaatctttgcctgttcctatgtccagaatggtattgcctaggttgtcttccagggtttttatagtttttgttttacatttaagtctttaatctatcttaatttttgaatacggtgtaaggaaggggtccagtttcaatcttctacatatgcctagcgagttatcccagcaccatttactgaatagggaatcctttccccattgcttgtttttggtaggtttgttcaagatcagatagttgtaggtgtgaccttatttctgggctctctattctgtttcattggtctatgtatctgtttttgtaccagtaccatgatgttttgattactgtagccacgtagtatagtttgaagttgggtagtgcgatgcctccagctttgttctttttgcttagggttgccttggctttttgggctcttttttggttccatatgagttttaaaagagtttttcctagttctctgaagaatgtcagtggtagtttaataggaatagcattgaatctgtaaattgctttgggcagtatgacctttttaatgatactgattattcctatccatgaacatggaaggttttttcatttgtttgtaagaaatctctgatttcttcaagcagtgctttgtagttccctttgtagagatctttcacctacctggttagttgtattcccagttattttatttatttatttatttatttatttatttatttatttatttatttgtggcaattgtgaatgggattgcattcctgatttggctctcagcttgacagttgatggtgaattggaatgtcagtaaattttgcatattgatttagtatcctgacaagttgtttatcagcttaaggaggttttgggctgagactgtggagttttctagatataggatcatgtcatctgcaaagagggatagtttgacttcctctcttcctatttggatgccctttatttctttctcttgtcagattgccctggccaggacttccaataatatgtttaataagagtggtgagagagggcttccttttcttttcttttcttttcttttttttttcgttttgagacagagtcttgctctgtcgcccaggctggagtgcagtggcacaatcttgggtcactgcaagctccgcctcccaggttcacgccattctcctgcctcagcctccctagtagctgagactacaggtgcccgccaccttgcccagctaattttttgtatttttagtagagacgggatttcaccatgttagctaggatggtctcgatctcctgaccttgcgatccgcctgcctcagcctcccaaagtgttgggattacaggcgtgagccactgcacccggccgggcttccttttcttgtgctggttttcaggggaaatgcttctagcttttgctcattcagtatgatgttgcctttgtccattttggaattggattgcttttgtcgttgttgagttggtggaagttctttatgtattccagatattaataccttattggatacatgatttgtaaatattttctcccatttggtgtgttgcatttttactctgttgatggtggtctatgatacataaacgtttttaattttcatgagtccaatttatctcatgaagtccattttttatcaccagtgcttttggaaaagttttatggttttagcttttatatttaaggttttgatccatgtagagttaatttttccatatattataatggtgcaacttcattgtttgtgtgtagatatccaggtttccctgcaccatttgttgaaaaaactgttcttttcccattgaatggtcttgataggctgctgaaaattatttgaccatatatgtgggggtttgcttttggaatttctattctgttccattggtctatatttctgtttttatgccagtaccatgctgtttttcttactgtagctttgtagtaagtttagaaatcagaaaatgtgagacctccagttttgttctttttcaagattattgtggttattcggggttccttgagaatccatgtgaattttaggatggtattttctatttctgcaagaaacttcattgggttattgataggaaccgtcgctttgttttgaaacacattttcactgggtattgaagtttaggttcacattttctttctttcagcacttaaaagatattctgcccttggcttgtcttacatagtttctatagagtaatctgtggctgctttaaaaattctatcttaggccgggcatggtggctcatgcctgtaatcccagcactttgggaggctgaggcgggtggatcacctgaggtcaggagtttgagaccagcctggctaacatggtgacaccctgtgtctactaaaaatacaaaaaattaggcaggtgcggcggcacatgcctgtaatctctgctgctcaggagtctgaggcaggagaatcacttgaacccaggaggcggaggttgcagtgagctgagatcactttgggcaacaactgcgaaactccgtctcaaaaaaaaaaattctatttttatctctgctttcagcaattcaactaaggtgtgtgtgtgtgtgtgtgtgtgtgtgtgtgtgtgtgtgtttattgtgtgcttggggtcattgagctttttggatctatggttttatagttttcatcaaattatgaacaatttgagccatttaaaaatattttcttaagtactcatttttttcctttcagacttcaattatgtgtatattagacagcttgatattatacatcactgactatatgttcattttttaagctattttttcttctttgtgcttcattttgtctaccttctattgccgatttgtcaagctccttgatctcttctgctatttctaatttggtgttaaatcttactagtggatttttcttttcagttattgtgttttcatctgtagaagtaaagtaatgtagttatcacctctttgtttccttttctctgagatcacaattcagtgtctgaaaagtactgtttcatatatcttgtccaatttgttagtagtttatggtgcaagataagatttctgttttttcgtatggctaaaagcagaaggccatacaatcatatttttaaggacatttattgtttctttaaatgttggccttttggaaaacttaaacaaatatatgcattgttctaagtgaaaactactataagccagatgttgcattacttgtgcaaggttaacgtttcattcagaagataattgatattgacaacagcattggaaacatgtatgaatcttttaaagaaagatgcttttgaggtttagtgaagtaggcacacatcagggcagtaaaaatgtcagattctccttgttactcagtgaatctggagtaggagaagcagtcaccatcctggggtacttcatgatctgtgttgatgatctgctattttgaccatagttcctcagccttcttgaaacttacgacctaatttagccattaattcaacagcaccactacacatgggacttcgttgtcatttggaaccgtcccacctttaaactgaaaacttgttggtccccatattagtcatacagggcctttttttttttaaacacaaacttttccccattcacatcccactacacatttacacatcactggatgtttgtcaattatttttcctcctttctattgattcttttccttagctataaccatgttatgttttctcctgtccttccacaaggaaaccttgtctcagctctttccttaatctaatattctgaacaatagtagatgtgagagcagtctgttttcctattcagtcatctcattaacctgtatgattgatttgactggccttactggatagtctgtccagttccctttcttccttggcgctttttggtgcatttttcccagagggcacataactggatctattagtacgacaaaaatcttatcaaattgagtaaaatgattctgcaagccctgaaaaactagttacttctccttttggtagtatctctaccctgtatattgttttcttttctgtgtatgtttttaaaaaatgtaattgtttttataaaagtgatatttgcttataaaaattctagtaacatcaaagattttacagaaaaaaatgatgagaatcccattatcagtctattcgtcaaatagcttttcttcttcttttattgtcttttattttttgtcatttactaattttatgtaacgcttatagggaagacatttcattcattaatttatatttttcacatcaaaaaccagtcacacgaggtttttattatgtcttctgtcatttagttcttttactggtggctattactgattcttctgacaatttttagtcattaacaaatgttttcatgtgcagttttagttaatgtgagatttatttattttgttgcttatttctaccagtaatattcattgagccttcaatatctgctgagaatgaaatggtggcctgatgtggtgatattcacctgtagccccagctacttgggaggctgagacggaaggatcacttgagccgaggaggttgagggttgagaatgaagtgagtcataattgtgccattaaactccagcatgggcgagagagagagagagatcctgtatcttaagaaaaattttaaaaagacaaaaaatgcaaaaagtagccaggcgtggtagcatgtgcctatagtcccagctactcgggaagctgaggcaggaggattgcttaaacctaggagttcaacgttgcagtgaactatgattatatcactgtactccagcctgggcaacagaatgagaccctgtctgtaaaaaaaaataaaattaaaaataaaaaggtaaaaaatacaagaaaaaaaaagagaatgaaattgaggcaggagaatagggtctggaggcagggaacctaaggccgattcacactgacttcctaaaactgaatcaaaaagaaaaactcacctctccacccccaagtaacaaaaggatcagaggctactctgtttgcaacaccctgcctttctactgaatggcaggttaaagaatggaaagtacctctccttcccacaaccagtcttcatgtgcatagggtgtaactctgtaacttcacttcagcctctgattggtcccctctcacaaccaatcagactggtcatgggccatgtcttcctttgcataggatgtaactgtagcttcccttcagcttctgattggttgcctcccacaaccaatcagactggtcacaggccacgtgtttatttacatagtgtgcaacaaaataaccaatggaaacctctagagagtatttaaactccagaaaattttgtaaccagtgctcttgagcctcttgctcaagccccctcccactctgtggagtgtactttctttctttctttctttttttttttttaagacagagtctcgcttcgttgcccaggctggagtgcaatagcgggatctcagcccactgcaacctccgcttccctggctcaagtgattctcctgccccagcctcccgagtagttgggattacaggtgcatgccaccacgcctggctaatttttgtatttttagtagagacagggtttcaccatgttggctaggctgattttgaactcctgacctcaagtgatccactcccctcggtctcccaaagtgttgggattacaggcgtgagccactgtgcctggccctttttacacttttgtaaccagggttggcaacttaaatgagcaccagataggtagcatgaatgaaagaaggggtctaagtataagtgcatgtgattacattctttaagtggcagggactgtgataccttgagagtatatgtctcatccaaatgtggcaatctagtcaatgttagtggattgctgtcctgtaagaatacaggcctaatgtggccagtcaaccagtttttctagaagaaaccagcactatggattttcatctcataatttttaagtagttcaaatttataaaactctgtgtagccattcaaaacatgattgtgaagcaggtatgatttgtggacctccagtttgcaacttcagctactaagtaagtttattttagtggtgttttaggtgggaaggagggcaaatgtgtgtacctaatctgccatattagactggaagtctcgtggtttcagttcttatatactgatctttaattcaactgtaaattattttgatgtaaggtgggagataggatctaatttttttccccaaatagtcattcatctaaatattagttgaataatttcccccacagatttgaaatgccacctgatttaaacagggtggtttgctttttttttttttaatttttaattttggtgggtacatagtaggtgtatatatttatgaagtacatgagacattttgatacaggcatgcaatgtgtaataatcatattagggtaaatgaggtatccatcacctgaagcatttatcctttgtgttacaaataatccaattatactcttagttattttgaaatgtacaattacattattttttactatattcaccctgttgtgctagcaaatactaagtcttatttattctttctaactacttttttgttcccattaacaactccactctctcccctccctagactaccttgcccagcctctgaaaaccacccttctactctctctctccatgagttcacctgttttaatttttagctctcacaaatgagtgagaacatgcaaagtttgtctttctgtgcctggcttattttacttaacataatgacctccagttccatttatgttgttgaaaatgacaggatctcattctttttatgactaaatagtacttcattgtgtatgtgccacattctcttcattcattcatctgttgatggacacttaggttgcttccaaatcttggctattgtgaataatgctgcaataaacatgagagtgcagatatctcctcgatatactgattttctttcttttggatatacacctagcagtgggattgctggatcatatggtaattcaatttttagttttttgaggaatttccaaattgttctcgatagtggttgtactaatctacattcccaccaacggtgtatgagggttcccttttctccacatcctcgccagcatttgttattgcttgtgttttggataaaagccttttttttttttttttgagacaaattctcactctgttgcccaggctggagtgcagtggcatgatctcggctcgctgcaacttctgcctcccgggttcaagtgattctcctgcctcagcctcctgagtagctgggattacaggcgtgcaccaccacacctggctgatttttgtatttttggtagagattgggtttcaccaagttggccaggctggtctcgaactactgacctcaggtgatctgcccccctcggcctcccaaagtgctgggattacaagtgtgagccaccgtgcccagccaataaaagccattttaattgggatgaaattatatctcattgtagtttggatttgcatttctctgatgatcagtgatgttgagcaccttttcatatgtctgtttgccatttgtatatcttttgagaaatgtctattcaaatttttggcccatttttaaatcagatttttaagggagtgatctgctttttaagaaatagaaacccgctaaaagaaagatcatgcaggagatataattcccctcattggaaatgaaaagtttttaggcagcttctctgttctctttggggcctctggtgtgacatctgcatttctcagcaaagttttctcattattttttgtagattggtttttctagatacttacactctttcatatgaccttaccatgacatctcaaagtggaagcctaaaatctaccaaatgatgtggcctattttctgtaattaatcaactcagtctaaatgccccaaatacaagttcttgggaaagtgaaactaattgatcttgctatgcctgagagtgtctttggatatgtgttattaatgtggatattaggttcagcctttcagcaggggatatagatgatttcagagtaagtaggtggacacatgtccatagaggtgcctaatacagcatctttatcatatatttgaaattcttacatctatagaaatatataccctacttgcccatctttcccccccctcccccctttttagagatgaggtcttgccatgttgcccaggctggtctcgaactcccaagcacaagtgatatgcctgccttggcctcccaaagtgctgggattacaggtgtgagagatcacacctgtccccatcttatttttccaaaaagttttggttattctcacttatttattttcaagattaaatttagattacccaaaaaaaaatcttgctgggattttgattggaattcagacaaaaattagaacaaaaaagattaagaaaagtagtttactagtctacaaaaattgtgaacccagttttcatgagctgcaacctgcagaacccatttttacctatgagcacacaatttttacagtgtacttttgctttttcctttctaacttgaatttacgaagagaatttctcacacatacaatgcacctgcaataaccattggttttctagaatctctgataatactttaaatgtattctgtccactagccacatgtatttatgttttttgattaattaaaattaaaattcagttagttgtactaattacatttcaagtgcccatgcggctaatgccaaatatattgaatagtgcagatatcaaatacgctgtcatcacagaaaatcctgttgggtagtgctgctttagagacttgtatgtaataataaccatttaatttttaaagcccatagaagcacaaatctctatgtcatatgttttgtttatagcattttggttaatatgtggaaaatgacatgataggatagcattgttttctcattttaaaaggttcattgaagaaagtttgaaaaataccataaaggagaaagtaaaaattacctgcaatctcaagagatagggttttttttaaaagcctttttgaaatacaatctataaccaagtgtacatatcataaattacaattggatgaattttcaccgactaaataatacatatatgtctttttaccacagtttctctattcccaggttctttttgattcatgtcttgattgtttggatttaataatcatgtagttttattgaagatgggcacaagagtatatttcttatatcaggaggcatatgaagccagttagtctcaataccattgatgctgaatttcaccacttggttagagtgtcactgccaggtctcttcattgtaaaggtacattttccttttgtaattaatgaataatctgtggggtgatattttgagactttgtcaatattctgttccctaataacttttcactgaaagatttcagcatccatttatgtaacttgcctgaatcagttagtacaggaaagttgcaaaatggtgatttttaaaattctatcattttatttacaattcttagctggcattcttatttaaagaagatattttccgcctacccgcccacttccccattttgctcgtttgagtcttcttttcccctttttattttttataaacaccctgggtttttctcatgaagttgatcggtgtgactcatcactgctttgagactcattgctataatcacatctatgtaaagttctattataccaggataatttttgctttatagcaggtcagtcatctttatgatatgcttgttcttaaactgataattcttattgatttactctattgaaacacagacttttcagaaactggagcaactgtgttaaggaattcccatttacactaggcaagaaagtaaacagtaagtggagagtagggtaacaaacacttatggtatcaaaaaacaaccgtgaaaaggatctgtcttaatgtgctagcccactgcagtttaacatattgcttacaaccttcacaatagaatttgagtgacttcagttacacattccaggagactggcagtctgttacaatcagagtctgaactttagagcaggctaatttacagcgatgggatgaagaaagttgtggatttgtattacacactctcacctgacactgtatctgatcccctacctgctgattgacatcttgaatgagctctttgaagcaagttccagcttaattaaaacgtttgcttggttagcagtgatctatgaaagcctgtgataaatattgaatcaggttcacctgctggttgctgtgagtggataaacagctgctttgtgcagtctaatcatgaaacggtggcagtagggtactactactgtttgaatttttaaaaaaagaatagttgaaaaggtatagttatgttacttttgctatcttactagagtgtgtgctaatgtgagattttgcacaacgggcattcagtacctgtttagatggcttggacaacagcaaatggttgataaagattaacaaacccttttttatgtctcaaagtttgtagtataattctatgttcattggccttttaccactagctcttcatatgcatgactttttgaaataaagggcagtgttttgcttttttgcttaagtggtagatgaaaacaatcctgttaaagcttcactttaaagatttaaggttatgaatttcaacttctccacaaatttattgtgtattttgtgggaatttgaattcttctgaatttccttttttatctgtaaaatgaagttagaaatatacattagtgaactgagtattttagccttatgttaatattaggtaattaacaaacattaaaatagaaatgagttcagaagcagtggaggaaactttatgaaattctcttggctgttgtttattcctttacagaataactatgtctggctaatttggttataaagaaaatgttgtttccatttgattttcgttaaaaaaccagatataaattctggaataaagccctaacccaaatcagtcacaatctgctttgagcacttgattaaagttaggggttcactttctaaaaatgcacacaaaattgtgtctgtagtttctgggtgatctgtaatagcccatggaccctaatttgagaacccatttcctaataaattaggttgaaaacttttgaggaggaggtgttaagatgaaagctattctgctgggtatgaaacaactgaggagaaaccagaacagagtatatttactgtgggtttttttttttttttccagcacttctagcatttttcaggtatgtttttcatgacaattgttagcttttaagattatcttccatagtcttgattcctcactctctacctgaagttttatatttttatttctatcatcaacttatttagaattttatggggaaaatacaattttgtttaagccatactcagcctgttcaactgcttgttcatgtttatcgatgtcgatgcatacaactgtcattcatatattttcattataatattattccattgattggaaagagcccacaatttactcatccattccttctgttgatacatgtagcttgtttttctcactattaaaacaatgctgcaattaatattcctcttgtatctgtcttaatgtgcaagagtttttctagcatgtatacctaacagtgtcatgctgggtcaaagggtatatgtatctttgatttcactagatcaccaatttgctctcaagtagttgtgccaatttatacttcgatcagcagtgaataagagtttcttcatatcctctccagtacccaatctggtggataggaaatggaatctaattatggttttaatttgcattttcctaattactagtgaagctgtacattagatggcacatcttttcagatatttattagcctttcagcttttctcttctgtgatttgcctgttcttggttttctgtagggtttgtcttttaaaaatagatttattggaattctttatatgttgtagatactgatcctcacttgactgtaagcactgcaagtatcttctgtcagcctgtgccccctttttacctatttttctttccttctttaaggaatatgtatctttaaatagaagtttaacatgttaatgaagctgtgttttcactcatttgtgtttttggtttattgttttaggaaatccttctctacatttcgatcataaaagatatcttcctatggaagaagagaccatatagcctttgaagcttgaaatgtttactgtctggctcttttgctgactcttgctctaaagagtctattaattgaaagtttgtgttttttatttttcccttgggggacataatatggatcttgttataacatatttgatttaaatgtcaactaataagttaaaacaatttttatgaagatcatacttaggaatattttgtaattgcattcataaaataatataactaactttaaacaattccttggtttatgagtgaaaatggtgtgataaactccaagaactacactttgtagaacaatttaagaatgaagctctctttgtcagtaagatgaggtgatccttgtcattgtcttctccgtggcttgatatatagggattccaatgtctcttgagtcaatgaatgaatgaaatgggatattagatgaaaaatgtttagcacaaggacaggcttaaaaatggcagtattattactaatgaaaatattgggatatatgtttgtcacgactaaaatactagcataagatggtttttctttttggccttgaaaaatagtaattgtcctgtactttttcctttaaaagctaatctggattttgaagtatctttttgatatgtgcagcacttcaaattaggacatcatttaagcatctgtcagatttaattgtaatgcatgggtacagtatttggttcagggacatttagtcataattcatcagtttaaaaaaagctaagttacagttatgtgcaaaacaccactctcgatgaatgagctatataaagaaatgtaagacatagtttctgtcttcaaggaatttgcagtgtggttggaaagacaatacatgcacatgtggaaagttatggaagaacacaagtttttgtattttttttttttactgtttcattgacctagttttccttttatttcactcaaacaggtttctcttcattctctttttctctctacttctttatatacttagttttcgtactcctgcctgcttttgaaattcaatttgtagtctcctttgagaatctctcctgatttacagttagcaaaggaacttcttctttggcaatgaaattagttcctatttctttatcattttccatttctaaaaatatttaattgctatgctcatttttcaggtatttaggcatagtatttttttgtgtgagtggtagggaaagtttggagaaagttataaatctttagaagttgacattgtggtatgttaccgtttgaacttataattatagcttgtgaaaggaacagtggcaaggactcagcaattcatctttctttcaagatcaaatcttcgaactcttcatctttgaaagaatgtagacatgtctctatataatacaacaagagagggaatataatttattaaacacaagaaaaattttctgaaaatccttggttgctgatgttctaagaacagttttgataattgtagatttgaaatgtatttttaaacaattggctactgcacatggaaatattatagctgtcacatccacatgtatctcctgttttttttttttaatgatagtatatttttgcagttacttgggttgggttttcttgccttttcttgaagtaaaaggactctgaacagtttctagcttggagaagaagccatttcttaaagagtttggttctggcactgtgtagccacttacaggtcttagagtttacagattttggaaagccccatgtcttatgtattgattttcagatatattattggatgagagtgaatattataaaatttattctctagtttcctggagaaaaggaaatctctgtcaatttaaacagcaaagggaaaataaaaaagtctttttgaaagataaacatgatcatttgttagcaggaaaaatactcaataagagatacaaaattatttaattttattcatctaattgttttaagacccctgggtcaaagggtttcagagagaggccataaagtattagcctggtaatttgattgggggatattctgacctcctgacactgctggcatcaggatccttcctctagttttcttagagcattgaaagttgctgattttggtacaggtaattatcttttgttataagtgactttttgaagcctttgttatattactacaatcagtttttctgtcttcaaatatgattgtaccaaatcttttattatttatttattttttgagatggaatcttgctctgtcacccaggctggagtgcagtggcgtggtcttggctcactgtaacctccgtctccctggttcaagtgattcacctgcctcagcctcccgagtatctgggactagaggcacatgccaccatgcctggctaatttttgttttttcagtagagacagggtttcaccatgttggccaggctagtcttgaactcctgacccaaagcaatccacgtgcctcggcctcccagagtgctgggattacagatgtgagccaccatgcccggcctgtaccgaatcttttaaatggaaactttaatagaagattgcttctgaagaaataattcctgtttaataatgcaaagggaaaagaattaacttttaatttccaccttataccttacttgcctaagtacctattgaaaaccatcttcttggccgggcatggtggcttacacctgtaatcccagcacttcgggaggccgatgcaggcggatcacctgatttcgggagttcgagaccagcttgaccaacatggagaaaccccatctctaataaaaacacaacattagccaggcgtggtggtggacgcctgtaatcgcagctacttgggaggctgaggcaggagacttgctggaacctgggagatggagttgtggtaagccgagatcatgccattgcactccagcctgggcaaaaagagtgaaagtctgtctcaaaaaaagcaaaacaaaaagaaaaacaaaaaaagaaaaccatcttcttgaggagtctacttaagttcatagatgttataatttgttcatattactttacaacttaaaaaaacaaacaaaaacatttaatataaagttagctgtggtttataatattctgaattatggagtgaaaaaacagatttcaagtcctaactaaagtcactctagtgagaaaagttttctgagactagttcttgatcttttgcttttgttagtaccactactagtgtaacatttaaagataagtagaacattaaattatttgtgccaaattcaccccttttaaaaattaaaaactttgaaaacaaagtatctagttgtaaaactgtataatagcatccctttctatttgaaaaaaagatatgaaagatatgtatatatgaaggtcagtaagttatacactaaattattcgtgatgggatagttgatttttaaaaaatatttctgtattattgtttgaatttttttgaccaagagaaaaggtgaaattaaagggagtagatggtaaagctttaagtggaattgatgttgaaaagtgtaacatcaaaaagtaagttttcccagccttgagaaaaagctactttattggattacttttatgcttagatagaatgtatctatatagtacataacagtgcattgggccatagcattctagtattcacatgaatttaactgtatcataaggaagagaaatagtataattgagggaaaaaattgatggtatgaaaaagtaaattaattctaattgagttaccttaattctttttgtatgttaattgattaatgtgatcattgcaaaagccaaaaagaattcagtcagaaatatcatgatataatttgcattccattttctctgtgaccgtaaattgttggatattgcaacatatgtaacataaaccacatgtcagctgtttcctgcctcactgttgacaagagccccattcataactcttctttttatccttttagtgaataagtaattattcaatatagaaggcaggatatttggaactggctatttaatgtggcagcactctgtaatgaaatctgctgttactggcaacctgagaggagaatgtaacaattccagcatggctgtaactttatctgctttgactgactgtttatttggcacatcagtgaaccttttatcccagtgagtgacagctccagaagggtcacatttacatccattctatcatgtattgtaatatttaatggcggacaaggttgagtgagactgggagtaatttgaacttgcttttccactgagttgaggctaaaagacagcttcatccccagtattgtggtgtaacatgctatgacttagcatttgtttatgaaggctaatcttactgattacaataataaaaaaaaacagtcaagtagagtgtttgttctactaaattaaaactctttagcacacagtcttttaagttacaatgctatttaccttttttccctccccatcaatgaccacttctataaattaaccattttacactatttctctaaaatgagactttgttctgtgtcatttggtgtaataattgagacttagaaggaagtagttattaagaacctgtgagttctaatatatagcattaaacttttttttttagtatttgagaatttggaaacagaagagaaaaatcaggtaaattaagtagactatattcctgatgttccatatggtttgtttaaagagacatttatataactatttcagttatgaaactgagttacaagtgaaattgtccaggaaaaactaccctggatgataattttactgattggtttacactccatgacaggtaactgaatttcagatatacttgttccacacaagcaacctgctttcattattaaatattaatattttgcatttattttcgtacctttgctaaagaagaattttctctttttgaagttgttaagtgatcctttagattcaacttgataattctattcttttgtaaactatatttaaaagtgcttcaaaagcattggtgtattaaggaatatttgaatgaactatgctgtgaacaaaactattaactctaaactataatatcacaagttcgtatgaagcctaagaaaaaattaaaattgttcctactttgttttatcatttttataatttatgaaagaggagagttaaaatgtactcaaaacatttggaattggagagttagagtggtatgttggaaagaatgcaaatttggaaatatcatttataacttttaaaagaaagaatgaggaccaattttaaattgtagttttttctttaatggcaagttttagatactataatttcttgttatttctctttatttgaccattgtgattcattacttacaggttctgattccatgtgaggtttgataacgttttttatggtagtttagatattagttatcgtttctttcctttcttacagccccctggccactgttctaggtgctgttgttctactaaacaaggaaacagtcaagagtcatcgaataccattaagaaggatcatacagggaaatccaagatacccaaaatatattttgggacacgcacacacaagcagattgctcagattactagagagctccggaggacggcatattcaggggttccaatgactattctttccagcagggatcatacttgtgtccatcctgaggtagtcggtaacttcaacagaaatgagaagtgcatggaattgctagatgggaaaaacgtgagtaaagttattttgtgttagagaaaaaataaggctgaaaatatttaaattactcagtatgtgttttatatgtacattttagtgataatcaacttcggaaaatcaaattaactgctagtattgatatcttttaaaaaacaattttcctgtaataaaatctttagtcaagttttaaagtatgggatttggtcttaaagcttgggatatttaattccttgaaattaatttctgttgtagtcagacatcttagtttcttcttttaaatcctgctaccaaaaatagtcaaacttggatgatatcatatgaggagatagaagtgtttaaatggtttagtctaattagatctaattaatatactttatatacttaaaaacttcaaaagcagatagtttatttaggctgtctgggcaaagtttgaattttcttaattgaatgagaaatataatgattatcccacctcataattctgataaatacaaacccctcttttaaaagttatactaaattattaactttcaaaagatgtcattggtggttttgaaattttccagggaaattagaataatatgaatttgggcttggtggaaatagagaattctttcttactaaagacttatatgactttcaaataatttcttttggcagtattagtttgggagcctatgttctggtgtgataattagtttactctaaaattgaagttgcaagtatgaaattatacccccaaatcagtgaaccataaattgattactatgaagtgaccaatgatattttaatatatttttagagttgttttgtttttcactagtatcttattagagttggttctacacaaaaaactgtgagctatagcccccagagtttcatttcattgatatatcaccccctaccatataatgtgaattattttgttttatgcttttcttccttaatactctcttttatagatgaaaatttatttaaactttatttagggatggtcaaaagatactttaacagatattcaaacgagattataaagtataagtagtaaggtgttccaatggcaaaacttgagtgacttgttccgagccaggagagaatacagaattactgaatcaaagtcattgttgaaatcctacagtcatatttatttccaaagagttatttctaactaactgaggaattgtgaaattcctttactctgtatattaaaaaacttctcttcaaggagagatgaaagtattaagtgtcaggtgttcaaaaataataaaataaagctctttatggtaaaactccatgaatttcatgcataagtagactgctttccatagtgactaagtgatctgctgaattcctcaaatgcttgaaatttattttttggctatatagcctatgcaagaagacttgctggcattgtcaccatatttttatctttttttgttttacttgttattggggaaattaattatgtatttgtaaaaaatacattggctgggcctgatggttcatgcctgtaatcccagcactttgggaggcagaggcgggcacttgaggtcaggagttcgagactggcctggccaacatggcaaaacacatctctactaaaaatacaaaaaattagctgggcgtggtggcgcatgcttgtaatcccagctacttgggaggctgaggcatgagaatcgcttgaacccaggaggcagaggttgcagtgagccaagatcgcgccactgcactgcagcctgggcaacagagcaaggctcttgtctcaaaaacaaccaaccaaccaaaaacatacattggtaaaatacattggtaaaagcaatgataaagtgtaagattgtgtattgaaggcagacagtttcattttgtgtaacctagaatcctacagtgctggttacgtttttattgatctttactcataagtttgaatcatgtaaaaataaaaaggaattcagtagacttcaatgttccgaatttttcattggcctttagtttgtcttaaagtgaacaggtattttattttttaatattagtaatatgaataattgaagatatctgcttgtggtttgtcttgacctaattctgcctcagaatgcttacctcacgggcatacatgaacatcctctttcttgttctcaagccctgttagtaatttggtattgtaatgaagggcaattacaaagtcaccataggtgtctgtgtttactttgactgaattaccaaagcgaaatgataaatagataactgacagtttgaatggaagtgtttaaagtgtgataacacttcaattgacagacttcctcagggttgtgttacactgctaaaatggatgagcttttctggttttgctgtcagcctgcagaggggtgtcattctaactgcccttaaagtgtaaactttctgattttttggcttgatccaaggcacatgtgtttttgttcattgtttcttttactaaagtgcccttatactggaaaagtatgcacttatctgttaaaagttaatttttgtttcagttaagaaaaaataattttaactagagtcaggaatgacaattctgaaatattattttagatatatatctttttttggttaaaatgagacttaatagctcatagtcatagattctaaaggcactttagtgatcattttgtataaaggtaagctttcagaattgtatggaagaagcttggaatgaagaaatggtgaatgtcctattattaaactcagtctgtatcaaactgagagtatgaaagatgattgacacgtttttacctgaatcacagaattttagagctggaaggaattttagagatgatatagtcagtgagtcagaaggaatcttacaagccttctggttcaaatattcttttgatgcttagtcacatgagaaaaatgggccctggagttttctcagtcagacaagtaattagcaaggagggaccagaacccaaattttctgattcctcatccattgctattttggttacactagaaacaaaatccaaagatggcattgaggtagggagaagttgacacagtatgaagaataagaacagtagaggttagagaaagtgagtgaaaataatgtagaaaatggcctaaataaatatagttagatgagtcctttcctcctaatttttatttttaatactttggaggactaacaggtatcatcctttaacatggctgaatacaaagctttaggagaactggtcctcagctattcatgtcttgtcctttgatttgctgacattcttttataggttatgaatctcttatggtttactttgtttctagcaatatctagatacatttgtgtatgtattgatgtatgtatgttttgaaaacacggattctccttttggataattcatagataaaaatacatgtaaagattatatatatgcatatatatgtgtgtgtatatatatacaatttaatttattatacagacgtatacaaatacaatttaattttacacacacacacacacacacacacacacacacacacacagaaagagagagacatttcatcctgccttggcttctcaaagtgttaggattataagcatgagccagtgcgctcagcctgtaatgaaatcttttatttccagtaatacaatggcaaaggacattagtagataacctaaaagaagaaattcaaattattgctgaaccttgttagactaattatttttatattttataattttaataattattagacaaaaatattttgaatatatatatatggggaaattattatgtatttgtaaaaaatacattggccgggcatgatgctcatgcctgtaatgccagcactctgggaggctgaggtgggcacttgaggtcaggagttcaagactggcctggccaacatggcaaaacctgtctctactaaaaatacaaaaaattagctgggcatggtgatgcgtgcttgtaatcccagctacttgggaggctgaggcatgagaagtgcttgaacccatatgtatatatgtatgtgtatgtacacacacatacacacacacacacacacacacacacacacacacacatatgtatatagctgcctcaaagtcttttatccctgatataatttatatattttatgtatggttgttttttgttaaggatagcaaactaggaaaaataaatatttttatttcaaaatcgttttaaaataaatagtagaattaattaaaataaaagtggcccattattctaccacttagttccaatgacaattgaaaaagagaagtagtacatgtatgtggttagaaaatgaaaagagaggctttttctagatcctccatctccttaatcctttaaggtaactactgtaagattttatatatctattctaccagaatgtttaaaaaatgtatttgctataatgtatgtgcacatattctttaaaaaagcaatttacatgaatttaatcattctatacacgttattcaacatgtttttctcacttaacatagagagcctaatcaacacatagacaaatctaaatcatttttaagggctaaagtttttgtattaatttaccataatttatttaacatgtcccttatgggtagacatttggttaattttcaattttttggctatttaacagtacagggtacatctattcacattaatggtaaaattttaaattttggtagttttttgacaaattgcctatgtacttctactactagaattttatacttctactaaaaatatatatacttttctaattttgtacatttttaatagtatatgagacacttgttagggctgggttttatcaaacattttatttttttattaatgcacataatgagtatttttttttgagacaggatctcactctgttgaccaggctggagtgcagtggcgtggtcactgctcactgcggtttaattttttttgtttttttgtagagattgagtctccctgtgctgcccagctggtcttgaactcctaggctcatgcagtcctccggccttggcctctcaaaatgttgggattataggcatgagccactgtgcccagcctgtaatgaaatttttttatttccagtgatagaatggggtggagtgcagtggctcatgcctgtaatccccagcactttgggaggccgaggcaggcggatcgcttgagttcaggagttcaagaccagcctgagcaacatgacaaaaccctgtctctacaaaaaaggagccatatgtggtgatgcacttgtggttccagctacctggtggctgaggcacaagaattgcttgaacctgggaggcggaggttgcagtgaaccaagattggatcgtgccactgcaccccaggtgacagagtgagactcccatctctgaaaaaaaaaaaaggtaatagaatggcaaagggcattagtagataacataaaagaagaaacacaaattactattgaaccttgttagactattcatacaacactatgttaaactttgctagaaactataaaaaatacaaatcaaaacaagattctattttttacttttaagatagagataacaaaagataacaccagtgttgataaggatgtgggaaaagggtaatgcaaagcaatatatactttctggaggataatttcactatatgttttcaagaaacttaaaaataccttgtagcgtctgatcccataatgccatttctaaaaatatagactaagaaaatatttagaaaccagcataagaatgctcactgcagccttatgtctaaagcagaaattggtaacagtctataagcccagtaataagaaaactggttcatcagctatggcacattaattcaatgtacatatatgagcagcaacgaaaagatgcttagtgatgtcaagattttccttgtatgatttttaatacgctagacagaagaaaacaaagggaatatgctttataaaaatttttgtttattgtggctgaattgttaataatcctcaatgcctggggaacatttgctttgttcttgtttttattactatttagagatagggctttgttttgtcatccaggccggagtgcagtggcttgatcatggctcactgcatcctcgaactcctgggctgaagtgatcctcctgcctcagcttcctgagtagctaggaccattgatgtacgccaccaatcctagaaaattttttattttttgtagagacagggttttgctacattgcccaggctggtatcaaactcctcacctaaaacagtccttttgcctaagcctcccaaagtgctcacacctgtcatcgtgccttgcttgttcttgttattttaatattgggtcacattgtagagatatccttatatacacatgtatagaagaaatatgaaatgaaatacaccaaaatgtttctagtgcattctttgtgtaatagaattatggataatttaggctttttttggtactcctgaatattttgtagtgaatactcttactttctttttttccccttaggacattccaacctacctacttaccttccttccttcttatttatatttgaataagaaatactatcacatggctcaaagttgaaaaggtacaaaagggtctacagagaaaaatctctcactcctgtgcccagtcacttaattctcatccttggaagcaaccagtgataccattgttttgtgaatcctttcagaagtatttcatgcctaacatcagtttaatcagaaaaaaaaaggcataacaaacatatttaaaagaaatttttttcaagttaatttagggtatttggagctcttccgatttggacttctatctaagtctgagtcaaccagacttcgttgtgattgtagctatggtattgtctcaaaaaagacaaaaaattagccaggtgtggtggcgtagccagtaaaatcttagccttgtggctttaatgatgttcctcaaattctgagataagcttattttattccttctatgctaatattggttcacatttcagttatgcatatttgtttctagggaaaatcctgctatttttatcatggagttcataaaattagtgatcagcacacattacagactttccaagggatgtgcaaagcctgggatatagaagaacttgtcagcctggggaagaaactaaaggcctgtccatattacacagcccgagaactaatacaagatgctgacatcatattttgtccctacaactatcttctagatgcacaaataagggaaagtgtgagtatatgtgtaaaaatgagaaccttcttcctactcatggagatgtaaatgttgaatgtaaaagcttttagatgttttaattttttttgctttaatttatgtaaataaatttgtgtaaacatattagagtactgaaaacatatcctaacatgggttaaaatcaacccactcattttaatttccaaaataacaagcagttttaaggaacatagtgactgaagtgggattacagcaggatttctctttgcatttatgaatattcaaaaagaattatttagaaacatttctctgaaaaaactatgttttgaagaacttatgtgggggaataaaattatgccttgtgagctttgagaagtgaacttcagataatggcatttgtgtttgtttgcctggttctttttagagacatgcaattgttaacagcataagacaaaaagtgaataatttggcatagtcaattgttattcctgtcttcagatctgactgcacaattcatctcagctttctatttctttaagatccaaattaataggcattatgtttactaccccttctatcctacctcttatttggttatctcttaactagatctcttccttctgagacactgtgcatatcaatgccagatcagttttccaaatattgcttttattacatccttttatctgcctaaaaatctattgcttcctttgctcatgagataaagttcatatttcttaagcttacactcaagatgctcaatagtctgacctggatctgcccaatttgaatccttcaaaaattacctcatactcccttgaggataccttgttctttactctatctttgcttttgatgacacctctttggaatgccctgtccactctttgtctgtccaaatccaaatcctacttatcttttaaaccccaatatatttcctactcttccatggttttttctcaacttttcagctgtctgtgtattcttacttcctcaaaataactcattgacaattgctttgtgacagttccttgtattagtcagtactctttctattgcaagtgacacaaacctaccctaaaaaatgcttaagaaaaaatacttgattctctttattgtgatggctttattctcaggcaagttctcactcttgcttatggaacaaagataaccataagcagctagctcacctggagaaaagagcatggccacatattagtccctccaaattactctggttggcctaccgtggatcacatgtctgttcctgaacctgaaccagtcactgtgaccacagaaggatggaatactctatttaactgacaatcctgggccttacccccattgtgaaagtggtgatgtcctttgattcacaggttaatagtcctgccagcatcacatgggagttggagaagaacaattctccaactcccatgttggagaaggattgcaggacagattaaaacaaaacatatatattatgttagtattttaagagtcattttaatcttgtattgttattttacttttaaaggttttatgcttttaatcttgtattgttattttacttttaaaggtcttatgcttttaatcttatattgttattttatttttaaaggtcttataattagtttgtaaaattatgttggaaacactttcatagtgggattttatacctttctgtgtagcctgtggtaccttgatccagactcactgacatatttttgttgctgtcgataggtttgcaaagtattttaagagtaaaaaaatggcaaacacaataatgtagagctgatatttggttggccatagtgcttcagaagttttatttaagacctagaatctgttgcttatgtaattgcatttgcaatattggcctatagtgtgaattttaaaatgaaatatcttgcctgctgttgttaaatctattttgccaaatgttttacaagaaaattcttttatcttatagatggatttaaatctgaaagaacaggttgtcattttagatgaagctcataacatcgaggactgtgctcgggaatcagcaagttacagtgtaacagaagttcagcttcggtttgctcgggatgaactagatagtatggtcaacaataatataaggaagaaagatcatgaacccctacgagctgtgtgctgtagcctcattaagtaagaagatttgtctattagtgtatttgtgctgcctttatatgaaaaatatgtttgattatgccagagtatttaaagttagtaaactttggttaactaggcttcttgggaaatgaattgttccttgccagttaagctttaaaaacaaggctagtccaaccttttgtcttgttcacaagaatataatgaacataagtgatttttaaaaatgaataattgtgaatcttattcctaatttggcaggataacataatagccccgaaggatgtgtctaggatattgaaccagaaactaaacgtgcttttaattaatatattttaaaattctggatcatggctttaatttattgctttattctccaatttaaataggattctagtttcatgggttttaattaatcaagatttcagtactctaaaataatatatttagtactagctttatgacaatttacactaatttttcttttattagacattaagttgttgatctagaatcttgttaccatagaaaaaaacttcccaactctgaatcccatttcatttattgtagcatttttctgtttccttcacatttacactttaaaaaaatttgaatgttacacagtcacatggtttgaagacaaaatgtatacaaatttgtatagtaaaaacctccttccagttccatccctgatctgtttaatgtctgtgttctcctaaacaagtttatcattcaatgcatattactcatttatgaaccaatattagatatattttcttgtccctcactattttccaaatgatggcatagtatacatacatttttctgcaacttgcttttttcaattcccagtgtattttggagaccttcccatgttaagacctagaaagctttctcagtttaaaaaaaaaatagatatctagaattccattagatagatatgcaatagtttatttaaccagcctctgattaatagaggaggttgtttctagttttttgctcttaaactgctataatgaataactttgaacatacataatttcatttgtatgcaaatatatctataggaatctttttagaagtggaattgttgggtgaaagcatagacatatttgtaatttcaatagatatagctaacatttacacaatgggtggatgacaggggggctaatgtatgcttctaccagcaatgtataagagtatggaaattgttttcttctagcctgctaggtgaaaagtggtatcccaatgtagttttaatattcattttccttaatatgcatgaaattaagcatctttaaaggccatttatatttccttttgtgtcaactgcctgttgacatctctgtcctttttttgttcttattgtggttctttttcttaatgatttatagaaccccattcatatattagggaattaaaatctttgcctgcaataagagttgtaaatactttccaccccattttgccatttgtgtcttttctggtggtgttttgccatgcagatttttgtggtttttattttacagcataacttgttgaaagagttgtctgtagttgctaattctattttctcacttgacattcttccctcatcgatcttagcagtgttgctctctggacaattctacgcaaattgttttgatcaagatcactagtgatctctatattgccaaatacagaggttattgtttcttttatctcagccagtcagtggtgttgggtagttgatgactacctctttgaaaagcatttttgtcttagcttctgtgacatctctgattttcctccttctcacagtccatttttttttatcatttcttttgataattcttattctttttgatatctaaatgttggggtgcctcaggacttacttggtactgggacctagtttcttctgtagttctattttccctaaatagtttgtagtatcatagcttagaatataatcttcagtactggtgaggcctgaacctatgtctctagcttcagcctctccctagaatgccattcttatatccaactatctactttatagctctttttgtatatcaaaatagacatttcaactttacatctaaaacagaattgcttttcttcctgtgttctgttttctccccagtcttcctcatctaagcaaacagtatgtaccagttcctcaagtaaaaaagttaaatactatccttaataatatccttactgcctcacctcatccaattaatgagtaagtcttatagatgccacctgcacagtatatccccaattcctcaatatcattgattgttcatatctatcatcctacagtcttctctcaacaaggatattataacaacctcctaacaggtctctactttcactcatctttctccagtaatcaattctagcttggtagctagaatcattttttaaacatgtaaaatagatagtctgtcttttatttaaaactctgtatttaaaaccttcccaccaaaacagcacagtactggcataaaaacagacacacagatcaatggaacagaatagagaactcagaaacaaatccacacacctacagtgaactcatttttgacacaggtgccacgaacatgcactgagggaaagacagtctcttcaataaatggtgccgggaaaactggatatccatctacaggagaataaaacaagacccctatctttcaccattaacaaaaatcaaatcaaaatagattaaagacttaaatctacaacctcaaactatgaaactactaccagaaaacattggaaaaactctccaggacatcggtctggggaacaacttcttgagcaataccccacaagcacaggtaaccaaagcaaaaatggacagatgggttcacatcaagttaaaaagctgctgcacagcaaaggaaacaatcaacaaagtgaagaggcaacccacagaatgggagaaaatatttgcaaactacccatctgacaagggattaataaccagaatatataaggagctcaaacaactctgtaggaaaaaatctaataatctaattaaaaatggacaaaagatttgaatagacatttctctaaagaagacatacaaatggcaatcagacatatgaaaagtgctcaacatcattgatcagcatttctctgctgatcaaaactacaatgagatatcacctcaccccagttaaaatgacttttatgcaaaagacaggcaataacaaatgctggcaaggatgtggagaaaagacaaccctcgtatactgttggtgggaatgtaaattaggacaaccactatgaagaacaatttggaagttcctcaaaaaacttaaaatagagctaccaaacgatccagcaatcccactgctagatatatacccaaaataaaggaaatcagtatatcaaaggtatagctatactcccatgtttgctgcagcactattcacaatagtcaagatttgaaagcagcctaaatgtccatcaacagatgaatggataaagaaaatgtggttacatatacacaatggagtaccattcagccataacacagaaggagatcctgtcatttgcaacaaaatggataaaattggaagtcactatgttaagtgaaataagccaggcacaaaaagacaaatatcacatattctcacttatttgtgggatctaaaaatgaaaacaatttaatccattgagatagagagtagaaggatggtttaccagaggctggcaagggtagtagatggggatcacaggggaggaggggttggttaatgagtacaaaaaaaagaaaaatagaatgaatgaataaggcctagtatttgatagcacaacagtgtgactatagtcaataatgatttaactgtacatttaaaaataactaaaagaatataattggattatttgtaacacaaaggattaatgcttgagaggatggataccccatcttccatgatgtgattattacatattgcatgcctgtatcaaaacatgtaccccataaatatatacacctactatgtacccacgaaaattaaaaattaaaacccaagccttcccattgccctttgaataaattcagatttcttatgatgactcaagatgactgatttctgcttatcactctgacattgttcataccattattcatttttgcccattgtgctgcaaatcatattggctttctttcagatcctcaaacaagcaaaatttgctaaccacctcaggacctttctcctagctgttccttctgcttggatatttcttttcttctgattctcccatgactggatactttttgcattcagttattagaataaatgtcacctcagggagagcattcttgacattaaaattaaagttgcaactaggttatattaaactaatttattttcataatttatttgtatataattacctgatttttttttcattttattagaacttttttttttaacttttaagttcaggggtacatgtgcaggtttgttatacaggtaaacatgttatgggggtttgttgtacatattatttcatcacccaggtattaagccttataactcattagttatttttcctgatcttttcccgtctccaacgctacaccatccgataggccccagtatgtgctgttcccctcttgtccatgtggtctcatcatttagctctcacttataagtgagaacatgcagtattttctgttcctgcattagtttgctaaggatatgatctccagctccatctatgttcccgtaaaggacatgttcttgttcttttttatggccatatagtatcccatgactacctgacattttcttgtttatgtatttgttttgatgtttattcctgtctccctttagtagaatgtaatttccatgagagtaaggaccttgcctattttatttaactgctgttattttcactacccagaacaatgtctggaataaaataggcattcaaacacttaatgtatgaatgtgtatatatatcaatgaatgtatttatatattttctagtaattctcttttttgtgttaatatgtaacactttaatttctttattaggttgttttgcatttccttttatatatatttgggataagtacctaagacctggctctcagttgaagagacattagctaagtaaagcaatgtgaatccacaaaacaagtgggaaatcatatgcatgtttgtttcttctgaataaaagctttcttttcagttatataaagtttattttgcaatatgagacatgaatgctttttaaaaggtgtcttaattaatccacattcatgtcctaagaatgtcaagatatacagatcaacgcatgacaataatgatgattctcttgttctgctgaaatagtgtgtgtaaggatgatactggttgacacaattgttttattttatttcagttggttagaagcaaacgctgaatatcttgtagaaagagattatgaatcagcttgtaaaatatggagtggaaatgaaatgctcttaactttacacaaaatgggtatcaccactgctacttttcccattttgcaggtaagatattttttctacctgtgaaacgtatttagtgaattagaagtgatttagtcgtgactaaatccagattaaatctagtgagtaacccagaattgttaaatatagcaatttaattttttaaaaattttattatctaaatttgataatctttaagtgatggcatgggtaaattgtgggtgaaaatatagcattatttagtttgaaggaaattagtctttaaagggattaattgctttgtttaaagctaaaaggagtcaatatttttaggttgtagacttacttagtcaattgtaaaagttaaaattttagaaaataaaaagaggagaaattcctatttcgttcatcttaatttagaaattataaacctgatattcatggagagatcatgagtaggctttggaagactatgaaacttatgaagctatatgcaaaattttatgagcgtatccttttgtacatttttctaaatagaggctgcataaatttcattatattttctaatgttttttgccgataagaatatattttctttttttgttgctatttacttatttaaattaatagattatgtattttagaatggttgttttaggtttagagaaaaattaagcagaaggtccagaattctcatatactctcactcccagctacacacctatacacatacacaatacacaccaactccatagtttccccattattgacctcttacaatagtgtagtatatttgttataattgatgaaccattattgctacattattgttcattaaagtccataggttaccttaaggtttaccccttgtgttgtagagttcaattaggttttgcctaggaatccaccactacagtatcatacagagtgtgttcactgtcctaaaaatcttctgtgttacacctattcatccctccaccacaccacgcccacacccaccaaacccttggcaaccacagattttttttactaactccattgttttgccttttctggaatgccatatagttgaaattgtgcagtatgtagtcttttcagactggcttctgtcttagcaatatgcatataagattcctccatgtatttttttgccttgatagctcatttcttcttatagctgaatgatatttcattatttggatgtaccacagtttatccattcacctactgaaagaaacattgatggtttccagtttttggcaattgtgaataaagctattataaacatttctattagtgacaagctttctactcatttggatatttacttaggaacacaattgttgtattatatggtaagactgtgtttagctttgcaagaaactgctaaacagtcttcaaaagtggctgtaactgccgggtatggtggtatgcgcctgtagtcccagctacttgggaggctgaggcaggaagattgcttgaacccaggaatttgaggctgtagtgcactatgattgcatgcttgtgaatagccactgctctccagcctgagcaacatagcaagactttgtctcttgacaaaaagtggctgtaccattttgcattcccaccagcaatgaacagaagttcctgttgttgtacatcttcaccagtgaactttggggctgaggactctgcttctacgagtacaacttttttagatgacacatatgagtgatagcatgcagtatttgtctttctatcaggcttatttcagatagcataatacttccagtttcatccatgttgttgcaaatggcaaaattttcttcttttttaagactgaatatttcattatatatatatgtgccacattttctttatttcattaatcactcactatattctcacttttccccatgggaagaattgtgggctaatggaggctctcttggcactgagctgtacttccgtggggcaggggtgatgtaggtaatatgaaactatactttttgccctcttcaatgcatctgttcttggattttttgctccaatggggtcctggaacttctctgctagactcttagactcttaacaaaggtactctcatgtgcgagtggttgtcagaattggttcattgttgggagatgacaatggaaaactcaaattcttttttttttttttttttttttgagatgaagtctcactctgttgcccaggctggagggcagtggcgtgatctcggctcactgcaacctctgcctctcgtgttcaagtgatcctcatgtctaagcctcctgagttgctgggactacaggcatgccccaccatgcccggctaatatttgtatttttggtagagacagggtttcaccatgttggccaggctggtgtcaaactcctgacctcaagtgatccacctgccttggcctcccaaagtgctgggctcacaggtgtgagtcaccgtgcctggctagaaaactcaaattcttccatcttgctgatgttatttctcaaagaggtttttgaacaaaaaaaatgatgaaaataattgccaacatgatcacaatagtattcggggcatgtgactattaaaacatatattttaatcaggatatacttaaatttttgccctgcatttataaaatgcagcgtggtatctattgtaagaatttttccatattgtgacatctttcataatattttttgcataaattgtttgcattttgaaagctacttatataacagtaaaatggggctgagggtggtggtgcatgccagtaatcctacactttgacaggctgaggctggcggattgcttgagcccaggagttcaagaccagcctgggcaacaaagaccctgttgtctacaaaaaattagctggtgtggtggcatgcgctgtagtcccagctacttgggaggctgaggcaggaggatcacctgaacccaggaggttgaggctacagtgaaccatgattgcaccactacactccagcctggggcacagagcaagaccctgtttaaaaaaaaagaaaaggataaattgtagcatattcatatagtggaatactacatagcaataaaaaatgaactgcttccaacacaaccatatagatatatatatatatttttttgagatggagtttcgcccttgttgcccagactggagtgcaatggcgtgatctcagctcaccgcaacctctgcctcctgggttcaagtgattctcctgcctcagactcccaagtagctgggattacaggcatgcgccaccacacctggctaattttttgtatttttagtagagacggagtttctccatgttggtcaggctggcctcgaactcctgacctcaggtgatcggcccaccatggcctcccaaagtgctaggattacaggtgtgagccaccgcacctggctctagatgaatcttaaatattatgttaggtgaaggaaaccagattcaaaagggtataaactgtataaatctatttttatgaagttgaagaacagacaaacctaattatggtgacagaagttgaagtactggttacaactatgtgggggtttgaagcagtttgggctgagaaggggcacaaaggaacatctgggattctaggaatgttttgtatcctggtcaggtgttagttacatggggaggtgtgtgtatttagtgaggtgtacatgtaagattagttcattctactgtatatgttacatgtcagttataaaatgtacaaataaaatgtatgtcaagggaaaaaaactggaaaatacagaatggcacaaagaaaaatgactcataaactcaaagatgaacattgtgaacattgtgatttatgtctacttatgccttcttctatgcccatatttgcttattataaatatatttctgatatgacacatttgttttaccctcttttaatttaacaatatattgtgtatactttcctatttaagtaaagattccttcacataatttttaattgcggtgtagcatttttatgagtgtacttattctaaattgattaatctgataagttgaaatataggttatttccagtttcccagtataataaacagttctgatatgaacatcccttatgaattgtggtttttgaatttactttaagcagtcttttcttatcctatgttatatttctcctaaaaattttaaggtatttattgtttataaaggatgggatttataaatacttttacaaagccttggattcattttgtttatgttgtgaatttatgaatcaatttttttcctgtatggatagagaattgtcccagcactgtttcctaaatagtgcatattaatttccctctaatttgtaatgctacctctgctacctatttttctttttttaattaaaaaaatattttttaactttttttttttgtttttaagagacagagtcttgctgtgttgcccggaatgaagtgcaatggtgcattcatagctcactgtaaccttggatttctggtcttaagggatcctcctgccatagcctgctcagtagctgggactacaggcatgcattaccacacctggctaattacttatttttttatttattttgagacagaatctcactctgttaaccaggctggagtgcagtggtgtgatctcagcccactgcaacctccgcctcccaggttcaggcaattcttgtgcctcagcgcccccaagtacctgggaccacaagcatgccaccacacctggctcattttttgtatttttttgtagagacgggcttttgtcatgttgcccaggctggtctccagctcctgagctcaagtgatccacccgcctcggtctttcaaagtgctaggattacaagcatgagccacccgtgcctggcttaattttttttatgttttgtagagacagggtctcactatgttgcctaggctggtcttgaactcctggcctcaggcgatcctcccacctcggcctcctgaagcactgggattacaagagtgaaccactacacccagcccctctaattttcatatatgtgtgaatttatatctggacttgattgtgttccaccattctgtttctctaatttgtcacatttgttaattaatgatttaagaaaagtgcttatatatagtagggcatatccctcactttattattttcctttggaattgtatcagctgtcctttgttttactctgccatttgaattttagaattagcttataatctctaggaaaagttctgttagaatttttattgtaattgcactgtatttatagattaatttggaaagaattcatgcatttacattatgaagttttcccattcatgacaagatatagttcttcattattttttcctatctttcaataaaattttataattttatttttaaaagattagatggctttggttagatttattcatgggtagcttaaagtttctgtttccattacaaatgatatatttttaaaattacatttttaattgttattgctatataaaactggtgtttgatttttatatatttatcttataattgtcttattaaccaccttgttgaattattttacaggtttgcccacagattatcttaaattttccatgtagataaccatattgtctgaataatgaccggtttctttctttctcatttctttctatttcttcatgtttttatttcttactatgctgtctcagacttccagtgcgttgtttatcacaggcaatgaaaaagacatcctgggccaggcgcagtggctcacgcctgtaatcccagcactttgggaggccgaggcgggcagatcacgaggtcaggagattgagaccatcctggctaacacggtgaaaccccgtctctactaaaaatacaaaaaattagccgggcgtggtggcgggcgcctgtagtccccgctactcaggaggctgaggcaggagaatggcgcaaacctgggaggcggagcttgcagtgagccgaaatcgcgccactgcagtccagcctgggcgacagagcgagactctgtctcaaaaaagaaataaaataaaataaaaaaaagaaaaagacatcttggttttgttgcttaaaggaggaattactagtattgcaccctttattgagatgtttgctgtgattaaaaattcttttttaattaacagctctattgagctataattcacatgcttaaaatttacctttttaaagtgagttctgtgggttatttttatattatatatttatatataatatatagtatatatattatatattttatataaatattttatataaatatatatactatatatagtatataactatatataatatattaatatataatgttttatatatttttatatattttatatagtatataatatatttttatatattttatatagtatataatatatttttatatattttatatagtatataatatatttttatatattttatatagtatataatatatttttatatattttatatagtatataatatatttttatatattttatatagtatataatatatttttatatattttatatagtatataatatattatatattaatatatttattaatacataaacatgcaatatatttatatataattatatttataaatttatataaatttatataaatttatttataaataaaattataattttataaaattatttataaatttatataaatttataaatataaatataatataaatatattatatataaatatattatatataaatatatatttttatatttacattatatataaaatatatttatatattaatatattaatacatatatgaatatatattttatataaatatattatataaaatatatttatataaaatatataaatatataatatatactatattatatataaatatataatatataaaatatataatatagaaataacccacagaactcactttaaaaaggtaaattgtaagcatgtgaattatagctcaataaagctgttaattttaattcaattcaattcagttaattaaattaaaaaattaattagagctgttaaataatatatatattatatttttattatattatatattttatagttatttttattggattaaggaaatttgccctaattctagttggctaagacattcatcattatgattatcaatatttttaggaatttttaccaaagtagtatacctatagaatataaagagtcagttctgttgagaaaagcattcctctgacccactcctcaatcccaattctcactttggagtgcacttttatctcttgtagtggtttcttctgatatttaaccacatttaaaaaaataacgtgggttctgcttctttggagttttcaattttagatgttgtctgttgactttctgttaagtataatgatgatttagctcctttagacacgcacacactcacacacactcttctctctctgtcacacacacacacacacgctcactcatgcgctctctcttcttcctttgcttcctgcttttctgcccttctttcttctctctcttcactctctattctgccagtatagttatattgatattcagcgtggatatcatcacgtgtatgtattattatagcccatgatagtaatgcatgtagcttacttgattatatttttatacagctttatgtatgtttcctaaggaaccataattaactttttatttatttttccattgcttagttttctatttttctaccccccccaacccagctgccaatgtgtaggtaacctaactggaattgagctcggagtactctaataattgaatatgtaggatttcatttagcccttctgtttttagtacagcgcctcacctttagtagtttatattttctatattttatcagagtaaattgccagtgttctgccagtgttggagaaggatattaagctttgatataaggtgttgctgaggggacttcatttttcaaaaagaataatttgatatttgtatttcattgcagggctgaatatttttccaagttcatgttgtctttcttgtttgttctttgttggtttgttttttaagtctttctacttatttgtattctgtaatgttttgttcagtgaaggctgatttttactcttatagatttgtattgtttcatgatatatctgaatattaaaatgtatctttcttatttatcctatttccccattttattttcattgaacacattttattgtcagacatcagagttgtcaccaatatcttttattgcttcagtattcagaattttctcttttacaatgtggggaacatactcttctgttttcttataattttgttttaatgtccacactttcatccatattaaaacttatgagccatgtaaagaccaaagaaccagttaacatacattttgttatttagcatgtattgtttccttaagtcatttagttttgcttgtgatgtagtcatattattctcagcatcagaattactttctggaaataactcatggatttaaggcaacatatcaactctttaaagccttttggagaagccatttgctacatttttatttaattccttacatctgaaaggcaccaaataataccctgattgaatcttctaaatacctaacttattattaaagagtctttgactctgaggagaattttgctaatatggcaatctaaaatatattgttagcattgtgctgttaataattgtctttgtttgtatcactataaatacctgaggctgggtaacttacaaagaaaggaggtttatttggttcacagttctgcagcttgtacgaagcatggctccagcatctaattttgaggaccttagcctgcttccactgatggcaaaaggtgaaggggagctggtttgtacagatcatatggcaagagaagaagcgagagagagaagggagggaggtgtcaggctctttctaacaaccagctctcgtgggaactaacagagcactaactcaccccctctctacttagggagggcgttaatctattcatgaggtatctacccccatggtcccaaacctcctgatatgccccacttccattactggggatgaaatttcaatatcagatttggagaagtcagactatcaaactatagcaattctgttcacctaaaatttcaatgcatgttttgttgggtttcattgtatttttgagaagtttctttttccaattccctcccaacccctctatacttaatatggtaatttcttatagggacatttttctgctgttcttcaaaaagaggaaaaaatctcaccaatttatggtaaagaggaggcaagagaagtacctgttattagtgcatcaactcaaataatgcttaaaggactttttatggtacttgactatctttttaggcaaaatagcaggtaagtgaagataactagtatgtattttccttttaaaaatagcctaatttggatgctagcatgtgtttaatacatacctattttgggtgagtaaataggagaattgaaaacaagtgttatagatattattatatatttgctcttattgacacagacttagaggaattgaaattagtctgatgcttttttgagacagggacttctctgtcacccaggctgaagtgcagttgcatgatcacagctcactgcaactttgacctcctgggcttaagcaatcctcccacctgtttcctgagtagctgggattacaggtgtgcaacacccacacccagctaattttttaatttttattttttttgtagagatgagatctcactatgttgatcaggatggtcttgaactcctggcctcaagtgatcctcccacctcagcctcccaaagtgctaggattgtaagtgtgagcccatgcctggccaaaattagtcttttatattaatgaatattgaaatcattaaataaatatatttaattaattcatattaaattatcttctattgctaaagttttcttatgttcctacagtgtcagaaagtcccttttttattgtatgaactgtggaaaatgaaaaacaaccaatccctctcatcctgtaacttaaattatagtagtacctagttctggtattttttttttattgtggtaaaatatacataaaatacaccattttaaccattttacgtatacaactcagtgccattaagtacagtatatttgcaatgttgtacattgtactcatttccagagatttccagaaattttttattattccaaataggaattctgtacccatgaaataataacccctagagtctttcccctcatcacctgctaacctgtattctattttcatcttatgaagtcctttctaggtatttcacataagagcgatcatacaatgtttgtctttttgtgtctggcttatttcaattcatttggcacagtgttttcagagttcatttatgtagtagcatatatcagaatttcattcctttctatggctgaataatactccattgtatgtatataccacaatttgttaatttattcttatgttaatggacatttgggttgttttcatcttttgcctattgtaaacaatgctactatgaacgttggtgtacaaatatctgagttctgctttcagttcttctgggtgtatataagtacctagcagtggaattgcagaatcatatggtaatgctgcatttaactttttgaggactcaccatactgtttctcacagcaactgcattattttccattctcattatcaatgcacaagggttccaatttctacacatccttgccaacagtttatgtagcagcatatatcagaattgtttttgctgacactcgttattttattttttgtataatagccatcctaataggtatcaagtgatatcatctggtttttatttgtatttcctaatgactagagaagttgagaatcttttcatgtgcttattggccaattgtatgtcttttttggagaaatatctattgaagtcttttgcccacttttgaattattgggtttttttgttgttgttgttgagctgtagttatttagatattctggatgtcagtcctgtaagagatatatactttacaaatattttctctcattctgtgggttgttttttcatttattcatagtgtcctttgatgcagaaaaggtttttaatcttgttgaagtccaatttatctttctcttttcttgttgttgcctgtacttctagtgtcacatccagtaaatcatggccaaatctgatatgaagatttcccctatgttttcttttcctttttttttttttttttttctgagacgggagtctcgctctgtcacccaggttggagtgcagtggcgcgatctcggctcactgcaagctcagcctcccgggttcatgccattctcctgcctcagcctcccgagtagctgggactacaggcgcccgccactaagcccggctaattttttgtattttctagtagagacggggtttcaccgtgttagccagaatggtctcgatctcctgacctcgtgatccgcccacctcggcctcccaaagtgctgggattacaggcgtgagccatcgcacccggtctcccctttgttttaagagttttacagtttttggctcccagtatttttataagattctctccacagttgttaagttcccaactttaattttgagatctaatctctctaggagtgaaatgaataaggaaatactatagcgaagacatggtagagaatatcacattttacttttttttttttttttgagatggagtcttgctccgtcacccaggctacagtgcagtggcgctatctcagctcactgcaacctccacctcccgggttcaagtgattctcctgcctcagcctcctgagtagctggggttacaggcgactgccaccacacctggctaatttttgtatttttagtagagacggggtttcaccatgttggccaggctggtctcgaactcctgacctcgtgatccacctgcctcggcctcccaaagtgctgggattacaggtgtgaaccaccgcgcctggccacattttattatttttaagcttaaccattttctagattcttattgaaagcagttatacactggatgggatcacagatatcatctggttcagcaccttcattaaaagtagatgaaggctgagactcaggtttcaaaggaatgtaagaattttataacttgttgctaatactttaaaaactttcagtaaaaattatccttctattttctcatttaataaaaaagtataacccaccttttagtctctttaaccataatactgttttctattttgtaactcatcatgtagtagagcatgcagagagctctggactgggagttaggaggcctggattttaattctgcttctgccatgacatatgtaatgtttgaaaatgaggttaggaagtagctgataaaagatagatggttagatgatttctaatattccctctgagaatcagttgattctatgattaatggctttattaatatcagaattactgaatttaattaatggtaaggagaatgttatttttgaatgggaaggtaccagctctttcaaatgagttttaatgtaatcagtttttatattgtatgtagctgggtcataggttttaaaagttttgccacttaattagcactttctttgcatctagatttgcagatgattataaaattgcgattcaacagacttactcctggacaaatcagattgatatttcagacaaaaatgggttgttggttctaccaaaaaataagaaacgttcacgacagaaaactgcagttcatgtgctaaacttttggtgcttaaatccagctgtggtaagctcatcatgtaaatggaaattttgtcttcttgctcagtaccagcattttaataaatgtggttgactcttttaaagatagttgtttgttgttgttgttgttgttgttttgaggcagggtcttgctcttcacccaggctggagtgcagtggtgcaatctcagctcactgtagccttgaccttccaggctcaagcgatcctcccaccttagcttcccgagtagctgggactataggcatgtgtcaccatgcccggctaatttttgtattttttgtagagacggggtttcaccatattgcccaggctggtctcagactcctagactcaagcgatcttcctgcttcagcctcccaaagtgctgggattacaggtgtgagccactttgcccagcctcttctaaagataattttatttatctaatgttgttttcttttaggccttttcagatattaatggcaaagttcagaccattgttttgacatctggtacattatcaccaatgaaatccttttcgtcagaacttggtgttacatttactatccagctggaggctaatcatatcattaaaaattcacaggttagttgttgtttttttttttggaaggccttcagtgtttctacttcaatataactatgtaaacaagttagaagatacctgaagtgccagcaagtaaatcttggtaggaaattcaacattccagttttacaataaaagaaaatctgtcagctacttaatgatgtgtcaacagaaggaaataatccagtcacttgggatgcaaaaggctgtatttcagcttcttcttctaagtaagttttagttttgtaatgaaaacaaaattttgatttctttaattctcattgtataattatgttttatttattgattgattgatttttgagacagagtctggctctgttgcccaggctggagtgcagtggtgtgatcttggctcactcgtgtttaagcaattctcctgcttcagcctctcaagttgctgagattacaggtgtgcgccgcacgcctggctaattttttatttttttggtagagatggggtttcagcatgttgtccattctggtcttgaactcctgccctcaaatgatgcacttgcctcagcctcccaaagtgttgggattacaggcgtgagccactgtgcccagcctatttatattttatttattttatctctgtatttttatttttacttttattttttgagacaaggttttgctctgtcacccagactggagtgcagtggtgcgatcttggctcactgcagccttcgcctcctgggttccagcggttctcctgcctcaaccttctgagtagctgggattatgggtgtatgccaccatgcctggcacatttttgtatttttagtagagatggggttttgccattttggccagactttatctttttagagacaaggtcgcttgctatgttgcccaggctggcttcaaactcccaggctcaggcagtccacctgcctcagcctcctgagtagctgggactacaggcatgtactaccatgcccagcttgtataattatttatgcttctcttttccattagactacagtgtatcctgattcttccttttacatccacgttcttcctctgtgcctagattaatagctggtatttagcaagtgttcagcatgtttgaatatctgaaatgagttaaaagtactcttatgagtcctatgatttaagattttaatgttttataacgatggctactaaatgttattttaatttttgtggaaatgtatagattgttatttttcattatgccttctggtttctttttatgaaatattttaaagtggttaggcacacaggtgatgttaagctgtggttaatgctaaagtggttaagttaacatcacctgtgtgcctaacacaatgctagctctttattaagctatatacacaggtttataggtgggaacatttttggtcctcacaattacttgggagcaactacggcatttggtagttgggaacctagaatgctactcctatgtaactaagaattgtgctttccaaatgccagagtgttcctgctgagaaatgtgactatgaacagcagtgaaggaagaatacatgttccacgttttcaagttgctttctttagagacacagataaatatgggaagttggtaaattcagcatacgttttctcataagaatgttattacaggctctatgttctcagcctactgcacaaaagtccatttaacctataatgtcgctgaattataataatgtagttgtgcagctggattctgttacactgtaatattttccttcaacttaaaatttaaaaaacttttaattgtggtagaatatatataaaatttaccatcttaaccatttttgagtatacagctcagtcttattaagtatgtatatgttgttgtgcaaccaatctcaagactttctcctcttgaaaaactgaaactctgttcccattaaacaacagctctctattctccccctctccccagctcctggtaactaccattctgctttctgtttctatgaatctgattactataaatacttcatataagtggaatcataaaatatttgtcgtttttgtgactggcttattttacttagtaatgtcctcaaggtttgtccatgttgcagataatgtcttcaaagttcatcatctatgttgtagcatgtgccagagtttcctctttaaaggtgaataatgtttcttgtgtgtatatgcctgtgatttataatatatatatttggtcttccactccatttcctggcatacaactcctaaaatccttagaatctccaaagtgacattttgtatgctaatgagatgactaatggtagggggctcctaggtagcatcaggatcagggctggcctccgggaagaccaagacatggtaggagagttgggattttcacccccattcctcaacctctggggagggcttgggggagatgatgctaaaggttaagtttatcttaatggccagtggtttaatcaatcatgcctacataatgaagcctccataaaaacctagaaggacagggttcagagagcttccagatagctgaacacttggaggttcctgaacacttggagggtgatgtgcctgggaattgaagctctgagccccttcccacatacatctctttatctgtatcctttgtaatattttttctaataaatcagtaagtgtaggtaaatgtgtccctgggttctgtgagcagctctaccaaattaattgaacccaagcagagggttgtgggatgcccgatttctagctgatcagtcagaagcgcaagtaaaaacaactgtgactggccacagaaatcaggggcagtcttggggactgagccctcaacctctgggatctgaagttatcatctcccagtagatagtatcagaattgaattgaattagaggacacccagttgatgtctgttgcagaattgattgcttggtatgtggaaaaaacctcccacacatttggtcacagaagttttctgtgttgattgctgtggtgtgagagcaaaggaaaaagtttgtttttttctactcaatgctacattttgatcattcattcattgattctttcaactgtatttcaaaaaattagaaatttcagaaaagttggaaagataatattaatattgtgaatatctttatatccttcacctagattcatcacttgttaacattttgcaaaattttcgtctctctccctctctctacatataagggagatagaattgcaaataactgtaagatgtggtgggtgtgatttttttctatgactaaggatctttgagcaccaatgaatttttgaaagagtagttcctgtcatttttgagacttgcctatggcaaattatactggccttcatccccagtattttggaattatctgattctgctattggtatatattcatcatttcacttgttcatttattcacctaacaaaaatttgttacatgcttaaattttgcaaagctattaagtaaacagagacaggtacaacctgttttgctttcaaagaattttcactctaagagaatttagtgatctgcctaaagcaaaacatttataaattaaatctgtatacagttaattgaaggtaatagaaaaccccctgacaatttaaaaataaattgttaaacttgttgcttgatcttttatgtacatacttccaaataaatactaatttccatgcctttttcaggcataactctaataatgacatattcatattctaggtttgggttggtaccattgggtcaggccccaagggtcggaatctctgtgctaccttccagaatactgaaacatttgagttccaagatgaagtgggagcacttttgttatctgtgtgccagactgtgagccaaggaattttgtgtttcttgccatcttacaaggtaagggaatatttattgtttcttttgcctttaaataatcatttacattttaaacattggcatgctaattttaaaattaccacagtaagcttcctagggtagaggcaacaaggtaataactatagttttctaaacatcacatattattttacttattttttgattaagatactgcctgattgtcctacctctgttttacttaaaagtctgaaagagcaaggctggacgtggtggctcatgcttgtaatcccagcaggttgggaggctgagctgggaggatcacttgagcccaggagttcgagaccagcctggagaacatggtgaaactctgcctctacaaaatacaaaaattagctgggtgtggtggcacacacctatagtcccagctacctgcgaggctgaggtgggaggattgcttgagcccaggaggttgaggttacagtgagctatgattgcacccctgcactccagcgtgggcaacagaataagactctctctaaaataaaataaaataatctgaaagaataaaagtcttcaagcaatgttaattatataggagaagtgtttatgtgtacatttttattcttagggacaagtcgatattttcagagtagaaagaaacagagcattcttttttattttcataaattacatttctgaaggtttcattaaagttaatctaagccaaactttcttcgttgccctcattttacttcatgtatctggccagaagaattttgttgttgtttttagagtcactgatttttaataattttttttagttaatttgaaattatttagtatattttggtcctcctaacattcaaagcattgaaaccacttataattcctgaaagtaacatcacattgcatcaaaatctaacctaaatccaatgtagagaagtggcgttcccttctcttttttccacaggaagttatacctctaaggacagaagcatttggaagtaatatatttgaatgacaatattgatacttttgactcttctactgtctttttatatatatgtactttgatagctagggatacactaaagcaattagtctcttgtagataaattaaaggatttgttttcaaaaacatatttaatcagataattttttacaagaatatctaaaaataaaacggacataaacattttttaaaattcttaatggaaaacaagatttattccagtgtgaacatctacaccaaacagttatatttaggaaaactagtaattaagcttgatactaagtcatacaataaaacttgtagggagttggtcttacctaataaaatttttaggacttttaattcttaaatatggagacaaatatcttccgggaaattggaagaaaagttatttatgggattatggaaactgtactcactccacagttatgtaagcgattaaagcaaaatcttatttcattgctaaaacctttttatattttccagtcatagtcacaaaaagggagataggagatgtctgggtgacatttttctgctaggcttggaatgcatatagcagacagtatgaattttagttacagacatttataattgggtgactagagactataacattgaaataactttttagtgactgtatatatattagcaaaatgaatagattatttttctgcttctagcttttcaattaaaaataaagacacaggaaatccttcgaatatactttgttccaattgagtttatttctttgattgcgaaattaattgttctgcaggtttttgtttaatttttttgtggcttaaaacagtaaacatttattatctcatagtttctttttttattattatactttaagttctagggtacatgtgcacaacgtgcaggtttgttacatacgtatacatgtgccatgctggtttgctgcacccatcaactcgtcatttacattaggtatttctcctaatgctatccctcccctaggcccccaccccagaacaggccccagtgtgtgatgttccctaccctgcgtccacatgttctcattgttcaattcccacctatgagtgagaacatgcggtgtttggttttctgtctttgtgatagtttgctgagaatgatggtttccagcttcatccatgtccctgcaaaggacatgaactcatccttttttatggctgcatagtattctatggtgtatatgtgccacattttcttaatccagtctatcattgatggacatttgggttggttccaagtctttgctattgtgaataggctgcaataaatatacgtatgcatgtgtctttatagtagcatgatttataatcctttgggtatatacccagtaatgtgatgactgggtcaaatggtatttctagttttagatccttgaggaatcgccacactgtcttccacaatggttgaactaatttatactcccaccaacagtgtaaaagcgttcctgtttctctacatcctctccagcttctgttgtttcctgactgtttaatgatcaccattctaactggtgtgagatggtatctcattgtggttttgatttgcatttctctgatgaccagtgatgatgagcattttttcatgtgtctgttggctgcataaatgtcttcttttgagaagtgtctgttcatatcctttgcccactttttgatggggttgtttgtttttttcttgtaaatttgtttaagttctttgtagattctagatattagccctttgtcagatgggtagatcgcaaaaattttctcccattctgtagggatgggagcctacagaatgttctgtaggctgttcactctgatggtagtttcttttgctgtactgaagctctttagtttaattagatcccatttttcaattttggcttttgttgtcattgattttggcgttttagtcatgaagtccttgcccatgcctatgttctgaatggtattgcctaggttttcttctagggtttttatggttttaggtctaagatttaagtctttaatccatcttgaattaatttttgtataaggtgtaaggaagggatccagtttcagctttctacatatggctagccagttttcccagcaccacttattaaatagggaattctttccccattgcttgtttttatcaagtttgtcaggttttgtcaggttttgtttttgtcaggtttgtcaattagttgttctgcaggtttttgtttaattcttttaaaatttttgtttattgtctgcttgtcttggttgtatttgtctttttaattgatttgtatgggcttttaaatatatagtgtggatagtaatcctttataatacatatcattaaaaccttgttgtttgtcattaaattctttaatttcttttttagctttaaatatcttaatttatcaaaataattcttatacataattaaataatgttagaatggttataatgaaaaaacaacagctcccttcactatactactcctcctttcttcccagtcccacatccccagaggcttcgcaggtctttgatttatttttctgatatttattgtcatttctaattgtggtgaaacatgcataacaaaatttaggttttttttttttttttttttttttttctgagatggaattttacccttgttgcccagtctggagtgcaatggtgtgatcttggctcactgcaacctctgcctcccgggttcaagtgattctcctgcctcagcctcctgagtagctgggattgcagtcatgtgccaccacacccggctaattttgtatttttagtagagatggggtttctccaggttggtcaggctggtcttgaactcccgacctcagatgatctgcccgccttggcctcccaaagtgctgggattacaggcgtgagccactgcgttcggccttagcattttttgtgtgtgtacaattaagtacattcacaatgttagacaaccaagaccactatctattttcagaacctttcatcataccaaataagaactctgttcccacaaaataactccccagattccttttccccatttcctgttaccctctagtattctttctgtctctgtgaatttggctattgtagctacttcatataagtggaatcatacagtatttgtcctttgtttctgatttatttcattagccataatgttttcagggttcgtccatcttgtagcatacatcggaatcctttttatggcagaataatatttcattttatatatatatatatatatatatatatatatatatatatatatatatatataatctcacatttgcttatccattcatctgtcgatgggtatttggattgtttctaccttttgcctgttgtgaataatgctgctatgaacgctggtgtacaaatatctatttgtgaccttgctttcaattcattcggatatatacctagaaatgtaatttctggatcttgtgataattctaaatgtaacttctttttttgagatggagtctcactctgtcacccaggctggagtgcagtggcatcatctcagctcattgcaacctccgctttccaggttccagtgattctcctgccttagcctcccgagtagctgggattacaggtgtccgccaacatgtctggctaatttttgtgtatttttagtagagacagggtttcaccatgttggccaggctggtcttgaactcctgacctcaggtgatctgcctgcctcggcctcccaaagtgctgggatcacaggcgtgaaccaccacgcccagcctaaatttaactttttgaagaaccaccaaactgttttttttatagtcaatgcataatttagattcccatcagcagtgcacaaggattccaatttttccacatttttgccaatacttgttattttatgttttttttgataatagcctttcaaatgggtataaagtgtagtatctccttgtggttttgatttgcagttccctgatgactagtgatgttaagtatattttcatgtgcttattagtaattcagacatcttctttagagaaatgcctattcaaattctttgcgcatttttgcattgagtcatttttagtatattcacaacgttgtgtaatcatcaccactgtctaattccagaatatttttctgaccccaaaaagaaactcctaactcattaacagtcactgcctactcttacctgctattccctagtatccactaatctgctatttctatagatttgccttttctgaacatttcatctaaattgaatcatacaatatgtgactttttgtgtctggctttttcacatagtgtaatgtttccatgttcagcattataggatgaattaatactttattcctttttatggctgaataacattccttttactttcaacctatttgtgtctaaatttaaagtgtgtctcttatagacagcatatagttggagcatttgaaaaattcattctgcttatctctgccttttaacttgagtgtttactccatttacgtttaatgtaattagtgctaaggtagtgtttacaaatgccactttgctgtttgttttctgtatatctggtgccttttccccctctatttctctatcattgccttttgaatctaatagatagatattttctagtgtgccatttaaatttttctaatgtgtcactttaattcccttggcttttcttttactgtgtattttttagttattttcttagtggttgtcctaggaattatatttaacatcttatgtagtttggattaatactaatttaattttcaatagaatgcagaagctttaatcctatgtagctgtttttttaatcctaccttctttgtgtcattattataaaaattacatctttacacattgtatgtctctcaacacagatttacaattattaccttttgcaactgactttcaaatcagataaaaaaaattaaaaacagaatacattttatattgtcttttgtatctatgttaaaacacattttatactgtcttttataactaccttgtagttatcttgaccagtgctctttaattaattcttaatgtggacttgagttactctccaatgtccctaaaaacttattcttaaatagaatctgagccttgcagctgtctctctctgttgtaatcctctgctgttatactggagccctgttgatgtggtggtaaggtatggggaacaggaagcatcttctaatcctatgattatgtctcagtcttttagcatgactgtgtcccttgcctgtgaccttcacaagtgtttctgagctcttcattcatatcataagattagatggcagggagctgcagtttaggaaatgatcccttccctcatgttggataaggatctggtaaaatcttccttactggcagactggccattgttttagagaatgcgttgaacgtatttcaaaatggttgtttttttccctcctcctgcccgaaacagtagggtttttcttggctctttactgtgggaacctggtgggatttttagaggtaatgtcttaaaaattgtgggccccctggcaagactgcagcccctaggagtttctcacttataaactagttcacattttatctccagcaattcatcaatattatcttttaactatttctgtcaatttatgttttagtggccgctgtcccagtaagcatatcttgattctctgtatttacctgtctctccagatttcagggtggcagtttgccttgtgacctcagttctcagatggatcccagaaaagtaattgatttttagtttgtttaacttttttctgttgtaaaacaggtgtgatgacttccagttctttacatattggagctgaaatcagaagtccaataaaattggcaaaaataaatttgctactgagtttcagaatctagtcataagagcaaactagcacattattataatcttttgtcagtaccgttgtcaattctcacatagtacagtgactacagttattaaatgtattaatattatgccatctagttttcatttcagaggggtttgatactgaccatgcagaagacagaaagcctacattagaattcatttcagggggacatgaggaaccaggattgaaatataattagatgggttgtattagttctatgttgctgcataacaaattaccacaaaattagcaccgtaaaacagtacacatttatcatcttactctttctgtgggtcaggagtctgggcatggcttatctgggtttttcttctcagtgtattacaaggctcccagcagagtcaactggggttgtggtctcactaaaggcttgactggggaaagattagcttccagggtccctcagtttgtttgcagaatttatcccttgtagtcgtaggactgagtgagatacccagtcttttgcgggctgttggctaaggatgactcttaggtcttaaaggttgcattcaggtcccagtcatatcaccctctcaacaacgtggcagcttattactactactacttttttttttccttcttcaaagccaacaaaggtgtctcttctgtaggggtgcattgtatcttttaaggacttttacctgattaagtcaggtccacccaagataatctcccttttgattaactcagaatcaattgaggtagaccttaattacgttcataaaatcccctcatctttactacataatataatctaatcatggaagtaaagtcttatttttatctcacaacggggagaagtttatgcaggttgtatatagggagtaggaatcttaggggctatcataaactttttatcacaggggttaatttatcagggtaagaaaaaggttaggaagaaccattagaataaagatttgtgactatggcatatgaaaatattaatagaagtgaaatgatatttatgaaatttaggtagcaaaggcatcacaactgcacataataatctttccataaatgcttgatgaataaacacacgaatggatggagactaactcttattgttccaagtctttcttactgcctttgaagttagaggtattttagaactgcaaactaaaattcctgtgatttcccgtagagcaatacagcctaattccatatactaatacttattttgtattgagaaagaactttaaatatctttagttgaatttctttaaaataccaaaatatttatattgagagccttgcttatattatatttaagatcttcctgagaaatctcataactttacttcacatttatttttatttacttaatccattgaagaaatcattattgagtacatactttgtgcggaggactgcactaagtcctgttaaagattcaaaaataaacaagttactgtctcttcaagaagatttcagtttgggttgtggtataaaataagtgtacacatccttgcattatttgacaaaatttgtaatcattagagagattaagaagaatgataatggaattaagagtaggaagagatcacatgtgattgaatgaagcagaggagtttcctagaggaggtggttgatatttcagtgggtattaaagaaaggtggatagatttctactggtagatgtgggagtgaggaatataatattctggaccaaggagacatgtattagcaaaggcacagaaaatattttcataatcacagagtttagcttggcatgtgtgaaaatgtaatgtaaagactggttgcagagtttcataaaagaaacataggataagggccaggtgcggtgactcacacctgtaatcccagcactttgggaggccaaggtgggtggattgcctgagctcaggagtttgacatcaggttgggcaacatggtgaaacctcgtctctactaaaaatcaaaaagaaagaaagaaacatatggtagaagtctaggcccagtgcagaagcctataatcccagcaatttgggaggctgagataggaggatcacttgaggccagatgttcaagaccagcctgggtaacatagagagacccagtgtttaaaaaaacaaaacaaaaaatatcagccaggtgtggtgttgtgagtcccagctacttaggaggctgagatgggaggatcgcttgagcccagaagtttgaggctgcagtgagctgtgatcacaccactgcactccagcttggccaatagcaagaccctatctctaaaaaagaaaaatatatgtctaaagtttttcaaaccatacattttagtggtcatttcttcccccttatatttaatggccagttttcttcctgtactagataattggaatgggtgatttactcaaaactttactctttcactgagtaaaaactaatattcttttgatgtaaactgcagcatttgtttaagggtaagagtgagaacgttgttcatctagtttttttccccacattctttcagaccaatagtttatggtaactaggaggaatgccattcttccactaagataaatttgattttgactctgttgttatttaagtagtagcagcattgctttagaactctctgaaattcatttttatgggtagaagagtttctaaactctttatatggacagagaagtttctgtccatataaagagaatagaaacttttctattaaatcattttgaaaagagactctctggtgccaaagtaacaagttggatctttttattcatacaatacagacttcgacttaaaaaaaaatacatctttatgagtaatatgtataaaccattttccctgagggcatattttacattcatcactgaatgtcagatgaggaataaaatgcaaacattcctgttcactctctagctgtagttttttaaagtattgttcagcactaaatttgtatgttaagaaatttgcagtgctactagtttgttttggttctcatttttaaagctgtaccgcacttaacctaaaggagaaactaaattgctacattaaaaagtgttttttttcccctcgtgtagaaggctgaaatttctatagatataaatttgctttaagtgatcaactgagccttttgaagaaatatttttttctacagtgttaaatagaaagaatcattatgccattgaggctttgggatgtggtagagaggttgtatatctctcaggttagatgtagttcttgagaacttctgctcttggttattaaacaaaaagtattcctttgtttgttcctttgtttattcatttgacaaacatttactgggcacatactacattctgagtagacaattcatatggctaaggtcatacatttaattagtgaaagcatttgccttagaactcctgattttctagttcaatgctatcctcgtaatagtattctactgtttgaaatatagttgatctgataaatattaatttgacctattatttttatttagaacaatatgcacttatataaaaatacctacatattggtatacctatatttatgtttgcttttcacatttgtttttgattatgagctaaactgttaggaagatagatataagagctactctgaaagaggatgttaaaaagctgctttaacaattgaatgaaaatagtagggcagttggaaagtaacaatttaataaccaagttgttttttgctctgtgtgtgtgtgtgtgtgtgtgtgtgtgtgtgtgcatgaatatagtcatttatgtactttctataaataacatgaatatatttgtatcacatctggtttcaaaaaagctttataaaaatatattgattaggctgggcatgctggctcatgcctgtaatcccagcactttgggaggccaaggagggtggatcacctgaggtcaggagttcaagaccagcctggccaacatggtgaaactccgtctgtactaaaaattcaaaattaaccggacatggtggcacatgcctgtaatccctgctaattgggaggctgaggcaggagaattgcttgaatccaggaggcggaggttgcagtgagccaagatcacgccatgcactccagcctgggcaataagagtgaaactctgtctcaaaaaaaaaaaaaaaaaaaaaaaaaaaaaatatatatatatatatatatatatatatatatatatatatatataatatatacacacacacacacacacatacatatgtatgtgtatatgtgtatgtgtgtgtttatgtatgtatatgtattataatttttaagtgaaaaatctagggagaataaaggcagagaagttaagattaaactagagtcaaggatgtccaggtaacttagtttgagaaggcagtgtcttggtcaattttttgatgctataacagaataccacagactggacagaaagaaaataaatttatttctcacaattctggagactaagaagtccaagtatcaagttgccagcatctagtaagggccttcttgctccatcatctcgaggtgaaaggtgaaagggcaagtgacacagaaagaaaaagctcctttattttttaaaggcattaaacccatccatgaggacagaacctttctggcctaatggtctcttaaatgctgcacctgttaatactgttacaatgacaattacattttaacatgactttgggaggggacattcaaaccatagcaggcagggatcaagtagcaaatttagaagctgaattcatcctaactccctgtgctccccccacccccttagttctaaactatttttcatggatgtaaggataaatataggaagcacttttgggaaatgacagacaaattagttaaatataacttatgattaatttactgtacattttacatattaaagcaatttttgagcttgatatggactagaaaaacttggaggttctagttgtttcatcttggttacaatctttaatatctacccagttaatcttcataatagcaaccaattgattttcctttttggctgacagtttcatattggcaccttttgaatttagatgatttgtgtggtgtcaggagggacgttaacttgatgcagtggtagtctccaaatatacttatcccagaggtcatgggacaaaaaagtgacaccacattgggatgcttgaatcatatagtttagtaaagatagttaaaacacacagtgggaggcaaggggagagagttgagggtaggttaacatgtgaatacaatgtaagtgggtggaaggaccacactacctaaatcctgggctgtgcaatgtttatgtcttgtctttctcttttccacatcagctctcctttgctgatggtgtgcttacagagactagaaatgaggtttatgcaaggggacccaacagatgcacaattgacacactttattagagtaaggccagcgcaaatgcacttggccacagctgtagtccatcagtttgcctgctgagctacaatgtattttatttgcctttcttgggcagaggatacatggagccagaatgggtgtcaccaatgggtggctgaataagattttatggatattgggtagtattttatatgcctcagatatatttaatgtatcttggatatttgatacctcatgtatatgtagtgtatcttgaatatctagtgtctttccatcctttttcatctatgttcatagagaaatgctgtacttactttatctctttaatatggcttacacaggtttctaacttctagctacgattttaacattttaagagtttcacccatctatttgggttcttgtattttatatattctcaaatatacagcagatgcaaattatagaagcgaactctcccaatctctagccttcgattttaagatatctagttaactcaagggttattgcatttttgaaaagtctttcaaaagatacatcagtctctacaggacatggtgaatgaatggttagagctcatatcagtgcgttggttgtttgcctttgtacaaagtactatttctgaggagtttttagaaataagattcaccttgcttgcctagtgtagataatgttagcttgaagtcatgctaacatgagagatcataaaggaaaaaagtcatcaaggaaaagattctacagatagcagctcaatgtagagaataccataggtcacatggtattttttataccagttttaggttcacagcaaaattgagtggacagtatagacagctctcatatacccctttacccgacacatgcacaaccttccccacattcccataccagctgccctgtgtctggacttctgacctacagagactgtgagataataaatgggtatttcttttcatgctacaacatggatgaatctggaggacattagactaagtgaaataagctcgtcataaaaacggcaaatacactattacacttatatgaggtacttagagtagtcaaattcagagatagaaagtagaagggtggttgccccagactctggtaactaccattttactgtcacttctttgagttcagttgttttagatgccacgtaaagtaagggcatgagacatttatctttctgtgcctggcttatttcacttagcataatgttctccaattccagccaaatgaacaatgctacagtgaacgagggagtgtagatatttcttctgcaaactgacttcaaattttaggggtaaatactcagaagtgagattgctagatcataaggtaattctgttttgagtgttttgagtaatgtccattcagttttttataatggctgtactaatttacattcttaccaacagtgtccaaggcttcccttttctccacatcctcaccaacactttgttatctttcatctttttgacagtagccattgttacaggcataaggtaatgtttcatcatggttttaatttgtatttccctaatgattagtgattttgagcattttttcatgtatctgttggtcatttgttgtcttcttttagaaatgtctattcaaatcccttgcccatttttaaattgagttatttgtgttcttgctaatgagttgtttgagtttcttatatattttggacattaactccttattggatatatagcttgtaaatattttctcccaatctgtaggttgccactttgtttattgttttctctttgttgtaattgcattggcctatttttgcttttgttgcctgtgcttttgggatcaaatccaaaaaatcattgcctaaaccaatgttatgtagttttcccccctctgttttcttctagtagttttacagtttcagttcttgggtttaaatctttaattcattttgagtttttttttaaatattgtgagataagggtccattttcattcttctgcatgtggatatctaattttcttagcaccatttttagagagtctttttttcccattgtgtatacttggcacctttgttgaaaatcagttgagcacatacatgggtttctttctgtgctctttgtttcgttggtcactgtggctgttttttatgccaataccatgctgttttaattactatagctttgcagtgtggtttggaatcaggtcgtgtgatgcctccatttttgttctttttactcatgactgccatggctattcaaagcttcttgtggctctatatgaaatttaggattcttttttctatttctatgaaaaatgacattggaattttgatagagattacattgaatcaatatgtcactttgggtaatatgaacattttaacaatattcttccagtctatgagcaaagaatatcatgctatttacttgtatcttctacaatttctctcatcaacattttatagatttcagcgtacaagcctttcttcaccttggttaaatttctttctttctttctctctctttttggtagctattgtaaaaggagttctcttaatttcttttttggatagtctgttattagtatatagaaatgctactgattttttgtgtgttgattttgtatcctgcaagtttactgtatttattcatttattagttctaacagttttttgttgtagtctttaggggtttctatatataagattatgtcttcagcaaacaggggcagtttcacttttttcttttctatttggatgctttttatttctttctctttctaaatttttctggcaaggacttcagtactgtgttaagtggacatagtgaaagtgggcatccttgtcttgttccagatcttagaggtaaggctttcaattttttcaccattgaatataatgttaagtgtggtcttatcatatttggcctttattggccaaatatgcagtacatttcttctatacctaatttagtaaaagtttttctcaggaaaggatgttgaattttgtcaaatgatttttctacatctaatgagatgatcatatggtttttgtccttcattctattaatgtgctgtatacatttattgatttacatatgttgaactatctttccatccagtgataaatcccatttgatcatgttgaattgttcttttaatgtgttgttgaatttggtttgctagtattttgttgaggatttttgcttttctatttatcaaggatattggcctacagttttcttttcttgtattgtccttatctggccttggtatcagggtgataatgctggtcatgtaaaaagaatttagaagtatatcctccttttcaacttctttgaaagcatttgagaaagattggtattagttctttaactgttaggtagaattcagcagtgagccaacaggtcttgggcttttctttgattggaaagaactcattattggtctgtttaaattttctatttctttatgatgcagtcttggtaggttgtatgtgtctaggaatttatccatttcttccaggtatccagtttattttgttggcatataattgtaatagtcactttgatcctttgtatttctgtggtatcagttataatatctcctcatttgtttctcattttatttgaatattctctttttttcttgttaatctagctaaaggtttgttgatttcatttatcttttcaaaaaccaattcatagttttgttgatctttgtgttgttttcctagtctctactttatttatttattctctgatctttattacttctttccttctgttaattttgggcttagttcttctttttctagatccttgaggagtaatgttatttatttgggatcttcttttttgatgtaggcatttgttattgtaaactttcctcttaggactacgtttgctgcatcccttaagttttggtatgttgtgtttccatttttgtttgtctcaatatattttttttaaatttcccttttaatttcttcattgcccccttggttgtttggttgttcaggaacatgttgtttaatttccatatatttgtgaattttcccaaattttcctgttactcatttctagttttataccattgtggccagcaaagatacttgatatgataacaaacttaaatttgttaaaacttgtttcatggcctaatatataatctatcctggagactattttatggtatttgagaagaatgtgtattctgttgctcttgaatgggatattctgtacaggaataccttattttattgtgctttgctttatcgcactttgcaaatattctgggttttttttttttcataaattaaaggtttgtggcaaccctgtgtcaagcaagtctattgtcaccatttttccaatactatgtactcacttcatgtctctgtgtcagcatttttttagcaataaagtattttaaaattaaggtatgtatttttttagacataatgccacttgtacacataatagactgcagtatagtataaacattaaccgtttatatatgatgggtaacaaaaatgtatgactcactttattgtgatatttgctttattgtggtggtctgaaactgaacctacaatatctccaaggtatgcctgtaaatgcctgttaggtccatttggtctaaatttattcaagtccaatgtttttaaatatattttctgtctggatgatttgttcattgttgaaagtggggtatcaatgtctcctactattattgtattagaatctatctctcttttcagatcctttaatacttgctttatatatttaggtactttgatgttaggtgcatgtgtatttacaattgttatatcctcttgatgaattgacctttttttgttaaataatgttcttcgttgtttctttttacagtatttgacttagtctattttgtcttatgtaagtatagataaccccactctcttttggtttccattttgttgaatagcttttttcagctgctcactttcagcctctgtgcatccttaaaagcaaatctcttgtaggcagcatatagttggatcttcttttcttactctttctaaattgctctgggaattaagactctatgtctttttgctagagtgtaattcatttacattcaaggtaggtattgaaaggtaaagagttattactgccatttatttatttatttatttatttatttatttatttatttatgacagggtcttgctctgtcacccaggtcagagtgcaggggtgtgatcataggtcactataaccttgaactcctgggttgaagggatcaacctcagcctcctgagtagctggtactacaggcatgtgccaccacacccagatacattttttaaaaacttttttttttttagagatagggtcttgctgttttgcccacactggtcttaaactcctggcttcaagcaatcctttggcctcaagcaatccttctgcctcagcctcctaaagtgctggaattacaggcatgagtgaccacgcccacccagcattgtgaattattttctagttgttgtgtaggtactttgtttctttatttctcttgctgtcttcctttgtgatttgatggtttcctgtagtggtatgccttgaggcctttctatgtttgttatgcactgcactgtaatttaaatatttttcttttggatcttattcactagattgtgaagcgatgctttctccaaaaaatttctttcaagttttagagcaacaaatttacagcagattcagatggcaatacttgaaagtagtaacttttaggtaacattatagtggttgcttcttattcatctgcttccctcagcctgaattctaatagtgcaagagcactgacctcattatagtttaattattagcccatttacagaagtatagaaaacgagttgcctttttcgcctacagttaatctattcaggaaaagaatgaaacatatagttgaatttgtgtgaataagtttatacattcagattttagccaacattattaactcagtcaacagttcttcatttttaaaaagcaaaacaagtcagattatatacattttaactaaatgattactttagacattgatgaattaactgttgatgaaacaacagtaattcagaatttatgtttcaaagagttaagaatttgttccatacataacatagtattgagttcttattgttttcttttcttttttctctttttttttttcaagacagtgtctcattctgttgcccaggctagaatgtggtggtacaatcactggctcactgtagtctttacctccctggctcaggtgatcctcccacttcagcctcctgggtaactgggactacaggaacataccaccatgcccagttattttttttgtagagatggggtttagccatgttgcccaggctggtcttgaaatcctgagctcaagagatctgtctgccttggcctcccaaagtgctgggattacaggtgtgagccaccgcgtctggcttttattgttttcttttcacatgatttcaggaaagtagaatttcatgtgtaaatatgttagttgttttacaaatgtcattttttgaagttttttgcattgtaaatatcattgtatatttttatcagaatgtatcaagaagtaactgtaaatcaggtgtcactagtgcattactgcactagtagtgcagctctgacattttcagagtcctcagtattttaactaatttatgagagagagtgttccttttcagagagggctgtaggatcttcatttccagttagattgccaacagaggtcttactttcactttagggcagtatttgtctatattattcctccaagtgcacctccaactgcacctgtgttcattgaaagtttgattctgaaatataacccagcctcttgaggtgaaagtgctgagtcaaatatcaccaaacaggaagctgtttcaatagaaattcatattcttggttttcttatattttcagtttgtatttagcaaaaattaaggacattcatttttactgtaactaaaaaagttatttaaaaaacactactactttttcatttttattagtatttaaaaggaactcttttttatttctaacatatgccacatatgggtacatatcaactgaataaaagaaagtaaacatttaaaacatatgagtacctcatgaaatgaataatgaagaatcatctttagatggaaaaatataccaggttctacttatgaaataaattatgtgagtaagattacaaaagatggtagtctgtttaggcaggcctattaaaagcattaagacttgagtactggctattaaagtgagtaaatggcaatattataaagttaaacacatgccaaaaaacattttccagaggactgggattgtaacaataccactaatgagggcaaagaggtcttaatgcaatttgcactttctaaagtttcaaaaagaggctttgagttagtgtattattaatgtactgaacatctggaactgtgtaaaagctatggacattgagcaaatgcaggatttccccactaggttgcattctaacttattccctccctagcgaaatactagttttaaagaagtttgacaaagtaaaatgacaatatccagataagacatgggcattctaaagtgtcttttagtttgtgagatctgactttaaaaaaaattgcctctgaggttaacaaattgaagtgatgtgaacaccaattagtaaattaaatcatctctatcactatatgttggctggtctccctatatgaatagtatttaccctttatgagctattaagtaggatattttcaacaaagatacctcacatttttcatatatgtaagccataagacctgagagacagctctgtgtcatcgtactttcctttaagttagtttttaggtgcctagttaggatacctaagagaatttaacaattgagttatttttgtgtttatttatgtgatttctctggcaagacagaaatagttaagctgtctaaatgtgtaattcaagtgtcacctgcaatgagaatataaaagctgtagacctaaatattttgttatctgaaactgaaaatttgctgtaggccattttcactaaaataaccagtatgtttttgctatagaattgtactccaaatttgcatgtagcccctgtgtaatccttaacaaaaggttttaaggtactttaaaaaaaatctccactgaagaaattaaaataaaacacattgtgttctgtggaaatgtgtcatagtcaccaaattctcccttttatgaagtgttcctcatagctctttgcccgaactaaaatccggatagacccagaggacataccacttcgtcagaccttccaaattgtgaccatcctttcctctcgtaacttgcagtatctcagacttagtatcctatttactctccattgttctttctaaatctttacctgtctgttttcttccggaagggaggggagaagaaaggaagggaggaaggaatgaatgaacaaagtctcaccaagagaaaactagtctagtctagctagtctgtttgctcatgtcttttagtcatacccttctttccccctcatctttgtcatcttacaaagcatctggatactcttatttttaatattttatttttatttgttttttcagatagggtctcactctatcacccaggctggagtacggtggcatgatcacagctcagtgcagcctcaacctccagggctcaagcagtcctcccacctcagcctcctgagtaactgggatcacaggcacacaccaccacacccagctaatttttgtacttttgtagatacagggttttgccaagttgcccaggctggtcttgaactcctgggctcaagtgatcctccagcctcagcatctcaaagtgctgggattacaggtgtgggccactgcacccagccaactcttcttttattaaggacttgggcatctggttttacagttatgttttacccctccctactctcctccctgaccttccattgttttggaccttcatttttcattcatttataaaattcattcaaaaagtatttactgaccactttctatatgtaaggtactgttctatgcactgggcaatcagcagtaagtaaaacagacaaaaatcattgtccttttgtattccagggtgagagacagaaaataaatgagagacacagaaagctactaatatgttagatgatattatggactgaatgtttgtataccaccaaattttttatgttgaagccctaacccccagtgtggttatatttggagatggggcctctaaggaagtaattgcggttaaatgaggctgtaagggccttccttatctgataggattagtgttcttataagaagagacaccagaaaacttcattgctctctctccctgttcctctctgaatagagaggaaaggccatgtgaggacacagaaggtggctgtctgcaagccaagaagagagccctaaccagaaatcaagttaacaggcacctttatcttggacttcatagccaagaagtaagaaataaatttctcttgtttaagccactcaatctgtggcttaaactaataactgtaagaaataaatttcttttgtttaagccattcagtctgatatttttgtgtggtagcctgaggggactaatacagatggtgataagtgctatgtagaaaactaaagcaaggaaagggggaaaagaggatcctggggttggaatttttttgggtgggggctggagggtgctcatttagaatttaattggatggtttgggaaggcctatctgagaaggtgacagtgagtaaaagtgtaaaggaagagaggaagcaaaccattctgatttagggggaagaatgttcagatagtgggaatcttgagacaggagagtacctagtttgagcaaaaggaagccattgtagcagagtaggactgaagtatggggaattgaaggagatacggccaaagaaatagctgggtaaaatcacaccacagtaagaatttagattttgttctaaatgcagtaggaagccattggagggtttaaacttagttttaaaaggattatgttggctgctgtatggaaaatggactgtagagagcataggctgaagcaagggtgactgttaaggagtctgctgtaatctagatgatagatggtggtggcttggaccactgtggtagcagtaaagatagtgagaaatgtttagagtctagataaatttaaaagtagtgctggcaggatttgctgatgaattggatgagcagtagtagagatgaggggctgggtgtggtggctcatgcatataatccctttgggaagccaaggtggaggagtgcttgagtccaggagtttgagaccagccttggcaacacagcaagaccctctctggttttttgttgttgttgttgttgttgttgttttcaagccagacatggcagtgcatacctgtagtcccagctacttgagaggttgaggtgggaggatcgcttgagcccaggaatgtgaggctacaatgagctgtgatcacaccactgcacttcagcctgagcaacagagtgagatcccatctctaaaaaaaaaaaaaaatggagaggaaataagattttcttgctggtccccccttttaaatctgtactctcccactaggcaatctcatctctatacattcttttttagttttatcttttgtcatgctttcctaatatataattaaattctgacttcttccttaagtactatgcccatatacccaactgccatatcaacatttccatttggatatcttaaaggcaacaaacttttaatctttccttccagtcttggtcctttgccagtgttgcctgtatgaatgaatggtactgtcttagttcattttctgttgcttgtaacagactacctgaaactgggtgatttattttttaaaaggaatttatttcttgcagttacagaggctgagaagttcaagactgagaggctgcatctggtgcgggccttcttgctggtgggaactctctgctgagtcccagggtggctcagagtatcacagggcaaggaggctgagtatacaagctcgagtctctattcctttttgtataaagccactagtcccactcccatgataagccattaatacatgactggacaaatccattcatgagggcagcactcttgttaccctgtcacctcttaaaatcccccacctctcaatgctgccacattagagattaaatttcaacattttggagaggacaaatgttcaaaacatagcaggtactgtaatcatatttgggctaatcatatacctacagagcacctgtgaacctttttctcccttccctgtcatgtcccatccaacaccatatcttactcattttaattttaagtatttttataatctgttcacttttctttctctacagttaattttcaaaaagataaagtcatagctcacatataaagttaacacctatcacagattttattaaactcactgattaatgaagaaaaagtatgatgattggcctattcagagagcatttaaggattcacgtacttgtaggcaatttaataaaggaatagactataagaaaactggttgatgtactacagggcaataaatagtaacttttagggttatcttttctcctgaacagaaatgatttgtatttgtattagacaaaaatatctaagttgaaatataattttgctaagtctggaaccttaattaatagtgaacagtgagttcaacaaagtgtatttccctagataatcttctagtgggcctttgcctccatttgaaatggaaagtttgtactgtttcttttttatcttattctcaaggtttgcattttttttcttaactctttctaattcaagctaccaccatctctggattactatattagtagcctaaatgtacctgttataacccctcctctaactcatcatattaataatcagactaatgttgtttaatttttatattttatatttgtgaaatatgtgtgtatataagtctacaaaactaatatgtacattttaaataataataaaatggagatctgagtatccatcacccagcttaagaaatagaacattatttctacattagaagcttccatctggccaggcgcagtgggtcatgcctgtgatcccggcactttgggaggctgaggggtggatcacctgaggtcaggagttcgagaccagcctgaccaatatggtgaaaccccgtctctactaaaaatacaaaaattagtcaggtgtggtggtgtccgcctgtagtcccagctactcaggaggctgggacaggagaattgcttgaactcaggaggcggagatttcagtgagccgagatcgcaccactgtactccagcctgggtgacagagcgagactctgtctcaaaaaaaaaaatcctccatttgttccttcccaattgtatccccctaaagctaaaggtattagtttcatgagttttttaaagttatatatatttttctcaaagaacatattgtttttgaactttatataaatgaaatcatatttgttatctatctgtatttgcattttttactcaacatctagaagtttatgattcatcctggttaatatgtgagaaactagttcatttatttatgttactaaatagtattcatttgtgtgttcttttcaatttttaaaattgtggtaaaatacacatgacataaaatttaccttttaagcatttttaagtgtacaacttagtgccatcgagtacattcatgatgttgtacaaccatcaccagtatccctttccaaaacttttcaatcatcccagtcagaaactgtactgatggaacaatgactcctgtttagccccttccctcaggccctggtaacctctgttctacttcccatctctaagaatttgtctattctaggtacctcatataagtgaaatcatataatatttgtactttgtgtacaaaaatacagtggcttttttcacttactatgggtttatccatattcaagcatttgtcagaatttcattcctttatagttgaataattttccattgcacgtaggtcatacattttgtttattcatctgttgattgacacttgagttgtttccactatttggttattgggaataatgcttctataaacatcagcatacagctgtttgtttggatcctagtactttcagatatttggggttatatacttaggagtggaattgctggatcatatggtaattctatgcctatgaacttttgaggaactgccagactgttttcctcagcagttgtaccattttacattgccactagcaatgtgtgacagttacagtttctgcgtgtccttgcaacacttacttatttggacagcagttatactaagtgaagtgggacttcattgtggttttgacttgcagtttcctaatgactaaggatgttgagcatcttttcatgtcctttgggccttttttttttttttaatcattcaagaaatgtctattaaagtcctttgcctatatttgaatctgtttggttttttcgttgttgagttgtagttctttatatcttctggatattaatcttttatcagccatatgctttgcattctgtgtactatcattttaactttcttgacagtatccaaaaaagttttataattttttatgaaatccgagtttatctgtatttttctttagttacttatgcttttgatgccacagccaacaaatcattgccaaatccaaggtcataaagccttctatttttttcttttagagttttatattttttagctcttacagtaatgtctttgaccaatgttgagttaatttttattatgtaggcaaggtgttacttcattctttttacatgtggtgatccagttttctcaacaccatctgctgaaaagaatcttcatgcattgtttcaataatgcaaaaaagcatttgacaaaatgcagcacactttcatgatacaaattctcaacaaggtaggaatagaaggaaatttaatataataaaggtcatatgtaagaagctcgtagcatactcagtggtgcaaactgaaaggttttcctctaagatcagaaacagggcaaggatgcccactcttgccatttctgtataacgtagtactagaattcctagccagagcagttaggcaagaaaaaggaataaaagtcttccaaatgggaaaggaaaaagtaaaattgtccttatttacagacgtgatctttcctaaagatcttatttttaaaaaacctgttaggactaataaattgagtaaagttgcaatatgcaaaattaacatacaaaaatgagttgtatttctatacactgacaacaaactgtctgaaaagcaaattaggaaaacatttccatttgcagtagtatcaaaacaaatagaacacttaggaataaacttaaggaggtaaaagacttgtatattgaaacccataaaacatttctatatatactgttttattttgatttttatttccttttctgttttccacagtggctatactgttttatattcccaccagcaatacacaaggattccaatatcacaacatcttcactaatagttattttatttacttttttaaataatggccttccgaacagctgtgaaccaatatctcatcgtggttttgatttgcatttccctgataattactgatgttgagcatctttccatatacctgttaaccatttgtatgtcttctttggagaactgtctattcatgtcctttgcctgtttttcaatttttttttaatattgggtttcttaatatattttggatattaaccccttatcagatatatggtttgcagatattttttctcatcctttaggttgcctttccactcttttttttccctttactttgcagaaaccttttagtttgttgtggtcccaatcgtaggttttacttttattgcctgtgcttttatgtcatatgcataaaatcattgttaaatccaatgttacaaaaattttctcctgtgtttttttctaagagttttgcagtttcaagtcttttttttttttagacagagtctcgctctgtcgccaggctggagtgtagtggcgtgatcttggctcactgcaacctccgcctcccaggttcaagcgattctcttgcctcagcctcccgagtagctgggactacaggcgcgcgccaccatgcccggctaattttttgtatttttagtagagatggggtttcaccgtgttagccaggatggtctcaatctcctgacctcgtgatctgcccgccttggcctcccaaagtgctgggattacaggcatgagccactgcgcccagccaacagtttgaaatcttacatttaagtctaatccattttgagtgaacttttgtgtattgtgtaagataaaggtccagttttattcttttgcatgtggatattgtttgccctgaactatttgttgaagagactgtcctttccccattatgtatttttggcacccttgctgaagatcagttgatcatacatgtgtggatttatttccaggctctctattctcttccaatggtctatatgtctgtctttatggcaatgcaattactattttgattatggtgggtttgtaagatgtaagtgtcatgaagcacgatgcctctagctttgttgttctttctcaagattgttttgattattccaagtcctttgtggttgcatattaatttttgtatttttttctgtttctgtaaaaaatgtcattgggattttgataggagttacattgaatctacatttgtattagtctttaaaatcaatggtccccaaccttcttagcaccagggactggttttgtggaagacagcttttccacagacctgggttgggggtgggggtgatggtttcgggatgaaactgttccacctcagatcatcaggcattagattctcataaggagcatataacctagatcccttgcaagcacagttcacaatagtgtttgtacccctatgagaatataatgctgctgctgatctgacaggagactgagctcaggcagtaatgctcactcacctgccactcacctcctgctgtgcagcctggattctaccagtattctgtggcctgggggttggggacccctgctttaaatgtttcatagaggactgtgcatagtggctcacacctgtaatcccagcactttgggaggccaaggcaggaggagcacttgaggccaggagttcaagaccaacctgggcaatatagtgagactccatacctacaaaaaaaaaaaaaaaaaaattaccagggcatggtggctcatgcctctagtcctagctacttgggaggctgaagtaggaagattgcttgagcccaggagtttgaggttacagtgaactatgatcacattactacactccagcctgggtgacagagcaagagtgtatctcaaaaataaattaattaattagcaaagaaatgaaaataaaaaattaataaaattaaataaataaaaatgttttgtagaatcggtattgaggccatttaggtccttagcttttctttgatgggagactttttgttactgattcagtctccttactagtctgttcagattttctgtttcttcattattcagtcttagtaggttgtatattactaggaatttgtccatttcatctattttatccaatttattggcatataatttttcagagtagtcttttattgtatcggtggcatcagtgtgtcttctttcatttctgattttctcttttttttttccttaaccaatctaggtaaagacttgtcaattctgttgatcttttcaaaaaccaactttttaaattgtttttctgttccctattttatttctgctctaatcttaatatttctttccttctgcaaactttgtatttactttgttctttttctagttccctgaagtgtagaattgggttacttgagatctttcttttttaatgttggcattaccgctataaactttcctcttagtactgcttttggtgtatttcttacttgtggtatgttgtggttttttttccactggtctcaagataatttcataactttccttttgatttcttttttgacccattcattggttgttcaaaagtgtgttaattttcatatttttgtaaatttgctggttttctttctgatactgaattttagtttgattctgttgtggttgcaaaagatacctggtattaatttttatcttacatttgttaagacttgctttgttacctaacacatgatctgtcctagagaatgttccatgtacagttgtgaagaatatgtattttgctgctgttgggtaaaatgttctatatatgtcaggtccatctggtctctagtattgttcaagttccgtttccttgttgatcttctgtttggatgttttattcattactgaaggttagatatatgactttcctactcctcttatattgctgtttatttctctcttcagtacaatcactatttgcttgctatatttgggtgctctgatgttggttgtgtgtatatttatagttgttaaatattcccagtgaattgacccatttatcattatataatgtccttttttttgtctcttgtgacaatttttgacttagaatctatttagtatcttagaattgccacctctgctgtcttttggttaccatttataagtaatatctttttctatcccttcactttcagcctatgggtatccttaaatttaaagtgagtcacttgcagacagcgtttttatctatccagctactttatatcttttgattagaaaatttaatccatttacatttaaagtaatgaccgatagggaaagacattatcatttcaataattgttttctgtctaactacagcttttttgttcctctattcctcccttgatgtctttctggagaataaaaagtaatataataacttcttagctgtgtttatggaattaaagtagttcttcctatttaattaaagcatattgtacagcagttaactattttactaatgttttgttttatagtcttattaagaagtttatttctaaaaatagttaaaggtaaaattgaggaaataaactatcttataaaaattgatcagttgctgttttccagagaattttgggtggtttcttataataacttgtccaaattgtgtagaactcatagtatataacaagtggataaaacagttcaatttaaataataatctctaatattagcttttgtctttttcatttattcagctttattattaacttctttctttgcatttgctatatttcattttctagcttcttggaaagaatacttgattcttttattttgacattttaaaaataaatatatttaaagctataaatgtatttccatgtattgccattgctgtatgccacatgtttcgaattgtgagtgcttttcttattcataactaaagatttcatgagttatactgtgttttttctatttaactcatatggtttttaagaatatgagttttacagccacgtgtgttggttcacacctgtaatttcagcactgtggaaggctgagtctggaggatcccttgagaccagaagtttgagactagcctgggcaacaaagcaggatctcatctctacacaaaatataaaaattagctgggtgtagtggcatgcacctgtagtcccagctactcaggaggctaaggtggagggattgcctgagcctagtagttcgaggctgcactgagctatgatcttgccactgtactccagcctgggtgacagagaccctgtctctaaaatcaatcaatcaatcaagatgagtttttgttttgggcttgacttttaatctaccatgactttatattattgacttttaatctaccatggcataactgttgaaatatgtgatcaatatgataaggattgcttaaaatttgttgaatgtccttttgtaatctagcccatggctgtaaatgttccatttgtgcccatatattttctacttcttggctgagtctttatttctatcttttttcaatgcaggttattaatgatgatcaaatattcaaataatgagcttatctgcctatacacttagtaaaatgatcttaaatcatcttcatttgaagactatttaagaatattaagaaacttcaccttaggtttaaagagagaacttaaagtttgttaactttgacagaggttttttgttttttgcttttgcttttgaaattgccaagatagtagtagtagtagtagtagtggtggtggtggtagaaattgccaagataatagtagaagtagtagtagtaatagtagtagtagcagtagtagtggtagaaattgccaagataatagtagtagtagcagcagcagcagctaactgtgccagcaccattcagatctctctaaatctgttaataaatttaaccccataacagctctatgagatatattgttttcctcattttataaatgagaaaagacacagagagattaatatacttgccgtagtcacattggcttaaacaaatgaagttaagtttgtttagctagacacacaaaaaatcatttttttctttcccctctttagttattagaaaaattaaaagaacgttggctctctactggtttatggcataatctggagttggtgaagacagtcattgtagaaccacagggaggagaaaaaacaaattttgatgaattactgcaggtgtactatgacgcaatcaaatacaaaggagagaaaggtaactggaaattatttcatggtcggtgaaaaaatattttttattacaaagtaagaaggtacaattataattttatatttttagatgaattacacttaagagaaaaattataatcctgagtgaaaagaaaataaattgggtaaagaaattcttttaattgtacttgttctcctatgaatattttcacttgagtatgctgattcaactttaagaaaaacgatgccatcatctcacagtcttcagtgcactacctgaaatagtttgtgcaaaaaggcagttaggatatatataaatatattccttactagccaaatgagacctatattctgatgcatttagtacacttggtgcttgtattctattacataaggtaaacttgaattttcaaaacataactgaaaactcaattccaagttagagcatatccatgaagagtttgatgtgaggccgggcgtggtggctcttgcctgtaatcctagcgctttgggaggctgaggcgggtggatcacttgagcccaggagttcgagaccagcctgggcaacatggtgaaatcctgtctctacaaaaagtacaaacattagcagggtgtggtgcatgtgcctatagttccaactacttgggaggccgaggtgggaggattacctgagcccaggaggtcaaggctgcagtgagctgtgattgtgccactgcactccagcctggctgacagagtgagaccctgtctcacacacaaaaaataataaaataaaataaaaaagtttgatgtgaagggatagtagtagtttatgaacaatgcaagaaagaggtaatataacatatcagtatctttttatggtgtatatattatggtgttctctgtgtctgttttcaatacttttaaatatattgattccatatgatatgtattatcaattacaattatttcaattattctgagaattttactttcaggtggtaaaggtaataatgcaacttcaatttttattaaataaacctgtttataatcacacagttcatatgcaagttgctattctgacatgtttttactgtataagttatctggaagatgcagagtttgtaaattggtttgctacccttttgcatataaatgtaattttgttccccttatttacttaaagacattgaacttttaaaactttatctcataatagtgttttattttgattattttaaatttgctactgtaattactataattataaatcaggtattttcaaaatgacaagaataagcaatttctgagaattttggatatgcttttttctgttgtttaagatggagctctcctggtagcagtttgtcgtggtaaagtgagtgagggtctggatttctcagatgacaatgcccgtgctgtcataacaataggaattccttttccaaatgtgaaagatctacaggtaggccatcaaaaccttaagttttattattacaggagtcattggttttgtataaagttaattgcagggatccctcattttattgcgctttgcttttatagtgcttttttacaaattgaaggtttatggtaaccctgcattgtgcaagtctttcagcaccatttttccaacagcatgtggtcacttgtttctgtttcacattttggttaattctcacgatatttcaaaccttttcattattattatactgttagggtaatctgtgataagtgatctttgatgttactattgtaattgttttggggtatctcatactgtacccacataagagagcaaacgtaattcataagtgatgtatgtattctaactgctccactgactacccttcccccatttctctctccttgggactctccattccctgagacacaacaatactgaaattaggccagttaataaccctacaatggccccagagtgttcaagtgaaaggaagtgttgcatgcttcctactttaaatcaaaggcgagacatgattaagcttagtgagcaaggcatattgaaagctgagacaagacaaaagctaggcctcttgcaccaaccaattagccatattgtgaatgcaaaggaaaagttcttcaaaggaattaaaagtgttactccagtgaatgtacaaataataagcaaacagtcttattactgatatagagaaaggtttagtgtctggaaagaagatcaaactgtccgtaacattctcttaagccaaaacttaattcagagcaaggccctaactctcttcaattctgtgaaagctgagagaggtgaggaggctgcagaaaagtttgaagctagcagaggttgtttcatgaggtttaaggaaagaagctatctccataacttaaaagtgcaagttaatgcagcaggtgctgatggagaagctacagcaagttatccagaagatctggccaagataattgatgaaggtggctacgcaaaacaacagattttcagtgtagaagaatcagccttctattgaaagaagatgccacctaggacattcatagctagagaggagaagtcaatgcctgacctcaaagcttcagagaacaggctgactctcttgtgatgggccagtgcagctggtgactttaagttgaagccaatgctcatttaacattttaaaaatcctagagcctttaagaattatactaaatctactctgcctgtgctgtatagatggaacaacaaagcctgcacgacagcacatctgtttacagcatggtttactgaatattttaagtccattattgagatctactcctcagaaaaatcagttcctttcaaaatattactgctcattaaccacacatgtggtcactcaagaactctatggagatgtacaaggagattaatgttgttttcatgcttgctaacaaaacatccattctgcatccaatgaataaaggagtaatttctacttccaagtctcattacttaagaagtacatttcacaaggctataactgctatagatagcgagtcctctgatgcatctggacacagtcgattaaaaaccttctggaaaggattcaccgttctagatgccattaagaacattcatgattcatgggaggaggtcagaatatcaacacttacaggagtttggaagtcattgattccatccctcattggatgactctgagggagttaagagttcagtggaggaagtaactgtagctgtggtggaaataataagagaactaaattagaagtggagcttaagacgtgactaaattgctgcaatctcatgaggacacttgaacagatgaggagttgcattttatggatgagcaaagaaagtggtttcttgagataggaactattcttagtaaagatgctgtgaacattgttgaaatgacaacaaaggagttagaatattaaataaacttagtgcatgaagcagcggcagagtttgagaggcttgaccccaattttgaaagaagttttatgttgggtaaaatgctatcaaagagcatcttatgccacagagaaatctattgtgaaaggaagagtcacatgatagagcaaacttcatggtcgtcttattttaagaaattgccacagccactccaacgttagcaaccaccaccctgatcagtcagcagtcatcattgaggcaagaccctctaccagcaaagagagtgactcactgaaggctcagatgatcattcaccttttttagcaataaaatattttcaagttaaggtatatacattggcttttgagacataatgctgttgcccacttaatagactgcagtatagtgtaaacatagcttttatatgtgttgggaaaccaaaaaattcatgtgacttactttgttatgatattctccttattggggtggtctggaaccaaacttgcaatgtctctcagggatgcctgtatatgttttcctgtatccttagacatttttaaatctttggtgaatctgaatgagtgagaaaaatttagtagatacagattttattttattttcaacttatactgtctttggtcaacaggagttattttcaaagtctggtcctgggccaggtgcattcgtatcacctgggaacttaatagaaataaagactttcaggctcatccagacctgccaaatcagaaactgtggaagtgaagcccagcaatttgtgttttatcagtcttttaaccacagactcatgggttcctccggggaatcctggggtcttttgtccatctggctcgcttctttccagtgtcctgccttgcagatcttgtgatttagtcactccatattctgatctcttccacctcagctcaacaggaccactgcgctctgcttgtactttaatgctctgtgctgtggtcaggaaattatacccaagcagagaactgggataatggagttcacctaatgaattccacttagctccagaattactgtcttgtgctgtttggtgtctactacctgaaaacaattgctccattttgcccggttatgcgattacttacaatggaagaaatattcttaaaccagttactcaatcttggccagaaacagttgtatctcattatcactgactgtttcctaaacaatatatttgaaaaactatagtaataatttgagcctaagttgaacttattgttcatcaaggaggattttcttttacttcctacaggcatttgaaagtgctggcaatctgagaaaatttgagattttctgaccactgagctgacttattgattatgacctatatccctccccctaggatacagtcagttagggtctcataccaaagcaggagttctttcattagaatagttatctttttaattgttaatactttactaggtactgtgaattagataatttttcttttatttttctagtccgtagcagtctttaggtaacattaacagtaataagcagtatttcttttggtagcccttactcttccgtaacctctggacctcttcaaaatttctgaaagtcctcagggggtatctcacttgatgattcagagtctaatactttttcagcctccagtaactttggtggtttctactacctttctccagttaaccagtgctactgctgagggcactaatggctatgcccaaagctgggtctcctattctaaaatggctgatgctgccttgactacagctactgatgaaacagttgacatctacccaagaaatctactgtcaccatcaacagcattggtgctgcattccactgaagtagagtgctactgatggcactgctgttggtactggtattgtctccttttaatgtcttatcattttactctagctctacattattgcactaaggctgctttgttaaagtggaaagaatccttttcccttctttagaccacatcttcttccaatatcttaataaaatacaattttgttccctaaaactaattatttccatttttgcctatgtcctctctcttccttggaccctacatatgagttcttgagacctggaaaagaagaaaaactttatggctaatactaggttgtactaaatattatacgtacaaagtaacaaggcctaaaaggatcatcaagattataattctgattacatatgaggagaagagaagggaatgatattcagagtagttatcaaaagaattttaactttttccataatttttagtaaaggaaaataagctgcaagaaaatatgagaatgcaggtatttattatgttattcttcattattttccaaaaattcttaaaattaaaaatatacatttgtgagaaaattccatttctcttttctccacctttgcctcaacagctatgattttgaacattgttattataccaatctggggttcttaatgctttttttcctcaggataaattcttcctagacaatatctcagtctgtcatgcaaaaaagacacctgatggcctactctgacattcctcagtcatgatcctatttgtcatagttctgcttatgtgcataaaacagcaaaataacagaagcatcaatgggttctgggtagaggggaggaaggtggttctaaagggttatccctagtggttcccaaaaggtacaagtagagtggacacaagaatagttcaagctgcagggacaagggatagaaaaagtgaaattatttaccagcactactagatgtactgggaagtgtatttcttattgccatatgtctggatcagttcttcttctgtaacaactccaaaacttagtgacttaaaacagcaatcatttattacaggtcatacatctctggagtgattgggtgacagatgatctaggcttgggcttggttggttggctctctcgattttagctgggctcagctactctgccctagttggctgatctgtgttgaagtcaactgagtcagctctgttccacctgtatttcattctttgtggaccaacagactagccaaggcatgttattattgcaatggcagtagtacaagagggcaggcttaactgtaagcagttaagtcaaatacctatttacatcacatctgctaacctcctgttgcccaaaacacgtccatgcacaatctcaaagtcaaggaaggggagaaaagggataatttctaccgcacatggcaaaggacttagaatcatgacttcaaaaagaagtcctcaactatcgcattttttcataattaaaaggtatttgttagttatccatttataagactggtgtgttacaagctttaagagtatacgcatgcagtttttataatgattaagaaggctttttattatttggaaatgcccagaatatagcagtcaatacctaaaatacttgaaatatgtcagagcatcattatgggtgatttcttaacatttttataaatggttaaacaagtatttgaaaatatttgtatgcctctatggaatataaaagttaagtttaaaattctaatgcagtccagtttatctgttttttttgtttgtttgttgcctgtgctttggtgtcatatttaggaaaatactggcaaatccaacatcatgcatatttgcccctaatgttttccttgaagagttttatagttgtaactctttaatttagatatttgattcctcttgagtaaatttttctatgtgatatatggtgaggtccaatttccttatatctaagtgaatcttttatttacagcgtatagttggatcaggtttttaaaaatccatttggccaatctctgcctttcaattggagagtttaaaccatttacatttaaagtaattactgataggaaaggacttacttttgctatgtagctatttgttttcttgtgtcatgtgctttttgttcctcaatccttcatcatttccttttttgtatttagttgatttgtagtatactattttgattcccttctttccttttatatgtattttttggtttttagtatttaccttggggattataactatcatctgaatctctgttcctccctttttatattgttattgtcacagattccatctttatactttgtgtggctgttagtttttaattattgtttttatgcatttgccttttaaataatacagggaaaacagaggaattgcaattcaaaagcatattgtagtattcacctgcagttacctttaccagtgtcctttattatttcctaaagcacatatttagtgtttataaagatgttttataatctgtttcatggtgtaccttgaggatagggataatttcttcagcatctttgtgtctctacaactaagatattacctaaaaacacagtgtttaataaatgttttagttaatgattgaatggggttttagtagaagttgttaaaattgtatttgactttgttatttgtttttaaaaacaacagcaaccactctccattcctggagactttaaggatggaaatgatagtaatcattagataataatgaacaggatggtagtaaacagtgatatgactcataaggaggcaatacagggtagttatagtagtaaatcattagaggatatgtagaagggaatgctcaatcctcaacagcatcttacactttatttaatacatagtagaacataataagtggagggagtatcttatattgactatattagctatccctcttttattatttatttatttaaatatttttattttattttatagacaaggtcttgttctgtcgcccaggttggagtgcagtggcacaatcatagctcactgcagccttgagctcatgggctcaattgatcctcctgcctcagtctcctgggtagctaggactgtaggcatgtgccaccacacctggctaaacttttttttttttttggagaggcgaggtcttgctatgttgtacaagctggccttgaactcctggccttaagggatgctcagacctcagcctcccaaagtgctgggattataggtgtgagccatcatgcccagcctgtattagttttttattgctgtgtaacaaattatcacatagtggcttaacacacatttattatctcagtttccattggtcacaagtgtgggcatggcttagctgggtcagggttccacaaaactgctgcaatcagagtgttggccaggttgtgttgttatctggcacttggggtccgtttgtggttgtaggactgaggttcttcctaatccatccaagaggcagtcttttttaaatttttttgaaaacagggtctcactccattgcccaggctagagtgcagtggtgcggtcatgggtcactgcagccttggcctctcgggctcaggtgatcctcccacctcagcctcctgggtagctggcactacagccacacgccaccacacccagctaatttttaaacgtggtttttttttttttgtagaggcaggatcttgctatgttgcccaggctggtctcgaactcctgagctcaagtaatccacccgcgtcagcctcccaaagtgctgggattacaagtgtgagccaccgtgcctagccctaaggtgtactcttggcttcaagaagctattcacagtttcttgccatgtggccttttcacaagccccctcgtatcatgacagtatacttccagaggccaataggaagctctctagccctagtcagccaatacagagtcttacacaacttaataaaattgtgaggaaaaaaataaaattaaaaaatcatgggaataacttcccatcatttttgctatataatataacctaattaagagtgactatcccagaaccctttccatattctgttggctagaagcaaatcactggttctgccctcacttaaggggagagcattacaaagttgtgactctctgtatatcaccttagggtgtgtctgccatactcctattccctatgaaaagagatgatgatctaaatgacctacatagatggctcttccaaaactaaaactatgcttcaaattataggaccttaaattagaactttatagttttcttttacattaatagtctaataagtagaagttatttagtaaataaaaatttaaatgttctaccttatagaaacgaaacaacctatttctgcattattttgtctatttcatttgacttcatatttaaaaaggttaagatcattgagtcagaaaagtgatttgagtgggaaaaagaaggcagtgacattaattttatgatactaaaattttttcttaaatttgagaaagattatggaagtaaaagttaaaatacagtttaaaatactaacataagactttgcagtctcaatagcagggtttggctttttgagaagaaggaaaatgtatgttagagccaaaaatatgactcctttggctgtgaccaggatttcctcttcccaccttagggactagaaagtagaggtaggaaaatttcattttggagccaagtgtgacttgtttagttcaagtcataatttattgcacatacctgagggacctgaaaataaagaaacccactatgaaatgttgataatgggctactctgaaggtaagcattaagctaactttcccagtgaggatttttttcacttccacctttcccagatgcttctgatcattcataaggatatacttaatcgtataatagttaaaaagaaaactttctgtgcactaaaccaaagcatttgaggggcatgagaatgaaccaaggcttttatatgactagatgtcgatggaaaagtataactaaaataaaagttgttttctttttcatgtaattaaatcacagtataacaaggctgcctttttaatggatatctaaagcaaatcctctggccaattactgtgatctaacaaccacaggagtattcagctttataattgaggcatccacctctccaattggtgacatggacatagtttgtgagatatgataaggtacaaatatatttaggttttaaaattgcattttatttgtattgcctagcatagtatagtataatagtatatagaaaagttctccttcgtaggtattgttcctttacttctctgaagaaaaatgtataaaaccatggcatatggctaaaaatgtttatatttttaaaatgttgaagtggtgtgtttagatttttataattggtttaataaaatttgatggtacttttcattgtcagaagtgcccttcaatgattaaaataatttatcatgctaataaattttatatttgtgggtttttttggtaatatagtatgttgagttaccaaactagattttatttggaaactatttaaaattcgcatagtgatctgaattgtctatcttactattagcatacaataaccattatgagttcctttttttgtttaggaaacttatcttagctctcaatgtaccaaactatttgggtatatattattttaatcaattttttaaaattacatttatgattgaaaaattcagacatctattttagttatattagttacttatcgactttataacaaacacacacaaaaaaattgataggcttccatgcattgttggcattttataaaccacagaaaaagggtgctttccctaaaggataacagcattaataaagtaataaagcacattaaaccatgttaaaccagtgctttcaactgtcaaaatattatcagatgatggtagtattggaattaaaaaaaaattttttttgagacagagtctcactatattgcccaggctggtcctgggctcaagtgatgatcctcctgcctcagctcccgagcagctgggattacagactcgcgccaattgcacctggctgtattagaattcttaaatctaacagatttctttttaaggagaatgatattgttccattgttattccttttgctttgacggcaatatgaatattcacgagaaaatgaatgagggcaggaatgcaaaggactgtagtatatcaagaggaacttgacttcagaaaccttttagatagattcatctgttccttttgaatagatttataaatcccttttgaattactcttctatcaaaactatgttaatgacggccgtgtgcagtggcttatgcctgttatcccagcactttgggagcccaaggtgggcagatcatttgaggtcaggagttcgagaccagcctggccaacatggtgaaacccagtctctactaaaaacacaaaaaattagccccggtgtgatggcacacgtctgtaattccagctacttgggagtctgaggcaggagaatcacttgtacctaaggggcaaaggttgcagtgagctgaaattgcgccactgcactccagtctgggcgacagagcaagacactgtctcaaaaaaaaaaaaatgttaatgatattgaatgttttgtcatgcacttattcattcatttaacaaactttttttaagagcttaatttgtacaaaatgcagtaggtgtaaaaatgaacaagatgctgtctctacactagtaatgtcaataatttatggaagaacaggaacatataacaagatgctttggtggaatagaaaccaggtgctcagatgcttaggaaagctgaagttgaccaacacctttcgcctcccttgcagataccaatttactttgactaacttgcctaaaagggatggaggagccagagagatgagatttgaatcttctctacagtgagattcaaatatacaaacatttcataaagtggaatggcctcatcagaggttagattacaacaaaactattcagattataaaactattcagaataggccgggtgcagtggctcacacctgtaattccatcacttggaggccgaggtgggtggatcacttgaggtcaggagttggagaacaacctggccaacataatgaaactctctctctctactaaaaatacacaaattagctgggtgtgatggcacaatcccagctatttgggaggctgagacactagacactagagttgcttgaacttgggagggggaggttgcagtgagccgagattgctccactgcactccagcctgggtgacagagactctgtctcaaaaaaaaaaaaaaaaaaaaaagaaagaaagaaagaaagaaaagaaaaaaagcaactattcagaataataaagcaacctttttttttttttaatatctggctagagcaccaagtattataatagactcaggggacagagtgatacacaacacagtttatagccccttgtctcatgttgcttatagtctagcaaggaatattgacattaatgtaatgaagaaacaatcacagttgtgataaaggctataagaaaaagtcacaggaaccctgggaatgttatagcaggtctttggggatcaagaaaggcttcctgaggaagtgatatttaacctgacactggaaagaaaactaggagttatgaatgtgtacagaatggataagagtattctcaacagagagaacagcatgtgttaaggttctaaggttgaaagaggatagcagtttccaagaactgaaagaagctgaagttgtgagtctgagagaatggcatgtgaatagaagctgggagaggtatttaggagccaaatcacttaggactctgtatgccattttcaggatttgggacattctaagttatgggaaaccagatccaggaatacagcctgaggtcagagtggagtggacttctggttatagtgttgcatctgatacagagacccacctggatatagctctgataataatacatggttacccaggggaaatggatgtgaatataaacttaaagtgctgtaatacttaactctttaacatttacaagttcagcaacttgctcttggaatttttggaaatacttaggttccatcacagatatagaagaaaaaaccttgtcacctctaaaagtctagagtgagtatatcctcaattacttaaaccttttttttcctcctcagagtatttttttccccagcttttttttttttttaagatagtttggccaaaagtattttgaaagcagtttctaagtatatcttgaaattccaaaattaaaacctagtttaaatctaagtaagctgtctaggttaataaattgtatatttaccttggccagcaaaaaatgagttaatgaaacccctctgtttccatcccttctgaaaaacaaatgaacaaacaaaaaaacacaaaacaaatggatgaattgctgaggttaatttttaaattctccatatttttaaaagatattttgggatcaaggatggaaatatttaaaatcccaaaattttaagcaagttcggttgataacctttttctcctaatactcatgtcattgtatttccttagcaaaaaataaataaataaatacataaagccatgcctgaaaatattgctggaagtttctctggataattaataaataaaaacttttggttttgatttttgaacaattctgaagttattttcttgtgttcatcttatttttggtgagaaaaggaactttgacctttatatattaattttgctctcaaactaggttggaggatttaaaagtgaaattatcaccctgaggacttgtaaggttgattgacacttacctacttatgttggcatggagcataatcagcagctctaccttaagggcagtggtgggattgttttttagcttctctgaaaataactaatttttttcttttgaggagaattttagttgtgaattttaatcagtttattcagtcaaattctctcaatgcctacagattgtagacatgtagaggggcttcaggtgactatgtcacttttttttctaactgtaaagctttaaggtctcaaataacataaactgtagtagatattgctgttccatgtttacaacatcactctttcctgtttttccctaggattaaaggcttgaaagcttgggaatgagttcagtttatactttgtaactgtaggacacatcaccccagtgcgtcagtgactatagtaagctatacaaataactcagtgtattttcctactgcatcaagtataccagatttgtgacttgaaattactttcaagctgtgtttctcaaacttggcactattgacattttggactgggtaattctttgttccgaggagtgtcctgtgcattccaggatgtttaacagcatctctagcatttacccactagatgccggtagtgggatctagacaccccccacggtcaccctgccaccagttgtgataacccaaaatatctctagacattgccattatcttctggttggcaaaattgctctcggttgagcaccactgttttacatagtgaggcatacaaatgtatacaataaattaaaattaataatctgcatttgtttttaaattatgatttatcaagttgaaaaacgtccaataaagcacttaccaagagtctaatatacactaaatacagtagatagctttttcttataacagtcttttggcctgcaccccacttctagcccctgcttctgacaggcagtgactttcacttctttagctattttatctggtatttacctccatattttatctttatttaatcagttttagacatgaactattaaattcctatttgagacaggattttacctcacttactctgctttttccttcttatagcctcccaagatagttacattacaatttttaattaaatctatagttattatgtacattatcatgactatgaaaatactgttcactgtaatcaaatgatttcctttcttttttgtttgtttgtttgttttgttttgttttgtttttgagacggagtttgcttttgtttcccaggctggagtgcaatggcgtgatcttggctcaccacaacctccacctcccaggctcaagcgatcctcctgcctcagcctcccgagtagctgggattacaggcatgcaccaccacgcccagctaatttgtatttttagtagagatggggtgtctctatgttggtcaggctggtctcgaactcccgacctcagaagatccgcccgcctcagcctcccaaagtgctggggttacagccgcccgtcctcctttctgttttgaactttagggttgatagaaccctcctctcttccacttcctttttctctttttaaaagatctttatctaaataaatgtgtcaccttccaatagttgtgtgccatgcctctcaatacagtttttctatcagacctgtcagataacaggccagttccttttttctcctggagatatcatttctggagcctcctgatcttctacttcggtcagggctaaattgctcatcaagcccagataactgccaatatcctgctatcatccaataactgctatcatcctaggaatttgatttgtctgtcttctgtgatggattgccagtttcctgggtctcagatcttcctcttgtttcttgcttactgtttcatctttgcggtacacatcctcccaacagtttccttatacctccatttcctgagactttctgaactcctgcaggtcaaactggcttatgtcccagcagtagctctgtggatacgttggtttgaactttctcttttctgcttagtcatttaacatttgtccatctaccttttatgttcatatattggggcttggaatcagatgtctcttagctttactgaagttggagactgtgtttctgtttcctatttgtcttttaatttaaaggcagtttctctgacaggtgagggaaaaagaaatgtctgggtttttttttttttttttgacttattgaaatcagaagtctgcattactttctaagataaagcatgagttatcaaagtgctatgattccatatgtcttattccaaaactcacattcacatttgaaaagctctgaatcaaatattcttggcaataatatttcaaaggtagaaagtgatcatatattttaaaaatcaaacctttgtggccaggcgcggtggctcacgcctgtaatcccagcactttcagaggctgaggcgggtggatcacttgaggtcaggagtttgagaccagcctgaccaacatggcgaaaccccgtgtctactaaaaatacaaaaattagccgggcgtcatagcacacacctgtaatcccagctactgtggaggctgaggcacaagaattgcttgaactgagggagcagaggttgcagtggccaagatcatgccactgtactctagcctggacaacacagcaagactgtgtctcaaaaaaaaaaaaaatcaaacctttgctcatgtttgaaagattatatatatatatagagagagagagagagagagacagacagacagacagacagacagagtctctgttgcccacaatgaaatgcagtggtgagatcatggctcactgcagcctcaaactcctgggctcaaatgatcctcctgccttagcctcctaagtagctgggactacagactcctaccaccatgcccagctaatttttattttgtagagacagggtcttgctatgttgccctggctggtcctaaactcctggcctcaagtgatcctcctgcctcatcctcccaaagtgctgggattataaacgtgagccaccacacctggccctgaaatataatttggatgtaataataaaaatctagatagcaaaagtgttatacttcatcttttggactgtggtggtaataaagttttaagtgtattttcagcattttccagtactcatttaatcttttttcttatgtacatgctcgctcttgcttaggtttgtttttagatgttagggtttaatcatatgaaagctgagtctgagcctcctctcactgggattaacttttactttttatgctactattgccaggaacctttatataattccctgagtgccattatgcgtcatattacatcttctggcatccaaaagcctcttccatgagcaatcttgcctttttccagtgttatataaggtagacgtaggtctctgtcacctgctgaatgcaccattactgagtccccttattaaatcctcttaatattgactcattcctttaagaacctctgattctatttactgctttcttacataagataatattttattttgttagttgttattgctagcaaaagtttattcacagttattgggctctcatatgtgactttaacaagaaaaactctagattgtaagatatttgaataaaataatatttagactaatatggtaccaatcatgcactcattctcatagattacaccactagcatattttatatagttatgctttcaaaaacacttcataagttgaaaagtgaccaaaaagtattatggaggatattaaagagtgctaatgttagctaaaatttcttagaaaatttaagatcaattgtagaagttattttttaaaatatttgtttcaaaactgtttgaacactgttctgtatgtattctgccaatgtatatattttcattgacacttgatgaaaaagtagccactccaagaacccaagaaacttactttttaagtcacctaaagttatgtgccaaacattgaataatgtagtcagagctctttcagaaggaatcggtccaggtggtaaaatgatttggggtgaactgactaaggtaatgactatatggcctccacagccttatggcttatttcacataccatgcagcaatatattacgacagcatttaaagtccactgaaacctacactgggtttcagaaatatggggtaagtaatgactttctcgtccacttacctctagtatctgatgctttactgtttcatgcatattgtcatttatttcttcaaccaattctctaaggtaaggttggcacacagtctccaacttcaataaagctaagagacttctaattctaagccccttcttacagacgaagaaattgagaaaggaaattataaagggctactgtgacttgtccaaggtcaaacaacctaagtctcaaggccttgattccaagccgtgtgctttttctttttttccattataccttcttcctcaaaataaactataacacgaatggtggcatgttctagagatgataatttaaacatttgcaggtttgtttgagtaatattttaacatggataacctacctaaattgacacaaaggtcattactcttaaaaagaattttttaggccaggcatggtggataacaccttaatcccacagctttgggaggccaagacaggaggattgtttgaggccaggagttcaagaccagcctgggcaatgtagtgagactgcgtctctaaaataatttttttttttaattagcctggtgttggggcacgtatctgtaagtcctagctactgaggaggctgaagcagaatgattgcttgaacccaggagttggaggttgcagtgacctatgaccatgccactgcactccattctgggtgacagagcaagaccttgtctctaaaaaataaaaatgaaaactttaacttagccctttacagaataagcatgctaagatttcttgcatgtcttagagtattaactttttaataggaaaaactggttatatttttataaccagttgaggctgaatatgttgagaagaggagatacctgatttcagagggatatattttgttctatttcttaaatttgaaatatccaggttattttagtcaacactgacaattagcgatactaagtttaatatagatttctctaccaaaaaaagcaccttatccaaaacagtcttaaagcatatgtgaaatatattgctgttactatgtcttgatagattattgtggtcaagttgtaacgtaacagggaaagtaagtaacaactaaaaaccatttctaatgtgcttttatcattattattcttatttaaaagggagcctggcttcttaactcttggcagaaactaactcattttccccatttaaaaaaagtgtatatatacacacacacacacacacacactatttggttaactgtgtcagaaatcttgaaaatatgccagatgaaataaaaccagctatattctttttaatctagctaaattatatcacatacaagatcttatgctgagtttataattctaaccattggaatttatattgtgataccctgatagaagtgtttacactatgatgatacggagcagcaaatgtctctaatgcacagtctctgtcttccagatttggtttgctgtaaatgtttaggctttaggccctgcaccttggctaaagataaaactgttctactcaagtgtttgctagacaaatgtgtttatttttctgaagcagagttttcttaatatttttataattatgtagtttagctgattatttgtccttagtctcatttggaggcttgaacttttgtcttcaagcttacatacaagaaaaaaattatattcttctattgattgctttcaggaaggcatttattactgaaatcataatatgtattggtatgagttgggataaaatccaccatctttcatgtgaagcagcagtaaaatgaagagatgcatttatagttctagctcatatttatcacaccatttattttttcagaagctactgataaactttaaaaaggctacttttgtgcaaagagtttgactgaaagttgaaaaagtctaatgttaataattgtgaccttaatttctcgttgacatatgcagtataatccttttgattatttcatattgtctattgctgctataagtgctctgctacttatactgtttccaataaaaccaaggcatggagaacttaagaaactttctgttcaatctcaagtacattatgatataatggtaaaaatcagaatccaaaatcatataacttctgcttgaatgccatctgtctattgggtatttttacccaattctaaaccgcctcagtcttaattatcaatgcctttgatattgaggatcttatttctacttatgtcagttaggttagattttgatgcagatatatatttatttgtctaaaaactatcatagtaagggtgctttacatttggtacaaacttgaccttcaattatgaaatgataaatttttgtgaatctatgcagcatctgaaccaatgggttgcaaactcaagcagctacatgaattaaacaggttatttaaatgagtgggttagttgaggacagtggtgagatagccaaagttttagatggtagcaaataaattttaattattttaagccacagtaagggccacacaaaacacaactatgggccttcagtttgcaactgttaataaaatagtttgtctttttcctgctcttcacacccctccaaaattacacatacactaatttattggggatgggaagcaagtagtttaactgtttccaaaaagtacaattaagtatagctttctattttgggaaaggcttgtaaaatgtatttgaaaagtaatgttaactgatctaaaagatcatcttcccaaaccacacttgagctcagtttatggtgcttactttctgtcaaaacttagaaaaaacattcacagttaacttccataatgtaaaatgtctgtctcattaggcattaaggaagcattggtcaacaggtataatgttgttagattataaggtaatgtgaatgtgggcatgacctcccaaatagatcaaagactaatctctttgacagttagaagatggcagagcttgccttgggccttttgctggtggtgcacattgaaactatttgtttggaaagcatgcctgagagataagaatgtgtttataaggatgagcaggtaaaagtaaaaggttgtcttttgacatttcaactaatcccttccagcctttggtttacttaacatttaggctatttgctggcaggagaaactggctttttcacatatgctgtatgtcattttaaattggtcattgattttcatgcttgataatccctaagtgtacaatgaaatagattctgatgtcattaaaatgaggtgtactcactttccaccttttcttaacccttagttttgctttttccaattaactgtgatctcacaaagtaatttttattattgattaattttaaaaatctgtttatgtaataagaactatttcaaagttaacctttatatacagttcatttcagggttttgttttttgtttgggagttttttgttcttttgtaggtttttaaactttttatctaaaataaattcccctgggtaaaatattggcagtattttaaaggccatttggagtgtaaaaggtgtttgaaaatttgcaataaattaaaacaatgtagccatacagaaaattttaattatgttaatgaaaaatagaagaccaaggagtcataattttatttaatctaatagttgctacattcactctaaatattccatttataactaatacgtcctagagcaactgttgtcttcggaacagtgaccactataatgtatcagtctgtccatggtgtaggaaattttgaaaacacataagctattatgtctgacaaagtagatgtcaactttctttgaggaaaatattgttaaagaagagaagctgctttagttacatttttgagagataggtaggaaatacatatatttttcccagctggacagaattttaaaagtactttttcttatagtcttaattatcatgtgctttattgctgaatttccagggagggtattaacatatcatctaatatttactatggtgttatgttatcatttactacttatgttgccctaaaaagcaaagttgggctgggggcagtggctccatgcctgtaatctcagccctttgggaagccgaggcggagggatcaccaggtctggagatcaagatcacctggctaacacagtgaaacccccctctctactaaaaatacaaaagaatagctgggcatggtggcatgcacctgtagtcccagctactcaggaggctgaggcaggagaatcacttgaacccaagaggcagaagttgcagtgagccgagatcatgccaccgtactccagcctgggtgattgagcaagactccgtctcaaaaaaaaagaaaaaaaaaaaagcaaagttggctaggcgtggtggctcacacctgtaatcccagcactttgggaggttgaggtgggcagatcacctgagatcaggagttcgagaccagcctagccaacatggtgaaaccctgtttttactaaaaaacaaacaaacaaacaaaaaatatatatatacacaaaaaattagctgggcatggtggcgtgcacctgtaatcccagctacgtgggaggctgaagcaggagaatcacttcaacccaggaggtggaggttgcagtgagctgagatcgcaccactgcacttcatcctgggtgactgagcggtactctgtccaaaaaaaaaaaaaaaaaaaaaaaggcaaagtctatgtcctttatatgtcctttatattctagttgtaaagtttcattttagaaatttgacagattcttttgagggaatgtaaaataaaaagggtggggttttgggtttttagattttggccaggcacagtggctcacgcccgtaatcccagcactttgggaggccgaggcgggtggatcacgaggtcaagagatcgagaccatcctggtcaacatggtgaaaccttgtctctactaaaaatacaaaaaattagctgggcgtggtggcacacgcctgtagtctcagctactcgggaggctgaggcaggagaatctcttgaacttgggaggcagaggttgcagtgagccaagatcgcgccactgcactccggcctggtgacagagcaagactccgtgttaaaaaaaaaaaaaaaaaaaaagcttagattttatttttacagtaagataaaattttttgacctcccaatttgaaagctgcttttcagaagtgtactgttctgttttctttcctaaagcatgttcttttatttaaaaaggttaatagtggctgggcacagtggctcacgcctgtaatcccagcattttgggaggccaatgcaggtggatcacctgaggtcaggcgtttgagaccagcctgaccaacaatgtgaaatcccaactctactaaaaatacaaaaattagctaggcatggtggcggccgcctgtagtcccagctacttgggaggctgagaggagaactgcttgaacctgggaggcggaggttgcagtgagccaagatcatgtcactgcactccagcctgggcaatggagcgagactctgtctcaaaaaaaaaagaaaaagttaacagtgttatagagtacacggaaaatactttgttttttcttgagtaggtttacaatttagtaaagtattattaagtaaaatagaggtcacttgaacctaagcactgcaataccatgacactcgattagacctagacagctactaagtaactactaactgctggtgggtagtatgtacagcatggatatactggacaaagggatgattcacatctgagtgggatggagcaggatatagcatgagatgtcatcatgctactcagaacagtgggcaatttaaaacataaattatttctggaattttttatttaatatttttggaccacagttgaccgcagttaacttaaaccactgcagataagagggaactgctgtataagttttgttaatatatcttgaaagcctaaaatgtttccaagaagtttactctttattttattttttagttgacagataattattgtacatattcatagggtacatagtgatgttttgatacatatgatgtttattgattagatcagggtaattagcgtatctgtcatctcaaacatttatcatttctttgtgtatggaacatgtaatctcctccttctagttatttgaaatgatgtaatattgttaactatagtcatcctactgtggtataaaagattagaacttattccttctatctagctgtaactttatatcctttaacaaatctcagccagacgcagtggctcatgcctgtattcctagcactttgggaggtcaaggtgggaggttttcttgagcttatgagttggagaccatcataggcaacatagcaagaatccatctctataaaaattaaaaaagaaaaaaattggccaggcatggcagcacacacctgtagtccaacctacttgggaggctgaggtgggagaatcacttgagcccaggaggtcaaggctgaagtaagccatgatcgcaccactgccgtccagtctgggggacagactgaggccctgtctctcaaaaaaacaagacaaaaaacaaatatctccccatccctcccttccttctccccttcccatctgctagtatcctctgttctactttttatttttatgagattaacctttttttttttttccgagacagagtctcactctgtcacccaggctggagtgcagtggtgcgatcttggctcactgcaacctccgcctcctgggttcatgccattcttctgcctcagcctcccgagtagctgggactacaggcgcctgccaccacacctggctaatttttttgtatttttagtaaagacgggatttcaccgtgttagccaggatggtcttgatctcctgaccttgtgatccacccgcctcagcttcccaaagtgctgggattacaggcctgagccaccgtgcctggccgagattaacatttttaagcttccacatatgagcaagaacatgtggtgtttaactttatgttttttatttatttcacttaaggtagtgtcctcagttccatccatgttgccgtgaataacaggatttcattcatttttatgactgtttagtattccattgtgtatatataccacattttctttatccacttatctgttgttggatacctaggttgattccatatcttggttattgagaatagtgctgcaataaacatggggggggggcaatgtctcttcaatataatgatttccttcaagaaagtaactccacatatctttatttaggcttctactacaaaaatacacaattggccctctgtatttatgggttctgcatctgtggattcacctaagtgtgaatcaaaaatatttgaaaaaaaattgcttctgtactgaacatgtacagatttttttcttgtcattattccctaaacactacaatgtaacaactatttgcatagctttacatcatattagctattaaagtaatccagagattatttaaagtataaaggaggatatgcataggttatgcaaatactaagtcattttgtatcaagtacttgagcatccatggattttggtatctgagggaagttctgaaaccaatcacccatggataccaagggacaactgtaccatttgatatacttgtcctggaatactacaattgcaccagattattacctggagacaattactaggccacagttcagggagaataaactcaaacagagctcagtggtcacactgagttaaagagataaagtttagggaaagtccgtggcagctagaatttgcaaggtagagtactagagaggatggagctacatagagagaaagctccaggtatctgcataggcgtccccttaagtttttggtcaagtactgattggcatatacatgagaggaagctacataaggccagggaaatgagtaggcagaaaacttcctagtgcttacaaagtctgggaatagtttgagttcccagcagccagaagagaaaaacttcataacacatggggtacttgaaacaatcatcagtagagtttcacctttgtatgggggataaattagccctagactaaaggctgctcttgactttccctaacaaagctgccaaagaatgaactggttccaagtaccctaattgcattcacagcaaaatccagtaaccactgacttaatgcccacaatgtctagtatccaatcaaaaattagcaggcatgcaaagaagagaatttaacccataatacagaggaaaatcaatcaatagaaacaaaaccagaaatgacagagatgttagaactggctagcagacaaggatttttaaaatatcttatgttttatgctctgtaagttcaaagaagatagcagaaaacataagcatactgaaaagagaaacagaagctattttttaaatacctatgtgaaatctctctatatgaaacaaaaaatacactggatggattagacactgcagaaggaaaatttggtgaacttgaaatcttataaataaaaattatccaaaatgaagtgtagagtgaaaaaaaagagggtcagtgacatgtggagtaatataaagtagtctaatatagttgtaattggagtctaagaagaagagtttcgaggcagaataatatatatatttagagaaataatggctgaaaatttttcaagtttgatagaaactataagcccacaggtccaagaagcttaataaaaacgcaagcaaaatacacacaacagcacactgtaatccaatccaaagtcgctaaaagaaaggggaacattacagagataggacaatagcatattttttcttcagaactatgcaaatcagaaaacaatgaaaagccgtctttaacaaaagaaaaaacctgtcaatttagaattcttgatcaagtgggacaatctcttaaaaatgaagatagtgaagtcttttcagaaaaagaaaagttgaaagaactcattgctagcaaacgtgcactactaatattaaagaaagttcttcaggtagaaggaaaatgataccagatggaaatttaaatctacgtgagaaaatgaagagtgccagaaatggtaaatctgtgggtaaatacggtatattttaaaagataatcttttgggacaaaacagaaatctgaataaaatacatagattatttaatactaatgtactaatgttaatttcttaatttgacatgagctatagtaatataagatgttaacattaggggaaattgggtaaagggtataaggaatctctgtactatctttggaacttttctgtaaatctaaacttatttcaaaattataaacttatttaaaattaaaagataatgtactgtttaaagcataatcaaaatgttttatgggtttatagcacgtataaaactaaaatgtatggcagcaatagcataaaggacaataaaaggaaatggaagtatattgtggtattgtttttacatcatatgtgaagtggtaaaatattattttaaggtagactaataaggatgtatatcataaaccctagaggagtcacacacacacaaagacatagctaataatccagtagtggaaataatatggaagcatattatttccagtagtggaaataatatggaagcatattatttccagtagtggaaataatatggaagcatattatttccagtagtggaaataatatggaagcatattatttccagtagtggaaataatatggaagcatattatttccagtagtggaaataatatggggggaggggggaacttgattgatccaaaagataaaaacaaaatggtacagattgggggggtaggggggaagcaaggtggtagtcttaaacccaatcataacaataactacattaaatgtaaatggtctaaacattgcaattaaaaagcagagattaccagactggataaacgtaaaagaatgaactactcataaacctttcaacatgaatgaattctaaaagtatattaaatgaaaaatgtcacaagtcattacatagtatatgataatatttatatgaaattctataaagggcaaaacagaaagcagatcagtggttgccagggccagcagtggaagaaagaaatttactataaagggataagagggaacttttgggggtgatgaaaatgttctatattatgatggtggttacattactatatatgtcaaaactcacctacttgtacactgaaaattgtgtggatttaatgaatgtaagttcaataaaactgcttgagatcacacagctgattagttatatgcattaggtaatttaaggaatgtgaagctaaataaaactattttaaatgaaacgaaaaaaatcagtactgaaaaacaaaataaaatctctaccctaaaaatatgtatattcaaactgttagaagttaatatgatgtttaaaatgagctttaattatctactaattttttaaatatattttaaaattattaggttgaactaaaacgacaatacaatgaccaccattcaaaattgagaggtcttctacctggccgtcagtggtatgaaattcaagcatacagggccttaaaccaggcccttggtaggtaagtggagtgaaatttaatataatattatctgtgacagggctatatatataaatctagtcttgctactttactctttataataaacttggtaaaattttatttaactggaaccataggaactggtatgtattcaatgatagctgtcacaagtagaatttgaaaagagtaagaagaataagttattcccaaaacaaaactcacaatttgctaaagtttaaagaaattttgtgattgatctaacaatgaatagcacacaaagatgctcagtaaatattaaagaaagcttatcaaatcaaaaaagttttgtcttgtgaacatcaaagctcagataacaattttatagataaacagacctctctcctcacctcccccaaaatgtcagggaagaaaattgatataccagccagtgtgaggagatattctatttgaaagtgtactttcagtacggaatctgtgtatctgttaaaatatcatcaaatagaaacaaaatctattttactgcccagtgagcttctgtagttgcacaatttttcattctgcttctatgtaaagaagacatctgacagaaaaaaaaatcattttcattttaatgttatttgtaagctttagataacaatgtgattacaatctatattttcttgtgccttttatgtatagtgataatgttgaaggataacattgaaactgaaggatatttaataattaaagaaaaaataaaataattaattattattattattattattgttttagacagcctcactgtgttgcccaggctggagtgcagtggcgtgatatcggctcactgcatcctccaccgcccaggttcaagcaattctcctgcctcagcctcctgagtagctgggattacaggcgtgcgccaccatgcccagctaatttttgtatttttagtagagatggggtttcactatgttggccaggctggtctggaactcctggcctcaagtgatccactcacgtcagcttcccaaagtgctgggattacagatgtgagctactcgggaggctgaggtaggaggatcgcttgagcctgggaggtgggggttgcagtgagccaaaatcatgccactgcattccagcctgggcaacagagccagaccatgtctcaaaaaaaaaaaaaaaaaaattagcaaatcattgaagaagggttaaaacaaactataatcgtgatcctaaagaattaacaccaactaaacatttaatcatgatactccgacttctaaatattcttgcccattaagatttgtgctttgtgagactcatttttaaatcattattttatacagtcatgcatcacttaataacggatatattctgagaagtgagttgttaggcaattgtattgttgtgggaacattataaaatgtacttacacaaatctagatagtatagtctactacacatataggctatatgatatagcctattgttcctagatcacaaacctatacagcatgttactgtactatagacaattgtaacacaaggataagtaattgagtatataagtgtagaaaaagtacagtaaagatatggtatagaaatacagtatattaaaaatggtacaaatgtatatggcacttaccacgaatagagcttacaggactataagttgctctgagtgagtcgatcaagtagtgagtgaatgtgaaggcctaggacattactgtacactaactgtaggctttataaacactgtacacttaggctatactaaatttatttatttttattttttcaataataaattaccctgagcttattctgactttttctttttgagagatgaggtatggctatgttgcccaggctggtctcgaacacctgggttcaagcagtcctctcaccttagcctcccaagtagctggaactccaggcacacgccactgtgcccagcttactgtaacttttttactttataaactttttatctttttatctttttttttacctttttgactcttttacaacacttagcttaaaacacaaattatacagctgtacaaaaataatttttatatccttattctataagctttttctatttttgaaatttttattttttatttttttactttttaaacttttctgttaaaaatgaagacatggggagcgcaatagctgaagcctgtaatccagcactttgggaggccaaggtgggcagatcacttaaggtcaggagttcgatagcaacctggccaacgtggtgaaaccccatctctactaaaactacaaaaattagctggatgtggtggcaggtgcctataatcccagctacttgggaggctggggcaggagaattacttgaacccgggaggtggaggctgcagtgagccgagatcaccccactgcactccagcctgggcgacagagcgagactccatctcaaaaaaaaaaaaaaatgaagacataaacactcatgtagtatcctaggcctacacaggatcaggagcattaatatccctgtcttctacctccatgtcttgaatcactggaaggtcttcaggaccaataaataacatgcatggagctgtcatctcctgtgataacaatgccttcttctggaattcttcctgagggatctgcctgaagctgttttatagttaactttttttttaatgtaagtgaaaggagtacactgtagtgataagaagtacagtatagtaaatacacaaaccagtaacacagttattatcattatcaagtattatataccatacataattgtatgtgctatacttttataagactagcagcacagtaggtttgtttacaccagcatcgccacaagcacttgtaatgcattgtgctataatgttacaatggtgacatcactaggtgataggaatttttcagctccattataatcttatgggaccactatcatatatgcacttcacactgactgaaacatcattatgtggtgcattactatcccttaatttcatattgtagggcatcaacatctaatttgtaaatgctataattaggttttgtgcaaattaaatttttttttttttttttgagatgaagtctcgctctgtagccaggctggagtgcagtggcacaatctcagctcactgcaacctctgcctcctgcgttcaagcaattctcctgcctcagcctcccaagtagctggcactacaggctcgcaccaccacgcctggctaatttttgtattcttagtagagatggggtttcaccatgttggccaggatggtctcgatttcttgaccttgtgatccgcctgccttggcctcccaaagtgctggaattacaggcgtgagccaccacattcggcccacaaattaatattttatattctctatgaaattttaattaacttcaccatgtaattatttatttcctagtgaagctgtaaggcatttggataattcatagaaacaggttgggccaggtgaggtggctcatgcctgtaatcccagccctttggtaggtggaggcgggtggatcacctgaggtcaggagtttgagatcagcctggtcaacgtggtgaaaccccgtctctactaaaaatacaaaaattagctgggcatggtggtgtgtgtctgtagtcccagctactggggaggctgaggcaggagaattgcttgaacctggtaggtggaggttgcgttgagctaagattgcgccactgcactccagcctgggcaacagagggagactccatctaaaaaaaagaaattggttaagagtaaaatcatgaaaacatgatcagttgacatatttgcacttcaaccagaagtcccacaactaatcataatcttaaccagtcaaataaaaaatttttatttttctggtgtcttgtgtatttacattagcccatttgtaaaccagatggcatgtgggttcagatttgtgtatcgcttagacatagctatatgtatatatatacaaatacataagctatgtgtatttgtgtatagcttagacataagactacaacaactagatttaagccctagaacatgtcacccactgtactccccatcattttattttttatttttgtttttattattattattattttttttttgagagagtcttgctctgtttcccaggctggagagcagtggtgcgatctcagttcactgcaacctctacctcccaggttcaagcgattctcctacctcaacctcctgagtagctgggattacaggcacatgccaccacgcctggctaatttttgtatttttagtagagacgggtttcgctatgttggccaggctggtcttgaactcctggcctcaagtgatcctcctgcttcaggctcccaaagtgttaagattacaggcgtgagccaccacacccagccactccccatcattttagaatggtattctgcatgtgtttttcttcaaactgagtgattcaggtctatggttaagctacagagatcctgctccccttttttccctagaaatcccattttacttggaatcaagttgcactgaaggttattgaagcatcacatctgcttactttgtgtctccctgctgattgacattttttttttgaattttaatattcagctaatagtttctaggggcgcttgaatatatttttgaaattgttgacttttagtcattatactcaatttgcggaaaataagtattcttagctcagttgatttttttcttccttttagtataagcaatgccttgaatttcaagaaaccatgtgaaacagaagtcatatttgtatgtggttttctcgtttacaaaccttctccacatatattatctcatttgattcttctaccaatcacttccagtagcaatgcatgttgctacttgatgttttatttgatttgctttgtttttgtttgtttgtttgggtttttttgggtttgttttttttttttttttgagatggagtctcgctctgtcgcccagtgcagtggtgcagtcttggctcactgcatcttcctccacccaagttcaagcgattctcctgcctcaacctcttgagtagctgagattacaggcacgcactaccatgcccagctaatttttatatttttagtagagacggggtttcaccatgatggacaggctggtctcaaactcctgacctcagatgatccacctgcctcagcctgaattgtttttaaactggttgtgagaaattaaattatttttctaaggccacatggctactaaatggccctttacatcttgttcccatccatttctaaaactgtaatacctgctttttcatccttatcctctacctctagccaccgaatttttcactattaaacataagtatgtcagtattaaactatcaaacatgctatattctttcattatgctttgccttggcttataagttatcatacaattcgtttggcaaatttagcaatcaaaacctcattgaaagtcatgtcctttatgaggacctttaaaacttctccaactagagttatttataccttagtaaacctatagcattttggttgctatctgtattatagcacatatctcattgtattgtaatagcctatctgttttcttccttgaacatgtgttacgttgttacattctcagcaaccaactaagtctcaaatgcttgttgaattagtgaaaaatgtgaggttcagtgctttttcctgccatacaacattgcccagagagcttttagagcttcaaaacatgctttcctggaatatcataaaaatcatgtatttatagtattgatatataatactgtacttttagaattttattaatttttttaaatggagagcccagctatcattttactgattttcagggaataatgtcaataattaataatttgttacaaaggaacttaccctttaaaaccaatcaataagtaaaattttttaaattaaaaaaataaagaccaagcaaatgttttatgttatttaataaaactcataatgtatattgattgacagaaaaggtgcttatactctgaggcactcttcttgtaagggatacagaagatctaaagtaagcagaaaccaatggattccttttaatgttaatttttttaagcacacatgggactgttagagtatttgaagtaatataagtctatgaaatacaagaacagcctttggaaacatacaagatggttttgcaaccaggttacaactgcactatgagttttctaactagtctttgttgctttactgaaagtataatctttgtctcaagccggcataattcatttaagcaaggcagtttgaaaacaatggtaaaaagaaaaggtgaaatcttttttctttgaattgtttcattaacagaaatacctttctaccataccatagaatgctttaaacataaatcaaactggaaccaaaatacagtggcacactgactttccattgactttcaatactcttctgtagtattgacaatattaatcttcttcctatccttcccagtgttatggtctgttgccttggagcctataggttactttaaaataatatcaaaaaataatgccctataaaatttagattttttttgtctttgtagaaaaattgaacatttatgttactcttcaccccctcaaaatcctatgataataaagaaatgaaaatgtcaaacctacaatattacaaagagagagaggagacagtgacagacaagcgatatcaacacattttgaacactggaaaacagccgaatgactgaatgacttagcaggcaagagaaagctgaaatttaaatctacattgatgatagtcaacaagcactttcagatttatgcatgaaaaagcctaggatttggagcaatctaaaatgtcaatgaaagtaaggtttaaaaacaggtggcttggttgcaaattagtataagaaacaattagcctcctccctcacccaggtttacttctggaaaggttgaacaacagagtctctgtattcttcaacaccaggcacagctgaggacgtattaaagatggaggttaatattatatacggggattttacatactgaatgtgagaactccaccccccttttcttttcagctctgagtaggctgacaatcagtcttacatctaccaagcgtgtagaattcctttttagggaaactgaccaccccatgagaaaatatctacaaattggcccagttcctgccaaattaccctatagcaaacttcccagcctataagctctacccatacattcagagctgccaatcagtgttttagtgccttactcttaagtaagtgcagagtcttcaccagattgtcaaagaaagtctgtaacatgaaaaacagaccaaaacaacaacaacaaaacaagtccaacaaagcaaacaaaaacacagcagaagaactctgagaaaatagaaacaacacaacagactagaacaaggattggccagtgttttctataaagggccagacagtacagtagtctctccttatccacagaagatagattccacaacctccactaaatgcctgaaaccatggatagtaccaaactctacgtatactatgttttttctatctgataaccaagatggctactaagtgactaatgggcaaaaagagtatacagcatggacatggtggacaaagggatgattaacatcctgagtgggacagcatgagatttttatcatgcaactcagaagggcatgcatttttaaatgtatgaattatttctggaattttccatttaatatttttggactacatttgaccgtgagtaactttgaccataggcaagattgtggctgtgggggactattgtgtatattttaggctttgcaggctacatacagtctctgtcacatattttttgttttttccttaatcctcttaaaaatgatcacttgaggtcagcagtttgagaccagcctggccaacatggtgaaaccccatctctactaaaaatacaaaaattagccaggtatggtggcgcacgcctgtaatcccagctactcaggaggctgaggcaggagaatcacttgaacctgggaggcggaggttgcagtgagccgagattgcaccactgcacttcagcctgggcgacagaatgagactccttctcaaaaaaaaaaaaaaatgtgaagaccattcctacacattggaggctgtacaaaaacaagacatgggctatttttgtaggcactataggctatagtttgccaacccccagataggagaaatcttcaaaaaaaaatcttaatatccatagagatgtaccatattgcctccatgaaacaagaacaaaagaataagaaaaagtgcttagaaattaacatgataccaacaatttttaaatgcataatagggcttggaagataaaatggaaattttccagatcaaaaagagaaagcgggaaagaagaactagaaaattagaggatcagtatgcaataaccaacttctgatacatagaaggctcagatcatgagaacagaaaaaataaaggaaagaaacatctcaaagaaataactcaagaaaatttctcagaattgagtaacacgatttcttggttgaaggggctcactcaggcacaggtaaaggaggaaaagctacaaagcacttcactgtgccctttccaagtaccggggataaagaaaaagtcttaaaatcttccaaagacaaaaagacaggtctctatcttacaaaagatagagaatcagaatcataacagacttctgaaaagcaacactgaaaccaaaaaaatagaagaaattgtcttcaaatattttagggaaatttttgatttgtaacttaagttctacatgagccaaactatcaataaactataagacaaaataaagccttcaacatacaaggacctaaaacatttgcttcaaatggacactttctcaggatgttactggaagatgtgctccatcaaaataaaaaaaaaaaatttaaaaaggaatatcaaggatgcagggaactagggttccaatccagaatagaggcaaagataattcctaaaacaaccaggaaggaaaactctggaatgataacagtgcagcaagtagtctaaattgagttcagaggatagaaggtttgaccatacttggaagaatttttacagctatggcatggtttggggattaattaatgacagaaaacattaaaaattaatccacaaaaagaagaggcagttattaactccagggaaggcaaaaagtcttgtacaataaaggaaatctaattatagtgcactatgtgactcagttgttaatattcccaggaagggatggtgaagtatcagtggtataagagaaataaacatcttccacaggagagaatcagtacgtaagttctaaagttcaaaaaccaagaagtagtagtaggatcaatgttccttagaaatatggagataaataaccagaagatctacctaaaatattgaaagtaattgtttctgaggaatgggaattgtaaacaggaggtgggtagggaaaggacagttatgtttttcattgaaaacataaaactatgtgttcgtgtttctttgataaaagttaaaatttacaaagctaaaattaactttaaaaaatagtttgggcgtttcagtcctagaaaagatgaagtaagcatatttagtagtctaaaaaacctagacagaatatgtggagtagctgtttgagaactctgaaaagtcaacactagcaggtagattaagaaaggagaccagaattcaaaataccaatgatctagctcaagtaactgtataataccagataaagtagaattccaagcaaacaaaattagggataaaagagaacattacataatgataaaagggtgaattcaccaagaagacataagaatcataaatgtgtatgcaccccaaaacagggtttcaaaatacatgaagcaaaaactgacagatctgaagagaaaaatagaaaaatacacaattatacttggaaacttcaaaattcctctcaataacagaactagtagacaaactaataaagatatagatgacttgagcaacattattagccaactcaagtccagtatgttctctgactgtaatggaattaaactagtaatctagtttaaactagaaatcaataacagaaaaatgtccaaatacttggaaattaagcagcatatttctaaataatccacaggcaaaacagcaagtttcaagtaaaattagaaaatattttgaactgatcaaaaatgaaaatacagcatatcaaaatgtaaggactgcagctaaagcagtgctcagatggatatttatgtcattaaatgcttattttaggaaaaaacatcctcaaatcattgatcttagtttctaccttatgaagctagaaaaagaagagctaaataaatgtgaggcaaacaggaaaaaaaggagtaataaaaacaagtataaattgatgaattgtaacaaaaataatgaaatcagtgaaatgaaaattaagctgcttgaactaagagttgagctaccattcaactcagcaatcccattactggttatatgcccaaaggaaaataaatcattctgccaaaaagacacatgcagctgtgtgttcatcacagcacaattcacaaaagcaaaggcatagaagcaactcaaatacctatcaacggtggactagataaagaaaatgtggtacatatacaccgtggaatactgcacagccattaaaaaagaatgaaatcatgtccttgccgcaacatggatgcaactggaggccattatcctaagcaaactaacacagaaacagaaaaccaaataccatatgttcccacttataaatgggagataaacaatgggtacacatggacttaaagatgggaacatagacactagggaatgaatgtaagtggaggcagagaaggagggaagcaagggttgaaaaactacctattgtgttctatgcttgctttctgggtaacaggttcaattgtactccaaactcaacatcatgcaatatacctttgtaacaaacctgcacatgtactcctggaatctaaaataaaataaaagttgaaaaacagaaaaaaatagactctttgaaaagatcaataaaattgataaacctctagcaaaattaacaaagaaaaaaaagagaagccacagttactaatatcaggaataaaagaggtattaatagtataactacagactccacaggcattaaaagaataatatgagaatactacgaaaaactctatacatatacatttgataacttagatgaagtagattaattccacaaaacccacaaaataccaaaattcacccaagatgaaatagataacatgaatagctatctagcaaataaatagaattcatagttaaaagccttctaaaaaattctccacccagatgtgttcattaacaaatattaccaaacatttaaagaagaaataacataaattttacaagatctcttctaaaaaatagaagatgtaatccttctcaatttattttatgaggccaagatgaaacagataacatgcatagctatctagcaaagaaatagaattaatagttaaaagccttctaaaaaattcacccagctgtgttcactagcaaatattaccaaacatttaaagaagaaataacacaaattttacataatctcttctaaaaaacagaagatgcaatccttcccaatttattttatgagaccagaattaaccagcaaccaaaccagatgaagactacaaaaacaaaaggaaaagggggaaaaaagaaaactataagagcctaaaaataaaactgcacacctacaaccatctgatctttgacaaaattagcaaaaataaacaatggggaaaggactccttgttcaataaatggtgctggagtaactggcttgctgtatgcaaaagaatgaaactgcaccccctaccttttaccatatacaaaaatcaactcaagatggattaaaattaactcaagatggattaaagatttaagtgtaagacctcaaactataaaaatcctagaagaaaacctaggaaatactgttctaaacatcagatttggcaaagaatttgtgactaagtcctcaaaagcaattgcaacaaaacaaaaattgacaagtgggacctaactggctagccgtaagcagaagattgaaactggacccccttccttacactatatacaacaaccacctcagggtgaattaaagacttaaatgtaaaaccttaaactaaaaacccttgaagaaaacctaggaaatatcattctggacataggctctagcaaagatttcatcatgaagacaccaaaagcaattgcaacaaaaacaaaatcgacgaatgggacttaattaaacttaagagcttctgcacagcaaaagaaactatcagcagagtaaagacaaaccacagaatgcgagaaaatgtttgcaaactatgcatcttacaaacgtctaatatccagaatccataaggaacttaaattgacaagcaaaaaacaaccccattaaaaagtggccaaaggacatgaacagacatttctcaaaaggagacatgcatgtggccaagaagcatatgaaaaaatgttcaacacactatcattagagaaatgcaaatcaaaaccacaatgtggctgggcgtggtggctcacgcctataatctcagcactgggaggtcaaggcgggcaggtcacttgaggtcaggagttgaagaccactctgcccaacatggcaaaaccccatctctactaaaaatacaaaaattaggtgggtgttgtggcgcacacctgtaattccagctacttgggaggctaagcaggagaatcgtttgaacccgggaggtggagtttgcagtgagttgggattgtgccactgcacttcagcctgggcaatagagtgagactctgtctcaaaacaaacaaacaaacaaaaacaaaaaaacacatacatacacaatgagataacatctcgcactagtcagaatggctatcgttaaaaagtcaaaaaaaaaaaaaaaaaagaacagatgctcgcaaggttacagagaaaaaggaccacatatgtactgctggtgggaatgtaaattagttcagccactgtggaaagcagtttgttgatttctgaaagaagttaaagcagaagtactgttcaacccaacaattccattattgggtgtatacccaaaggaatgtgagtcattctcccataaagacatatgtatctgtatgtttatcacagcactattcacagtagcaaagacgtggaatcaacctaaatgcctattgatagtagactggattaagaaaatgtggtacatatacacaatggaatactatgtaaccataaaaaagagtaagatcatgtcctttgcagcaacatggatggagctggaagccattattctaaatgaactaacggaggaacagaaaaccaaataccacatgttctcacttatacacgggagctaaacattgagtatatgtggacagagaagggaacaacagacaccagggcctacttgagggtggagagcttaaaattaagctgtttgaactaagagttgagctaccattcaaggaaaactacctgttggatactatgctgctttttacctgggtgacaaaataatcggtcctaatttgtcacaacaaatcaccatgacatgcaatctgcctctataacaaacctgcacatgtattcctgaaactaaaataaaagttaaaacaacaacaacaacaacaacaactatagatcaatatccctctgaaacatagatgaagatgtcctcaacagagtgccagcaaattgggtaaggtcctcaaaaatggcagaacaaagacctctgaaatttctaaaagcaatgagaaaataggcaaaaataagttagaagcaactttatcaaaactctgggtattaaccaaaagttacagcattctaggaagaatttactccttaaaaatagctgaattgcagtaagaacagtaagctttgtggtattttaacttgctctgttctcacctctctccaagttcacaatagccttaaaaaccaatagcctgaaatcgtgaggaaagccaacaacctgacagtcattggagggagcaaaacaggtctggagtacatttccagagaattatgtgacctacctgggagtttcctggaagaccccactcacaaggctatctttatttgacctgactcagagctcacccagccagctgtttaacttcacagttgcctgagacaatgaatgacatttggggcaagtgagaggctagccaaaaaatgtaaagagaaaagctgaggaatgcaatgtccatagagagcttttaaagttctgacatattcctgggattttagtgggccatgcatatgtgtaggagagtgcatgtgaccagtgatgtggacatgctaagaaaagacctgaaaaggccctaagctatcaccttggtgctctgctgaagcaggaagtgaaaacaagatcagagttattacctacagtgctgaggattgaaattatgccccaatatatgcagagactcttggcaaagaatgggagacatgatggttctagacatttaaggaaatctctgtctaattattagctgactactaagttaatcgagcagtcttcaatgaccacacatgacaatacagactttacaagattattttagaaaaattacaagaacaaaaaaccttgaagagggagaataatccgatttctatatttgccacattatattatttaaaatgtactgttttcaacaaaaatcatgacacataacaaagaaagtataactaagagaaaaaaataatagaaactctccctgaggaaacccagacatttgtcttagtagacaaagctatgccttaggagagaaagctagttcaaatacattcaataactaagcaaactgtgtcaaaaactgtgagaatgatgtctcacctcactaaatagggaatatcaataaagagataaaatttgcttaacaaaaacctaatggaaattctggagttggaaagtataatagctaaaatgaaatattcattacaggggcccaacagcagatttaagaaggcagaagaaagaattgatttacttaaacatcaattgagattatttactctgaagaacagaaagaaaaagaatgaagaacaactagcataatctcagagacctgtaaaacctcatcaagcgtaccaacatatgcatatttggagtcccagaaggagaggagagaaaaaagaatagaaagaatatttaaagaaattatggctgaaaacgttccgaatttgatgaaaaacgttaatttatacatccaagaagataagcgaactccaagtaggatgaactcagggagattcctatctagatggttgaaatcaaacagccagaagacagaatctagaaagcggcaagagagaaataactcatcatatacaaaacatcctccagaccaggaagcagttaattgacatgttcaaagtgctgaaagaaaatgactgtcaaccaagaatactatatctaacaaaactgtccttcagaaataaggtaaaaattaagacattcccaaataaacaaaaaccaagagaattactctgtagcaaacttgtcctacgagaaatactaaaaggagtctttcaggctgaaatgaaaggatattaggaagtaagtcagatgcacacgatgaaataaagaatacccacaaagttaacgacatacgtaaatgtaaaagttaatataaaggtacttcttgcttataattcttttactcttgattttttaaaagagcaactgcataaaacaataattgtaaatctgtggtgattgtcttgtgggttgccaagaccaccttcaggttcagcaattcacttggaacagttagatagcctcaggatataactgtatacatggctaggatttattacagtgaaacgacaccaagcacagtcagcaaagagaacaaaacatgtgcatgggacaaagtctagggagccagtcttaagcttccaagtgtcctctcccagtgcagttacacaggacacacttccccgagcaatgagttgtggcaacatgtgtcaaatatttccaatcagaggaactcattagcacccagggattttactggggctggtcatataggcagcctctgcctagcagtttccagaagactagactctcaaaaggagaatgagtattcagcattaatatattgtttactcaaacagttcaggcacagtgagacactcttatcagtcaatcacaggtaccctcctgaatctaagttttcattcatcagcccaggaacacctttaaacagacctttctaggggtaaacaatccaacctacaatgttaattcttctgcaccagcatacaatgtttaaagatataatttatatgacaataacaacccaaaggtgacagatgagggaacagaaggaccatttttttgtactattgaaattaagttggcaattttcctgactagtttattactggttgatatgtttattatactcttcaaccactaataaaaataagaaaatatagtaatgtaaatgacaagagaattaaaattatatactggaaagtgtctattggagaaaatggaaagtaatggaaagacagaagaacaaaatacgtaaggcatatagaaagcaaatagcaaagtgagtattttacaaaatagctgagtaaatcctaccttatcagtaattacattaaatgtaaatggattaaatactccaatctaaaggcaaagtttggctgaatggattgaaaacaatgtgatatatgctgtctgcaagagaaacactagtttaaaaaacacaaataggttgaaaataaaatgatgggaaaagacataccatgcaaatagtaaacaaaagagagctggtttggttatactaatatcagataaaatagacccttaagacaaaaaaaagttaatagaaacaattaacattttataatgataaaagtgccattctgcctgcaatcccagcactttgggaggctgaggtgggcagatcgcttgagcttaggagttcaagactagcctaggtaacatgatgaaaccctgtctctactaaaagtacaaaaaaattagccaggtgtagtggcgtgtgcctataatcccagctattcaggagactgatgtgggagaatcacctgagcccaggaagttgaggctgcagtaagccatgacctcactacttcactccagcctgggcaactggagtaagaccctgtctcaaaaaaaaataaaaataaaaaataaaaaaaaataacaagtctaaatatgcaattataaacatacaaagttaacaaaaaggccccaaaacacatctagcaaaaagcatcagaaatcaataatttagtaatacttggagacttccataccctgctcaataatgggtagaacaactagaaggaaaatcaacagaaaataaaagccttgaacaaaactacaaaccaacaactacaaacaaacctaacagacatctgtagcacacttcacccaacaacaggaaaatacgcattctgctcaagtgaacatggcatgttcttcaggataggccatccgttcatccataaaatataaggttccataaatgttaagaggttgaaatcattacaagtattatttctgactacaatgaaataaaccagaaatcaataatgggaggaaaaatggaaaactcacaaatacatggaaattcaatgatatacttttaaacaaccagtgggtcaaagaagaaatcagaagaaaaattgaaaaatacattgtgataaatgaaaatggaaacaatgtcccaaaattttggggacacagtgaaagtactactcccagggaaacttaaaaaagctgtaaacatctaggccaggcacggtggctcacgtgtgtaatcctagcactttgggaggccaacacgggcagattacctgaggtcaggagttcgagaccagcctggccaacatggtgaaaccccgtctctactaaaaatacaaaaattagccaggtgtggtagtacatgcctgtaatcccagctacttgggaggctgaggcaggagaactgcttgagcccagggggcggaggtttcagtgagctgagatcatgccactgcactccatcctggctgacagagcgagactctgtctaaaaaaaaaaaatactgtaaacatctgtattttaaaagaataaacatctggaatcaataatctaaccttcctccttaaggaattaggaaaaaaaaaagagcaaactaaacccaaagcgaggcaattaaaggaaatactagaaatgaaaaaggaaataaatgaaatagagaattcaaagaacagtagagaataaccaaggtaacaaaagttgatttgttgaaaagatcaacaaaattgacagacctgtaccaagactgaccaaagaaaatacagagaagttctaattcactaaaattagaaatgaaagaggggatgttactaccttacagaaatacaaaggattataagagaataccttcaaaaattgtgtgatgacaaataacttagattaaatggacaaattcatagatagacacaaaatactgagaatatatcaagaagaaatagaatatctttttttttttttttttttttttttttttttttttgagacagagtctcacactgttgcctgggctggagtgcaatggcatgatctcggctcactgcaacctctgcctcccaggttcaagcaattctcctgtctcagcctcctgagtagctaggattacaggtgcctgccaccatgcccggctgcatttttagaagagacggggtttcactatgttggccaggctgatcttgaactcctgacctcgtgatccacctcccaaactgctgggattacaggtgtgagccactgcgaccagctgaaatagaatatctgaatagatgtataacaagtaaagatagaatttgtcatcaaaacacttcccccccttttttttttttttttttttgagacagagtctctatctgttgcccaggctggagtacagcggcgcaatctcagcttactgcaagctccacctcccaggttcacgccattctcctgcctcagcctcccgagtagctggggactacaggtgcccgccaccacacccggctaattttttgtatatttagtagagacagggtttcaccgtgttagccaggatggtatcgatctcctgatctcgtgatctgcccaccttggcctcccaaagtgctgggattacaggcatgagccaccacgcctggcctttttttttttttttttgtgagacaaagtctcactctgtcactcaggctggaatgcagtggcgtgatctcagctcactgcaacctctacctcccaggttcaagtgattcttctgcctcagcctcatgatcaaatggcttcactggtgaattctaccaaaaatttacagaagaatttgcattaatctttcattaactctagcaaaaaatgggagagaaatatttaccaactcattctatgtggccagtattacctgatactaaaacaagtaaaatacattacgagaaaagaagattgtacagcaatatttcatatgactatagaaataaaagccattgacagaatcagcaacatactaaaaggattatacaccatgaccaagtaagattgatcccagcaatccaagactggttcaacatgctttataaaatcaattaatgtaatacaccatattaaaagaagactaaaaccacacgatcttctcaagatgcaaaaaaaaaaaaaaagcataaaacagtattcaacacattttcatgatgaaaatactcaacaaagtgggaatataaggttacttacttagctttaatgaggtcatctattaaaagctcacagctaacatcatacttaatcttaaaagactgaaatgtttttcctaagttcaagatcacgacagtgattttcactcttaccacttctattcaatattgtattggaggttctaaccagggcagtgagacaagaagaagaaagaaaggtatacagattggaaaggaggaagcagaactatttttatttgcaaatgatatattacattctaagaaaattctaagaaatccatttttaaaataacagaactgataggttcagcaaggtttcaggttacaagaccaatattaaaaaatcaatgacatttttattcactagcagccaaaaatctaaaaatgaacttaaaaaataccatttaaaataacatcagaaagaagaaaatacttagaaatatacttaactaaggagatgaaagatctgtatactgaaaactgcaagacattattgaaagaaaattctaaataaatggaaagaatcccacgttcatggattagaagacttatcattaggatatcaacactcccctatattgatatagaggttaaatacaatactaatcaaaatcccagctgactttctggcaggaattgagaagctgattctaaaattattatggaaaagcaaggaacccagaatagtcaaaacaatcttgaaaaagaagaacatactaggagaacaaacagttttctatttcaaacttactacaaagctacaataatcaagactatgttgtactggcataaagacagatgtatagatcaatgggtagaattgagggtccataaacaaattcatacatctacagtgaactggtttttgacaagagtgccaagacaactcaaagaaagaatagtcttttcaacagatggtgttgggacaactggatatctgtgcaaataatgaaattagactcctacctcacaccatatacaaaagttaactcaaagtggatcaaagacagaaaaaggcaaaaacagaggtataaattttcttgaccttgtattaggcaatagtttcttagatctgctatcagaagcacaagcaaccaaagaaaaagcagataaattggactttgttacagttcaaatttttattcttcaaaggacagtatcaagaaatggaaaagacaactcacatatggagaaaatatttgtaaatcatgtgtagcaggatctagtatccagaatatataaagaactcttacaacttaataataaaaagacaaaatgggccattaaaaatggaccaataatttgaacagacttctccaaaaaaggatacacaaatggccagtaagcacgtaaaaaatgatgttcaacatcattggttgttagggaaatgcaaatcaaagccataatgaaatattatttcacactttctagggtagatatatttttagaagggtatacaataacaaatgatggtgaggatgtggagattttggaacccttgtacgtaggtggtgggaatgtaaaatgtgcagctgctttggaaaacagtatggcagtgtttgaaaaagttaaacatagaattactatatgactccccaattccacttctaggtgtatgcccaagagaataaaaaacatgtattcatataaaaacttgtacccaaatgtttaatagcagtattattcatactagccaaaaagtggaaacattaacttataaatgaagtactgagaaatgatacaatatgagtgaatcttgaaaacatcatgttcagtgaaatatgccagatacaaaatgctacatattgtctgattcccgttaaatgaaatgtccagaattggcaactctctaaggacagaaagattagtggttgccagaggtaatggggaataattgggataatttggagtaacaattagtgggcacagggtttctttttggggtggtgaaaatgttctgggatagataagtggtataggttatacagccttgtaaatataccacaaaccattgcattgtgcactttaaaattgtttaataattattaaaaagtatgtttttatttttaatgtgtttttttaaactagcaaattgaatccaacaatctataaaaagaataatacaccatgactaggaatgcaaggatgattcagtgtttgaaaatgaaccagtgtaatctaccatattaacagtcaaaagaagaaaaactacatgttatgtcaattgaattttagaatatttttgacaaaattaaatgtttattcatgatttaaaactctcatcaaactagtaaaaaggacctttacaattatttataatacttaaggtaaaaaaaagaaaacagtctatgtggctaagaaagatcttagaatatattttctataattttcttgagtgcaaaataaaatacaacattttggatgcaagttatctgtatttggaaaaagtagggaatttttaatacatctagtttgttacattgtgttggatagcttctgtaacttttctgataataacaaattgtttaaaggaatctataaaattgatttttttccaattttctgtctgtcccactggaaaactggatttatttccgatgttataattatttgactttttccctattttttctagatgtattagacacagaaatgattggggagctcttattctagtggatgatcgctttaggaataacccaagtcgctatatatctggtaagatctcagctgggcttagagtaaaaactagtaacaatcttcatatttttattgtggtgaaaaacacataacatgagctctactatcttattaagtgcacagtacaatattgttaactataagcacagtatttcacagcagatatctagaacttttaaatcttacataactgaaacttaacaccaactgaacagcaatgccccatgtccctctcccccctgtccactgacaaccaccgctatactttctgcttctattagtttgactgttttggatacctcatataaattgaattatgcagtatttgtccttctgtaactggcttatttcagttagcataatgtcctcaaggttcatctatgttgcaggatttccttcttttcaatgactgcttaatattttattttatgtatacattataccatattttctttatccattcatctgtcagtagacatttaggttgtttccccctcatggatattgggaacaatgctgcaatggacatgggaatgcagatatctcttcaagatgctgatttcaatttttttgaacaaataccaagcgtaggatttggcgaatcatcatagttctaagtttaattttttgatttgatactgttcttcatagcaactgcaccatttaacattcccaccaatagcacacaagggttccagtttctccatatcctccctaatgcttatttccttttttcttctttttctttttaaaatttcataatggctctcctagcaggtataatgtgatagcacagtgtggatttgatttgcatttctctgatgaatagggatgttaagcatcttttctatacctgttggccaaatcatatgtcttctttggagaaacatcttttcatttgctcattttttaattgggttatttggatttctttgcatatctgtttttttggtttggtttttggtgtgtttttttgtttgttttttctattgagatataggagtttcttatatattttggggattaactctttatcagatatatgcgttgcaaattattttctcccattctataggctgccttttgactctgctgattatttactttgctgcacagaagttttttagtttaacatggtcttccttgtctaattttgcttttattgcctgtgtttttggtgtcatatccaaacaatcattgccaataccaagactggataatttataaagataagagatttatttggcttatggttctgcaggctgcacaagaatcatggcatcagcatctgcttctaatgaggacctcagaaagtctacaatcatagcaccaaggctttcatgagggttctgtccccatgacccacatacctcccactaggccccacctatgacatgggggaacacatttcaacatgagctttggaggaaacaaataaccaaagcatatcaatccccaatgacaccctgttgaagatccgctgaccatatatgtgtggatctgcttctgagctctctattatgttccattggcttatatggttctctttatgccagtaccatacttttttgactactacagctgtgtaatgtattttataatcgggaggtatgatgcctgcagcttttatcatttttctcaaggttcttttgcctatttgtggtcctttgtggttccatatgaatttagattgcagccgggcatggtggctcacgcctgtaatcccagtgttttgggaggccaaggcaggtggatcacgaggtcaggagtttgagaccagcctggccaacatggtgaaaccccatctctattaaaaatacaaaaattagccgggtgcggtggcgggtgcctgtaatctcaactattctggaggctgaggcaggagaatggcttgaacctgggaggcggaggttgcagtgagccaagaccgcgccactgcactctagcctgggcaacagagcaagattctgtctcaaaaaaagattgctttcagtagtatggacattctgacaatattaggtgttccaatctgtgaacatgggatatctttccatttatttgtgttatctttactgtttttcagcaatgttttataatttccagtgtacaggttttttgcctccttagttgtttattcctaggtattttattatttttgatgctattttttttccctggtttgagtttttttattttaatttttatttttattattatactttaagttctagggtacatgtgcacaacgtgcaggtttgttacatatgtatacatgtcccatgttagtgtgctgcacccattaacttgtcgtttacattaggtatatctcctaatgctatccctcccccctctccccccaccccacaacaggccccggtgtgtgatgtcccccttcctgtgtccaagtgttctcattgttcagttctcacctatgagtgagaacatgccatgtttggttttctgtccttgcggtagtgtgctgagaatgatggtttccagcttcattcatactattataaatgggattgttttcttacattcctcttttggttgtttttagtgtatagaattgcaagtgattgttgtacattgatttttgtattctgcaactttactggatttattagtcctaacaggttttttttcaatctttagggttttccacataaaagatcatgtcatctgcaaagagagatcatttcactttattctttttcaatttggattccttttatttcattttcttgcctaatagtctggctaggattcttagtactaagctaaatagaagtagtgagaatgaacatccttgctttgttgctggtcttaaaagcttttcattttttaattttttgaagaaaaatgctttgattcctttctcatttttcttttgtataccttctatagatatttcctttgtggttacatgggtcttacatgaaacatagttataacaatattttcagctaacaaattcatttcagttgtataaactctacacttttacttttcccatcacattttattattaaagtcacaaattatacccttttatatagtgtatccactaacatactattatagttattttcatactttgtcttttaacttctgtatagaattaaacattatttatgtatcactgttgttatattaaagtattctgtatttgtgtacacttttaacttcacgagcaaactttatgcttttgtgttgctgtttagcaggcttcctttagcatatcttgtaaggcacgtttagtggtgaagtccctcagcttttgcttatctggaaaagtttttacctcttattcattttgatagatggctttaccagatataatatccttcactggcaggtttttttctttcagcacttcaaacatgtcatcccacttccttacagcatgcaagatgtcgcctgagaaatctttctctttttggagacaggatgttactctgccacccaggcaggagtccagtggcatgatcatgactcactgcagcctcagcctcccaggctcaagtgatcctcccacctcagcctcagctgggactacaggcatgcaccaccagacctggctaatttttaattttttttgtagagatggggtctcactatgttgcccaggctaatctcaaactcctcggctcaagcaattctcctacctctgcctcccaaagtgttgggattataggcatgagccttcatgcccggcctagtgactgtcttatgggacttcatttgtatatgacaagttgcttttatcttgctgttttcaaatttctattgttttctttgacttttgacactttgattataaagtgttttggtacagacttttgggttcatcctgttcaggttcactgggcttcatgtatttggatgtcattttcctccccccaggtttattaagttttcggtcattatttctataaataagctttctgctcctttctctctttctctttctaggactcccagaatgtgtatattggtcagcttgacggtgccccataagtcaagtcataaatgaagccataagccttcacttttttttttccattttgttttttactttttgcttccctgactggatgatttcaaacgacttgccttcaaatttcctgattcttagcactttgggaggctgaggaaggtggatcacttgaggtcaggagttcaagaccagcctggccaacgtggtgaaaccccacctctactaaaaatacgacaattagccgggtgtggtggtacatgcctgtagtcccagctacttgagaggccgaggcaggagaatcgcttgaatcagggaggcggaggtttcagtgagccgagatggcgccactgcactccagcctgggcgacagagcgagactgtctcaaaaaaataacataacataacataacataacataacagaatataaaatatataaaataaagtaaaataaaataaatttcctgattcttccttctgcttgatcaagtctgctgatgaacccctgtagtgaatttttcagtccagttattgcattttttagctccaaaatctctttagttcttttttgtattctttatcattgttgaaattctcctttttttctatattattttcttgaacttgtgagcatcatgttgacagttattttaaattccttgccaggtaattcatatagcttttttttttttttaagggttggtttctggagacttattttgttcctttgacagggttattttttcctgtttctttatgtttcttgtaaccttgtatggtatccacacatttgaaaaaacagccacctctcacagtgtttactaactggttttgtacagggaaagaccttcactcatcagccctggtaggcattctgggagcctctcaaaccttttccgtggatctgtcttctttggacttctctgtaaattccttattagaaatatttgcttggtttttttttgttttggtcaaggtctcactctgtcgcccatgttggagtgcagtggtacaatctcagctcattgcagcctcggcttcctgggttcaagggattctcccacctcagtctcccaagtaactgggaccacaggtgtacaccactatacccagttaattcttgtattttttgtagagatggggtttcaccatgttgtccacgctggtctcaaactcctgggctctgggctcaagtcatctgcctgcctcggcctccctaagtgctgggattacaggcatgagccatcacgcctgactctcttttgttcttagtagattccaggcatacagagtatgctaggtccagtcagtactctatgacaagcaagacagaaacgagtccctagacagctccttgaaaagccaagatgttggatgcacactccaggcttttctgtccccctgagggagtggccatcaaactatatgggcctctgttgcactgtggttcctgtggagcagaaacttgctgcacagcgcttttgttcttagtggcccctgggcatgtagggtatgccagctcatgtcagctcttcagtacaggtaagatagaagccagtccctggggcagcctcccagaaaaagacataaggtccagttttctcttttctccccaggaagaagcagccaggtatattctgaagtggggatcatgacaagagggtgccacaaattttcctaccgctttgatgcaggcagtagtatcatttttttctcactcgatggtttcatccaacagtaaacagttttcagagtcaataccaggagtgattactaaagagctatgggatacatgtgtatctttattattaccttttagctaaaaaaaaaatacattttattataataaagagatgttaaattttgttttagattagccatgtgtgggtgtagactctaccttttcaatttcagagcttaatgactgtatttggtttgatattaaaacataaagcagaaaatattgctttatttgttttatcttccctttccacgtaaagtgtgcagtagcataggtcaaacagtaactaaaggcaaaaatgctaagtgctggtgtctagtcagcaggtggagctcagattctttcaagttttcaaaagcagacaatgatattttacattgaaaaggctttctttgattataaaaaggttgaaatgaagaggtaaatatagtactaaaattcttatttttatttacttatttcttttttagagacaggtcttactctgttgcccaggctggagtgcagtgacgtgatcatagttcactgaaaccttgaactcctggcctcaagcaatcttcccacctcagcctccccaaatgctgggattatacatgtgagccaccacactcagcctaaaaattttcaattttagagaatttcacatatttttatggtctaatcatattccccaaatgaacaaaataaaaaacttcaagggaaatggcttatttaaaatttttttagttttaaaatctagaacttaaatttttaccctatagtgacttttaaaactaattcctccaaaagatgatgctagttttagtagtgttagcagggaatatttattttgtaaaagtccaaatacctgattttgcatttcatttggaagcacaccatactagaaaacaccttaaactcttaggtttcatttttgtgcagtttttatgtcacaggtcaaatcatatcctttataacttgattatatattaaaaataattatatcataaaaattcagaagggatgtgatttacccataagacagtgttatttatttcacctccagaataattttaatttaagatatatttggaattggtggaggaagggaacaaaaaaacttgagactagaatcttgaaattatttttgcaaaaggagtaaaatttagaatattagaatggaaagttgtattgtttacaacttctagtttccctacaaaaaaaaaaggcaatttttgtggggaattatgatgaaattaaatttgccatgttcaccagttattcttaaccagagaatatgttttcccatctctgccctacttctactgcctctttgctctctccatttgacaattactgtatataaagagaatgttactcatatgttactgatacatatgtagtaaaattgctgaattgcagaaaaaacatatggagaaccattctgtatattcaaaatacaaattaggttacttcactagaaaaagcaagtgtattaccttagcatgtaatattttaataactaagtaaccaaattttccctgggtttacctttttctttaggactttctaaatgggtacggcagcagattcagcaccattcaacctttgaaagtgcactggaatccttggctgaattttccaaaaagcatcaaaaagttcttaatgtatccataaaggacagaaccaatatacaggacaatgagtctacacttgaagtgacctctttaaagtacagtacctcaccttatttactggaagcagcaagtcatctatcaccagaaaattttgtggaagatgaagcaaagatatgtgtccaggaactacagtgtcctaaaattattaccaaaaattcacctctaccaagtagcattatctccagaaaggagaaaagtatgaaaagttcttcccatttacctttgatagagaagtctttcattatatttagtgaaatgatatttatttgggtatagattaattccttaaatatggtggtttgtaatataaggtgttatcataaaatagtgaaacagtatggtgtactgtaatgggaacaaacttttgtcaggagaccagagcatattttctggttttccactaactggctttgccacttactagctttgtgatcatgagcaagtcatttgtcctttttgagtcgtaataggaaaaaaaaaatgcctgcctagctatcccttcaggttgggttgtaaaggtcaaaattataaatatcacagcattgtaaagtaccatgtaagtggtagatgttattctaaaggctatataaaaatttggcctaatttttatgtagatacttctatatgaactacttttcctatatagatagttcttatgaacttatttttaggaggtgagagacatttattttaagtgatgaaaaataatattttaaaatattttgaaataatcatctgtatcagattggcaaactgtggcccatgggccaaatttggcctgctgcctgtttttgtaaataaagtttaatgaaatgtagtcatgcccatttatttacattttagaaacaacagcagagttgagtatttgtgtgtattgcactagaacagcataattgagtagtcgcaacagatacattatgctccacaaagcctaaatattactatctggcctatgacagaaaaggtttgccaaactctggtctattccattggatataatttcagttgttttaattcatatatccaaggcgggtggatcatccgaggtcaggagtccgagaccagcctgaccagtgtggtgaaacaccgtctctactaaaaaaatacaaaaattagctgggtgtggaggcagctgtctgtaatcccagctactcaggaggctgaggcaggagaattgcttgaactgggaggtggaggttgcagtgagccaggattgcgccattgcactccagcctgggcaacaaaagcaaaactcggactaaaaaaaagaaaaacatcaatttttaaacatgtattttgtagtatataagtactacaaaatagtaatacaattttgtatataaatactacaaaatagtaatacaaaattcactataaatagtgaattcaagccgattaacttggtaatcaggaaacctagtttctagtcttggtcttcttactaaccagttttataactttgagcaaataacttagccttatgtcactttccttatttattaaataaaagaattagtctaggtaagtttttctcagtcactggttagtggattttcaaggcaaatgtttacagcctgttccctcctttcctcagctcccttcctcttcccttttaccccttctttcctcattcattcttgagctccctgctgtggaatttgatagtttaccagacagcattataacctgggctaggaaacattagagacctaagatttctttcagagttaatattctgttccaagatgaaaatccactagtattcgttgggggctctaagttatgtatcctatacagttatttaggtatttctaataaataattattttaacctagcaattatgttagctaggagcagaaagttaaatctcttaaattcttgtattcttagatgatccagtattcctggaagaagcagggaaagcagaaaaaattgtgatttccagatccacaagcccaactttcaacaaacaaacaaagagagttagctggtcaagctttaattctttgggacagtattttactggtaaaataccgaaggcaacacctgagctcgggtcatcagagaatagtgcctctagtcctccccgtttcaaaacagagaagatggaaagtaaaactgttttgcccttcactgataaatgtgaatcctcaaatctgacagtaaacacatcgtttggatcatgccctcaatcagaaaccattatttcatcattaaagattgatgccacccttactagaaaaaatcattctgaacatccgctctgttctgaagaagccctggatccagacattgaattgtctctagtaagtgaagaagataaacagtccacttcaaatagagattttgaaacagaagcagaagatgaatctatctattttacacctgaactttacgatcctgaagatacagatgaagaaaaaaatgacctagctgaaactgatagaggaaatagattggctaacaattcagattgcattttagctaaagacctttttgaaattagaactataaaagaagtagattcagccagagaagtgaaagctgaggattgcatagatacaaagttgaatggaattctgcatattgaagaaagtaaaattgatgacattgatggtaatgtaaaaacaacttggataaatgaactggaactgggaaaaactcatgaaatagaaataaagaactttaaaccatctccttccaaaaataaaggcatgtttcctggttttaagtaataatacttaactctcaagctaagtaaaaatatgtcatcatgcttatgttaaactctgttgtaagtaataatttgtaaattgaataagtggcatactttttaaaaaactattttatgttcagaaatgtaaatgttattattcttgagtttttgggtttctttttttgagacagagtcttggtctgttgcccaggctggaatgcagtggtgtgctctgggctcactgcaaccttcacctccaggttcaagtgattctcctgcctcagccttctgagtagctgggactacaggtgtgcaccaccatgcccagctagtttttgtatttttagtagagatggggtttcaccatgttggccaggctggtctcgaactcctggcctcgtgatctgcccttctctgcctccctaagttgctgggattacaggtgtgagccacagtgcctggcccattcttgagttttgataaagtaattcatacaaagtactgtcctcaaataagtcttccttagctaaatgcaatttaaaattattcaaagatcctagggcacttctagtttcacgtaaatattcatattaggtggttctcttcatccatttgttttcacactgatacataaaaattaacagcagtctaatctagtgacacctcagtcatatttcgctatagattttacctcaaatcagtccaagactttttcagagatcaccatttgtcttgaaaggtttatttcgttattaaactgcctacttataagtaattaagagaaattaagaaagtagtatgcatttttaattgaaattgttttacattctttgtataataaacctaaaaccaaacatgtcataaacaaattgacgtaaagatataaaatgccaaatgaagtattccaaattttctattctaattatttagcttcaccatcattgtggaaaaaaatactagatcctgcttagtattatatatttttcctagtggatcagtgagtaataagtaccaaacactagactagaaggtaatttctacattgtttagaaagggtgaaacaatttatcccctctggtattgttctagcataagctttagttatacaatgattaagatagaaaacttcatatataaatttgataagcaaacccacatttatagctgcagctaaaatatgtttccttagggcacagtaatcctttctgtgaattttgaccttgtttgtgtttttgtgaatgaagctatatgtctaatcaaaaatgattataaaagaggctcatctctgacatcattccaaaaatacattcattgatctctttttaagaaacatctgttattcactgggcattgggactttttgtgagtaatttgaattgaaattttatgagctatccaagaattctgtatggtctattattttcaagtcaaaatttccagtaaggatttactttacatttcatttggataaatgaatcattatataggtatgtctttgcttccattttgagacatttagatttttacagcctgtttctatagcatttgatgttacaactctaagcgtagttcaaagacatttaaattgacaagttaccagttaaagaatttagaatatattagatcccatctagtattatatattttttctagttgatcattgagcagtaaataccaaatactcgattagaaggtaatttttacattgttttgaaagggtgaaacaatttatctcctctggtattattcttaaaccacagatagggatagtagggtagtgaaacgaataaatacctggtagaagacaagagacttgggctctacacctggctctgccactgatttgctaagtcatattggcaatcaccacacccttcagggaattagtttcatctgtaaaatgcagcggttagtactataaaatcatacaaatttctttgtgctttgagaatctataaaggaatgtctgttgatattctgagtcgattttcatttgcttttgttccagaacggttaaaataaagcatattatttcatttaaaaagtaaagtggctcttactcatttacatttagggaacgatggtgacgtggtttggctatgtccccagccagatctcatcttgaattgtagttcccataatcccgacgtgttgtgggaaggacccagtgggaggtaattgaatcgtgggggcggttaccctcatgcggttctcgtgatactgagttcttatgagacctgatgattttataaggagcttttccctgcttcactctcattcttctctcctgctgccctgtgaaaagttgccttccgccatgattgtaagtttcttgaggcctcctcagtcatgcagaactgtgagtcaattaaacctctttcctttataaattacccagtcttgggtatgactttattagcagcatgagaacagactgacacagatggtatatgtgcataataacttggaaagctagatatttattttcgcaatgctacaattaaaacattttgaggacttttaaaattacctttagggccaggcgcggtggctcacgcctgtaatcccagcactttgggaggccgaggcgggcggatcacgaggtcaggagatcgagaccatcctggttaacacggtgaaaccccgtctctactaaaaatacaaaaaattagccaggcgtggtggcgggcgcctgtagtcccagctactcaggaggctgaggcaggagaatggcgtgaacccgggaggtggagcttgcagtgagccgagattgcgccactgcactccagcctgggcgacagagcgggactccgtctcaaaaaaaaaaaaaaaaagaaattacctttagaattggtaaactacatgagaaaattaagcatattattcatatcttagtgttattacccaacttcatctccaatactttcccctttccctagctagatatgtttttgtttgtttgttttagacagtcttgctctgtcgctcaggctggagtgcaaaggcacgatcttggctcactgcaacctctgcctcgcaggttaaagcgattctcatgtctcagcctcctgcgtagctgggattacaggtgtacaccactgcacccagctaatttttttttttttttttttttaagtatcgacagggtttcaccatgttggccaggctggtctcaaactcctgacctcaagtgatctgcccacctcggcctcccaaagtgttgggattacaggcgtgagccaccatgcctggcctagatattttttattctttccaaaatttaattctccctgaagttaaaaattttcattactgagaatgtacatagagatgtgtcacaaccctttagtaattccaaaaggtgtttcaaaaattttatacaatgataatcactgttgaaacaggtgtatattctcctcagatcatgactgaccaagatgatattccaagaagtaaactactggcctttatagagtaggatgtaggccattttcattactgataacatacttttaaaagaaatgtttacagagttaaataagttaaaacatctaaatgcttttaaaagagcacctggcacattgcaagttattcattattaattagtagatgaatcatatatctggagtgcacccttgctctatatgaaagcttccctaactatagatatataggtgatagactgacaataaagatttgaggaaagaaaaattatttggctggcttattttttaagcttttgagatgtataaggtagagattgtttatcaaataatttatgtgacacattcaatgcatatgaaataattatctaatactgaatttattcaaggactgaaagtatatagagcacacaggctgcaaaccaggaaaactaccagttagagacagggctttattcttggaataaaggtacaatgtaaagagtagatgtttcatgacttgattaaattatttaaaactgtctagaattgtgttataaaactattactatgtttctatgcacttagttattacatgggtttaaatttggcactgtttctaagtttctataaggctttgttgttaagatctttctattcaaaacattaattttaacaaaaagcttttccccgttatttttctgcaactggacttttttgtattactttcctatattaaaacgcatttaaaatatttaattctttagggctgcttacaaaatttcatgaaatcaaagcacctgttgtcaaatcacttgaaaggctggttatcatggtcatctctaagtgatggcattcttttgtatttgattaccacacaattattctcgcatatgctcttttaaacgctgatttctcaatgagttacacaagaatttaacctttatgaattcttggtggtttattatctatttccataggtaaatgcagttaatcttttgtaaatagatagtattgatgataatcaaaaaaaattttaagaccagatcaagcaatgaatgtaagaaagctaaaaccttaacgtaaaataactgcagagctatgaaaaatacaataaagaacatcaggaaatagaaatttggaaaagtgaccaaggcttatgatcctctagccttaaacaattttcatgtctcaaaaaaaaaaaaaagaattttgtttcttaagtttcatttgatagaaccattagctgcctggcttcctgtactccacaatggagccttgttataatatacatgggatctgagccagcagatcaccttattggtaagactaccttataatgaggtgctttcagtaactaaaccctcttggaccaggtccaaaacaacccatcttacaccaaattccactctgtaataaacaagcgtcaatgtattggaaagaaaacaaaagctatatgaaatttactgttcccagaaattaacctttgaaaacccaatggtaaatactgattaaaaggaatgtgtaacaaggcataattagatagatattttagtacattttataataactttgtattttcttggctcagtcttcctttattcgggaatttatattattttgattatcttaacgctttccccaaaatttcatcatttcacatgaaaatattttacattaatatttatagaattcaatattaaagtttgatttggctccttgctattataaaacacaaaattgtacaagaggcataccatttctgtaaactaggtgccattatcttttatatatgattcacatatagttgaaaagttttaaaagtatttagtactgtttgttattattttagatgcagtattgtcttcgtatattttccctgtttttcttttttttcctgtatttttatttttttaattaatttatttttattatactttaagttctagggtatatgtgcacaacgtgcaggtttgttacataggtatacatgtgctatgctggtttgctgcacccatcaactcatcatttacattaggtattactcctaagctatccctcccccagacccccacccccagacaggccccagtgtgtgatgttccccaccctgtgtccaagtgttctcattgttcaattcccacctatgagtgagaacatggggtgtttggtgttctgtccttgtgacagtttgcttagaatgatggtttccagtttcatccatgtccctgcaaaggacatgaactcatccttttttatagctgcatagtattccatggtgtatatgtgccacattttcttaaaccagtctatcgttgatggacatttgggttggttccaagtctttgctattgcgaatagtgccgcaataaacatatatgtgcgtgtgtctttatagtagcatgatttataatcttttaggtatatacccagtaatgggattactgggtcaaatggtatttttagttctagatacttgaggaattgccacactgtcatctacaatggttgaactaatttacactcccaccaacagtgtgaaagcgttcctatttctccacatcctctccagcatctattgtttcctgactttttaacgatcaccattctaactggcatgagatggtatctcattgtggttttgatttgcatttctctgatgaccagtgatgatgagcattttttcatgtgtctgttggctgtataaatgtcttcttctgagaagtgtctgttcatatcctttgcccactttttgatgggtttttttcttgtaaatttgtttaagttctttgtagattctggatattagccctttatcagatgggtagattgcaaaaattttctcccattctgtaggttgcctgttcactctgatggtagtttcttttgctgtgcagaagctctttagtttaattagatcccatttatcaattttggcttttgttgccattgcttttggtgttgtggtcatgaagtctttgcccatgcctatgtcctaaatggtattgcctaggttttcttctagtgtttttatggttgtaggtctaatatttaagtcttcaatccatcttgaattaattttggtgtaaggtataaggaagggatccagtttcagctttctacatatggctagccagttttcccagcaccatttattaaatagggaaaattcctacttaatattggtctcttttttggttgtgtctctgccaggctttggtgtcaggatgatgctggcctcataaaatgaattagggaggattccctctttttctattgattggaatagttagagaagaaatggtaccagctcctctttgtacctctggttgaatttggctgtgaatctctctggtcttggactttttttggttggcaggctattaattattgcctcaatttcagaacctgttattggtctattcagagattcaccttcctggtttagtcttgggagggtgtatgtgtcgaggaatttatccatttcttctagattttctagtttatttgcatagaggtgtttatagtagtctctgatggtagtttgtatttctgtgggatcggtggtgaaatcccctttatcattttttactgcatctatttgattcttctttcttttcttctttattagtctcgctagtggtctatcaattttgttgatcttttcaaaaaccagctctggattcactgacttattttgaagggttttttgtgtctctatctcctttaattctgctctgatcttagttatttcttgccttctgctagcttttgaatttgtttgctcttgcttctctagttcttttaattgtgatgttagggtgtcaattttagatctttcctgctttctcttatgggcatttagtgctataaatttccctctacacactgagagattctggtacgtggtgtctttgttctcattggtttcaaagaacatctttattcctgctttcgttttgttatttacccagtagtcattcaggagcaggttgttcagtttccatatagttgtgtggttttgagtgagtttcttaatcctgagttctaattggattgtactgtggtctgagagacagtttgttgtgatttctgttcttttatatttgctgaggagtgctttacttccaattatgtggtcagttttggaataagtgcgatgtggtgctgagaacaatgtacattctgttgatttggggtggagatttctgtagatgtctattaggtctgcttggtgcagagctgagttcaagtcctgcatatccttattaaccttctgtctcattgatctgtctaatattgacagcggggtgttaaagtctcccattattattgtgtgggagtctaagtctctttgtaggtctctaaggacttgctttatgaatctgagcactcctgtattgggtgcatatatatttagaatagttagctcttcttgttgaattgttccctttaccattaagtaatggccttgtctcttttgatttgttggtttaaagtctgttttatcagagcctaggattgcaacccctgcttttttttgctttccatttgcttggtagaacttcctccatcccgttattttgagcctatatgcgtctctgcatgtgagctgggtctcctgaatatagcacactgataggtcttgactctctatccactttgccagtctgtgtcttttcatgggggcatttagcccatttacattttaggttaatattgttatgtgtgaatatgatcctgtcattatgatgttagctagttattttgcccattagttgatgccatttcttcctagcattggcagtctttacaatttggcatctttttgcagtggctggtaccggttgttcctttctatgtttagtgattccttcaggagctcttgtaaggcaggcctggtggtgacaaaatctctcagcatttgcttgtctgtaaaggattttatttctccttcannnnnnnnnnnnnnnnnnnntatatatttaggatagttagctcttcttgttgaattgttccctttaccattatgtaatgaccttgtctcttttgatctttgttggtttaaattctgttttatcagagcctaggattgcaacccctgctttttttggctttccatttgcttgacagatcttcctccatccctttattttgagcctatgtgtgcacgtgagatgggtctcctgaatatagcacactgatgggtcttgactttttatccaatttgccagtctgtatcttttaattggggcatttagcccatttacatttaaggttaatattattatgtgtgaatttgatcctgtcattatgatgttagctggttattttgcccactaattgttgcagtttcttcatagcattgatggtctttacaatttggcatgtttttgcagtagctggtactggttgtaccatgtttagtgcttccttcaggagctattgtaaggcaaacctggtggtgacagaatctctcagcatttggttgttcgtaaaggattttatttctccttcacttataaagcttagtttgactggatatgaaattctgggttgaaaattcttttctttaagaatgttgcatattggcttccactctcttctgacttgtagggtttctgccgagagatctgctgttagtctgatgggtttccctttgtgggtaacctgacctttctctctggctgcccttaacatcttttccttcatttcaaccttggtgaatctgaaaattatgtgttttggggttgctgttctcaaggagtatctttgtggtgttctctgtatttcctgaatttgaatgttggcctgccttgctatgttggggaagttctcctgggtaatatcctgaagagtgttttccaacttggttccattctccccgtcactttcaggtacaccaatcaaacgtagatttggtcttttcacatagtcccatatttcttggaggctttgttcgtttctttttactctctttaatcttgtcttcttgctttatttcattaatttgatcttcaatcactgataccctttcttccacttgatcaaatcagctgttgaagcttgtgcatgcgtcacgaagttctcatgccatggttttcagctccatcaggtcatttaaggtcttctctacactgtttattctagttagccattcgtctaaccctttttcaaggtttttagctttcttgtgatgggttagaacatgcttctttagctcagagaagtttgttattaccgaccttctgaagcctatttctgtcaactcgtcaaagtcattctccgtccagctttgttccattgctggtgaggagctgcgatcttttggaggagaagcagcactctggtttttagaatattcagcttttctgctctggtttctccccttctttgtggttttatctatctttggtctttgatgttggtgacctacagatgggcttttggtgtggatgtcctttttgttgatgttgatgctattcctttatgttttgttagttttccttctaacagtcaggtccctcagctgcaggtctgttggagtttgctggaggtcccctccagaccctgtttgcctgggtatcaccagcggaggctgcagaacagcaaatattgctgcctgatccttcctctggaagcttcgtcccagaggggcatctgcctgtatgaggtgtctgtcggcccctactgggaggtgtctcccagttaggctaaacgggggtcagggacccacttgagg

SEQ ID NO: 245 - DNA, 3895 bp, Homo sapiens
atgtcttcaatgtggtctgaatatacaattggtggggtgaagatttactttccttataaagcttacccgtcacagcttgctatgatgaattctattctcagaggattaaacagcaagcaacattgtttgttggagagtcccacaggaagtggaaaaagcttagccttactttgttctgctttagcatggcaacaatctcttagtgggaaaccagcagatgagggcgtaagtgaaaaagctgaagtacaattgtcatgttgttgtgcatgccattcaaaggattttacaaacaatgacatgaaccaaggaacttcacgtcatttcaactatccaagcacaccaccttctgaaagaaatggcacttcatcaacttgtcaagactcccctgaaaaaaccactctggctgcaaagttatctgctaagaaacaggcatccatatacagagatgaaaatgatgattttcaagtagagaagaaaagaattcgacccttagaaactacacagcagattagaaaacgtcattgctttggaacagaagtacacaatttggatgcaaaagttgattcaggaaagactgtaaaactcaactctccactggaaaagataaactccttttcgccacagaaaccccctggccactgttctaggtgctgttgttctactaaacaaggaaacagtcaagagtcatcgaataccattaagaaggatcatacagggaaatccaagatacccaaaatatattttgggacacgcacacacaagcagattgctcagattactagagagctccggaggacggcatattcaggggttccaatgactattctttccagcagggatcatacttgtgtccatcctgaggtagtcggtaacttcaacagaaatgagaagtgcatggaattgctagatgggaaaaacggaaaatcctgctatttttatcatggagttcataaaattagtgatcagcacacattacagactttccaagggatgtgcaaagcctgggatatagaagaacttgtcagcctggggaagaaactaaaggcctgtccatattacacagcccgagaactaatacaagatgctgacatcatattttgtccctacaactatcttctagatgcacaaataagggaaagtatggatttaaatctgaaagaacaggttgtcattttagatgaagctcataacatcgaggactgtgctcgggaatcagcaagttacagtgtaacagaagttcagcttcggtttgctcgggatgaactagatagtatggtcaacaataatataaggaagaaagatcatgaacccctacgagctgtgtgctgtagcctcattaattggttagaagcaaacgctgaatatcttgtagaaagagattatgaatcagcttgtaaaatatggagtggaaatgaaatgctcttaactttacacaaaatgggtatcaccactgctacttttcccattttgcagggacatttttctgctgttcttcaaaaagaggaaaaaatctcaccaatttatggtaaagaggaggcaagagaagtacctgttattagtgcatcaactcaaataatgcttaaaggactttttatggtacttgactatctttttaggcaaaatagcagatttgcagatgattataaaattgcgattcaacagacttactcctggacaaatcagattgatatttcagacaaaaatgggttgttggttctaccaaaaaataagaaacgttcacgacagaaaactgcagttcatgtgctaaacttttggtgcttaaatccagctgtggccttttcagatattaatggcaaagttcagaccattgttttgacatctggtacattatcaccaatgaaatccttttcgtcagaacttggtgttacatttactatccagctggaggctaatcatatcattaaaaattcacaggtttgggttggtaccattgggtcaggccccaagggtcggaatctctgtgctaccttccagaatactgaaacatttgagttccaagatgaagtgggagcacttttgttatctgtgtgccagactgtgagccaaggaattttgtgtttcttgccatcttacaagttattagaaaaattaaaagaacgttggctctctactggtttatggcataatctggagttggtgaagacagtcattgtagaaccacagggaggagaaaaaacaaattttgatgaattactgcaggtgtactatgacgcaatcaaatacaaaggagagaaagatggagctctcctggtagcagtttgtcgtggtaaagtgagtgagggtctggatttctcagatgacaatgcccgtgctgtcataacaataggaattccttttccaaatgtgaaagatctacaggttgaactaaaacgacaatacaatgaccaccattcaaaattgagaggtcttctacctggccgtcagtggtatgaaattcaagcatacagggccttaaaccaggcccttggtagatgtattagacacagaaatgattggggagctcttattctagtggatgatcgctttaggaataacccaagtcgctatatatctggactttctaaatgggtacggcagcagattcagcaccattcaacctttgaaagtgcactggaatccttggctgaattttccaaaaagcatcaaaaagttcttaatgtatccataaaggacagaaccaatatacaggacaatgagtctacacttgaagtgacctctttaaagtacagtacctcaccttatttactggaagcagcaagtcatctatcaccagaaaattttgtggaagatgaagcaaagatatgtgtccaggaactacagtgtcctaaaattattaccaaaaattcacctctaccaagtagcattatctccagaaaggagaaaaatgatccagtattcctggaagaagcagggaaagcagaaaaaattgtgatttccagatccacaagcccaactttcaacaaacaaacaaagagagttagctggtcaagctttaattctttgggacagtattttactggtaaaataccgaaggcaacacctgagctcgggtcatcagagaatagtgcctctagtcctccccgtttcaaaacagagaagatggaaagtaaaactgttttgcccttcactgataaatgtgaatcctcaaatctgacagtaaacacatcgtttggatcatgccctcaatcagaaaccattatttcatcattaaagattgatgccacccttactagaaaaaatcattctgaacatccgctctgttctgaagaagccctggatccagacattgaattgtctctagtaagtgaagaagataaacagtccacttcaaatagagattttgaaacagaagcagaagatgaatctatctattttacacctgaactttacgatcctgaagatacagatgaagaaaaaaatgacctagctgaaactgatagaggaaatagattggctaacaattcagattgcattttagctaaagacctttttgaaattagaactataaaagaagtagattcagccagagaagtgaaagctgaggattgcatagatacaaagttgaatggaattctgcatattgaagaaagtaaaattgatgacattgatggtaatgtaaaaacaacttggataaatgaactggaactgggaaaaactcatgaaatagaaataaagaactttaaaccatctccttccaaaaataaaggcatgtttcctggttttaagtaataatacttaactctcaagctaagtaaaaatatgtcatcatgcttatgttaaactctgttgtaagtaataatttgtaaattgaataagtggcatactttttaaaaaactattttatgttcagaaatgtaaatgttattattcttga

SEQ ID NO: 246 - protein, 1249 aa, Homo sapiens
MSSMWSEYTIGGVKIYFPYKAYPSQLAMMNSILRGLNSKQHCLLESPTGSGKSLALLCSALAWQQSLSGKPADEGVSEKAEVQLSCCCACHSKDFTNNDMNQGTSRHFNYPSTPPSERNGTSSTCQDSPEKTTLAAKLSAKKQASIYRDENDDFQVEKKRIRPLETTQQIRKRHCFGTEVHNLDAKVDSGKTVKLNSPLEKINSFSPQKPPGHCSRCCCSTKQGNSQESSNTIKKDHTGKSKIPKIYFGTRTHKQIAQITRELRRTAYSGVPMTILSSRDHTCVHPEVVGNFNRNEKCMELLDGKNGKSCYFYHGVHKISDQHTLQTFQGMCKAWDIEELVSLGKKLKACPYYTARELIQDADIIFCPYNYLLDAQIRESMDLNLKEQVVILDEAHNIEDCARESASYSVTEVQLRFARDELDSMVNNNIRKKDHEPLRAVCCSLINWLEANAEYLVERDYESACKIWSGNEMLLTLHKMGITTATFPILQGHFSAVLQKEEKISPIYGKEEAREVPVISASTQIMLKGLFMVLDYLFRQNSRFADDYKIAIQQTYSWTNQIDISDKNGLLVLPKNKKRSRQKTAVHVLNFWCLNPAVAFSDINGKVQTIVLTSGTLSPMKSFSSELGVTFTIQLEANHIIKNSQVWVGTIGSGPKGRNLCATFQNTETFEFQDEVGALLLSVCQTVSQGILCFLPSYKLLEKLKERWLSTGLWHNLELVKTVIVEPQGGEKTNFDELLQVYYDAIKYKGEKDGALLVAVCRGKVSEGLDFSDDNARAVITIGIPFPNVKDLQVELKRQYNDHHSKLRGLLPGRQWYEIQAYRALNQALGRCIRHRNDWGALILVDDRFRNNPSRYISGLSKWVRQQIQHHSTFESALESLAEFSKKHQKVLNVSIKDRTNIQDNESTLEVTSLKYSTSPYLLEAASHLSPENFVEDEAKICVQELQCPKIITKNSPLPSSIISRKEKNDPVFLEEAGKAEKIVISRSTSPTFNKQTKRVSWSSFNSLGQYFTGKIPKATPELGSSENSASSPPRFKTEKMESKTVLPFTDKCESSNLTVNTSFGSCPQSETIISSLKIDATLTRKNHSEHPLCSEEALDPDIELSLVSEEDKQSTSNRDFETEAEDESIYFTPELYDPEDTDEEKNDLAETDRGNRLANNSDCILAKDLFEIRTIKEVDSAREVKAEDCIDTKLNGILHIEESKIDDIDGNVKTTWINELELGKTHEIEIKNFKPSPSKNKGMFPGFK

SEQ ID NO: 247 - DNA, 203070 bp, Mus musculus
  misc_feature (1)...(203070): n = A,T,C or G
ttttttatttaatagtttgttggctttaacatagaatccttcagttactgttattataaaacacaggacagatttttaaaaataagccatattttatttatttacttatattttgttttttttgaaactgagtttctctgtgtaaccttggctgtcctggaactcgctgtgtagaccaggctggcctttgaagtcagaaatatgcctgcctctgcctcccaagcgcttggattaaaggcatgcgccaccactggcaggcttttattttgttttgattttcgttatcattttggttttgagtttatttttgaaacaggttattgttgtgtagctcaggaggctgtgggactcacagtgtagcccagactagcctgggactgatggtagttctggctcataccagacttgtaatcctcctgcctcagcctgttgaatgctgtcatcacatgaattcaccttatgtccttctgttcctctggtttgtttgcttgtttcattttattgtgttttttaaaccatcttattatgaaatgtctaaacaaacttaaaagagaaatgattatataatatactatatattgtcataccccagtctgacaattatcaagatttagtcatgtacgtttatttagagccttgtttttctttactaaagtattttgaatccaatgtaagcatcattttactgaagccctttaagtatccattctagaaaatacagatattttcttagcttcccatattgctatgattgtatctagcaaggttacccacaatgctttgctgtcacctaacgcatttcatattcatgttttccttaccactgaagtgtgtattttcccacagctagtttggttgagtcaggaatttagatcaatggttacacaccttgagtgccctgtaaccttcctgtgtttcttgcttcattgacttagagagactggcacacacatatagaatgaccctaattctgcaggatctctttgctttcttgtaatgacatcgagcttgtgcctgcatcctgttactcctggtgtatggatactatctctagtcttgacgaatccacagttcccccccagtgctgtaatgttggagtcaggcctgttctttgactgtgaaactgaacacttgagtgtcctccccaggttacagagccagcagttgtcagtgtttgggtacaagaattctaaccagcatcctggcaaggtagagaatgctaaggaagtactgtgagacagtaatctaaatatacttcttaagcaccttaatcacgatgtcactgtgccaggaaaataacttgtagattctctttatgaagcaaagtcgacccagcaggatttcagtctaagatacagatacagatcccagcagataaatagttcttttgtgccctgtccaacacagcaacaccagatcaggatttgctctgtatcccactggctcccattcgccctatatgtcaagactacattcgttggcttgccacgcaaaacctaactcgaatggggaaaatgtaagatctccattgtatgcaaccaacttaagagttcaaattgatcagtacactctgatgatctcatccactcagatcctttgttgtgacattgaatgatctcacattgacaaatagaaaataaccacaaattttcagttgatggtgcgagggacattgccaagcgcttataataacaacaaaatggtgcatggggtccgttatcccattgctcatgaggcagaggcaggcggatttctgagttagaggccagcctggtctacagagtgagttccaggacagccaaggctaaacggagaaaccctgtcttgaaaaaaacaaaaacaaaaacaaagcaaacacataaacaaacaaagaagacaagacagacctgtgttaggacactctggccactgggtgatggcaaagcctgcacatatgcagggatggatagtgggaagatggtgaagagatgtggtgagggaagatgctctgcagatcccacacgtgccttagtgctgttctctcagcctgagagacctttcctatccatctgtttctcctctgacccgggccacacacccactgtctgtaccatctgccttctggtaacccagagcagagactatgctggcacaaggtttgggagacacagacactaacatattatatgtattttttcagtgttgaatgttaaaatgagtcttgaggtcacagccaagaataccagacttcctcctgtggctgtaggcactataagggagtggagttgtacctggaaaggttgaggtattggtgaagatttcctctgtagaaaggataggatatagatctttattaactcattagttcaagagaaggtgagtgttaattactaagtttttattatggaagttttaaaaagtgactccactttaatataatatatttggatatatgtgtgtgtgtgtgtgtgtgtgtgtgtgtgtgtgtataccatgtgtgtgcctgcccttggagaccaggcaggtagcattggatcccctggaactggaattacagatgattgtgagttgccatgtgtttgctgggaattgaaccccagtcttctagaagataagctgtctattaatgatatgccgcctctccaccccagcctttctagcagagtctggcccaggcaaaagccaggcataatgacagacacctgtaaccctagcatctgaagtggaagcaagagaatcaggggttcaaggccagtcagggctatgaggctagcctggactatatgtgacttatgtggtggtggtggggaaggcgagaacaaattgggaaagagcacctgaaagagccttttgtcggttctcctggagagaagggggaagttgaaaatcaggattatcctgcctcttacaggttatttgatctccttagggcaagaagggaccttgaaatgtcactgtaacctcagcttcctttgctggcaggtcttggcagacattctttcaggctctggtgacagtgcctactttgaaaatcagggagaagtctgtgtaattgcatcttagcaggtgacagacagctagaagagaagccacagaggtgttgcggtcattttcctcagataagatcctggagggacggcagagagaggaggccggggcagaggcttggtgctgactttcctggattgtactccctgcctttcccccttgttctcggagtgaccgacagcaggagcggttttataaggacacaggtggaaggagctgcgtgtcctcagggtatcccgggagagtcatgtctgttgtcacattctgaggtgtgccattggtcaggctagattcctgcatacctagttctcagtgcatagtggcccaagaggccatgcagcctggcaaagcggtccccatagccgaaagacaaatgaggctgtctatagaaactgccttacaccctaagtcagtaagaaacctcatccccaaaatcactttttttttcttttttttaattttatcatcttctgacgtcccagccctgctcatgccagagcagaccccacgttagcaaacttgccgtgttcacttttatcacaagcagcagatggtactgaagttatggtgggtcctgttggtctggggttgggtttttaccaggaccacctcttatgtcccctaacacaggaatggttgctctgtaatatatagcatctacaggcacacttaatcgtactttgtgaatatgatgagcccaggtcctctggagcatcagcgtgggttctggattagattgagccagactagaggtccccccaacacactgccgcctggaagttaaaataataatgtgatggtcagcaggtgggagtgtatggttattaattaaaatatagactttaatatatcagcgtatgctaggtgtgtgcgtctatctatctctgtgtatgtgtgtgtggtgaaggaggagaaagtagaggagggggaagaagagaagggagattactaataggcttgtgatcctcctgcctcagtatcccaagtgctagcactctagccatgcatcatcagacccaactttggacttcagcttttgcaagcaattggcatagctgagaacgcaactggctatctctaaatttagggtttggtctgataaatacgggttgattttaaaggacaaggtgtgagaatcctgtctgctaatcatataagtaataaatactattacgctagagactgagactggtgaccagataaggccactatggaggccggagagatgcctcagaagctaagagcactggctgctcttgcagagactaggctccagatcctcagcccccttcaaggtggctcccaactgtctgtgacttcagttttaggggctccgatgtcctcttctgacttccacctgcacctgcacatacatatcaatacataaaaataaacatgaaattgtttcaagaagagaagaaagcaaaagttatattgagtgttcttactacactagaatgaaaattgttcagtgatgtggaagcttctagaatgttcatgcagctcccaagagctcccgagggctctgctctgtgaccttagccgagtccacttccttctctggacctttctgatcttatttgcactaaggagactgttgccttctaggatcacggtaaggagtaagcatttctggcatccaaggggtctcttgtggacccctaagcatgcaggaacagtatttagatggctgggaagctaagagtagaggaaagtattgattccgtaagtcttgggtcctctgcaggaactaactgccagtgttcttactctacctgactccccaagcttctgctcctttggagaagttgcagtacctttcaactgtctgtttctgaagctccctcatgagtacaacagtggaccacttattagtgccctcacaccgttcatgtggcacattctccacttgtattttatgtgatgatcctgcaatgctagtaaacaaagtgagccttagggaacaacaagacttggggttgaagggagtcttcgctctgaggaacaatctctggcacctgaaagtgaacaaggcgccgagaaccaacagaaagaagacatttggggctggaaagatggctcagtagttaagagcactgactgctcttccagaggtcctgagttcaatttcgagccatcacatggtaatctgtaatgggatctgatttccctcttctgatgtgtgtctgaagaaagcaacggtgtactctgtccgtgtgttctgtccatccttgcaactggatggaaaaccagggggactggccctcttttcagagtcatctcctttgtgattcaaggaagaggcaccctgtacttgttggccattcgacttctatccttcacaggctgctacaggccccatttcctctgaaatgggtgcacagattcagggcagtgcacagggatggaatggaagagcagatcctgatggccaagtgtgtctggactttcttaggcacacatacaaacatgcctggcttccacccctgtctcagcatctcaggctgcctcttgtcaagcctagaaagaggcttctggccacaggggcttcgcttcagtttctctttctattttgaacttgttgtcatctgattgtgtgtgtgtgtgtctgtgtgtctgtgtgtgtgtgtgtgtatgtttgtgtatctgtgtgtctggctgtgtatctgtgtatgtttgtgtatctgtgtgtctgtctgtctgtctgtgtgtgtatgtgtgtctatgtgtaggtctatgtttctgtgtgtgtgtatgtgtctgtatatctgtgtttgtgtatgtctgtctatatctatgtgtatctgtgcctatgtgtgtgtttgtgtttctgtgtgtgtttgtgtgtatgtttgtgtatctgtttgtctctctgtgtatgattaatctgttttgtcagaaagtaggcagtacaacaaggaagaaacagtggccctcttcaccagcagttcccagtacctagaccagagcctgaagcctggatgcccactgagcacctactgtccgggattgagtgaggagtaagtgcttgtgtccagtgagaaacagaattacttatggaaaaatctgaccaaggactgggccatttgcccgccattccgctgtgctctcagcttctggaggtcacacaggaggacagcgaggctgcctttcccttcttcccagcatcatcatagctgtagctgagttactgatcgatcgtagagggctgcttgcattggtcctaggaatgctggcaaagcaagcaggaagatagatccaaagtaatcctcagctacagggagaacttgaggctatcctgggctacacatggtgcctggaaaagctgaggagaggagagggcacaagagaagattgtagcgaagttagaaactcaacaacagagcttttctttcacttcccttttcttctttctttttggacagatgaaattagtgatgtgtggttttaaagcaagcaaatgccccggggaaggaagggctgatgattttttctatggtgtgattagataaagggcggtctttctgttgttattcttgagggtgttttgctttcggtttatttgttgttgtctgagataggatgttctatagcctgggctagcctcaaacttcttctcttcctgcttccccttcctaagtgttgggattacagttgtgtaccaccaggctcacacaagggaggagctggcatcgattttgatgaccaagctgtgcaaacttctgatcctcaaatgcgtagcttccctgtggggaaggcttcactaaaagccttgtggcgattcttcctgagaatgatagcgacggaggctggtgcttgttttgaaattgacgatggtgagataaagaaggctttctgaaaccaaggaacagatccggctcaaaggccctcacccatgacctttactgtgccaccatctctctaggctggactgtgcaaacccagagccatcgttgaagcggagactgcttccccttcactctctgcttctactcgggggtacttggcttgatacgtgggtggactctccacacagagacatcagattggaagtacagaaggatgctctttttaaagacagctgtgggtgggtactttgggcttatcaatggagaggctggtaaagcaggcaggtattctggtgccaggatcacagctatctgtgaccttgccaggggtgtgccaagggtcattgtcctgaacagctcctcactatcattatgggttcagcctcaggatcttgtgatctcgggatcttatgtcatcacagttaccgctggtctctagaaatgcattcagccctgagagacaccaggataataaagcattgtttcccaaggaaggttttaggttgacattcagttctctggctctgaagtgtggtgaccttgatacagtaggaagatagtgcagattcgatgtccctctgagctgggacagtgccctacttccacaagatgtctgtgagcactggagaccaggcagacatgagcaacagtgacctccatcagccgacttggattatttgctgtagaataagcactctcgataagctgggctttcagtccacattttacccctgttctaagctcacctgatcttagtttcttcgcaggataattgacacctgattagtacttggctggtagatgctagaattttttttttcctcttagaaaatcacggttctcttagccggtcatggtgacagattgctgtgatcccagcttttagagaagctaagacaggaggattggctctgagtttgaggccagactcaaactatagaggccaggtctatagagtggggctctttttaaagaggtaaagcaaagcaaaacaaaaagaaataggcgctcaacttgttggcctggctggccttgaactctagactcaaatgagcctccagcctcagcctggccagtatctggagctataggattatctcaaatattctatactcagaattctacatggcaaaattccattaaaaacagatagatttgcattcacatacgaaattattttcagcaactatctgcttaaaatatgtttccattaaattgggttcttcttacacgcgttcacgcgaccggccaggaagaacacagcaaaccagaatcttctgcggcaaaactttattgcttacatcttcaggagcaagaagcaagagccagagcaagagagcaaaggagagaatggcgaaaccccgtccctttttaaggagaattattctccgcctaggacgtattactccctgattggctgcagcccatcggccgagttgtcgtcacggggaaggcagagcacatggggtggagaactacccttggcacatgcgcagattatttgtttaccacttagaacacaggatgtcagcgccatcttgtaacggcgaatgtgagggcggcttcctacaggttctgtgtggagaccacccccccccccaattccaggagccttgatggctacccctgctgggaatcagtacaaatatgactctacattttgtaaaaatcaaaacaggaattgtaacttggcccagtggtggtgaggatcaaaaattcaatccacaccttggatgtcatcaatacagcccctgtccctctttgatatggtttctttgagaactccaagtgtctcgcagtgtgtcctgaacatgttcgctcttccaattcttcccagattgtccttcttcccatccactcaactctgaatcccgtcctccaaaacaaaataaaactcttcaagaccaacttgtgctgcccaaaatgttctttgatgtgcggtttccactggagcatggctgacttgccagaggttgtgctcttcaaggaaacaggatcttttctttcccagagccctttctcagcagtggggtttggtcgagtgtgggcttgcacaggtcttgtgcttgcatgctgttagagccactgtgaattattcgtgcaaatggccagctgcctccatataacactccatataacactgccactggttcttacactccggtccctgagccttggtggggaggcgggtagtccctttacagctgagcattctgtagtctgatggccagttgtgagtctctgtgttaactaccatctactgtgtcttagttagggttttattgctgtgaatagacaccatgaccaaggcaactcttctaaagaaaataattaattggggctggcttacagattcagaggttcagtccattatcatcatggtgggaagcatggcaacatccaggcaaacatggtgctggaagagctgagagttctacatgttgatctgaaggcaaccaggagagtgctgagtgctgcatggctctgacaagtgtatgcagagaggggcatagaaagacaggcaggacctccttcccttgctcttactgaagaccaagctggccttgaactcacctgcattacccaggctggccttgtactcacagagattctcctgcctcagcctcccagagctaggactgcaagcatgggctgctgagacctttctttctagcagtacatccgtttgagagcagcaaccagctgagtttttgaaaattggctcttagagatttgtggaagcaatgagccaagagtttcttcacttatgaaacagaaaacagggagcctgccattaaaaactagacaagaaatcacttttctgacacttcttaatctacttgcctaggttatttaaaaagaagccccaaacatcttaaatgttatacaattaatccgctatatccatgtgataaagacttttggaatggtgtatttgattgtaataaaaacaccacatgatcaaaatatttaaattctaacagcatttctagagaatatgagcaggctatgatttgaagcagacctttttatgattcagtcttacattgatgatttactaacatataccgtctgaatatttatgactttttttttctgccattaaaatctactctgtttttcagcttctccagttggcaacggttacatcaaacctccagtcccacctgcttctggcacgcacagggagaaaggaccaccggccatgttgccgatcaatgtggacccagacagcaagccaggagagtatgtcctcaagagtttgtttgtgaacttcaccactcaggccgagcgtaagattcgaatcatcatggcagagcctttggtgagtacagaccccatctctgatccgaacatgactggtactctaggtccatgggtccctggtctattcacccaaccaagctcaaatcaaaacatggagagcaggggtagcaggggggggggggtgatgtactgcatatactgaacaggatgtgagtccagaaaaaatatggtatcatagcaactaaccctcagtatttacactgtagtggttgttataaggcacctagcaatgattttaaattgctcagaaggatatacataaatgatatgcaaacaatgttatcttggtttggtttcccattgtgatagacactatgaccaaaggcaacttgggaaggcaaggatttattttatcttacagctcagtccatcattggttgaagttacaactggacttaaaagcaggaacacagaaacaggaactgaagcagaggacatggaggattgatacttatttgttcagcctgctttcaaatatagctataagtcatgtacatactgtagacatttagataggtaggtaggtagatatacagacagacagacagacaatagacagacagaaagatagatagacagatatagacatagataaatattcattgcttggagtactgtgaccctctatttgggagactatgtggcattcttttatgagaccaagacccagggtgcttcccttaaggtcagaagagagttggtgggaaggacccatgtttgttcaaaagcaaacatctttaggtaatgaaggggctggtatcctcaaagctacatctggagaaactcgggagagccaagagcttgtgacatggaaagcaaagcactgtgggtaatatggctacacactgagcagggtcttctggggcatgtgttttgtttttactttcttctgtagttagaatgtcacagacttgacctcctggagctatttgtttgtttggtttttttttccccaaacaggaatattactttctttcaggctaaccctcacagaaacatacatgcttccgttcattgatgtgtagagccaaagactaaggaaagctctttcgtgtcctaaaaatcattaggcactgtagttctaaaatctgaagaaaggttatttagcagttgacattgattttttttctttttcttttttttctttaacactctctttgggttttgttgttgttttgagacagtgtctcagaccggatttgtagcaagcctgccttgaactcatgtctccatctctgctcatgtactgtcattatgatgcatcatcatgccctgctctgtttaatacattggtcaatgtggtgttatttctatttcacatatagattgatggatgaaaggcatgggatataatcctatctaaagccttagggagagaagagaaccttgcagaaggagaaacagaagaaggaaaaagtaattctgatgatacccaagggagagtgtggctgctactgtaactgttcaatagacggtgaacaatagaacctgcaccatggcacattaaagtttaaaattctatagatgacttttcagtacccagagatctatccttagtggaggaaaaatgatggacagtaagaatgtcctacaaaaatcagatttcagttttcatcaatatttttataaacatctttcagttgttcagcagtatttctatttgtacccaaaagatgctcaagtcagagtcattgatattgatggaaaagtcaataattttatcctattttctaatgcttcgtggggacatttaattgcctatgttcttattcattgttatcttggtttgtctttcttgtgcgctaagcaagctaagtgaggtcatctttgtcatttttatatttttatcttatagcataaaagtcaaagggaaggctcgtgtttctcagctcagtgtccccactcagtctctggtgatagttcagctgggtatagaattctgggtgtaactcatttgtcctatagatcttgagactagatctttgaagctctgtttcactcagttgcctctgtggtttctcttgaaaattctcttgttttattcctttgtagaagatttactttttctctgtttgcttttatggttttctctttggctttggaactctgcttttattactctgcatttgcatgtgaacttcttattatttttgtgtttgagacttaagctttttaagtcagacttatatcattcattcattcaccaactctggaaaatacttgactattcagtatctgaatatcaccttttatcctttttactcattcacagtactaattaattaattagttagttaaattttttttttgagacagtgtttctctgtatagccctgactgtcctagaacttactctgtagaacaggctggcctcgatcttaagagatccgcctgcctctgcctcccaagtgctgggattaaaggtgtgtgccaccactgcccagctcctcatacacatgtttttattgtttctgtgtgttatatcactcatcctttccctgttcttcttccattgctaactcttcatctcaaatgcttactgagtaatttcctcagacctacactttagttcattagtgttcaagagaacttgggctttatctgatatgttaattaatcctcctaagcagaattttgatttcagcaattgcatttttaatccttagaagctctgtttatttctcctttaatatctatttaaaggtttctgggggctttgctgtattttgttccttacagtcccaggtttcttttatgcattcactcaccttaactgagtgttttctgtcctcctataagtgagtgtgctgtaataccaactttcaaaggaccgtgtttgtgtttgttatgcctggtaacttttgccaataaggaattgtcctcactgttttggaggtgagtttatataaggtcttgtctttccattgtcccaccactgggggctcaaggcttcctttgttatctttctggagacagcagaaatgctgccaggatcttgagacaaagagccctcccacaggcagccagatgccatctcatcccttgccctttgtgtgtctcctcagatcagctctgaggtttagaaatcatgtattccactcagcctttccagatgttgcacaggagctctgtggtccttttcgttcagttttctgtctttggcatttgtggaattttcagtttgctccctaggctgatgaaagtcagagtaaatgcctgcatgtacaaacaggggtgcctagagtggggcagcatgtccccaaggtggacatagtggagagagacagggacgatatctctctttcctcccatcctgtctgatgaatcttcctaggtgtacctttgtctcttttatcttgtttgaaaccctcatttcatattcttctatctcttgatttggccacaatctatcttacctgtaccatgcacctgggtaaacccatttcttgctggccacgtgcagtgatgaatattctgcctcatgtaattcttagcttctcttcctgcccatccatcactgactcttgctgtctctcactcttgctcttcttttttctcgctccacctctctctctctctctctctctctctctctctctctcacacacacacacacacacacacacacactccatgtatacactttattagaactaccatcttatcctctcagacaagatattgtcctcactgaaatagaacaattcagtggagtagaataaagaatattacagttttttaagagtggaagttgttttgtgtggcttttgtttctgtatgttcatatcagaccgtagtatgaactgtattttcatgggggttgacttttggttgcaggaacttacttccataccatgtctttctgctcaatgccatgctttgggccacgacaattataaaccttcataagagttgcctttataaaagttgccttggtcatggtgtctcttcaaagtagtgaaacctcaacaaagactgaggttaacaaataaaagttcacaacagaagaccaggctaccctctcattgtgtttccaacaagtacgtaggttaccatggatgctttctgtttgtaagagaacatcccgtcaaaaaaaaagagtctattcaggcttgtggatctagagagaacatggcagcaggcagtaagtcaggaacctgatagaatatctcatcaaccacaaacataaagctgagagagagtgaactggaggtggggcggggctataaactgccaaagcccacccacttccaacagcaaggctgcaactcctaaatgtttcataaccttcaaaaacagcaccacctactggggaccgagtgttcaaacccacaaccctgtggagaacggttctcatttgaaccaccacaaaggtaaatgttgaggaccacagcagtgtataaccaggatacgaagtccaacagtgatggttttcagagacaaactgtcataaagacccgaggctagcagagacagcaagaaacagcataccgccatgccatactaagaagccaggcagcgcaccatgggaaagaatgggtcattcagaatttcaaaaaattttctgtcttcccaggatggttcttttgtctgacccctctcctatagtctggcttaggttcaagaaacttacttttctatcacaaaactgctggtgatccatgcttcaggtaatcagtcagatcccagcattgtctactgtaaggtcagaatagtcctgttaagcacagtcatagtcctaatatgtgcaaggaatgattgggggcttaggcaaatgcctgagcctagaacatccaacaggaaggagaaatctcaactcacttgacagaagaatttgagttttgtttttttggagactttggagtctctgaaaaggcaaatatccacatgatttcaaaagcagctggcctatgtagttttcatcttgccctttagcaaagaccaagatggagggagagagccacgttgcaagtattttcaggatgaaagatcttgtggaggtgggggtttgcctgagccacatgatagacactggctcagacctgggcggggtctttcagatactggccctgtgcccagttggaagctcaggtatggactggtgggagctgtaataattcattaaaatgttaactgtgttaccataaagctggattagaggcttttaaaaaaaaaccacagcgagacctagctggtttgctaacctccaaagaaataaacaagactgaacataaactagaagtaacacagactgttttcttaaagtaggagatcatggaagaatccagcatgccaaactattgcaccagccagtgtgtacaaggaaggatgctgtgctgtaagaccaaacctgtatgaactatggtcctgaccagctggcttattgtaggccaagcagttagctaatgatggcattatagcatgctaaagttccaggtgctggaagaagggtttatgacaaaccagagtccattacagatggttgtgagctactgtatggttgctgggaattgaactcggggtctcaggaagagcagccagtgctcttaactgctgagccatctctctagcctgagggacaggatttttacatgccagatcctaatgcagtctgttgtattcaaagcttcatgaccctggtaggtgtcaagataggcaaggctgaaggagggcgattctcttgtaccattgtacctggccatccttctgtgctaagaaagcattttgtgtttgttggctggggatgtgtaaacagcagagatagagccttcagatctctgcacagtgctttcaaatctacttcccttccttttgaccaaaaccctctttaatctgaggctgctgctgctttaatgtgtctgataaaagttcacagagaataacatggattgagcttcctgccaagggctgggatgaagaccggagtcatactgttcagaaaagagactggaggatgggtggctagtcatatacagggaatacttacaccatgcttgacaaggaattgccttatttttcaggtatagttaaaccagtcatttctgaactagttgcttggtagtgaggcagctttggctggcactgccttccttaatctcacaagccattcccaggaaacctgtagaccagcagttctcaacctgtggggttgtgatgccgctgggatgctgggggagggtgtgtgtgtctcatatcaggtgtcctgtatatcaggcatttacactatgactcataacagtagcaaaacttacagttatgaagtaacaacgaaaataattttatagttggagggtccacacaacctgaggaatcagtgttaaaagaccgcagcattaggaagattgagaaccacttctgtagcgcgccgtagctcagaaccacagaattggcagtggctaacagcagaggcaacagttgaggaagccctgagattgggattcctccgagcagctgattgagacactttcccagctgagtgtgcagagttgcttttctctgcgtgtggctaaccctgaatgaagtgcgttttcatgcttggaatcaagcaggtgaaaaccatctcttccatggctcctaagtaaggcttctcatctgtgaaatggaatggaatgccccccaccatggcccagttgaaacttatagcaaataaaccatgtgaaaagtatcttgaaataggaaaaaaaaaaaaaagatcaaagggctttgtgttccaatttagtagtattcagttcatgcatgggtggggctataatttattttaacattcttattgatttcttgaaattttcatacatgtgtacagtgtatgttcatcatagccaccccatgtctccagcttccaccaggaccccctaccccctccaaatttcatgtccttttttctaatccactgggttgaactagtgttgcgcatacacacatgggtgtctgtatcaattaccagtggccactcctcccaaagaaaacagttgcctctgtgccaagaaagcatcaaatgagtgtgtgtctgtgtgtctgtatgtgtgtacacacacacacctatgatatctctattctacatatggaagaagtcatacaaagtgatgctatccaactctgtttacttttgtgcacgtaacacatccccttgcatctttataattaatgtaaatagtaaaaccccactgtctatatctgccaggttttctttattgtcctctgttgatgtgcttaatcctggcccatgccctggctgctgtaaacagggtcacatcagctcatgtgtgtaggagtttctgctgtatggtggcctagattccttcaagtatctacctgggagcaatatacatgaaacacaggcatgctaattctatttttagccttttgaagagcccccatactgtttttcctctgtggctgctctattctacagcggatgggggctcctcgtccccaccgcatcgggaccagaaggttctcttcttgatgacaaccaggctgccagggaggacatggaatttcaatgttcttttgatttgatttttttttcccatttctactgggtctttgccgcctctaccttcttttgggaactgacgggaacatcatttttttttaacacaagtaagagatcatacgaaagtgttttgtattttgtagggacaaaaaggtactaatatgaatccattcaagggccagcaagatggctcagcaggtagaggtgcttgccagcaagtctggaaacaggatccagtctccagattctatctgatagaaggagagaagctcctctctcagcttgtcatctgaccttcaaaggtcgtggcgtgagcacacacacacacacacacacacacacacacacacacacacacacaaataaatataaaaggtattttattaaatattttacttattattcacacatgcatagaatatttggatcttatccactttctggtccctcccttcagttcttcccctattctccccaccatttctccctcccaacttcaagggccccttttctcgttttttcaatctaatacccactgagtctgtttaatgatgtctatatgcatgtgtgtatgagcccaacttctggagcatgggcagcctgccgggttcacatccctgaagaaagctgaccagacctctccctgggttgacaacagccaatagctcctcagattctggtgggagctcataagccctcccccatacatgttgtgatttttgactggtttgatcttgttcatgttttgtagacatagtctcggtcattgtgagttcatatgttcaatggccccagtccattcagcaaatactatttcaacatgttatcactccctgtggctcttacagtctttctgtcttctaggatattccaggccatgacagggagggatatgatacaaaactattcacaatcattcagttgtaggaattagcggtgtcattgggtggcagagaatttgccttgcacgcacaagaccctgggttttaacctcagcagcaaaataaataaacagataaacaaataagtgaatgcacaatactagtggagtcttgagtgaccgccttttgaggtagcacggctgtgtttccacagagcactttaaattttcacatttctaaggtcatcagtatagtttgggcagtagagatgtttgctatggcttggtagcaactttaatgtgcacaaatcttaatatcaactagtcagtcgatcagttatccgactcttgctattagatatcttattggtatctattcatacgtacatctcttgccacactattctctcctccatgatgtccctgatacctttggggatttctttctactcaagtcctaggttgaatagaggtaagcatggatatgccaggagattttcccaagatgcttcagtactacagagtatgaatagtttagaggcagattatcctatgaaggccatggagaaaaatgagagctggctggggtgggaggtaattcgcgtggaaagaaagggacggtagaggacatctcattgcaactggaggccaagagagagagagagtactgaaaataatggccaccattttggagattcccggggcctctggggatgacatttttctgtgataagagaaaatccagatcacatgcctgccagtggtggcgtatgccttgagtgccagtacttgggaggcagaggcagagaggcagagaggtaaagaggagaggcagagaggcaaagaggagaggcagagaggcagagaggcagagaggcagagaggcagagaggtagagaggcagaggcagagaggcagtgaggcagtgaggcagtgaggcagaggcagagaggcagaggcagaggcagaggcagagaggcagaggcagaggcagagaggcagaggcagaggcagatctctggtaatttgaggccagtctggtttacaaagagatagccagggctatacaaagagaaaccctaggtcaaaccaaagatagaaggcaggggagcagagaagagaaaacagaagtgcaggccactcgctgggaaacagaagagtggcagaggtgaccagaaagagagcaagtatggtgctggtcagctggtcaggatggggcaagttggggagatgaccctagaggctgtgaagagctgctgtgtggagcaaggacctgaagggagacacagagatccagccagacgaactggaagtctggttcttaaacgaagcgaggccgtagagcagtaagttttggagcaataaaagtagcagtcaccaacaaaagagactataattcagaagtaaatgagtgaaggtcatagctcatgtttcgtggtggatattgtagaaggagaaaggtgtctgggagccattttcttcttcaattaaagcaaagattaactttgtagccaaatttaattgaagtctcccctccactgttcagataatggatttggtcttggaactgttaaatttgacagagaaataggctcctctgacatgagcagagccagccacaaataggacagattgcctcaagaggtttcattttcaaaaaatgagtacccagatagacctaagggctttgagtctcccatcatgtctcacggtgcgtgcacatgcacatacacccacacaccaccactaccaccaccaccagcagcagatagaaacctgcctgcctgtatctttgacttctttgagacagccagtatcattgtcttgatcttgaattatttttcccaaagctttgggtaaaaatcagtgtatgttttacttacagaaactcagatgcgtccacctccgcaagcacagtccctataaatctgaggattctaactagttctgggtagtcactactaggacgtgctcagggtgtcccaggacgacactgtcacccgtggacaaacaggcatgcagctgatctgtgtagtagccagtccatacaccaatgcctcatcaggacagttcctagcctcaggtgtctgccccccccccagtccccccacacaggaggagttgcttggggtgaaaggttattgttattcagagcatgtttttaaagtcaagtcagagctaccactagtaagataggaagagaaaaatgtcttgtgcccgcctttcttcagttcaggctgaaagagcattcctgctgctgcgggaaccccatgatctgggctaaatgcttcagagggtgacaacaattgggtccccagacctccactcagaaagatactgtggccatggtgatgggatatcacaccactcacaatcctcctctgtctagtgaagatggggggaagccgatctgagttctgacatttttgccaactcacatataatgtgtgatataaatttatataatgtgaattttccacaaaacatgttcttataagcaatcgttcaagtcttgagacttacaaagtctggccgttagttgaagtgttacttcggttgttttaataatcacccccaaaagcttcctctaaattaacaatcaagattagtgtcttggggctggagacggctcacagttaggaagcactctgcttttcagaggatctgggttcagttctcagcatccatatggtgcttacagctgtctgtaactccagttccagggaattcaatatcctcttcaggcctccacaggtattgcacacacatggtacacagacatacacacaggcgaacagtcacactaataaagtaaaaaaatgagtaaatctatattaaaaatattaaagtttttctagtaatgtgggctttttgtttttcttaagaaacatttatactttataatacacctccacactatttttttttataatagaactttctggttacatatagaacatatatagaacatatatagaacataggaagttgaagttaaaaatcttaatatctgtaggagtgtgtatgatcccaagagagcatgtgggatttggttttagctcctagacattatccaggaggacacgggtccatcttaacatagaaatttctctttaaaaagtatttatttgttttatttaagagtgcattgtagctgtcttcagatacaccagaagagggtgtcagatcccattacagatggttgtgagccaccatgtggttgctgggaattgaactcagggcctctggaagagcagtcagtgctcttaaccgctgatccatctctccagccctaagaaatttctgaaagactgtgacggccatgctcacaggccactaagaggatgatactcaatgctctataccacacatcttcccaatgctgtggctggatttctttccctctccatagtaaccatattttagtgaggataagaggctcccaggctatccaggaggctgggggtcccccatcctgtgtcctcacacattgctccacccactactgtcatacccaaggcttactaggatggtcctgagctgggggaatgacacattcaacagtctgagtatctattctatgagccccatgcctctgctggcttaaacatgtcgatgggtatgactccacagacattgttataacttgagttgcctagcttctgaagtctagcctgtgtgggccccagttggaatttgggggacccactaagaagctaaaagtgggaagtgatgtatttaatgtgcttcttgaattcctaggataaacttgcctctgagcaataggcctctagagacttgtagctgtgatctggcctgtnnnnnnnnnnnnnnnnnnnnctcctcctcctcctcctcctcctcctcttcctcctcctcctcctattcttcttcttcttcttcttgtttttgtttttgttttaagacagggtttctctgtatagccctggctgtcctggaactcactttgtagaccaggctggcctcgaactcagaaatccacctgcctctgcctcccaagtgctgggattaaaggtgtgcgccaccaccacccggcttcacccttcttaggcattacagagcacttggtgtgaaaagacggttgtagccagaacacactgaaattatttgaaattaggatggacatctgtggcttcattctgccctattagatagtttcggacactgagcttttataggtgtgttttgtttaagcaggggtaatgggtggggggggggatgaaaattccataacatagctaataaggtgcataaggaagggcacgccaggcagggagtgacctcaataccctactgttagtggaaggaaccaggagttgggcaggtctacaacagctccatcagaaggccagctgctgaaatgggtttagagaatggctgataccatccaaagtggagcagtgtatgatttaaactaaacaaaagaagaagtggtcatgtcatggctgtattttagttgtttaattatgaagaattcaagcatacattgtgaggacagggtatctatcatctctggccacatggtcatttttaaacacacatgactgtttagatgcaactctctgaacttaggttcacagagatttgatccaggagccttttaaacctgcaaataccaactcacagatacccaaggcccttgtgtaaatgatgtagttttggcacaggagatgcacaatcttccatatactttttattattttgtttggtgacaggctcctactacataacccagtttggccttgggctctttctcttttttagaatatttctctttttcctttaatatttatatatgtataacatatcttaatcatacctgtctcaactttctacttctcccaggcccccatcacatccctttccatttccctaagacccacccctcaacaaacacatccaccactcattccccaagcccctcaacactcacccttccattctacaagaaccccaaacacatccgccctcatgcctcagacccttgacacatcttcatgccctctgctttcaggaccccaggatactgatagatccatactgacgtaaaagatgatatctgtaatgttgaaatgtcaagtagatttctctttcccaaagccatcttccaggtgcacagggacatagtcactcctgtagcaccccaccctcagtagtgaattctgtgggtcaagggtggggaagtcagacatatgatgaaatggagggtctgctgaccaaagcaggtgccaacaaaatgctttgtttgaaagaacaggtaatgttaatcccgcctacctaggattccagagtatggctccaaattacattaatcagaggcttataaaggcaaaagccacaaggctacgtgcttcccaccttcatccaatcagggacaagcttacattctgacatacttcctacctatatacctcccacctacatgtgctcaagtgcatcctgtgatgttggggcagccaggcttgtttacagacgtgcgatcatgaagcatgttacctcacacaagcagcagcttacaagttagagttacttttgttttaaagatctcttaagcacaactttagccatcacagcaacagacagggaaaagggggggatggggactataatttggaaagtgatatttaatccaagtcttcaaagaaaatgattaagacagcatatttgagtaaatatagataaggaaggaaacttagtatgttaatttctgaggcttcaagcccacattcttagctcatagacctgactattgtatgtgacaataactttatcagcttgagctgtttgcaaaatgttgcctcctttctgtgtgtatgcagctgaatcctcttttgagaaggagtgagaaggtaatcccactgtaggtgtggcctgtgacatgtaacatcatttgctttgggttgacctattgagatgggctgtcattgtgtagccctggctggtctgaaatttgaatataaaccagactggttgggaactcatagagatctgcctgcctctgccacacctggcacatgtatatacatatactaagaccataaatatatatatggtcttagggttatactgctgtgaacagacaccatgaccaaggcaactcgtataaggacaacatttaattggggctggcttacaggttcagaggttcagtccattatcatcaaggcaggagcatggcagcatccaggcagacatagtgctggaagagctgagagttccatcaattattctgaagacagctagactgacttccaggcagctaggaagagatctcatcttaaagcccaaacctacagtaacacacttcctccaacaaggccacacctccaaatactgccactccctaggccaagcatattcaaactactacatatattaatattaatatatacattttaagttttagctcacacatgcacacacagagtggagggtctcatgtctaacactgcaccaagtcctcctgctctactccagaacctttcattattgaaacagatagaggttgctgcccatctggagcctctgacaagtaggagcttcattcattcatgcatgcacctcagtgtaaagtggctttgcaccatgggatgtgctgtgaaaaggaagaataatggggctgtgcaggcttggaagctgggacacagagctggtgttggaggctggctccggacatctccctggggagtgatggcggagctgtgggcagtgataacgcagaggggaccactgaccgaatttctccccaagtgacaggaaccacgtggtgcccagccctccacccagcctgtaggttgggcaccaagtgagccctcactcctggatgaagagagaaaattcccatcaggaatactcacccacagttgctccaaggatgtctgaggacctgacagccacctcatttcaaatgattgatgtcagtgtttgcattttagctggatttacaaagaactgcagaaaggctccctggccaataagaacacagaatagtcctcaaaagagagggggcctttaattcctaagtctcccaggggagacctcaaagaaaggttaaggtcagactagcaaaggaatactttttaacttagttaaaaaccagcaccccctcgttgtatgtaggaaaaaaaaatgaatgagaaaattataatagtaaagatgtttctcttacagtgtttcaagcctacataattactttcattttttttttcctgtaggaaaagccattgacgaagtctctgcagcgtggagaagacccccagtttgatcaggtatgaggctgttgctgtgcacgttgtgtgtttttctatttatatcaaaatggacataacaggagctggggttgtagtacagtggcagagggcttgcctcgtgcgagcaaggccctggtgtttgacatggcttagggtggtgaggaggagctacatggaacgtcagatacagacagggaggcagagatggccactctgaggctccctcaaagccataggcgtgtggttttaatgttacgcccttggggcaggagagatagttcagaggttaagaggggacccatgcctggtttccagcacttaccagttccaggggaaccaaccacgttttctggccttggcagtcacagtatgcacgtggtgcacacacatgcatcaagcaaaacatacacataaaataaaagcaaaataaatctttcaaaaaatattgccccctcggcgtctgtagctgggtattagagacattcaggggatgccctatggtttgagctagagagaactggaaacccggagaggaatataagtagaccgtcgggattttgttttatttttttcctagatctttgtatgccaaaattggagaccgagaaaaggtgattgcaaaattacaggtgttgtagtagccaattaatctctactcaaaatcaccctggtggtggctgcggaatgcatttctcattacctgccccaatattctgagttcccaaatgaaagacacacacgtatgcacacatgcatcctcgcagccttatattttaatatccattaaacagctcaatggctgggccacttcccaacctccatgtagctgactttccgataatcccaattcaccacttactaaaacctctattccatcttgcctgccctggactcagacctgccgtcctcctgggccgtgatccgctgcccttccatgttggctgtctctctgacctgcacttctcaggtgtggcagcctctcctttcccggcttggcagctatccttcttcttccctcggtcccttgccggggaatcctaaaagtcctgcccccccacctcgcgccctcccccctcacctcttctccctgcccagccattggctgccagccctcagcatcttacgtgcagaagtgcagattcctgtgtaatttggggcgggggtgtcaaattaacataatacaagtagcattagaccaaacccacaacagaattcttctgaaaaatcaacttcctctaaattagttatagtctatgatgaccgggtctctactccagggcttggttttagtttcgtccacttacttccaggccaccaggcttcgtggcccacacctgtaaccccagcccttgcatggtgggggcaagcctgagctacagaggaaaaccatgccatcagaaccgaaagagagataccgatacagtcagtggtagaattcgtgcctagaatgttttagttttaatttgtaatactggagaaatattgggaggaagggagagagagagaggccaggaagagaaggagagacagagacagaatatatttgacaagtgttgaattgacaaatctgaaggagaaaaatggcctcaataatcattctgaaaacatggaaccttaagctccaatggagaaaataataaattaaaaaaaaatagtagagaaaaagtaaagacagccaagcatccaatgacagccaagcctaggaaaggacatccaggagcactgagcatgggacactggacaggacagagcctggtcctgtcactccagagggacttcggggactctaggaatgatgtgtagcagaacatttgaggaagctggacaggtgtcatggtgctgccctggcagtataggacataaaggacagcatgtcttcaaaaccttctagtggatgcctgtgtctgaggccccagtactgctcagtgccctacagcctaatgaactctcgggctttatggtctgggaaccctagagaaggaagctgtagttcatgtttaggacacagggagacacctcaggtctcagggatccggagcgtcataaccacgtccaccacagagatgctgttcttgtgtgctcccggacagtcatgaggtggtgctcagccccgcttcctgaactgctgtggccctggccttcccctggggctggcagctgtggtgattgtaatagagcgagggtggacccccacccctcaaccctatgctgtcagttgtggttgtgaccattgctcaattggtcagagagagaaccttggaggaggtatccgtggtgtttggtgtcagtggcaggtgtgggctctttctgctccctttgtcattaagcattcactttgcgtgacgtttcattaaatttcatattcttggtctctttatcctactgtcagctaccctttcttggaaaaacatgtttctctagctaaatatatctccttctttattctctcaatttgtctaaattagcactgtgaggagttcttatcccacatcattgagcttgtaacacagcagtgaggagttcttatcccacatcatccagcttaaatacactttgttcttgcatttagcttttcattcaacattgtagaaacacactaccgtttggagctagacagacctaggcttaaatgtcagcttatgcactgaattcactaggttatttttaaccttgcgacacctagcgtaacccgtgggcttgtgttgtgaacgtcacctggcagtccagagctgcaaccaaaccacaaccccatgttgtgaggtccatgaactgaggagggctcacgaaaggctgggaggttaaagagatttttacctcttcagttgtagactcatgagacatatctctttcactccagaagaaggctgctgaccaggcagtcaccagcaggcacccagacacatgttggcacacatgggctgcatggtagtgggcacatgaggctacagaaacacacacacacaaaagcaggctggctgctactctgccctcaaggccatgttcgtataaaacccatacaaaagtggcccttgctaaaagtagttatataatagattacatcactgttcatttgggtccccagacatctggtgtctgccattttgtgctaacccagacccaacacacacacacacacacacacaccatgtttagtgtcagccatgttttagctaactcgtagaagatatccatagcagcaccatattgtctaagcataagctggcccttatagccttctgctccctacacacattcactgaaagcttgagacggcccattctgtaccatcactgtctgtaaagatgctttgagtgggagcgaacggtaagacacagtgttgctgtctgatctagctgtatcccaaagcaacactggactctttgtagaagacaatcatcaactgaaccttttctggtcagtttcttcacatctatacacaagggtccttcagtattgccagcagtaatctcctgttgaaatggtttcaagatacctaaaaggagccaggcgtggtggcacatgcctttaatcccagcactcaggaggcagaggcaagcggatttctgagttcgaggccagcctggtctacaaagtgagttccaggacagccagggctacacagagaaaccctgtctcgaaaaaccaaaaaccaaccaaccaaccaaccaaacacaaaacaaaacaacaacaacaacaacaaaaaaaaaaaaccaaaaaagatacctaaaaggttgaggaagattcctggatttagagttatatgaattccattaaagggaatgctttaagtttcctgcagtctgtgtgtgtttacaaagaacttagcctgcactggtggaagtccccactgtcagtgggatgccacttcatcatacacctcccagtatcaaagtggcctaagtgacagtctcatgttaaccctgggagactgtgctcatgaaggggccgtgggagtcctctgaagaatagaaatatgggggggggggggttggaactgatgaagatttgacatcaaataaagcagcggcaaggagactcattacaaaggatagttagtactaatattatttaagaataatgaatattagtgaaagaagtagaaacaaggaaacccaatgcagaccgacttttcaggtcattcccacttagttcaatgaagagtgtcaggaatagctgtgtgtggtggctaatcctgggtcagcttgacacactggggaagagaaaccctcatgaagagtctcttccatcagactggcatgttggcacatctgtgaggcattgtcttaattgatgcaggagagcccagcccactttgggtggtaccacccctgggcaggtgggctgtaatgagaaagattgcaagccagtaagtaacattgctccatggtctctccatcagtccatgctaccacgttcgtgccttgagcacctgcctttgctttctgtattgatgggctataagccaaacaaaccttttcctccacaactcggtttaagtcagtgttttatgacagcaagagaagcctacctggggcactgtgtaagggtacagatacgatagaggtcctatcctcaagaaattctcagcaccagaaggcatgcttagaattccaccatgggaatgctagaggtacatatcgggttatgaagaagtttagagatgagagcagctcatgagcatcacggagagtcatcgaagagtagtgacctcgtcatccagatagataagatggaccaaggctagcccatggacaaaggtgttgaaggcacgaagagtatcatggcaggcatggcagtgggaagttgggaggatgttccatttcagtgggtcacagagccaccccagagggtccgactgtgttctatagattagaattatcaagcagaggacaatggggaaggctatggattagttttaggtggggaataggagaggaccattcacttatatggtcactcaacaaacagatctgaaagggagaaccaacagatacagaagaatattataggaaagcatgaaagggttcaggtaacagtgctgggagctgactggagtggggcaacatcataaggtcctagagagcaaatcctttcaaggaaaaacccattggagcaaagtgtgtcagaacctgggagaaccctaggaagatgcagctgtccagggtacaggtaagggacatgaccacaacagaaaaggcaaaggggtagactggactcaacagctctggggaaattatgtgatgcaactcttgtctgcagggctatttgttggaatattgacgttagattcttgagatcaggtcttcctatgaagccttgactcacctctgattctttccctggactcccacctctttctccccagtactggggttccaggtattgtacagttgttgaatatgttttccatggctgataaatccatgttaagcggtctaagggcctcactttcacacctaagtttttatcactctcaatgactgacaacacttaaagagcagcgtgccagagcaggaccacggtgcccatgatggggtggtttttcgtgagagaacatggagaatgtgctatgagatgtagtgtagctattttaccttcaagcacctcttttctgttatcaaatttaacagacgtcctttctcttgtttgttgttaaagatttttaaaaaatcattttatgtgtgtgtgtatgtatatatgtatgtacatatgtatgtatgcctgagtatatacatgggtaccctatgtgtgcccagggactccagaagagggcatggaactggagttgcatgtggctgtgagccacaagatgtgggcattatgagccaaactcaggccttctggaaggcagcccatgcttgtggctgctgagctagctctccaatcaaacagcagctgacatgtcaaggctggacctgggcacctagtggccaaatgcagataaggagaaatacatgctaatgttcagaaatgcccctttaccagggaagatggtgatgctttcttttcagagggtgcattcacgatggacactatacacatgcgcagaagagacagctgccgagtcagcactaaatattcttgcactccccttccggctgtttacatactcatgagccttctggctgtttacatacgcatgtgcattccggctgtgcacatgtgcattctctgactttagtttttagactgtagcctatgtgctgtctgatagtgagcaaacaggactgaaatgcaggctaagtgaccctcacgtaaaaatacttaaagccagagtgggtttagaattctgggttttacaaatatatagaaggatgcccctaggtctaagtatgagattggtgctgtggcttacgcactttctacatgtagcctaaaggggatttgatgcaaaatttttaaaaataattttatagattagtgatgcagatttgtacagtttttcatctgaggtgtcaatgtaccttaaattttcagatttgggagctttatagttattttactttataattcagatattgtattctccctgtttcactggctggaccactcccactctcacccctgctggggagtggaggtcacttcctttctctgtcttattgttccccaaaggagctatggctggaatatcagatgaaagtccaaaggtcagaacgattgtccgaggtaaattgtctcactgtgctttggccattgcataaggacaaacacaggagctaaagagaacgtgctggaaccaaactgggtcagggcattggcatggaaccttagagaggaaagcccttcagggaggatcctcaacagataagactatagacaaggcttccacttaacttctgagttctgcagctgctgatcggtcagataagaagccgcagagtgtggccacactagacatgggattttgaggactaaggagagagcagtgaggcagggagaggaggctttctgatgtgtgagagactgagaatacttgaagaaaggacaaagatgttggggtgggtgaacagaagagagcagagtcaggtgaggcctgcacattctcacagacccaccgagactgagtgcgtgactaaccaatggcagtgttcatttttcacttgctgtcatggaggtacctgggacttgtgggtaagatgggcactgtaagagcaggcttcatccagggacagattctgaatctaggacggctccagctgcattcctcagggtcatttcttgttggctttagagtgagtcatatcccaaagcaaacttggggattagtcgttcaccaccctgctcgcgcagagtctaatgacggacaagcacacctcgatcagcctcccctgtaacaagcctcgggaggctggccagtgtttgacagtgtgcctatgtgctgcagacagaagcatggagcgtaagctaagcccccatgaatcccccaagaggccccgagagtcagcactggaagagggagtggttaaggctatccccactgccattgcccttaaaatgcatttgtctggctctggtagataaaattctattattggcttcagtcactcagccaatgatctcgtcagagtcgtctgaatggcattaatgagcatataaagcaacaggctcttttacagcaatttcatacgtgcatatttttggttgattgaccctttgctccctccctggcttccattaccacttacgctccccccccccccccgcctccatgttccctctcataccaaagcctccccccacacacacacaccttagagtccacacccactgctggctagtggagccctttctagtttctcagccctcacttgcacataaatgcacacagataaaaaggtaaatctaggctgaagagatggctcagcggttgagagcactgactgctcttctagaggtcctgagttcaattcccagcaaccccatggtggctcacaaccatctgtaataggatctgatgccctcttctggtgtgtctgaagagagctacagtgtacttatatatgataaataaataaatctttaaaaaaatgtaaaaatgtaaatctgagtccacatctgagagagagcatgcagtctaggtctttcgaagtctgtgttgccccagtcaacataatatcttccagttctgtccatttacccattcatggatgaataaaattccattgtctaaatgtgtcttagaatttccattgctgtgaacagacaccatgaccaagacaactcttataaaggacaacatttaattgggggtggtttacaagttcagaggttcagtccattttcatcatggcaggaagcatggcagcatgcaggcagaaatggggctggaggagctgagaggtctacatcttgatctgaggggccactaggaaaagggtctcttcctcactgagtggagcctgagcatcagacctacccaacctacccagtgacacacttcctccaataaggccacacctcgtaatagtgtcatttcccatgagccaagcttattcaagccaccacaatatgtaccacaaagtactcattatctattcattcatcctttgatgatttctaagctgcttccacatctttttattgtgacaagacatgaacgtgtatctctggggtgggacagagagcttattaggcatatgcccaaaagaggtatagctgggcctattttcagttcctgaaaatgttttcttaattagtgtcataaaataattgccttcacaacaaccttctcatacatgtacttagtgtatcttgatcacacttagccaccctcttgtccctttccctctcttgttaatcctctgtctcttcccaactaacccccgtctaggtttgtgtctgtctgtgtgcgagtttatgtgtgtgttgtgtatgtgaaagtgtgtgggactggaaagatggctcagcggttaagaggaccaactgctcttccgaaggtcctgagttcaaatcccagcaaccacatggtggctcacaaccatctgtaatgagatctgactccctcttctggagtgtctgaagacagctagtgtacttacatataataaataaataaatcttattttaaaaagtgtgtgtatatgtgagtatattcatgagtatgtgcgtgtatgcatgtacatatgtgaacgtgtgtgtgttaagtttgagtgagagtgtgtgtgtgcgtgtgtgtatgtgtgtgtgtttgagagagacagggagaaaaagaagagaaagaggatggtggaagggggaagaggaaaaagaggttggagagaagaaaaggaggagaggaggaagacaaagaggaaggagaggaaagacgaggaagaaagtaaggaggagaacagggaggaagaagagaagatggaggaggaagaggaaggtcagaattttcattagggtttttttacacaagtgtggagtgttggaggggaagtatttacaggagcagggacaccttaccagaggttagaccactgaagaaaactgtttctccctctgcctctgagattgcccccccttccacagcagaagcctccacctggtttccacaggcactagtgtccgctcctgccacgtctaggtgttcttccccccccacacacacacctccttagttttcctgattacacacacacctccttagttttcctgatggcgcctgtcttcactggagtgcggtggtggctctaggtagtttcctcaagtgttcaaggatgttgaatactttttaaaaaattctctcacaatttcatgcatatatgtgttccattttgattgtagtctctgttatcagcccattcccaccaagtccccttccagggtttatgtctgactttgtctgtctgtctgtctgtctgtctgtctgtctgcctatgccccactgcatttacttcgagttgcatgtatgaacttgattggggtgtcatttactcctgcaagggcaactacacttcccaggaataggacccctcctccggccgccattagccttcagggaggtgtgcggcttcatcccctccccccatgacagtgttggtgggcacagaaccaagtgcagtaaccactcttgctgtgaggtgagcacttttacaaatacttattagccacttgcttttcttctcgcatgaactatcaaccgaattcgttggcttatttactgatcagaagttttgggtttggagtgttgaaatttcacagctcttaatgtaatctggacacttaaccccttgtccaagggtagttaacaacagttctccaccctcttttgctgcgcagaaatcagatgtgttttatgtctgaattttcatttcaatatttagaagcgggagaatgagaccagagggttgttatgtgccctgaattttacagtgtctcattttgtcctcggtttaaaacccagtgagattaagtattccctgtctcgctttacaactcagtgcttcagagagacggtgcagtgccaggcccgtcaagctgtaacgtgaagccaagaccttctgagcttctcagtgcccttggggattatggaaacaagccgggtgaaggctcgggcatctcatgctgggctctgaggacagtcacttgcaagcgtgtgttcagagtattgcttgcattcattgcctgtggtgttgttgtaattcccacacagtgtacgcaaacatcctgagtaacttctttggttttctcataggtgctgcctgttttgtgtaccaataaagcagcttaggttgttaatatgttaaaaaagaaaaaatatctcctgttagcagaaaactcatggtaaaatacatccatgtgctagagttgagacagcatcgtgaacacttataactgtctcaaaaaggaaccatgaacccctagtgtttcagcagtcactgtagtgtcacagtgcagtaaacacctgtttaaagtggctaagtggggctggagaggttgctcagtgattagagcactggctgttcttacagaggacctgggttcagttcccagcacccacatggtagttcacagctgtctggtactccaagtccagtagttctcacaccctcttctggcacctgtgggcactgtatgcacatggtgtacatacatacatggaggcaaacacataaaataagaaaattactaagtctttaaaaatgcctaagtgaaaatgaataagaaattaaggataaaaaattaaccaatgttggatttatacattattagtgttattcagcatttctgaaatgattctctagtagagtggtacgtgccttaaaaaccaaggtattaaaacaacaacaacaaaatggttgctaatcttctagggaaaaaaaagtatcaaattaagtgtttaaagctgttaccacttaaacatgagtgcagtgttacaatgtcagtattttcagaatttacacaataggtaccctgaccccctgagccatcgctgaggtgattttaaattggccgttcagtgccatgacaaatctgtcttatgactataaaatatggcgtgaccttatgaagtaagtattcaaatatctaagtgtgaagtttccctctttgtattcagcaaggataacgaaaggtttcagaaaagccaccctcttcgccggagcgttaatgggcagtgtctgatagcctactcacacacagaaagccaaagcaaatattagaacatttgcagagtacatttagtactcttatatacaccccaaaagaaaacaccctttgaaatgagcctgggattccatatactccatccccacctgctgccccgtctctgcccatccatggtagaagggcatcattatttaaaggcaacaaggccatctttgtgccgggcctgcccgctttcagcagcagcacagagctggaattcatgtggccatttggcttcacttcccataaagggaggagtccagaagccaagacagcaagaccttcctcccttcctggactttgagggccagggctctgcagaccccacccttcctccccgaaaacctggcttctgcagggcagggagagagatggaagaggcacatatctcccccacccccaccccactgacctgtctgtctgtctgtcattccctctgaggtactgtcagcgcctgtgctaacaaaagtgcctgcaggtgagagaggcttcatggtcattttttttaacaagcagagaatttttctcttaatttttataggcaatttgtggaatgcttgcctctttgttgctatgataaagaccatgatcaaagcgacttaaggaggaaaagcttgtttggcttacacttctagatcgtagttcattactggggcaagccaaggcaggaactcggaggcagaaacttttgtggagaccatgaggaaacactgctcactagtttctccttgtggcttgttcaacctggtctcttataaaacccaggactaccagcccaggggggactccacccacagtgggctggagcctcctacaccaatcatcagtcaagaaagtgcctcacaaaccagccacgggccaatctaatggaggcagtttctcagttgaagttccatcatcccaaatgaccattgctgtgtcaagttaacaaaaacaataataatagtgaatgcatacagtttaaaaaagaaacctatctagcacaggttatccctaaataaagcatatgagtacagtaggttgtgcccagagatgttcaggatcaggtgtaagtctatctcctttacaagtttgcacagactgtagtatcccatacaagattatcttgatttatcattgtttttaaattttcactaaattatatgtctatctattaatatatacatatatatatctttttcttttttggggaggtaggtttttattttgtttgtgtgtgtgtgtgtgtgtgtgtgtgtgtgtgtgtgtgtgtgtttgttttgttttgttgatacatggtttctctgcgtagtcctggctgtttaggaactcactgtgtagaccatgctagtcttgaattcagagatctgttgccccctcccccctggcctctgccccctgcctttgttctggggttaaaggaatgtacctgtgtaaccactgtgcctggctaaattttccttactttaaaaaggttgtgtatgagtgtttacttgcatgtgagtatgtccaccacatgtgtgcagagcccatggggtccagaagagggcgtcagagcccctggaactgaagttatatacagatagttgtgagctaccatgtgggtgctgagaactaagcccaggccctctgcaagagcagccagtgctctaaaccattgagccatctctccagacccaaaatattctgtctcatgttggaatagcagattggtttcgatttggaaagattgataaccagattcatagaatggtccaaatacaacatcctgtttattttttcacttctaccaacccatggctaaagataacgtacagatatgtgtgtgtgtgtgcttacaactattgtcatgggagagagagagagagagattaaggcgttgagtaatattctctgaggggaaagtcctgcttgcttgctccaaaggttttagaagtgatggtgggagagtctgctcacaagaccacttcactttaagaggaggctacgccaaatatgtttttaaaatatagcaatacatttaatcaataaaattaaactatactcattggcacctggatcctgattgggggcattagttccaatgattgcttattgggagagtataatgattgtttgtcttattgggagagtataatgatcttctttcctgtatagtctcccctccctaggtctataggatatccacttgggaaactggtttacaatatgcttgagttctttttattttctctaaggacttttgaagatggaaacagcacagtgttattatggtagacgacacgataaaataatggtgctggtttcatgaagaactcaggtgcagtgaccatcagattgctaccgtgaatggcagtcgggggtcagccgtgtcttgagccacaggatattattatgtgaaaagtgtctgccacgctaagtgatgtggcacactaatttacgaaagagatgtctgagcatgtgtagaaaacttggtggtgcctattgctcgtggttgataatttatgcaacagccagtgtctcagggactgactggccttgccagcaagccgtctgatggcctgtgtctctctttccctaaggtcatcagctctatgagctccctctctgagtactgcctgccctccatcctgcgaacactcttcgactggtacaaaaggcaaaacggcattgaggacgagtcacacgaatacaggccacgaacaagcaataagtccaaaaggtacacactctctctctctctctctcgttctcactttctttctttctttctttctttctttctttctttctttctttctttctttctctcttccacttccactccctctctctctctctctctctctctccccctctctttctctctcatgcctgttacactctcacccctgtctttcctcatgcatcaaaatgagaattgtgtgagaccctgtgctctctgacattcctggaagagccccagcaaatgccatggagtgccctggtctgtagcagagagggcatttgcagcatcctgtctgtccctggcgactggctcctcttggaaacacaaggggtcttatttatatatctgtcaacacagactatactggccccaggtcatcatattgcttcttctttcctctatagtctcccctccctaggtctatactcaagatcaggtcactgcaggcccagtaatccatcagatattttaatattagcctgttacccatgtaacctggagtgcttagcaaaccatggtagaagggcactgggctgcaggcagggagtcttttggctggctatctctctgtatttcagagagagggttcaaacgtagaggttaaattcatgtctgtgacatccgctgccagctgtgcactctgtggtccatcttccctgtgggtttgagaagtggaatttactaccgcaggagctgtttggcagctgactacattcttacgggatcaagttagtgcatgaccccagatattaggcaaacattgaagtccggaagtttgaagtgaaggtatggtatctagctaggcaaaagaaagaaacaacttatggatatgaagaaggcttaatatgactttttaaaaaatgaaatgccggaaggatggctgagctttgaaattaaatattgctcttgcagaggacctgggctgggtccccagacccacatcaggcatctcatagccacctatgtcccagctctttgggtatcagatttcgctttacctctttgagtccctgcactcagatgcacacacataaatacatacatgcatacatgtaattaaatataagatcaatcttgaaaaagtaaaaaaaagaggctatcttgaaactagttctatttctccacaagaattgattgtactttttgtctaaatgcctttaaacagagtaacatgaaatttgctactaaaaatcagatacctgccactgctctccagtggcctagcttttgtttttcttgataatcctgatactatgtttaaagttttctttttgaaatttaagacctgtaattttatcaaatacatttctttagggtgtgtaagttttctaaaatgcttgagtttctgcgacattcgatcatattgatcactttgtttgagaaggtgataggtaactttttcacagtgagtatgttgtagttgaaggaattaaaaacaaaaacaaaaacaaacaaacaaacaaaaaacccagagcctcgctctctagccggggtagcctggtgtgcctggcagaccttttcttgattcctaagtattgggattacagatgtgggcttgcaggaaacacctgatgacacagtatacatcctataacagatgtcgctttgaaccatgtgttcattgatcgtagagtcccaacactgtacagggtcaccactacctaagtccgttgttttctgactccagaaagagagcccgttcccattaccagtctgcctttaatcttttcctttatttagatttttaatttttactttgtatttataagtatttgcctgcaatgtatggatgtgcaccacatgcatgcagtgcccatggaggccagaagaggacgacagatcccctgaaactgaacttacagatggttgtgagccaccatgtggatgctgggaacccaggtcctctgtgagagcagccagtgctcctaactgctgagctatctctccagcccctttagcagtctctcttcaagaataactttttaatatattcaaatttgacagcagatttttttttccaatggatgtctgaaaatagtttgcagtaaattcgtgcaatcacttcctcccatcagacacattggctcgtgagtgggagaagagactcgcctggggataactctccacagggaccagcatccatttgtaagaattgaaccaaatgagtttggtctttttttttctttgccctgtcggaattcagttactaaatctagattcttgatgaattgaaaatgcaaggtttgttgttggtttgtggttgttgttgttgttcctgttttgttattgtttgttatttggatttgtttatttgtttctgagtttggtttttaatcactgctggtcctttgcaggtcagttttgaggtcaaatgtccgcagaattagagcagtagaatttatctcagtcgtgttttagctatacttcaacatttaaaatgagagtatgtagtcaggcacctttggtgcacacctttaatctcagcatgtaggnnnnnnnnnnnnnnnnnnnnagagagagagagagagagagagagagagagagagagagagaatatgattatctatgtctgaagagtcccaagagtatggcatagctatagctaggctgtgactgaatcggtaacttgagggaggggcctaagcgagggaaaactgttgagtggaggaactgtccccgggtcgtggatagcagtagcagcatcttccctgtcaaaagtatttgtcagatgcctctggctcctgtcacttggacctccactaggcagtcaaattgaatcactattggaaaagtatgtatcttttcttttctttttctttttttttttttttttttttctcgagacagggtttctctgtgtagccctggctgtcctggaactcactctgtagaccaggctgacctcgaactcagaaatctgcctgcctctgcctcccaagtgctgggattaaaagcatgcgccaccacgcccggcaagtatgtattttttatctgaagtcataatttgccatattaaataaaatcagggtttaaaatgtttaattttatttttttatttttcccagccagaaactacccctttcttggggttctctgagcactttgggaaacggttctaagttttattattattattattatcatcatcatcatcactgggtagaggcgaggggacgagggaggtggtccagcatgcgtgtatgtcagctttggggagtcacctccacctggggttccaggaatggagcttgggttgtcgccttctctggctgctttaaaggacctttaccaagcggctctactgctgctgtattgagagccttcttgctcttgcttcaaacctcctttttctgtctcgtgaggtgcgtgctggagtctcgactgggaaggctctctttttgaatacagatttgttcattttctagcaccgagctcaggtgggtctcaaatgaccttggatggatttgtttacactcttcctcctgtcttgctgctcagaaatgatctgaccatgatttcccttggaaaagcgaaaccaaagcttcccttcttaacctcaccaacctaccggatgtgacttcatacaataacaggcacttccagaagttcgtgtgtgtgtgcatgggtctgtgccttggtgtatgtgtgtgtgcgtatgggggtgtgtgtgtgtatatgtatgcatgcgcgcatctgtgtgcgtgtgcgtgtacgtgtacgtgtctgaaatcccatcttgttttcctcttattcctcattcctagacacacaacaaaagcatctcatgctttaaattcctttggcttattctgaaaataccttccaagggagtgtgtatcctgttagcctcaacaagtatggaccctctatgtgtttaggagattacactaagtactatagatgcctgactacttcaaaccttcattcaagtaaagttgaccatctctcttgaaaaaaaaaaatccccaaactgaagtgctcctaaataaataaataaataaataaatgtctgatgtgacaggaaggtcaaaagtagatgaccccacggctgatctcacaccacagatgcaggcgacacagagagcagtatgctcgacccatgctaatcaccatcacagagtattcatgagacataaggaatttcgtgcttagatttggatctcatccccaagatgttacgtgtacaaatactccaaagtgagaagacatcccccagcatttcagagaagagacagtcaatctgtatcattagcatttccctctcatcattgggaaaggtagaagaggcatagtttaagtcaggacatttccacaccatggccatcccacccattgagggtcaaggtcagtacccagcagaaagcaggcatggagatgcacatttcccttggcatgcctttacaatgaatacaaatactccactttacccttcctcctccctcccttttttccttccttccttccttccttccttccttccttccttccttcctcccttccttccattcctgtcatatcacttcctctgtcaaatgcttccagcttctcgttacccaggatcctttgtgaaatctgttaattacatcgctaccttaagtcccaagatcctttgaacacacacccccaccctggaagctctgtctcacatatgaatcttattttatcaacagtcgcattcctgggctgcagggggactataggaaagttcacagaatgaggttctgcacccacagatggctatatggttggcatttttttaaaatcaaatatnnnnnnnnnnnnnnnnnnnntcatagcatggtggtccagggtaacacatgatcttgtcagagcagggtggtccagggtggggactgggagcagtcttctgatgagatggtccacttcaccctaaaagtaccttcgttttaaccttcacagtgatgaacagcagcgagactatttaatggagagacgggaccttgccattgatttcatcttttctttagtgttaatagaagtcttgaaacaggtgagtgattcatttactatcactttctatttacactttgtaagactgactacgttttaaaagtctgaatgtatggcttatgaattactgggcaatgtggaccctgtttattgattacaataggccatgtgtcattgttggagtgactgttatagacaggctgtttaataatctcttccaaattcaatgtcatctttttttttccagatcccccttcatcctgtaattgacagcttaatacatgatattattaacttggctttcaagcactttaaatacaaagaagggtaaggcgatttccctccttagagtattgacgacgtagaacgctaacttctaatttagctcattgatcttttctgggcaccagacccctaacttgtctgcttctgtcccactcaggtacctgggtcccaacactggcaatatgcacattgtggctgatctgtatgctgaggtcatcggagtgctggcccaagccaagtgagtgagtgccggcgcccttgagcctctaacgtacagaagcctctaacttacagaagcatgtgcagagtgtgaagccaactagagtctccctcaaaacaggtccaaactgcctcttccatcttggcagttggaccagatcccaccacatcccttcatttcgggccactgtttctaagaaagaaaaaaaaaaaatgtgtgtgaccaaattactttctctcttctcaaatattccaaagacatcttttagtttagttttgttttgcttttcagtccgccaggaccagatagttacttacaggctctcactcgtaagtgggaaaattccattctacaatgtccctttcactacagaccttgcttaattcaactgagctaaaaatgtcccagacattgtcatggaaacaagtcaggggggaaattctccttgctaaatttatctggccctgtgatacttagcaggctagaacagtgccatgttagactgtgagcactgataaactcattccagacacggtcacaccctacctgccaggcttcattccgttcaactcagaggcaatccagtcaaaagcctgaatggctaggtcaggtacaagcaactaaggacatggtgggaattcaggccaaggaaacagcttatggcgaatgatgccccagtccccgtgaagtgcagtcggggggggggggggggttggggagagggaagagggagagggaggtctgtcttcaagggatggaattcttcatgaccattaagttagtgcattcctcaacccccattagagaagctactttttgcagtagatgtcaataatacagggactctcaactgatcagtgtacagagtaagatactatggcattctctctctaagacagccatctcatactccgtgtctctaaggcctaggaagcatcagggaagagagagcagaaagatggttaaggaccagaggtagtgtttgcctgctgtgaaaatgtttgctggacacggaagggctgttgcccgtatgaactcgaagcagctacggctctgtgtttaagacctgagtaagatcaagccagcccatatccctgcctcacccctatctgaggagcaattgggaaattgatggctgctgcggagaaagaatcaagtttcagggatgggggtctggagagtctgcccatgctgtctagtgctggcagcagtgtgtgagctcagtgagcattttaaaagtgcccatgaagttagaaggaagaagtaaccaataggataggagctggagggaggctggggctagctctcatcaaagcacattagatacaggtgtgaaatgctcaaatgataaaaaaggtttttaaaaaattaagttattttaaaaactagctatataacttcatctaaagaggaaaatgcttagtgtttttggtacaggtgtccttgccgtgtgcacttgggtttggtcccagacccttgttcccatggataccaaagtctgggatgctcatgtccatgcaaacagcatatgcagtctttccacataagctttgctcttccgccatacagttaggtcactctgggtaacccataacccctgataccatatgaatgctgtggaaatagttgacacgctgtattgtttaaggaacagtaaaaagaaaagaaaaaaagacaaatgaaatttcctcacaccatggaagtgtataatttatcaaactttttatgtcttcgtcgttgtcgtcatcatcattatcatcatcatcatccttctattaggaggcacaaacaattggcaagagtcagttctctccactgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagagagagaaaagagaaaaaagagaggagaagagagaaaagaaaagaaaagaaaagacaagacaagacaagacaagaaaagaaaagagatgggctggagggatggctcagcagttaagagcactggctgctcttcagaggtcctgagttcaattcccagcaatcacatggtggctcacagccatttgtaatgggatctgatgccctcttctgctgtatctggagtgtatttatatatatatatatatatatatatatatatatatatatatatatatatatatatatataaatatatatatatatatatatatataaaatctttttaaaaaagaaataactcaaattataagatgttcatttcattagcaaatgcattaattgctatcattcaaggttaggctgttggttggttgttgattggttggtttctcatctttattcatgtttttcatttttttcttttttttctaatgtgtatggatgctttgccctcgtgtgtgtgtgtgtgtgtgtgtgtgtgtgtgtgtgttccatgtgtgtgcagtacatgaggaggccagaagagggtgccaaatcccctaaaactgaagttacaggtggttgtgggtgctaggaattgaacccaggttctctgtaagaacagccggtgctcttaaccactgagtaatttcttcaggcccctttatgtgagtttcatagaataccacaaattgagtcattgtttaattcttgtatatgctaaatatagcaccaaatgaagtattaaaggaaacaccatagataatcttctttctttaaaaaaaacaacaaaaaaggagaccattataaaagaaattagactttaactggaaatagatctgcaggttggttgtatcctaaaataacatgtttgtgttatatggaacttttcacagtaaaaaaaaaaaaatagttgcatctatttttaaatgaaaaagtaaaattttagccactgcctcatcgtattgacgtactgagttacgtaagcagcctgcctttttctacctctccttgttagctgtggattaagagtaaaagaatagatgtataactgcaggccttttctatgagaagtgcctgttattcaacgggagaaatgaattgatattaattacacattctgaccatgttcactctgagacgcctctcagtgacgtcctccgagtgggcgcacaagggtgtgtggggcttctgcttaaccacctccacatcaggacttcccactcctaagcaattaatgtgctcagcatcgctcctgagtacctactgtgtgcctgatcttgtggagcctgcacctagctcagaggtgtcagacaataagcattaaaggagagaactgtaacacattcaagtcaagaatctttctgcctgccctccctagcccgtttctcttcctctttctctttcctacctcctttgcttgcttccttccttgtttccttccttgcttgcttccttgcttcttttcctttgggagtggaaattgaacccaggacctcccatatgttaggccggtgactacctttggacccaggtcctcaagcatgctgagaaacactgttctgcagatgcatatcccatccatcttcttgttatgtttccttacaggctatttcttttgacacaggatcactctaggtttcccaggctggcctggaactctcagtatccctggcagactgcaagccttaaacctcccaattctgcctcagtctccggagtcgctggggcttaacgacctgtaccacagaccaggatgccacacagataactgtatgttcatccacgtgatgcttgttttagtcgttgaggaaagtggcttggtctgtcgggtcagttccctttcaagctgtaggcattagctggcgaggcggttgcccacgtgataggtcaggatgctgtaacaaaggccacagacctgagaaagctttactgacagacatttatttcttcagagttccaggcatcaagttcaaggtgctggcagggctgattcccctgtggagaagtagcccttcattgtggctttacctgtcggtgctatgttccaattatcttgtctttaaaacatcccccaggcatattgagtgagggcccacgccagacaacccgtcttcccatacctcttcaagggccccatctcctagaatagtcacactcactctgtgtatgacttgggggtacgagggagaggcataagcaacccaaacagtaaatctaggcaggggctagactccggagactgaggcagaattgggaggtttaaggcttgcagtctgccagggataccgagagttccaggccagcctgggaaacctagagtgatcctgtgtcaaaaggtatcttttcagtgagttttcagaccttgcccacatagggaacaaacatacttaaacaatcctgaattcagtcttagtgtgtctcatgggagtaagaggaggaaagtctgagtcagccatggccttcagacatcagctccatcattgatcagctgtctggctctattaggttttgaagccttgatgtttgagagggatgcaaccatgccccttcacgggactgccctgaggattaaagagctactgtgtgtggttgaagtgcctcttagatatctgttgtctctatggtcatctttgccatcttaacatatatatatgtgtgtgtgtgtggtatgtatatttatatgtagtgtactgcacacatatgaaatagaaaagaatggtgtcattggaatttaggatttaattttaaaacgttcaggagtacaattctcagtttccacccaaatgagcgttacctgacaccaaattgagctttctaaatttaatacaatttacattttaatctttacgagtatcttcatctgaaagacaaaaccacaactttacaatccctgtgttaatttatataaaatgatatacaaccaatatttcctcccttatttcccaagtattcaggaaatgttagagacagcacgatgggccagtttgaaatgttgtccaggaagtgggaaatgccactgcagatcaggagtgagcccttagtgagtcaccagctccctggagaatacctcacccaaatgcatttacatttctgtgcggacattaacacctctgctcagctgcctttctaaaaagaatgcagcagacatcggaaaccctataaaatgtaaggtttagtaagccataactatgggtgcaggcccattctgtgtctgcaagcagagtgtccctgtaccctcctctgtgtcctgtcacgtgtcctgtgatttctacctcaagggcaacagttgctctgaactcctcagatctgggtagttcccactcagctttcatgatcacagttgcccttcctaagttcagtttgctatattccctcgcctcctatattatgggaattgttagttccgacccagggtttctaccccgcttttgatcattttgtccctgggtaaaaactacacacagcctttatagttacaataatccttaaacagcacaagagctggcctgatatctacctccatgctgttagactctactgtcctatcgataaccccgagttattgcttactatgtttcatctgggctgctcttaactctaattggccagccctcagcaccctgttttctttattcctaacccatggtggagtctccttctcctgcaccttcttcttcctcgtgtgccctctctggcccccaagcccatgaaacctatatcccacctatgtctcttctgcccagctattagctgttggcatctttatttaccaatcagaaataacttggggtcagggtcacttattgtcttactgttcagactctcttatctctggggcaccagtcttggggcccaatgttagcattaggatacaagcagcatcaagccaactctctacactcctagccttgataatgaatcatttattattatttactaaaaccttattataaagaacccccaaataaaaaactccatggaccaacattaaccatactcagagtctatgcatctcaataaactccttacgatgtggccctacagaacttcgcattggaccttatattttcagatatgttttctgcacttatttaccaccaaaacctgaaaatctacgacagagttagaactagaaaagcaattagctttagggcttttttgtttgtatgtttgtttgagagactctctgtgtagccccagctgcccaggagtcactatgtagaccagactagccatcaacctgcctctgcctcccaagtgctggaattaaaatcatgtaccaccatacctggcccaagcaattagctttatatccttgattgaaatttcaaaaaatgatgttacaggtgtcgttggtattaatctgctttttcaacaatacagagaagttgaaagtaggcactgtagcttttgtatctgtgttcaatcaccagctcaaactctagaagcctgtactacacatagtagataggtcattcttatttatttgtttatttatttattgttattgttgttgttattgttgttgctgtggtaccagggagccggactttgccatgctgagccagtgctgtttgactgagttccatccccagtagcttcttctttgaaccagttttattatatagcccaggctagactcaagctaatggtcctctgcctctgcctctgcctctgcctctgcctctgcctctgcctctgcctctgcctctgcctctgcctctgcctctgcctctgcctctgcctctgcctctgcctctgcctctgcctctgcctctgcctctgcctctgcctctgcctctgcctctgcctctgcctctccttctgcctctccttctgcctctccttctgcctctccttctgcctctccttctgcctctccttctgcctctccttctgcctctccttctgcctctccctctgccatcccaggcatgtgccagcccttcaccttcttctctcagatataatttcaattttcccattactggacttttccttccacttaaaaatatatatttttccgtaatcattaacctaaaattatacaagaacaacagaaaacttcagcaatggaaattggggtattttagtcattatttgagatacatatccaaaaattatttgtggtcactgtcagaaatagccgatcccatgaactgcacccagatgctcgctgtcggacactctgggccctagggacctgcaagtattttggtggcctgagaaaatggacgggtgtgtgtttgtctgtttggcatgctcaggttaagatctaaaccctcatgagagggtctaaacagcaacttagctcagtctgaaagagatagtgatcatcccattaaacaaaggagggaaaggggccagctggactccatcagatgctgggggttgagtcctcatgatccatcagccatcgtatttcaccgtcactgtgcccagccacctttggatgctggtcaccctcatgatagtgactttcttacctgttactcagtaagtcttttatgttttctcaggttccctgctgtcaagaagaagttcatggcagagctgaaagagctacggcacaaagagcagagcccctatgtggtgcaaagcatcatcagcttgataatggggatgaaattcttccgaattaagatgtaccccgtggaggacttcgaggcgtccctccagttcatgcaggtgaagtccccacatgggagtcacgcatgtttccctcatgacattccttccagcagaagactgcagctagaatgtggaaaacccacacaggcagtgcccaacatgggaagggtcagcagccagcgctcagacttttcaaagctgtggcacaacacacactcaatagaaagcttatttcacattatagaagatattcacagtactgagggttggatctagagcctcgttcacactaaaaaagctctctaccaacactttaaaaaaaaaaaaagatttagtacactgtagctgtcttatgacacaccagaagagggcatcggatcccattacagatgttgtgagctaccatggggttgctgggaactgaactcaggacctctggaagagcagtcagtactcttaactgctgagccatctctccagccccatcccaacacttttttgttgttgttttgttttttttcgagacagggtttctctgtatggcctggctttcctggaacttactttgtagaccaggctagcctctgcctcccgagtgctgggattaaaggtgtgcaccaccacgcccggctccaacactttttataaagtttttattgtgtaactgcatctctcgtggttgaccaggtttgtctcaaacttgtccctcctgtgtgagacccccagctcacattttgtatttgcgtcttgtgcttgccagcacgatgtagtctaagctgcttacgatgctgggccatgtcagtaatggcaacttctgggccagccacacaaccagcaaggagaccagggactcttctgtgccctgccattgtggaaagttgggggtcttaagtgaaagttccctttgtgaagttctacttagattgaatttattggggccattaagtcaagagtgtctgcaacttaactatacatatacatacacatagatacacatacacacacacacacacacacacacatatctctctgtgattaaatctttgctgatagtggccattgaggcagcagcagctctgggtgggccatagtggcattcacaagcataagaacttccataaagggagatatgtgtctgctctatactatggaagggagtcttaacatcactgacctctgagatctcagtctccactgagttgaagggaaattgctgtctgaagggatttctctaatgctgctgtaactgaggttggttttgatcctactcaagagttgagaagtatgaactaggaatacaggctgtatggcttcgtaattccaatggccacagtcagaaaggaactacagctgtgggtgaggacagggagaagctggacttccacactgccagtgtgggtagcaagtagtatgttggaacacagtacagccggcctttctgtgagaaataagttcagggttgcaagagaccaccacttcagtagacacgtccagaacttgatcaagagggtgtgctccaaagagcaagcacactgacaggaagtgcactgggcttttattctaacacagatggtggttctgtcttttctccagtggctggggtctgacatcacagtctttttagacagttttaaaagactcagcaaaggaaatgaagagagaagagggcagctgcttcaatcctttacattctgagagtatggcaggacctgtgggtaaacaaaggtttatggggggagggggtgggtattgaagcatttgcatacaagatggagataaaaagatgttaatttattgcaaacatgagtttcatagtgtagaatagaaaagacagaatgtttattacactccaatggttaaacctggaattaccaattgatatagtagacccactcctcttctcacaccaaagcaagtgaaaatacagtccacacaaaggcttgaagtatttttaatagtagccgaaagttgaaagaagtttaaatatctctcaacttgtaaatggattaaaaaaaacaaaaacaaaaaacatggtatttccatgcatcatggtagtaatttcacttaatgagttccagctatctgctgcaaaatagataactcttaaaacatcatgccaaataaaagaagctagtgttaatcctaaagatgggaggagaaaaccgctgacccaaatcattgtggccaaattaattaaaacaagcaattacttaaagcaagccttttgtgtacccaggctgccttgccctgaggtgggattcaagaggtcggcattgaacatgaggaagacaagatttttatagctcagagttaagggtcttccaaatgggggatttgatgggcaagggctacaggagcagaacaagttagctgtaaggatctcctgaaacgaagacatgattgcaaggtggttgccacaggtagtcataacaaaggtagggttgcaagatggttataataacctttggaaacaaagatatggttactgtttcctcaaacaggcagtgcaaaccgtttgtagttaaggttacaggtggatatagcccaatccttgagaaacagattgaatcataagtaggatgaacccatgtctttatgtaagaagccattcatggccaagaaggagaccggctgattcatcactagagacaaaaggctacaagtgatctgtatccctttcatgcagtgttcacagtaagcaaatctgcaacataatgtatcctagagtaactgttgcctaggttgaggaccagtgtggatactgagattgagagagactgccaaactgtcaaggagtgagatgtgttactaaaaagctgtaggttggtcataaaatgggaacacgactgtaaccatagaataagactaggaagtaaacactttaaagaagggagttgcatgggtgcgtgaaacaaaatctcagtaaagctaatctgtagggcggggggggaaggaggaggcgactgctatgcatcaaccttcctgggattgaattcctttagcacctccctgactccagcctcagttgccttgactgtaaatggtgatgtcactagccttagggagcagctctcaatgcctgtcaactattatcttactccactgagttaacaatgcatgtatccaccaggctggaagagcacactcttaggcccagctcttgggaggcagaggcggatgaacctctgagttcagcctggtctccagagcaagttccaggacaaccagggctacacagagaaaccctgtcttgggggagaaaaaaaattcaaaaacaaaaataacacacatatctatgtgtgtgaatatccacttgggaggtgacttacatacctgtgcagaataacgcaggaaagggggccaggatcctgggagccagaggctccatcctatagccagttggtctcagggacttcataggctcgggtcattcagcctagaatgagatttggtacaatgatacactgaagaccttaggaattttttttttctttttgctagtattgctaatagtgcttgaaaatggaagggtaagagttgatgtagacataaacagcataattgaagacagcacctggaagccataggaagtcactaatgtaaggccaacctttctccagaactagtctccaggcaaccaaaactacactctcgagtaggcagtagttttgtaggcagagagaatggttaagtgttccagaggcctccttacctgaagggaagccttccagacttgcttaaggaatgatgggtgtaataaacacacactagaatgtcaggccctgaacgtgaacacttctgtgggaagaaggctgtcctgaagttagacctaacaggagtttactgctgtctttagggatttctgattggcccgatcagtggcccaggaccccacagagggtgaaggaagccatagaaatgtgttcggaatgaatgaatgaatgaatgaatgaatgtatgaatgaatcaaccaacacatgacttgaacctgggtgtgactgtcagtcatttcaggacaaaaagaaaacaaggcttggaaagggcctctgattctctcaagcagttagacccccacatgaatccttgaagattgtggcttttaatagatctcagaatgtgctgtgtccgtttacagcttaattgggtttatttaagtgcatgctcacacgtatttcaacttctgtttcctccctgtgctctcgttctgctttctaggaatgcgcgcattactttctggaggtcaaagacaaagacatcaagcacgccttggctgggctctttgtagaaatccttgtcccggtggccgctgtgagttgcgtttttgtttctaacaacttcttcaacctggacggcacgcccaacagttccctgactggaatattctcacaagtctctctctactgtaggctgtcaaaaatgaagtcaacgtcccctgcctcaggaactttgtggagagcctgtacgatacgacgttggaactctcctctcggaaaaagcattccttggttagtaactatgggagaagccgattgctgtcctaagtggagagcctggagcacctcgggagaagccaacttgagaatgagaaatatccacacatgggagaactgcctcagcctcacccacctcagagcttatgtttagcacaggcccatgaataactgtgataaatggagattatcccacaccccctcagaggaattttctactctagtggattcagctgtttatttagagattggctaaactgagtttctgtttgaatttctgagaagtttttcaaatctaaaggctaaagtttataataataacggtttctcgtctctgtcccaggaatgagcctgtgctggctaattcctatcttgatgctcagaatcaaaactgagctcagaaggagcaagagatggcccacaggcaggagtctctggaggctggcatttaattcttgagagagcaatctaaagtctttcaagttgctgcttggtgaatgaacatctggttgataaattggcagtagtgtgccagctatagtcatgagagtgtaatggagtccatagttcagtagccggccacagacctggcctatgctagtctccaaggcctgagcattcctgtcagggtctgagccagcaccccgttgttcagctggtagtagtgccaactttgctcatttgcctataccctatgatcattaggactaatcgcttgcatttattggctggcatcagagatgccgtgagtgggcagagtacttcagagtcctctaagactaagttcatgtcaagaacgatgctgaatttgaagtgtggaccacaggagctcatccatcagtcattgttttttgctagttcaagggaataggtgtgtttccctttaaatctcccttagccctcgaggtgtgtgctacctggctaaggaaaatgatggtgagctgtgtgttcgtgttctttggatggctgcctgttgctatctttgtcgtctttccagttgctgtggcagaggggcctagttagacaggaaaagcacagtagcacctctgtttattctgtcatgaacaaattcctgccgcgcttacatttgtcttggtagtgtttatagcaggaccataagcgctctttcaggaatcccccttaattacaggaagatttcaggaaaaggtaaatatatataaatatatttactttcttctgcatataaatgtacacacacacacctgctgctaagacaaagacagactactaggtattttttgagtgagaaagccaataacattttcaaactgagtgtgccctcatggctgccctagcttctctgttcctgtggtaaaacactgaccaagagcagaagaggaaaaagaaccatttatttagcttacaagttataatccattatggagagaagtcaaggcaggctctggaggcattaactgaggcggagaccatggaggaatgctacttactggcttgctcccctgagcttgctcgcgcaactgcttttttttatatagcccaggacccatctgtctagggatggcatcgcccacagtgggctgtgtcctcctgtgttaattaatgatcaagacaatgtcccataaacacagaccagtctgatggaggcagttcctcagttagctttctcttcctgagtgactctagtttgtgttaaattgacagaaaaaaactggcataatagtggttttatttctatggtggttgagagcataatctaaacttctaagtttgctttgagagtttgtaagtgaaaacgaagctagtcagtcaatcagctttccgtatcattggacctgaaacagacatcttactgtatgtataatactagctggagttctagatgattctatgcagtcatcatcaggaagcgcccatgagttcttgtgtttgtacagcgtgcattgcatttatttgaggccgcgtggccacagaggacatgctgaagctttgggcgcagtgaatgtgtgtttcctggtctgttgagctgccagtcaccctgcagcctccactcctgtctcctcaggccttatacccactggtgacctgtctcctctgtgtcagtcagaagcagctgttcctcaacaggtggcatgttttcctcaacaactgcttgtccaaccttaaggtcagtatttgtcaactcgaattaaaaccaccgtatctatgtatgtatcttggtatataattgtcgtctcgtgcatctaagtgataggaaatgaaatgatcattttacttagctgatctggacatgtgaaattatctcagataccctgtgacacctctgtcccttttggtcgaggtagatattttggaaacaaaagctctgttctgtggaaggattgctctggcagagggcattgcctcctgccattcttgcttgtgatctgtatactaaacacttactgctcttcaggcagagagcacaggtgttgggggataagatgcgtaaagccacagcccctgggaccaaggagctataataaatagttataataattggctttgaaattgactttgaatcaaataggaacattctttcaattttagtgactacacagggcagctagatgagaaccctctataacatgagaacagattctcctggtgtgttgatgcttgccagtaattcaaaccctggagaagctgaggatcacaaagttgaggctaaactgaactatatagcaagaccttttttattttcaaaaaaaggaaaccaggaaagatggctcagtagttgagagtgttagctgctcttcctaggatctaggttcaattcccagcatccccatggtgactcacaaatgtctgtcacagttgtgacaactctaggtggaggagatctgatgccctctgtggatgcctaacacataggtggtgcatagatgcacatgcaggcaagatacttaggcgcataaactaaaataagtgaatctttataaattattttacaaaataaagcagataagtgcaaatcaagagaattggtcacaaattccaaagctgtggctcagcttctatcactggcccaatatttgctactttcattaaaaaaataataataactaaaatttcttgcatatgcttatacatgttgcctcattttgtgtatatgtatgttttcccctcaagacattttaatttagagaagtagttaagattaattatgttattttgttatttactgtaattatataatagtgtacatgggcctgatctcagcgctgactatgtcctggctctaagaactgattatgaaatccaagattgcaatcattcatttccttcaagttggcaacgaaatctaatagtagctggtagaaaatgacactctcagggatgggcaaactgaaatgcctttcagggtcagcggtggttacacagtgtccactcccgggcatcggctgcaccagctaaaggcctccctgtaccactttccctattgaggaaactcagtgtcttagtcagggtttctattcctgcacaaacatcatgaccaaaagcaagttggggaggaaagggtttattcagcttacacttccacattattgttcatcactaaaggaagtcaggactagaactcaagcaggtcaggaagcaggagctgatgcagaggccatggagggatgttacttactggcttgcttccactggcttgctcagcttgctttcttatagaacccaggactaccagcccagggatggcaccacccacaatggacccttccccccttgatcactaattgagaaaatgctttacagctggatctcatggtggcatttcctcaagggaggctcctttctctgtgataactccagctgtgtcaattcgacacaaaaccagccaatatattcagttacaaattctaatatttacagtgtatcttttaagatgtaaagtggccattttgttcaaaactaacacagaatagttagcttttgtcatcaggacataagtgagagtggtgtaggaagagcaaacttcagctaaggaattgacctcatcaggttggcctatgggcaagtctgtggaatcttcttgattaatgacggattgggcagggcgagcccatggtgggcagtgccacccctgggcagatgtccctaggtcctatacgaaagtaggctgagggctgagaagtggctcagacactaaaggttagactcacaaccaaaaatgtaagaaagcacgcggagcaagccagtgaaccagtaagcatcacccctctgcagactctgcattgctccctgcctctggttcctcttgggcaatgggtgtgagggaataaagggagtgggagaaaacccgcctcccgccagagttcctgtgctgtgggtgggaagatgcgggaggactgacacgtgcattccacacagccccgggtgggtgtctggctgggggaagccactggaccccagctcagcagagggtgcacaatggggcagtcctaggttctcagtctcaggcatcccagataccgctaaacaccactcggtcatccccagggctgcagggagagagggggtgctgggtggttcccatgcgctgagagtccttggtcctgtctgtggctggagcacaggaaggccttccagcaggaggttagttgtggctcattaggagaaagcctatcccatcgttcaagcacagtgggccttgatgagcaaagacagtctatggttttacagctttattgtagaaaagcagggaaaaggagagaaggtagaaaaggtagaaagagggagaccaccagtcatggccatgtggagagaagggggaagggagagagagaaggagaggaggggccaagcagccccttttatagtggactgggctatcttgctgttgtcaggtaactgtggggaggagcatacctggctatatagtcaggtaactgtggggttggagtctagccagaatgccaaaagcttgggacattgtctgcatgactgatagtcacagaattatggagttgggggctctgtgatgtcaggcacctgtctctgggaacgtggctcgctgttctgacccttgtagagttttctactgggtcgccagagcaagcctcattcaatcaaaataggctgcctttcatggccccacaggttcctaccttggccaaatgatggactgactgtaagttataggccgaaaaccttttctttccccaagttgcttttggtccatgttctatcacatgcaacgggaagcaactaggatagaatttatgtttgatgattaagaatgctttataacacagctctctggatatattgaatacatctggggttaaacattaaaatattttgtacgatgatttattgctgtggcccaaagagccattttggggttgacccaagttgcttttgaaacagagcagggcagcttactctgaaaattaatgatttcaaaattagaatattctttagtgctcctgtcaaagcttggcagaaaaaaaaaacaagtaaagggttataagctgcccctggaaagacacaagtgtaggctcagacaatgtttccctacacaggcatttcacgatagaaggttctaaaactagaagctgtaagatcaggatgaacctgtgggatcagtgctacacagactggaacacgttccaaactccagttccaatctccagggtgtgcaccatgcccactgttgctgtcacggagtgggatgcacaggggaagaaccctgtgtcaaatgtgagccctggacagacttcatctgtgaagagctctgggttgaattttgtagaagtcttgtatcccaggaaacatggaagagcaacttgttagccaagataagggcaaggattggactcagtgagtagcccataaccacctgtaactgcagctcatgagatctgacaccctcttctggcctgcatgggcacctgcacccatgctcacacatacacacttaaagtatgaatctttaaaatgtaatgaaatccaggtatgagaatgggcacctgtgatcccagaattaggaagcctgaagcaagagacttgccatcttcccagcctccttgcttcccaccttcccatcttgacttctttcatttataaaatgaataaaagtaaaagaccctgttatttcatttaataacagggtcttgttctatatcacagcctgaactatatatatctttaagccagcctgtgatacataacaagaccctgattctaaattcataaataaatgctaggttatctatatggatggtaaactgctagaagccaatgccctaatggaaaaggatattcaaaaattgcttgatgaattccaagcagaataaagtcatatcgtttatgtttaaatctgagcccagtacgaattagatgtgactgttcctaatgtcattaatacatagaacacattctaacccccatcttacacattcaatagggaggagatgcctgaagaaaacttggcttcgaatataaactttaccttaaatagcttcgggggtttttattttctgttacacaattccatttgagaagggaccagaccctaccgcatgtacccccttcataatcttctcccctactcccccagatgcttcagggtgaggagcccagcatttgcatcctccatgttaccctggtagcttccgctggtatgttctgcagagccaagctgatgagggtcagagtgacttgtgtgaggaagagagctgtgcacacagtcgcatgttctcaaagtaaacccacccatttaacattgatgccttagtctgtctacagcatgagacaggacaggctgggaggagcaggctgccttgggagcacaggcaggaagtctttggtatttatacttagttaacgtagtcacccatatttatcactgtggagtgatggggactttcagttccttgtcattgaggtatcatccttcagtcactcctggtcagtgatttctgtctgttgtgtcttaggttagagtctggatatcctgagagcaagaggtagagagagagaggaagagagtatacaattgatgcctacgtttgtgtcaatcatacaacacttaactggaaacgaggggacaggctttgaaaagttactggtactttcagaaagtcatgttcattgcactgattactgcatgctgattttttatgctccaagctgtctagttggaaccatttcaaattctcttttctttttcttaaaaaaaaaaaaaaaaaaaaagatttatttatttatttatttatttcatgtatgtgagcacactgtcgctgtcacaccagaagagggcatcagatcccattacagatgtttgtgagccactgtgtgatcactgggaattgaactcaggacctctggaagagtagccagtgctcttaacccctgagccacttctctagcctaaattctcttttcttgaacaataacaataaaataatgtcccagtgaggcccagatttttttttaaaggaaataaagaaaccttagaggtcaagaaattcccttactgagctggctggatggttaagagcatctgcaggtcccatggaaggaatggaaagagtgggttatatgtaagaagggtggtatctggggcttgctggccaggcaggatcttcctcgtagagtttgctagggcaatttagggagttgcagaaggatgctatgatatgaagggtgccttaccatgaggtgggggcagaagtggtcctggtgggcagatccataatgcccctcaagttcatatgcctcaggagggctttaaatacaaaacgtaacttatttcttgtattcttggggtattatttgactgtacagagattaaaagagaggagacaggctggatgcaggcatcactgatagcatcctgaaatggcaaagtcagataccactacctactctctgggcagaacaaatacaaatttaagccaaccacgttgctgttcaaattttaggaacaatcagaatatttgtttagtacaatagaaaatactgttcctaaagaatgaacagataggggctagagagatggctcagtggttaagagcactcactgctcttctgaaggtcctgagttcaattcccagcacccacagggcaactcacaaccatctctaatggcagtttgggtattcgatgccctcttctggtttctgcaggtattgcacccatgtggtacccttacatatatgcaggctaacgtttatacacataccatttttttaagttgaaattaacccaaaaggcattgagaaaagccactggaactggagatctcagtccgcagtcaggttgagaagatataggctttcatggttcacagtttgagcactggtttatgcgagaatttcaggtgacttaactgtgcactagacacactgaaaagggaactttgtaagggagagatggacccactgagactagaggcaggtagattcatacccacaccagctgagttcagaggctgcttttcatcattaagcaagaacaccagagacagacagttgctgatgtgggtcagactgcatagtctggttaaatgaaaggagaatatacatgtaacttcattagttacaacccaatttaacaaatcaaagcattgtacaaatcagatcattagcatgcaaaaaatttttaaattgtatataaacaggcacttctcaaaaactggatcccaccccactttaagctagacaagtacatgtaacatttacatagaagggtaagcattcgagaatatgaaaaacttttgtaaaaaaaatttgcctttaaatattaatatatctgttgctcttattgttttttaaaatctggtgctgggtactagatttaagcgttgagtactatgggccggcatttaatccagaagctacacccataaaccctattgtgcaatttctttttttctttaaattttcttataggtatatactgtattttgagttatacttcccatgcacaccccattcctcctacccacttttccccttccccttattccttatcaatcccctctgtctcccaggtaatttcacttctacttttatttaatattcacaagctttatgtgactacataaaacttaggatcacaaatatgaacaagaacatgcaacattgcctttctgggactggcttaatcctctcaatttggttatctccaatcgctcctgtttgcctacagttaacttagctttgcacctctttatggctgagaagaaatcctatttattatttatggcatttttttctatctatttcccattgctggatgctgcagggaccattgatgtgcattcttctctgtgatgtgaccaggtccagtcctatggcctaagtcaaccagggtgtggagtctgcgtaaatgtacaggcgtactacagctgggcgtactacagctgggtctgacggtggaagtacttaaaaagtcatggacagtggaaagtagatgtgccagttattaaaatgtattatgactatattaattaaattactattgtattcacatttgggtggacaaatagaacaatgaataaataaataaaataagctaggagcagatacagatacatagtaataaataataatatgcaataattactattaccatatcagtattagttaattttcttattaatatttgctgtatttattatatatttcgatagtgtatagtataacctagtaatattagtaatgaaacaaactgggaaaagataaagatacaaatactctcctatcctaccttaagaaacaggagctagggctagagagatagctcacgtggttaagagcactgcctgttcttccagaggtcctgagttcaattcctagcaaccacgtggtggctcacaaccatctgtaatgagatcttgggcccccttctggcacacaagtgtactcaaagatactcatacattaaattaaaaaaaaaaaaacttaaaatattttttctccatgtctaggttttagtatagtatgtagtatatcttagtctcactaagtattcaagagtaattcagatgcaatggagaatagaaaaatcagaacaataactgcatgaaaagacatcatctatcatgggaagaccatccaactcttctgtaaatgctatgccattatactggttgcctggcatctcctgaatttccattttggcaaaagacagagcgagggcttcctgtgacattcccctgtctcactatcatgatcataaccatgggttatttatccagtgaacaccaggaggcagatggttcaggtgacccagatggtgacatatgccttgtatgtgcctgcctccaacccggttggccctccccacgcttaggaaagaccctcctacatagtgtgcattcaactagtaaccttacagtttgcattctgttacagaataaagaccccaaaatggctcgcgttgccttggaatctctctacagattactgtgggtttacatgattcgaatcaaatgtgaaagcaacacggccactcagaggtaaggccgggtgggcgtgagcgagcatgacaggtgagctgggcacacgcagggtgagccgggtgcccttgcagggcgctagagtcaggcgtgctcagccaccacaccatgcccggggttctcttttatggcttcccgacctggcctggctaaaacctgctcagagccagaacttcaccactgtcttagcagtaggtctttagcagcctcctctgggacagggtctgcacagggtctgcttctgtgcagcatgcagcactttaaggaaagaaatagctgtctattatttttctagctgccctgggttttccaaaaaagaaaaagaaaagaaaaaatagaacctcttcctaagagtaattgtgccaatggaaagggatgagttggtttggttttttttggtttggtttggtttttttttgggggggggttgtttgtttgttttctgtttgtttgtttgtttgtttgttctttgtcctctgatactaagatgaaatttgcatcatcccctgacaactagatctcagccaaccttgcttgttttctctttttcgcctgcccttatcttgcagccgactcataaccatcaccaccacgcttttccccaaagggtcccgcggcgtggtacccagggatatgcctctgaatatctttgtgaagattatccagttcatcgcccaggtaacgcccgtatgtctgcagcggccccctcaggcgtagtaatcgcgtaaacagcccgcaacgatccttcatacatcctgacctcttagaaagggattgcttctccacacagcctattcttttgcttcacaacagtccgtggatatgttgaatgcctttggcctctaggaagtaaactgagagatgaagtttaactgattcctccaaggctacaaagcccagccgtaaaacctctgtagcacagataagggcctgcctgggtcagccccaatcacaacagaacagaggaaactcttgtgacgctcttaagtctccccttcccactttccacagatctctgctctgtattccgcaagtaaagaggagtcaaaggctctgatatttggcagaactttaatctaatttgaaaagatgatttagtgcagttgaggagtaaatagcaattttctaatgtttctctatagggagaaaataatttcatggggaaattatcatttacccactttattcctttgttcaaaactattctaagcagtttacacatgaattaatttacttttaaacagactccagtaatattgaagctggcttggctgtgatctattattcaaacttaagattttttacttagatcatttatgtggggaaggggttggtggactaagcccaggatccctgctcataccaggggtatactctactgctgaattgctccccaaggctactgtttcatttattcactggtgtgtgtgtttacttatttactgatttgaaacaatgtctcattatttaaccctggctagcctataactagctctgtacaccaggctgactttaactcacctatctctgcctcccacatgctgggctcagaggcaagcaccaccatactgaacttatctctttctttttcagatacttggtgagtaaattttttaccctcagtttgacctctgtgacttatggaggcactgggggtctcctgcacttgctgggcctctgtcacaaagcaaacctcaaactaaaaaatatcttctgtctcagtttctaatttatctgtaaagcaagggtagaagtttttgcccatttatgcctcagaatagtatatggctgaaggaaattataggcatgcaaatgctgctgaagtacagttgatattaatatacagataagtggttcagagcagagactggaaagtagcatctctctattgtgaccaatgagagaactctttaatacgtatccctagagaaagtgcactcctcactctgccagtggaaaatttcatatgaattttcaaatgtagcctcaaagtatatgtggtttgcctattgtggaatagtgtgtataaaatgagcatgtcatataatagcagtcaatgatgtgtatgaccaggctccaccttaaatgttctatctcaagtgttaattcttcttcccccttgagtttgatttttataaagaagtcagaggattttttttcaatgttaaatggtagaggaaaacagtcattttgtagtgataccatcgtcttagtcagggtttctattcctgcacaaacatcatgaccaagacgcaagttggggaggaaagggtttattcagcttacactttccacattgctgttcatcaccaaaggaagtcaggactggaactcaagcaggtcaggaagcaggagctggtgcagaggccatggagggatgttacataatggctttcgtcccctggcttgctcacctgctctcttatagaacccaggactaccagcccagggatggcaccacccacaatgggcctttccccccttgatcactaattgagaaaacgccttacagctggatctcatggaggcatttcctcaagggaggctcctttctctgtgataactccagcttgtgtcaagttgacacacaaaacaagccagtacagccattaagaatatatttctcagctgagtttaaaaacactatcaacatatatcatacaagctggaagaacctaggctgtttctggttcagacgcccaggtgtcctgttgacttggtatctgtacctccagccttactgtgctcaattctgtgtgttgctgcatcatggtggctccctggacagttctggtggccctgatcttccttcgggggctctccgtgacccataacactaggcagtagcccttccagaagccacctgtttgctgcatgtggtgttaatttgcattttttgttattcttggcgtctcatgtttttattttattctatttttctcccccacccccaaccccctccaggaacgtctggactttgcaatgaaggaaattatttttgactttctctgtgtgggaaaaccagccaaagctttcagtctcaacccagaggtatgaataactttccatgggaacagagcacatgttcatagagcccatacctttgctctgaaagtctcgggccccaatggggcagggctccgatgggggcggggctccaatgggggcggggcaggggaacacctctgaagatttttctgtctgttcctgctcgtgtccaaatttgagggtcagtttttcagaggtaaaatttgaggagagctgattgaggtggacccagaacctgtgtgctatggggcctctctcctttttaatggaatcattctcacttcaaagactgtgttgaaacagatgagtaaatgtggtagtggcgaggttgcttcaacacaatgggattagggaacaggacacaggcgcttggtactgtgaccatatcccagctccccacacacagggaatccttggctctgcaaatgactggcaatccagtcttacacttaaaagaaaccaccctcagccaatagaaccctgccagcccggctgccttcctgcagcccttattctgtgcaatgacttcaaagaatgctgggtccaaagcccggaaaccaagtctaccacttgtggtggggtgccactgccttttctaggtgtgtgacatttacttgtgactctcagctattccattggtaaaatggacagagtactttcctgggttccttcacagaagagtgggtctggactaaagcattgcaggctaaaaagggcatgaaggggaggaggataaagaaagtgaagcaaaggagaagaaaaatatcctgtgccagagaacatatctctgaacacgtatctctgtcatctgtaatatcctgactccttcattccaaggaaattggtccaaaggaccgaggcccagcatagcttgttagctgcccccaaaccatccctgcatcccctcccccttcccaccataccctgcattgtctggtggctgatgacctcacagacctctgtgagttgttgctgtcacagtcagcagctcaagaggaggtcaaatccagggccagatggaggccctgagctggacagtggcagatttctcttgccggcgacattctcaacatctttttcatttctcagtagtcataaatctactattttaataattctcagaattactgggttactcggtaatactccgaattattgttgtcccagtcaggattactgttgctggaacgtcatgaccaaaagcaagttggggaggaaagggtttatttggcttacactccacatcataatccatcactgagggaagtcagaaccggagatcaaactgcgcagaaacctgggggcaggagctgaagcagaggccatggagggtgctttatactggctcctcatggcttgctcagcctgctttcttatagaacccaggaccactagcccagggtggccccacctacaacaggctaggccctcccacatcaatcactaatttaaaaaaatgcctacagaccgatcctatgaaggcattttcttaattgactctccctcctctccagtgcccccccccccggcttgtgttaagttgacatagaactagccagcacacttgtctaaagcgaacatctctgatgctgcttccatatgctgagtatagtcacactcacctgccatctcagtcctttggagactgaggcagccggatggtgagtctaagcccggactggcctgcatagcaagacccgtcccaaacaagcagagtgctcgcggtcaccaccacctctaacgtttatccttgggtctgtctatgaactcttggcccagtcaatggctcgttggctgatccatctgtgaagagcagccgaaattgtggtttaaagggagaatccagtaggaaaaaaaaaaaaaaaaagatttgggtcttttacatctctttatctttattaacgtcacctagtgtaatttattcattgggtgtctgcgcacacatgcttgcgtcatagtggagtgtggaggtcaaaagacaacttgggaagccagttctctccttctaccacatgggtcaggaagctcaaacttaaatcgccaggtttggcggtaagcacctttgcccactgaatcagcttgccagctcccttccatgtctcttcctcttgtagggggaatagaagcatttgcctattagcagctgacagttagaagccatcagactatacacagccagcttggctcggggaaaggcctgactggggcagagaggtaatgaagaaaagacagacacagaggaatccaggatagaaatctgggatctgggtggtctgggctcttaactgaagaagccacaacattctggaagctcagcatgtttattacagagctgaacagcgaggcagggttatagcatacagctggacaaaggaagcagggttattacttacagataaacaaggaggtagccggatcaaggggagaggtttagctctcagtaggagcagcctctgtaggggagcagcctttaggccataaacgtccaatggggagaaaactatatatagcagacatattctgtacacactggcagtactcacacttgtcccactgaggaagtctttgccatttccctctggtcctcactccagggggaaaggctttgcattcctccatgggtctgagactctggggtctttgagatggccagcttatgtacgcacacacacacacacacacacacacacacacattcactcgagatataactttgggtttctcacttccctatacagatcccattaagacacaggcattcagcagtcagaaaacagaagttagtgtttcctaacagtgatgaaaaatgctgctattgggtacagtttcttagagattggcctgttggggcgtgcttatctgttgattgtgtgattccatagggtctcgcactggtcttgaacttgctgtattgctgagcatgacctgtcccagtctctgaagtaaagaaactataggctaacattatcatccctgactccataatggttcttaaataatgtttttggaatagtttgtgtagcaaggctcggagacataaagggttatcctaataccaactgtgttgagcatgaactcaacagttggggagtgtcttgataactgtcttactgaattggggcctggaatatgtactgtatacatgcccatcgtcatgagacgtgacatatctgtgacatgaacttctaggccgtcagtttctcactcttttgccctgatctaaaagaacatggaattggaggtcctactcagtgctagaggcaaggaagaaccctgtgtgctgacagattggaaatgaaaggataaagctgtttttatccatgagcaaatatggtagaaaactgcaaaaaaaaaatccgtgcttggtgggacacacttataatcctgcagcatttgagagacgaggcaggagaatcaggagtccatggttatccttgattatatagggagttcaaggccaaccttggcaacgtgagaccctgtaacatagaaaacaacgttagcgcgaacaaagatatcactatttaaaaaaggaaaaggaaaaggaagggaaagaaaaaagaccaattgatttggagctgatgcatgactttaggaagtttacaagatacgaaataaataatatatttctataatccaataatgaataatcaaattaaacaatttacggtattgatgaaaagcaaaatacctgtcaataaaacaaaatatgcacactacttttttattgcaaaaattaaaaaattttgaaagaagacaaagacccaaataagtagagataagtactcaaaggtcttactattgttgagttttgttgtccccaaactaacttaaatgttatcaccttttacaaaagatttatgcatttatctaatgtatatgagtgccctatcttcatgtacacctgcatgctagaagagaacattagaccacattacagatggttgtgagcaaccgtgtggtttctgggaattgaactcaggtcctctggaagagcaggagtgctcttaaccactgagccatgaatgttatcatcttaataagattatcttaataaaattatcatcttaataatcagtcagagtccctatagcttcttttaaactaaaaatcaaagagctagtcttaaatttttatatggaacatcaaagtactaaaatatccaacatagcttaaaaataggggaataaagttggactataaaatcatatgatcaccaaatcagtatagaggttggggggacataaagagggtcccacgaggatggagactctagagatagacccacttgaatgcttcgttgatttcaacaatgagaatttatccagcacagagaaatctttgctctcgggggtactgagcaattggatacccaccttggaaaattatgatttccaggtcatgacttttactgtaagcaaagacaagctcaaattgggtcatgcaacctaaatataaacccaacactgtatgtcttccagaaaacaaataacataaaaacctttatgacccttgagtgggcaaactttctagaacacaaaaatcataaatcacagaaggttaatagattgaatatatgctttaaagtttgcatgttgccaagatatttaaaagagagtcatagcatgggacaaaatatttttgactacctccagcaaagtacttccttccagaatatatgaagaactcttataatcaataataaggaaataaacaacacacttttaaagtgagcagaagcaatagcctctttgtcaaagaacagctagaggcagtcagtaagcctaggaagagatggttggtgtcattggtccctggagaaatgtaaggtagaacggagcatggggtgtaccagggtggggtgtaccggggtggggtgtaccggggtggggtgtaccggggtggggtgtaccggggtggggtgtaccggggtggggtgtaccggggtggggtataccggggtggggtctagagattatgatctttcttcattcccggagtgattcagagagcaagtgccgtgctgagccctcatttgcatctgtagctgatgcccttaggaatggtgtgtctcctcctgggacatgtgttttcatgggtttcagaacatccagtttttaaaatgtattctcaaacttcctggcctttataatcagagatcaaggctgaagagatggctcagaagttaagagcactgactgctcttccggaggtcctgagttcaattcccagcaaccacatggtggctcacaaccatccataatgatatctgatgccctccttctggtgtgtctgaagatagctacagtgtacttacatataataaataagtaaatctttttaaaatagattaaaaaataaaaataatataatctgagatcaataatgaatgttggctgggcgtggtggggcacacctttttaaaaatttatttatttattttatatcccaatatcagccctcctctcctcccagaaccccctcatgcagaccctcccccacccccctctccttctcctccgagaagggaagccctgctataggtagcttcccccttccccccaggatatgagctcattgcaggactagacacatcctctcccactgaggccagacaaggcagcccagttaggggaacaggatccacagtcaggcaacagattcaaggacagctcctgctccagttgttgggggacctgcatgaagacgaaactatacatctgctgcatatgtgtggtgaagggtggggggcctagatgtaactcatgctcaccctctggttagtggttcagattctgggagccctcaaaggtccaggttagttgactctgttggatttctgtggagtccctgtcctcttcaggtgcctcagtccttcccccaactcttccataagactccccaagttccatctaatgtttggcaaattgatcgctgtgagttgaggccagcctgacctacataatgaattccaagacagccagagctacacagtgatttatttatctcaaaataaataagtaacacacacacacacacacacacacacacgcacgcacgcacgcacgcacgcgcacatccctttaacagatgcgtgcccatttcaaacatgccctctaggtttggcgagcatctccctgcctgtttatcctcgagttaaaccctgacggattcttctagatgactgagcctttccttgtgtctcttccagagaatgaacatcggtttgcgggcgttcctggtgattgctgatagcctacaacaaaaggatggcgagccgcccatgccagtgacgggagccgtgctcccctcaggaaacaccctgagagtgaagaagacatacttgagtaaaacactcactgaggaggaagccaaaatgataggtgggtacgaacccctgaaaatcattagcaggtccttactgtaagtgcgctgcattcaaaaaaatgaaagagagagagagaaagagagaaatgagcaagtctctggtgagacattcctgcacagctgttgactgattcccagtgggttccaatcttggagcccttcaaactctttagcacttccaggtaaatattttgccatttagatgttggccttcatctgggtccaggtaaacatctaatattcattattggttatctacattgtacagtaagtttccacaatatctgtgtattttggcaaataatcttatttataatttttcattaattcatatttcaaagaaaattccttcccttcttttgtaagcatgccaagtcccacaaacactgcaggagaatttttctctttctgatatatcttcctgagtccaaagaggtgattctttttaatgcttgtttgttcaaacaaacattaagtactcagatttagaaactattataaacagtccctaaattccagagatatgagagaacacatgcagaactcttcactttaacgttggtcctccttaggctcaggagttcaagacttttcatgtgtaaggcatgactcttggcactcattttgctacaatatgatatgtaccaattcttgtttgatttgtgagtgtgtatgtgtgagtatgtttgtgaatgtgtgtgtgtgagtgtatgtgtgtgtgtgagtgtgtgtgtgtgtgtgtgagtgtatttgtgtgtgaatgagtgtgtgagtgtgagtgtgtgaatgtgtgcaagtgtgtatgtgagtgtgtgtatgtgtgagtatgtgtgtgtgtgagtatgtgtgtgttgctgtcttctaactgtaaggatatttatagcacatgcaatggtagcagtacatttccagcattttacagtttataagtgaagtcagtagtttattttgctaagactctgcacacacatttcagtgtacactctacagctattaaacagccccaaataagaattatcatttataatataattgctaatgctggtaggttttcttgttcttcagaaacataatatttataaagcaaaattaattacttaactttcatgaagtctttctcattgggattttagaaatagggagcaggagagttgcctcagtggttaagagcattgattgttctcacagaggaccccaagtggtttcccagcacccacaatggcagctcacaactatctgtaaatatagtccataggacacaacaccgtcttctggcctctgagggcattgcacacctgtggtgcaccatttatgtgtgcacacaaagcactcacatacataaaataaaaaccaatcaagggctggagagatggctcagtggttaagactgctcttctgaaggtcctgagttcaaatcctagcagccacatggtggctcacaaccatccgtaatgagatccgacaccctcttctggtgcgtctgaagacagttgcagtgtacttggatataatagtaaataaatctttaaaaacaaaacaaacaaacaaacaaaccaatcaaaccatttcaaaagtattacagctcttcttaagtaagtcccaatgattatttgacaaacatctccaaagtgtggggtggtgcactaggagccaggcaaacagagacggaactaccctcagctctgcactcacggaaatcccaggcacaggcacagaggacccgctcgcaggagaaatgctgtagaccctgtgtaaaccaggttatgattctttgacgtatttagttgacaatatggctaacacatattttccaggaatgtccttgtattactctcaagtccgcaaggccgtaggcaatatcttaaggcaccttgataaagaagtggggcggtgcatgatgctgaccaacgtccagatgctaaacaaagagccggaagatatgatcacgtgagtgcggccaagaaggcaggatgtgctgctggaggggtcaagccagagtctctgagggtggttaaacagatgtgttgatgagatttgacttccacttttttttttttttttttttttttagtttttcaaaaccgggtttctctttgtatcctggccgttcaggaacatgctttgtagaccaggctagcctcaaactcacagagatccacctgtctctgcctcctgaaggctgtaattagacgtgtatgccactatttgaccttttaaaactagaattattcattttattttgtgtgtgaattgtatgtatatgtatgtatgtgtgtaccacatgtacaattgtccctgtaaatattggaaggtgaaattagatcccctggaactagtgttagggatggttgtgagcctccctgtggatgctgggaatcaaacctgggtcctctgtaagagcacaccccgctgtaaacatctgcgccatctctccagcacctgcatctagacttttaaaattccattgacattcgtgaaactctgaggagataaacatttgctaatgctaggggccagcaccaggctgtacttagaaggcctgtgcctagatacatctaatacataaacacataagtctaaatggtttctcataatcttttgacttgcttaaactttgtcttcaaactctaggggcgagagaaagcccaagatagatctcttcaggacctgtgttgccgcgattcctcgcctgttgcctgatgggatgtccaaacttgaacttattgacttgctagccaggtaggtgggaacaatctcaaatgttactccatcaaaattggttttaatctttaggaaaaccagaatacaatgattattttctactgacagagatttacttcataaggtgttattctaagtcttatgtgtgaactggcaaaaggaacttaggtttttgggttttgggtttttagttgtgggccttgagcctaggaatccccgtgtgctaggcaggtaagctctctgccaccgagatttattgccagccttctgtttactcattttgagacaaggtctcactaagtccccagctgatctcaaagtatgaccctcctgcctcagcttttcgagtaactgggattacagccccgaatcatacacctgtcttataactaagatctttgttttgttttgttttgtttttccatcttcaaggatttaaagtccagtttacaatagttacaaaagaaccaggcagtggtgacactcacctttaatcccagaggcaggcagaactctgtgagctcaaggccagcctggtctacagagtgggttccacgtgcatggttatgccagggctatacagagataccctgtctcaaaacacaaacaaacaaacaaacaaaagcacaacaaaactccctgcaaaataaatatacagaagtccacgaggttcctaacaaccccaggatgcatccgcacagctgaccagctttatgcttgagttcagtgggaggagggtcagctgtggaccaaggaagccagcaaataaatggtacatttggagaggcccctggagaggaaggatcaagttcagaaaggtaaagagaagtgcctggcctagctatgagaggtcatgaccctcggtttgaggtccctaaactctctaataaggccaaaagagacagcaatcttaaatctatccgtagtactcctgagcgctaccaacaaaatcccatttatcattttcccatcacccgcatgactgcacagcccaactgtaacctaaaagacggtttgctcccgagggaaagtctctccttgtagtttagatacttcctcatctcctgtaatctgaaactccaaccgacaacatctctttcagttacactcagaaaagaaatgcagaaggcaaaatcatcagatgggaggcgtaaggaatgggagggagagggaactgagaacaaagagttaacaaagccaacaaagaagggacttagacactcacccagagagagagagagagagagagagagagagaggattttagcttcaggccatgccattaatgagccactttaggggctagtgagatggctcagggggtaaaggtgcctgacaacctaagttcaaccctccagatccacatggtggaagaagagaactgactcctgacctctaacctctgacctcagcatacacaccatatagtattagtattcacccaaacacacatgcatgcacacacaataaacgtagttttaaatagtattttatttagcttggagagttaagctctgtggttaagagtactgaccagagtactattttatagaggactccagttcagttcccggcacccacatggcggctcaccgacgactgtaactccaattccaggggatctgataacccttatctgaacaccccaggcatggcacatgatcatgcatgtaggcaaaacatacatacatatacaatcacatgggtgctcagaatcaaactcagattctctggggaaaaaaattaatactcgtatccactgatatgtttcatcccccaaaaaatgtaagttttaatctgatgacagtgacacaaaaagaacgcccagagaagagaaagatatcagtgcctaaccccctagggatacccgaagcctgaggaggctctgtcatggcagcaagcttcagtttatttatttagcttccgatgggacaaggcccacaggctagtgaggggatcagcctaggctatgcgccatgcatctttttcttagttatctactgcatgacagccagaggggaatcaacagatggtctcaaacgagcagcctgcgacagagagcacactctctggcctttgagcagtgacatttattgcctaagtccatcctgaccctcttcccacacatcaggcatgggatggttctgactgtgaaggctgctgacaatctgtcaccttcagaaccatgctcctcagtcttggtgtcacctgagcaagccttccctcctcacttgtcacttgttagccttcgtcatgttagccattatctgcctgctgctctcacggtcaaccttcagtccatggatccttccctctagtccatgatcagagcacaattaaggaaggacacgggctagggacagaacacagcctgaagagtttgcctcagcaacttgaggctccgggtttaatccccagcccctccaaaactgtataaggtttagacaatgaacagcctcagttttccttaaggccccccatatcagggacactgaggcagagtgggggtggggaggagtaatggacctgaattgaggtgagtgttcaattccaaggagacccacaaaggaacaaagggcaaataacagaacacactgatctacaggagaagccggtatggaaggaaggaagagtttgggatcccttgagggtcagccactcaaacactctcctgggacgagagcagaggctgagaataaggggaagtctctgagcaaattccagaatggccctgaaacacaaaggaggtactgttgctgtgggcagtagtagacagggtgacaacgagaagcagggcatggggaaatgaggatgtgaccgtgaccaccagaggatacagtactgctgcctgagagacaggaagcggcatgggaaagatggcggaattttctagaaagtttgaccttggtatcttggcttgctattttactgcctgtgtgatctagacaaattatttaaacctccaacgtacctttcctcccttggcaaaaatttggcaatcttggaagggtgccacctatctctgaggaccaaatagcactgtggcatctacaccctggttagtcagaggaaggtccgtgggaaagaggcagttatcagtgtagggtgggagggccgttggctttactctgagatctagccgctgattgcctacaccgaagctcttgaaatgccaggctttgtagataaagtggagcattctgggagagtgtctaacgctgctttgctgtgggtctgcatagacggcttttaacctctgaaaccaccttgacagcctaatccgaggatgctggagtctgcaggccgtggtgccagacatgcagggagggaatcgttagacatacttggaatgtctgagctatttatagcatcctgtttattattgtgtacattcttacaaagcccaaagccgggagcactttttgagaagggaaaagaacaaataaatattcttgaaagctcaagaaaaatggccaggctttatcgggagctcatgaaaaatgctattttataaacttcaaaggggagtcagagggtgtctcagagggaggtaaggagcctgcgacctgtatgctgggtcctttgggtcctgagaaaatgagcctcttcggatgccccaccccccagagggtcaggacatgaaggtagggagccacgtacatgaaatgtgggattgagttgccaacaggaagtgcatcaccccgcaccccaaaaagtccagtgaagaggtggtaagctgactcgatgcagtatccacagcctggccagaggagggagatacacacttcacagttacttcatagtacattttaccagaaaacttgggttcttcataattggaaaagcaagaccattgttgcttcagcctcccattccttactggctgagccctcagtaagggtttcaaggacatgtctccacatagccgctgccggcctgctacaccaacacttctggtgatagctaaatacatcagacacacaaactgcagacagattgtggagtgtggaaggaggctggccagctactatatgtgtgctttgatatgtattgttcagccaattactaatggctgagtctgagagggcttacccagcgggcttcctggaggctttggagatagattgcctcagcatcatggtcaatccctaagcagttctgcattcatgtctgagtgctagagcctgcctggtttggcttgtgggtaccaaaagggactctccacgggcaaggcatatcctttcttccacctagaagaaaatgtaaccaagtcagcgatctcatgcctttcttttcccagactctctattcatatggatgacgaactgcgccacattgcacagaactctcttcagggactactggttgacttctctgactggagggaagacgtcctgttcggcttcacgaacttcctgctccgggaagtaaatgacatgcatcacaccctcctggactcctccctaaagttgcttctgcagttgctcacccagtggaaactggtcatacagacacagggaagagcctacgaacaagccaacaagatcagaaactcagaggtgattatgtgcacctttttatgtaatacacactcacacatacactcatgtacacacaaacacacacaaacatatacacatatacacatatataaacacacacacacatatatacacacacacacatacatacatacacagatatacaaatacatacaaacacacacaaacatatacacacatatatacacatacacataaacacatgtatacataaacacatatacacaaacatacacacatacatacatacacaaacatatatatacaaaaacacatatatacacatacacacacacacatatatatatatatacatacatatacccacatactcacacacaaacacatacacagattcacacaaacacacacaaacacacacacaaatacatgcatatacacacgcacatatatatatacatacacacacacacacacacatcgaggcagcctagggaacctttagagtttttccttcctgatgcctcgggcctacctgtgatgctggtccttagttcttccaccagccatgttgtgaccaaggaacacaggaaacagcattccataaggttggacttgttaactccaagaaggccatgtaaggggtggaaattgtgtcatggagacagacggggagagatccagcagttagctgtccaccggagtatttttttccaagttaacatttattgcttcacactgtatctgcacagatgacaatgcagtcttcgagtttcttggtcactagtgaatggtaaaactattgctagcagtctggagcatgcatggaagggtaccagggtctcagagacacatggtgagctggcagtggccatgcggatctctggttctggagggacagcatcatcggaggctcagtgacctgcggagactctgggcagcatagcagcacccagtgaaaagtgagggtggcgttcaggttcctgtgtgctacatgaacaaaagaccaactggttgaaaaagaagcccaaatgctttgaagacgggaacggaggtggcacctgcctagcctctcagttgcctttgcttgagggtcatgtgattgcagtttggaaacttccagaacccatcatgtatgtaaacatgcaaaacttagaatagattctacctaagaaaatgtaagttagtgttggtttatccttataatcccagtacttggaggcagggggaggaagatcaggaattctaggttagtctgagctgcatagtgagaccctgcccccaaaaacatacagaaaagggggctggctgaggggtagctcagcagttgagtgtgccagctgctctcccaaaggttccccgatcaggtagctcactctatctctaactccagttccacaggcactgatgccttcttctgacctcttgctccacatgagcacacatgcagaggcaggcgcaagccagttactaaaaactaatagaagcctttttaaagttgttttaaaaaaatacaaagtaacaacagtgacctctcccgaccttaaaaaacaaaaactgaattctcttggaaaaaactccagctttgggcttgagttggcacaggagggtagagaacttgcctaacatatgggatgccctaggttcaatattctcagtacacattgataggttatttctctgctggtggagtgagccaattcaagccagattagagtatattaaatgcagatttgttaggaagctgctctcgggcgagtccactggccccaaggaccaaggccagggaagtcaccatggggaggtgggggagagggaagagaaaaggaaaaggggtgtactcacagagaaaggaggagagagaaggggagaaaggaaaaggcaaaaatgtctgaattacatgtagggaagagcctctggggggaagggcagcccagcccctgggctagaaggttcagggctggaggcgggggtatgccaggtagggactgggggatgctgggaggacctgaaggccaggtctgctttgatatgtaaaatatgcacctcagttccttttcccagagtctgaatccaaacacacatatataccagtaccaccaaatatgtgtgtatgtacatacattcatagtacatacatacataaatacatacatacatacactagtatcaattagaaagtaaaaattttgaaaaatctaacttaatagtgtcttttgtctgtagaaacttcagtgaaaataaattaaaccactttgatctcagctgtagcataatcccaaatggtgtggatggagaggcaagatccgtctcctctctacgtacagcccttaaacagtcatttcccatcagaggtaacagacggctggctttatcacaaagcacccattgatcgatccgaaaggcaaaaagggaatccagagatctcatgaataataatcatttcacacactcttgtctctaagctgtttcaatttaattttatgaaactaaatgtgcagaaagcctgtatttctcccttgttatcttgctgctgaccctggaatgttcttcttgcacgacagctcattcccaacggctccagccaccgtatgcagtcagaacgaggcccgcactgcagtgtcctccatgctgtggaaggcttcgctctcgtcttgctctgcagcttccaggtggccacacgcaagctgtcggtgctgatactcaaggagatccgagctctcttcctggccctgggtcagcccgaggtacggggtgttctccaggagtctcccttcaacagctatggatcaaagactagaaataacacagtactattgggggtacctaatatgtgtagggcaaggactttgttgttgatacattgttgggtttttaattagatagcggctgtagtttcatttggtttgtttatctgtttttgctttattttgttttgaggacagggtccgtaggccttgaactcacagagttctgtctggctcagcttcctaaattctgggattaaagacatgcattcccaggctataacagaattctttttaaaatcttaagtaaaccaccttttaagattgcatttcttgttattttctgtgcacaagtattttccacccaagcacgtgtagcatgtacattcagggtccttgcaagccagaagaagtcgttaaatctgctggcactggagttgcaggcagtcatgagctaccgtgtgggtgctgggaactgaacctgggtcttttctgctgcttctttttttttaaactttatttccaaatttcatactgtatttccatacaacactctcttggctccaatctataccccccaatttcactatcttctctttttaaacacacaaacacacacacacacacacacacacacacatatatatatatatatatatatatacacataaacatacatatgatacacacacacatatatatatatacaaacacataaacatacatatgacacacacacatatatatatacacacacataaacatacatatgacacacacacacacatatatatatatatacacacacataaacatacatatgatacacacacatatataaacacacataaacatacatatgatacacacacacacatatatatatacatacataaacatacatatgatacacacacatataatatatatagtgtgaaagtccagcctactagtccatttagtattgctaatatgcatgtgcttagggctgaccgcttaggatcagataacctatgggagatttgtgtatagagaagactaattatctttctcaacagccgttaactagctgtagctctctaccaggggtggggccttgtggaacttccccagccacgctggactatcagctggtattgtcactgtgtaaccatattgtgagatttatgggcacagtggcatctttaatctagtagaagcaaatcctatattctgacagtgacagaagagaccacttctaagttcctaaatgaccccactttaccaagaattttaagattaatttggttgtgggtcattcctctcagcatctagcatacatctaattaagaagctgccacacatagagaataaactagaaaacgtaatacatcctctttaaaacatcatgacgccaaaacaaacaccttggtttcgatggtggcggaagaaaatgtggcctctcaagataagaggcaaggctgcgctgcacatgggaagcatggggtacggggcttgtctactgtgtgttttctttggactaaaattcaatcacaggccacgttgtcagctatcctggtaagccagtgacctcaaataagatcattttagtgtcccagcgaggtatgttcctgcaggcagggctcctgccccttaagcttatcccagaggtgtgagcgtctccgagactaatatacagtactggcatttagattctggagtatgagcaagtatttgaaactggagctttaattatcttgcgctggaaatcaaaagtctgtctatcctcgggaccaaagggttgttttagtccctgccttctctttcctgtctctgtgagaaaactgttatcactgtctggcaggctgctctgcttcatgtcctgggatgaaggttgtggggacagtgggaaggacacgtttcccatggggatataactggctcctcctttgtacaggacgatgacaggccaatgattgatgtcatggatcagctgagttcttccattcttgaaagcttcattcatgtggcagtttcagattcggtaagcagacgtgtggtccccaacgctatctgatgtcagttataaatcctgagcctctctcttaaaacagagccaaataaaaaccctatgtgtcaagcctctcaaggcagattaataacctgagacccagatacctaagaaagaaagattagcttttcaaaaaatagcacaggacaggtctgaaaaaaaaatttcatacaaaatttgaactttagaaatacaggtaatatttttgaaaacttcaatttcaaataactagccttaaattgttatttttaatacataatctttgtttaattttgtacttaatattttgtattacagcagtctcaatacataagttccactatgtgttactttatagttcccaggatggttttatttttagtacctttgaccctcacagttattaaaactcagaagcattaagccaggggttagctcagggcacaacactttgtttttcaaggatgggtttctctgtgtagccctagctaacctggaacttgctctgtagaccaggctggcctagaactttagagatctccctgcctctgcctcctgcatgctgggatcaaaggccccggtgacccttaagaaacctaaaactagacccaggaatggaaccttgagcctgtggtgtgtggtacaaatgcctttaacctgagcacttgggaagcagaggcgagtgaatctctgagttctaggccaccctgctctatatagtgagagctcgtctcaaaaaaaaaaaaaaagaagaaggaggaggaggaggaaaaggatctacaacctaagatgacaagtatttagaacatggcagattttttaccacagtactagctaaatgtaagcctctagctgcatacgctaacagacatcctcctgcctctgcctcgctgggaaagcgtgtgtcaccactacccagcttagctatctatcctttaaaacagaaaaagtccagtgagcagtcttggattcattccagctccacaaacagggaagtctgcggggagggggggggggtcactgaagaacacacttagctggtacttagcactgatgcctgtcacatatgcaaatgactgcattgtggaatctgtaaactttccacagactttcatgacacagaacacaaaatgctaattttgggcaatcacaatcacgataatcactaaggccattggccaggcacagtcagaataaagacgtatacgttctcttatgttacagttgtcagaacccgacgtggaagggctcctatagttcttatacatgcacatctgcctttcctgtagatgactgtcatatatcctcattttcttctgtatttgctagactcagatcctaagcatgtcaccaggtcagcatcctgcactctgttcagcaggtgagcacgcacaggcgttggatttctgtacccatctgattcacaaagactatcaggagagattacttacagctgcttagtcatgaatgcaggagatgtctgtctctagagtcagtgatctccccagaacccaggtttagggagaccacttgataggatctcatctccctggctctgaaagtccagttctgcccccttctagcccagtgacttatgaaggccagacagatccataacatttacctaggggagttcatggccccagcaggtgaaacagaacactcaataaatgcctaactaatggctcgcagtcttggcacatgtctttaatcccagcactcaggagtcagaggcaggagaatctctgaattcgaggccagcctggtctacagagtgagttccaagacagccagggctacacagagaaaccctgcctcgaaaaatataaatacatacatacatacctaacaaaagagcaagcatccccccaccccacccctgctttggaacaatggatatgctgtttgaaaactggtattgcctaaatattgatgtggatacttaaaagacaacaaagtgagagaacttatcaattcacacatatatattttaagagaagttttgaagtacattggcttgatatcggagggacagattaggtatcctcttaaaaatcatcgctgggatcccttcatacaagggaaagtaagtgttcaggtgtttctaaagccccggcaaggtgtttcagtgcaagtaaagacagaaaacaccacgcacacatcacacaaacaaatcacaggagcaaaggcacaggtatggatcccacatgtggattgcgtgttagggagattgctccatggcgaagaacacttacttccagaagttcagagtttggattctcagcacccacatggtggctgtacaggctggttttgtgtgtcaacttgacacaagatggagttatcacagagaaaggagcctcccttgaggaaatgcctccatgagatccagctgtgggtcattttctcaattagtgatcaaggtgggagggcccattgtgggtggggccatccctgggctagtggtcttgggttctataagaaagcaagctgagaaagctaggggaagcaagccagtaagtaacatccctccatggcctctgcatcagctcctgcttcctgacctgcttgagttccagtcctaatttcctttagtgatgaacagcaatgtggaagtgtaagctgaataaaccctttcctccccaacttgcttcttggtcatgatgtttgtgcaggaatagaaaccctgactaagacaccaactgtaactctagctcctagaaattcattgccctcttctggcctccacaggcaccagacacataggcatatgtttgggcctaacattcatatccataaaataaaaacaaattttagaaaagcacaaatctgtggtcacatttaaattgattaatatcatatatcgtcacataaatgtttggtaaccatcctctgacttcaaaacttaaaaatatgattatagctaggccttggtggttcacacttttaatctcccacaccaggcccacctagtttacagaacaagttacaggcctgcaagagctacatcgtgcttccttgtctcaaaaagcaacaacaacattgaaaatgattgtaattgttgaaagtcacacttactgctgctatggctggcagaggggtgcagctgactcggacagggtgtttgttaaatgtgatgggtgtcccagatccaaagctgattcgtggcatccgaggttcggaaaggcaccgtggaaagaggggcagcaggtcgagccctggtaaagtctgccaagcctgattacatttggctgcccgtttcttgccctcaggcaacactacctccgacccacaatgtagatctccagtggttggtggaatggaacgcggtcctggtcaacagccattacgatgtgaagagcccctcccacgtctggatcttcgcgcaatctgtcaaagacccctgggtcctgtgcctcttcagtttcctccgtcaggaaaacttgccgaagcattgccccacggccctcagctatgcctggccttacgccttcacccggctgcagtccgtgatgccgctggtagacccaaagtaaggtgcccgtgtgcgtccaatgcttatgattggttctcttacattttcattccacgtaagaggttaggctaccataatcttctctaatttttaaaaatttcctgctatagcattcttagtacatagtagagataaaaatattctgtctagaacagggtttttttttcttttgctttaataatcagtatgactaagtataccagtataggaagctctggctcttaatcccgagatctttaaaattcttctgtgtgtcctctcatccttgatgggcagctgcctaatttcttgagccctcctaatgatctttatttaagaagtgatatttacagcccggcataataatatatgcttacaattctaacactcaagaggctgagatagaaggatcgctacaggatcaaggccagccaggctatgtacagaaaggcctgtatagtgagattctagctcaaacagaacccctaaaactcatattcaaaatcaagaattggagagacagttgcacacacggctctcgcagaggacccaagttcagttcccagcacccaggctaagtgggttaaatggctcacagctgcctataactccagctccatggggatctgctgccctcttgtggtcaccataggcacatgcatccctgtatacacacacacacacacacacacacacacaataaaaataaaaataaaaacataaaatcaggaatttagttttaccgttgtttgcctccacatctatagcagcccagtcaacgccaagaaaaccagcacagcgagcagcggagacaactatgttaccttgtggagaaattacctcattctctgtttcggagttgccaagcccagtattatgagcccaggacacttacgagcatccactccagagataatggcaacgactcccgacggtacagtgagctacgataacaaggtgacatgacatgcttcaggggaattagtctgtaagggttgctttttagcttgttcatgtagcgtttgttcccagtgcaaatcacactgtgcctgccatctgcattagcgtggagtctgacttctcatctaccacatttccagattccattgagcatcttctgggaatagtttcttgcccctcccctgcaagtgtggaatggaagactgagagataaggacgattgccaatagtgtgttcagtgcctcaaggctgggcttgtccactccgggcccagtttccctcttcaccaattgaatacctcaaaaccacaactttacccaatgatagttttgttgacttaaatagtttgaaaaagaaaagggcagggttttctttaggacttgtatcccaggtagaaaataattgtactgtgttagatatatgttcatttgtttgtttgtttgttttaatttttatttttccctgaaatgatggcagcgttttggaatgtgactcagtcacctgttgttgcctagttaccgtgttacctctttgtcacttcaaatctcctcgttccaggccattggcacaccatcagtgggcgtcctgctgaagcagttggtgcctttgatgaggctggaaagcattgaaatcacagagtcccttgttttaggatttggaagaacaaattcccttgttttcaggtatgactgtcccagtacattcttcaaaaccatacatgctgctgcaattatagctgtttctcttaactcaagcgtgggggtgcccggtgccagcgagtgctggccggtgctggggtaccagtgggctgtgcatggttttctttatgcctttgtttgatgtgcaggtaaacagccttcctttttaaccctcaatttttattgcatttgcaagctttgtcctgggtaactgtacgtaagataattccttatccatctcccattaaccagacttttgcgaggctacaataccaaaatgagggtagtgtgtgaaagcattttgtacttctaaatggttttatagtcacatatctgaggaggatggaggcaacacttgttaaacaagagtcaggaaaggggactccccaaacatctcaccctgacaataactaagaatacaagttttcattacaagagtaccaattaaccaacatttagccattcattaattatttagatctgctttaaaaagataactcacggttcctgaattcagcgttctttccaagagaacgcaaatccccgtgtatagcttatcctctctctgtgatcctggaggtagatgctgccatccattcagctaaccaacagcaggagtctaaaacatctccgcaagcctcaggttgcacagctgcaccagtaactcagtggttcagagcactggttgctgttgcagaggacccaggttcgattcccactgcccttctctggcccccgtgggtactgcatgtatgttgtgtgcagctgtgcatgcagataaaacacatacacatataagtacaagtaatttttaaaaagtttttaaatcaatcaattacatattaataacatattagtgttatcatatcattatattaatataatgtcctttggtatcatgctatattgtgataatttagtgctattaacatgatatgttattaaatgagattttttgataaattattagagcaatcaagacaaaaatctcagatttttctctatcagttcagagtagattcccatagccttcctggttccctggagagtgatagaggtatcatgtggaagttccaaacttatctagctgcgagttagatctcacatctgcttaaacatgcaattcagaaatgatttccttaagaagataatttataacaagtataaatgatagttggagacttggagggcaaatgagaaccgtgtgtgtgtgtgtgtgtgtgtgtgtgtgtgtgtgtgtgtgtgtatgtgtgtgtgtgtgtgtaatacatatacacaaaagatatagatagatggatagatagatagagatataatacacatgtaaaatatatatagtatatataggtgtatacatataatgcatatataaaatacagatatgtcttagttaggatttctatttttgtgaagagacaccttgaccatggcaactcttataaaggaaaacatttaactggggctggcttatagttcagaggtttagttcattatcatcatgacaggaagccagacagcatgcaggcagacatggtgctgggggagaagctgagagttctacatctggatccacagacaagcagccaaaagagactgctacactaggcctgacttgagcatctaagacctcaaagcccacccccacagtgacacacttcctccaacaaagccacacctcctaatagtgccacttcctatgagccaagcattcaaacacatgagtctttgggggctatacctattcaaaccaacacaatatataacacagagagaggtaatacaatatatattaatgttatcaaaacatttttgctacataggaaaggttttaacaaaaactgatattttgtcccttgctatagtttgcgtctatcagataacacaagtgtaattactctgaaacacaggtttcatgttttaaatctcgtatgtgtcagtctcctgagtatatctctaaggtagttcaatattgatcctctccttccttctgattggactgacaggtttatttgagggtagagactcaatttataattattttcagtttctggaagccagtcctgaagctccctgcatttggtaaacacttgggagatcctgtgtcgttgttcagatatggtgttctgctcagtacatatgcacagcatcagaatgagggctgtctgtgtagggcaacacccatgcatatgtcaccggaggttttggttggtagccaagtgaaataattacattatttaggctggaatggatatgttgatgacaagtcttatatcaataacaacaaatttcaaatatgaccttttccctctgtagagaattggttgaagaactccatccattaatgaaggaggctctagagagaagaccagaggtaaggtttggaatctccaccatgagggcctgactcatttggacagtggtgtgaatcttaagtcagctttgtcataccctaaagaatacaaacaccccaacctgttcctaacagtgagccttgctatatagtacattagatttccaatagtcaaataatttgtgtcttaatgaattttctaaatgcacaaatgcaaaaacaactcaagtaatcacatggttttagttttgcaaaagagctaattcaaaatctaattttggtttttagcttgcttgactttgttgccatctttattaacaagccaggatcgaggagaccagaattctcttacaatatatcaagattgaaaaataataagattaaaaaagaaacttccaataaatatgatacaagaaacagcaacaacctggggctggggagagctcagctcttaagagcactggctgctcttgcagagggccctgggtggctcgaagcatccccaacttcagttccagggactcagatgccctttctggcttccatgagcactgcacacacaaagtgcacatacatgtaggcaaaacacccatatgcataaaataaatattataaaaaagaagcagcagaagtttaacagtctggagatcaaatagcatgcactccctgagcagtctgggaattgtcagcatctggagtccgctccagtcgctcccgaatgctcagcctttcaaatgaccctggtgccttggcaccttgcacgctactcaacacttccgcctcatgtattcttaggggtttactgacgatgttttccttacagcctgtgataactggcattgtccccacctcttaggaagaaaggacagtgcttcccttttacacttagaaaacttgaaaatactaaattaggccgtaaagttcgcattgtattatccataactgtaagtggctttccacgcagaacaagaaacgccgagaacggagagatttgctgaggcttcagctgcttcggatattcgaacttctggcagacgctggcgtgataagtgacaggtgaggttaaatgactgagcaccccccacccagccaccccttgccgaaacctcttctacttctccttgttcttttaaatatattacttcaacaaagatttctggcaagccgcccttacctttcttcatacccctgtataatgtgcataaaaaccaaaattgccacgtgaactccaaccatcgatgcggtcctcgttaaacacctgctcctctgttctaacaccctctcccttccatcccagcacaaatggagctttagaacgagacaccttagcgcttggagctttgttcttggaatacgtggacttgacccgcatgctcttagaagctgaaaatgacaaagaggtcgaaattcttaaagacatccgagcacattttagcgccatggttgccaacttgatccagtgtgttccaggtaatccattccttcctctgggctgggtaaagagttccagcccccaccgatgtccctcctgattcctaggggcctgaatagagctctagggcagtttctttgttaattctgagtaattataaaaacaactcgtttcatgtgccattttcttattttgacattattaaccacactgctccacctcagctgttagggggcttaaactacagtttaagcttgatttctttggtaataggaggcacatgtttttgaaatagcatatattatattctatgtgctctataacaacagggagcagtagtcacaaaaattcattctgtatatgcgaaagttaagtggaaagatcagttagaccagcagttctgaacctgtgggtcaccatgaccccttttgagggtcagatgaccctttcacaggggtcaaatgtcagatatcctacatgtcagatatttacattataattaataataggagcaaaattacagttacaaaatagcaacacaataattttaatcattgggggctcaccacaacatgaggaactatgttagagggtctcagtgtgagaaaatttgagaatccagaaagaaaaattgtattgaaatttatttaaaaagtcaagattctgtaactaaagaaaacgggagttactgggctggtggtatagctcactgggagagtgtgcgttgaacatgctcaaagccccatgttctattcccagctccaagcaaaattcggcttagaaaaataaagttggttcttggggacggagaggttgggtcagcttctgcccttgcacaggacccaagtttacttcccagtgtcgggcagctcacatctacctgtaactccagtttcccgtgatccaatgccttcttctggcctgtctgggcaccagcactcatgtgcacttacccacatacagaaaaacacatatacacataattaaaaataaaaactttaggagattttctttctttcctcaaaatttgagggtaatattcagtagtgctacaattatatattcagcctaatatagactaacaacagtcaaataacagacactggttttgtgttattctctctagttcatcacagaagatttctcttcccccagcaaagcctacggcaccatctcttcatcttgttcagccagtgggctggccccttcagcatcatgtttacacctctggatcggtacagtgaccgaaaccaccagataacgagataccagtactgtgctctaaaggttggttagtagcatcagcggtctcctttgttaagctaacaaccataccttaaaaataaggttacaataagtagtataatacaataaaaatatagggaaggatataaaaattcaaatggatatatgcatgcacatgtaaatataaataattccaaatatttaattgcagatgtgggtaaatacataagcacaccatctgggcccacaattacacaatgtaaaattgcgtcgggttcctgcctttatccagtgtttcttcttttgcctatttatccctgaagttactatgttgctacttaatttccagtctaaggaggagaaaaaatggtcaagcaacagccacactctgtttatctagtcgtatcctggacatccacactgtgaaaaccttcccatctgaagcagtgtgggactctgtgtcacttacttctccattaccgggatgaagtaccatggctgaaagcagcgtctagaggactgagtttatttctgcctacagcgtcggaaggctggggttcacaggaaggctggggttcacagccgtgcaaagggagctgccagtctccaccacccacacaggaagcagagaacgcaggaaacctgctgctctggttccgtctccaggtttcacggtttctgatttcaggcaatgtcggcagtgctgtgctgtggccctgtatttgacaatgtcggcctctctccggacggctatctgtataagtggctcgacaatattctggcttgtcaagatttacgagtaagtatgggtcaggaaggcattgcttttcaacatttttgaggttagcatgatgcacataccaccttccctccatagtcacacaaatttggatatgtacttaggaacattgcagtggggtgtaccaggcccaaaagtacagcatccattaaccaaattgaccaaaaactgaatcataaagtgaggctcaaaacagtttgcataatttgaaagcaacctttatactctgtatcattaaactgggaatgagtaattaaaatatcattaaaatgtacttcccgggagctggaaagagaatgtgcagcatcaaagagtgtgtgctgctcttgcagaggacctgacttgagtccccagcacccgcactgggcggctcacaaccaccctaactccagttccagggaatccagtgccctcttctggcctcctcaatcacccacaaatacagactgtgtttgtgaacatgcacatacacataattaaataagttttaaaacaatatatgcttccagatagctagtaaattgaagtgaataacagtggcaactggaaagtatctttatatggaacatgatgaaatattacatttgtggtttataaataaagctgtgcttaaagtgaagtgacagggctggagagatggctcagtgggtaagagcactgactgctcttccagaggtcctgagttaaattcccagcaaccacatggtggctcacaaccatctgtaatgggatctgatgccctcttctggtgtgtctgaagagagccacagtgtactcagttatataaaataaataaatctttaaaaaataaatgaagtgacatatctagagatagagatagatagatagatagatagatagatagatagatagatagaggacaggaggacagtaatttgcagcctgttcatcactagaaattactataagaaatagcttaaccaagtctgaaaaaaaaaagtacagaaattaactaggggaaaattttaataacaatgaatattatattactaacgtttccactcctgtgacaaaataccttttaagggagtttttaaaattataaaaattgtatttacaatttaaaaaaattttaattgtattttacggagaaaatttaagggagaagaaaatcattccagcacatcactgtgggaaagacgtggctgtcagaggtgactctggtggggattataagactaaatctgttcacgtgtcctggacctggaagcaggcagagaaagctagccaaccagggttaggtatgactttcaaagactccccctagcgactgccagccaggccccacctcctgaaagctcctgagcctccgatctggaaaccaagctttcaaacacgaacctggggggcatttcaaacccagaatattaatacagcagatacataagccaggcccttccttttcggcctgattgcaactacggaaaagagtagatggctaaggaaagaagcaggcaatgttaccttctgagggggatggagtctcccttcccagagtccagtggagtttgcatcctgccggcaaggctacattgcgcccccttaaggaagatcgagaggcacaaagatcagcccaaataaagtgtccagccccacttaaccccacttaaggttgttcgcctgacctgtattagttacgttggatcgtatggatctctctggaatattttctgatgaagtaggaatagctgatttgttcctcatcctcaggttcatcagcttggctgtgaggtcgtcatgttgctactggaacttaatcctgaccagataaaccttttcaattgggccatcgaccgatgttacacaggatcctaccagcttgcttccggctgcttcaaagccatagcgactgtgtgcggaaacaggtataggttttctgtaatcagtgttcagtggcaagggtgaaggcaattgctctctgtgatgtgagagctgagcagatgatgctcggccgttatcttcagagtgtgacagcccagaatggcttctgtatccctcacagataagctagccgctttaagtttccatggtattgctaattccatttgatcaggagatattccttatatggtctttccttcaaagtgcccaaactgtcacagtggagcatggaagcaaaatttgaaaataataaaaacaatgcactgaaggaattaaagcatctatgtggacaagtgtcccaacacatgttaactctgagcccgtaagccagctgcccacaaacccaggaaaatcccctctgctcaaaacttcaagaagcatgtgggaaggaggcacgatgcgtcagaggctgagtattacactcatttgaacttgtactgatctgagcccagggtctcatgtatgctaaaagtgttctccaccactgagtcacaccccagcccagagattatgcctcgaaagccaccaaccttatcatataacaagcaagttcatgaagctgtttggcactataacttagtaagtgtagtactggcataattactttaaattccccaagttgcgtaaactactcctaagagagagcatatggattaggatgatggagagaatagaaaacagtagaggtttttgttttaaaagcttcatggagggactggagcaacacctcagtagttgatagcatgtattgttgtcttagtcagagtttctagtccaagaaagaagcaagttgggggagggaagggtttattcagcttatacttccacactactattcatcaccaaagaatgtcaggactggaagtcaagcaggtcaggaagcaggagctgatgcagaggccatggagggatgttacttactggcttgcttcccctggctttctcagcttgctttcttatagagcccaagacaaccagtccagggatggcaccacccacaaagggccctcccaccttgatcactaattgagaaaatgccttatagctggatctcatagaggcatttcctcaagggaggctcctttcggtgtgataactccagcttgtgtcaagttgacagaagaccagcctggtctacagagtgagctccaggacagccagggctacacagagaaaccctatctcaaaaaaaaaaaaaaatagatacataaataaagacagggcaatgtcattggtgaggatgcaaatccaggtgccaccccagacgtgtccagcttacaagccaggatgtcctctaaccatgctgtgtatttttcttcatttccccaggaactatcccttcgacatagtgacactgctgaaccttgttctcttcaaggcctctgacaccaacagagagatttacgaagtctccatgcagctcatgcaggcatgtatcatccacacatgtggaaatttccatccttgggctcaggatgcagttatctgttcctgcgaggaaacatgcacagagtgttctccagacagagcagttaacctactcagtgtgaagatgaacgcacttgccgtgttattacaagcattcctgaggtgtccagatgacaatctttaaagcctgttcctttactcctcgtagatcctcgaagcaaagctttttgtgcactccaaaaaggttgcggaacaaagacctggcagtattctatacggaacacatggaccgctgccacctctctacagtgtgtcgctagcccttctgtcgtgtgagctggcccggatgtaccccgagctcactcttcccctcttctcaggtaccacccagttgtcataccaactctgtcatcgtctcctccccaactcgaggagctttcctaagtccgttgcagtcttagtgaaattgtgccagacactggtgataaatctgtgtatcagagttgctacgggataaatctagttacatatgacagcaaattcaagaatatttttaaattttttgttctatgtatgggtgttttacctgcttacatagctatgcacctgtgaatgtagtgctgatagaggccagaatgggtgccagatgccctggaactagagttacaaatacttatgagccaccatgtggggtcctgggacttaagcccaggtcctgtagaagcacaacagtgctcttaatcaccgagccatccctccagcnnnnnnnnnnnnnnnnnnnnctattatatgaacaacacactttaaataacccttaattatttatatatttggtaatgttaaataaatagtcttcttttttaatttatttatttattttctataagtacactgtagctgtcttcagacaccccagaagagggcatcaggtctcattacagatggttgtgagccaccatgtggctgctgggatttgaactcaagacctctcgaagagcagtcagtgctcttatctgctaagccatctttccagcccattatatagtcttcttatattttatattactacagtgatattgtagaatacatacaacttgcctcctctgcagtcttcatgagtaacttgtgagaatcaggtctcaaaaggtgttttcctgcctaagtttatgtagcaccttgccaagagacagtctatggcctaggatgtacctcattctccacctgcaccccaatacctcagccctgttccccctcagctttccctgcctttggtcatgtgctctgcactgcagttcttcagtatacaaactcacatctgtacaaccacatctgtacagtgcttcccacctgcacatctctgttcagccatcctgaaggaacgctaataataacggcttgcaattagcgggtacctagggtgtccaaggctctctgctaggcccctcgtgtgcattgcttaaagtgcgatttttgaaccagaaaggccgagaaaggctatccaggcaggctgagctgcagatagacagaggaaacttaccaggcagccaggaaggtgcctggaatcggcagcccaagggaacaacacatgacttgatttaaagcagcagttctcaaccttcctaatgctgccactttaatacatgaggatgttgtggtgatgcccaaccataaaaactactttttgctgcttcataactgtcattctgctactgttgtgattcataatgtaaatatctgatacgcaggatgtctgatttgtgatcccccaaaggggttgtgatccacgggttgagaacagctggttcagaggcatagaccagcacagtacactgggaagttgtatacaggacagtgtgactgacgttagagatggccctgggtgggtgctcgttgatctacttcagagccctgtggggaaagtgcattctcagaaagctgctagggctttgaaagccactgacgagtccataaaacactaaactggaagccatagtatagtcagaagacctgatgtggaccggtgtggtccccagaccggtgtgggccctgggcttgcttctgctgtctctctgaattcatatgagcatgttcatctagaggcccttgctctcctgggcctctgtccagtctggctcatcttccacgggctaccctgagctcagaagaaagggatttgatggagacatctcatttagggcccagtgccccaagatctctctctcctctgattgacgtctgatgatggccgaaccaggtgctgatctatgagtataacacaatgtcactgggggtcatttatcactacaagttttctttctttctttctttcttccttcctttctttctttctttctttctttctttctttctttctttctttcttttctttcttttcttttccttttcttttcttttcttttcttttttagaccagtggtatttggttttaccagaggtctctgggctatctagtctcaggttcttggacacccaagcagttttgggcattggaatgggcctaaaatcaaatcagttattggttggttaccccccaagctttgtggcaccattgccccagcataccttgctggcaggacaccattgtagatgaagggtttttgactggcttggtgtttatgtttttattttgataccatgctgagtatgtccctgtatcagattccaggacggagggatgaaggctctatgtggacactgcagtgaattcttcagatgttgtcttacacaatggggccttgctttgtggcgagcaccctatagtcttggcaacagcctgggttgtttggggattcctatgggtcccctgtggccatcaacccagttagatgtaatccaatctcagtactagaagcctcatttggtgatgagaggtggccagttgggactcagtcccactatctgactattttacttatatcaccttcatataatatgtgtgcatttcaggaagtttctactgtaataagagcttcgcatttttatgggattcccaagtgggcaaacaaatgggtctctgattcttgtgccctctcttgggctcttttccttctgttggtttgtcttgtccaaattcaatatgatagattttgttttatattattaatattgttttatttggttatattttttaatgaataaatgaagaatgaatgaagaatgaataaatgaatgaatggaaatctagtcactaggttaaaggttaacaactgaactatcacttattcttctgggaaaggggaaatcagttttccccaacagagtgacactgggtgtatcaacaactccaggacaggcctcgtgctcaggagcagttgatcagcatataatggactctgcaggggctgggggaggcttttatttacttacggtttagagttttgttttttgggcgcgggggtggggatcttgttttgggggtgttgtcacattgggttttcagttttttgaaaaagaacttaaagttgcatagatagagcgggggagaggatctgggatgacttagaggagaagaatttttttttaattaaaaaattgttttaaataataagagagaaaagaaaaaaacttaagagccatagaacgaaggctgtgttggttgacagacataaagctgtaacttttcagggtcaggggatactcttaagtttgagaactggaaaataagcttcagaatggtcaagtttctatcacagggcaccattaaataaaaggaaggaaggacaaacagactgctgagtttaaaagaggcagaaagaaaggaagaaacaaacaaataaacaaagactgccgagtttaaaagaggctgaggaaatgacacaccaccatgcatttgggaaagagcggaagtcgcattcgagcatgcagtctagagagggccctggttgggaagggtggctgtaactcaaagaggaaatgatgtcataagggcctgaccctggaggcggggccagagttgctgaggaggttcacagacagatgtgctgcctggaagactgatggtgacccctacccagtcagcccagagcagggagagcaggggtgtagggcaaggcggacacagagagccagcctgggatgctggggtagggcctctccagaatagacagacagaccagaatgcaagaggcggggcacgggaggtcaggagtggcagagcatggagggaaagaagccctcaacaagcgccttttgaataaggaggaagggatggaagagggttggaggcgtcatgagggagtcatcctggaggcagttttcttcatggaaacctagataaatgaaaagattaggatggaaggagtgatgctcatcctccaaggcgagcaatcccagtatgtcagggttctaaggggaggtgcgggcagaggtcaggttgcaatagcctgcaaggagaggaggcagacagagctgggacaagggtggctgcaagcccaagaggagcatttacgcaagagtaagacgggaaacagcttattagctgatatagggagctgggaaagtggggggcagcggacagctggggagaggggagataaatccaggccgacaggcagcagagccccaagaaggaaattgaaccattttgacgttcttctaagccacccccgctcttgatttatgaagaagctttgaaaagaacttgaaaacattaacatgacctagtgaattcctaagctgcctgcgctgctcaggccctgcggtgaggctttatttcctgtaacttcaggtggcctaattacttccaagcagccagacaagatgtttgggtcccgcccaacgaggctggggagtataccctgagcacccgcattttatttcatttctctgtgtatcttccagagagttgattcgggatccgtggcatcttcctttctcttcaaaaacgtctccacaaaccaaggtgttcatcggcccttctctcacaactctagccggcaccccgatttggggggcgggggtcctcatgtccggcacacaaattgcaataaatgtaataaatgagcttgtgttccatgttagaacttggcattgtttaaaaataggtatttttaatgtttctttctctggaattggatttttgtttttctctcttttctctcttctaaagcatggtctttcctatggagcataaacaactcttccataataaaattgtatttttgtaagtggaaatcattctctgacaagatcctcagctcggtgccttctgttacctgtcgctttctcccttgcccctgaataatttgtcagtgtaatttgtcacctaggatcttctccaggctcaggaacttttttttttcaaaaaattattttgagaatttcataacataactacatctatataatctccatcctccccctaaaagtcttcctgtgtcccctctcgacccctataaatgtcgagacctcattacatatatattaatgtatacatgcatatactattgactatagaccctatcctgggttccttaatgtcccttgtatatggctgaccacattcctgagatgttctggctgttttcattctgtctagtataggagcttgcactaatgaatgctctcccagcaggattaatggatgctctggtacagtaagatgcaagtgtctgacgtcatagccagagcatacgtgtcatatcatagtgtgtgtcaactctaagtcaaatactctagggaccagccagatggctcagtgggtaagggttgcatgccacaagtctgacaaccaaagtttgatctctgagccccgtgtggtagagggagggccagggcatggactcctacacacagagaaagatggttcagtggttaaaagcactgactgctcttacagaggaccttggttcaaagactatgccctcttctaacctctgtggtaatcttggtgggcaccaagcatgcatgtgatacatgtacatacatacatatacacacacatacatacatacacataaacatacaagctagatatccataaaataaatataagaagaagaaatatcattgtttaaagtaagaagaattaagcattttaaaaatttttccacttatgtaaaggaccaacagcatagcgccatttattgtaactttaatttggggggaagggctaaggcaattaaagtttctgctggaggcatccaaagggttgtgccgagtaatttctggttactgccttgctctgttacttagctgctaggaacaccgtgagtgaggtcatgacctatgctggctagttgtgcaggcacaggacaatacttcctaatttctctttggataaagccaattctcttatagagctaaaaggtgctactgacactcactgcatatccataaagctgagcttctgactgtacagctgagcttctgactgtacagctgagcttctgactgcacagctgagctctgactgtacagctgagcttctgactgtacagctgagctctgactgcacagctgagctctgactgcacagctgagctctgactgtacagctgagcttctgactgcacagctgagctctgactgtacagctgagctctgactgtacagctgagcttctgactgcacagctgagctctgactgtacagctgagtttctgactgtacagctgagcttctgactgtacagctgagcttctgactgcacagctgagcttctgactgtacagctgagcttctgactgtacagctgagctctgactgcacagctgagctctgactgtacagctgagctctgactgcacagctgagcttctgactgtacagctgagctctgactgcacagctgagctctgactgcacagctgagctctgactgtacagctgagcttctgactgcacagctgagcttctgactgtacagctgagctctgactgtacagctgagcttctgactgtatctgactgtacagctgagtttctgactgtacagctgagctctgactgcacagctgagcttctgactgtacagctgagcttctgactgcacagctgagctctgactgtacagctgagctctgactgtacagctgagcttctgactgtacagctgagctctgactgcacagctgagcttctgactgcacagctgagctctgactgtacagctgagcttctgactgtacagctgagctctgactgtacagctgagcttctgactgcacagctgagctctgactgtacagctgagcttctgactgcacagctgagctctgactgtacagctgagcttctgactgtacagctgagcttctgactgcacagctgagctctgactgcacagctgagcttctgactgtacagctgagcttctgactgtacagctgagcttctgactgcacagctgagcttctgactgtacagctgagcttctgactgtagagctgagcttctgactatacagctgagctctgactgcacagctgagctctgactgcacagctgagcttctgactgcacagctgagcttctgactgactatacagtgacactgcccatcactgctcaggatcctgctaggaaacaggtgttgtgctggcactgatcaacagtgtgctggtgtcactatcctttgccgttgtgcagtgtgagaccccacgtagggggttgctctcattttcctgatcagttgatgggagctcagggaggttatttaagtggctgagccacacagctgtgcatgcagccagatatggtgaagttgggactcaacacatgtcctgcagacgcccggtacactctgttactccttatctactaacagtgtgtttgaactcatgacgctttcatctcagtccgtgcttagcagcctgccccgcccacttcctgcacagaggatcaaggatgagccctgctctttgctcttgtcctggatagctattatatacagtaatctttttactgaatgcaaaccacttttggagcagtatacttgtgttcctccttagtttgctttggagaatagtgtgtaactgtcctttgccctgtctcttcagaggtgagccagagattccccacgacacacccaaatggacggcagatcatgctcacctacctgttgccatggctacacaacattgaactggtggacagcagactcctcctcccggggtccagtcccagcagtcctgaggatgaggtcaaggaccgagaaggagaagtgactgcctctcatggactaaaagggaatggctggggctctccggaagctacctctctggtcctgaataacctcatgtacatgacagccaaggtacctcatatagcatggctccatcagcagggaagccctgggttcacaaacctttgccacaaacccaagaaaatagtgtttatcataaaatggttccagaggatgttgagtggtggtggtgggtgcacagcaggacacttagtgccactgaattctgtacttaaaaatatgtacaatgctagagttcaaaaccatcctcagctatatagtgaacttagatccaggctgggctgcatgaaaccctgtttaaaaaaaaaaaaacaataaaaggaaacaatgttcatgatgttgccagggtaatcttcctttttttcccctcagtatttggtaaagaaatataacattgtatccatggtaatatattcctgttttagttgttcttgcagaggatctgaactctattcctgatttctagttttgcatatgatctaataactttgtgagttatgatagttgtataaacaggtaagcttatgttcaaaggagcgggtaaacatggccttcctcgtttgctgtaaaaaataagaaaataaaaagaattgtttggtgcacttaaaaagtgtttttcgtaaggacttgggatgtatcttagggtagaattcttgtgttgaatgtagggagcccagggttcaaatgccccacagtgcaattaaagaatggggggattatgatgcaaattttagagagatagatagatagatacgtacatacatacatacataggtagatagatagatagatacatacatatatacatacgtgtattgctgcatagataaatagatatatagatacatagatagacatatatatacatacatacacacacatacaaatatagatatcacatattttgggggaaaccatggcctacattttaaaaaaatgtttgtatgagtacttatgtagctgatctatgtattgtaagttgtcatccaccccaaaatgttgtttttatcaaatagtcatttccaccctggtaataattttgaacaatcataaccctttacaacaacttattcacaaactcatgaaggctgcttttaatcttgtctgagtcagtatggagatgaagtcccaggagcagaaatggagaacgcttggaacgctctggccaacaatgagaagtggagcaacaacctgagggtcacactgcagttcctcatcagcctgtgcggggtcagcagcgacaccatcctcctgccctatgtaagtgccacacaggttgacttctgggaatgctctctcgttcccgcaggggatcatccatgtactatgtaaaagctccttctgccccacccagcacaggctccatgtcaggcacgcctgtcagccccttggattgagctacaggatacaagcacctatgaattcagggtcattttcctgacagttactaaagcttcctttataaacagcaccagtaggaaagaggtcaaatgtaaaagtcaggactaacaaaaaatgcttctggtttgcatatgacattaaatacaacagacctgggattttatgtagatgactgtttgcctgcatgtatgtatgtgcagcatgtgcatgcagtactcatagaggccagaagggggcaacagatcccctggtatgggcattataatactgagctgtcatgtggagcaccctggaattgaactctgatcttttgcaaaagcaaccagtgctcttaaacaaagagccatctctccaacccccaaatgtgttaagagagaaagcaaagcagagctattggtagggtatattctgtttttacttgaggatggtggatgagcagaataacagccattcctaacagactcacttggcctctctgtgtggtttgtgagtttatgacttcctgttgttctgagctgcttcagccacgctgcaggttagacatcaggacctgcagttatgtgacacattgatattgccatttttaaacctaacactttacagagggctaaaacttatttgtttctaatgacaaagaggagaagaagtatcttggtcactattctgtgctgtgaagagacactgtgaccaaggcaactcatataaaacgtttaattgggggctcactgacagtttttgggggtgagtccatggccaacatggcaggaaacaggcaggcttggtgctggagcagtagctgagagctttacatcccatcgtatagacagcagcaagaagaaagggagagacttgggcctaggcttttaaatcctcaaagcctacccatagtgacatccttcccccaacaatgccacaccccctgatccttctcaaacagttccaccaaccggggaccgagatttcaaacctgtgagccaatgggggctattttcattcaagccaccatgggagagactgttttcccttattaataaaaatagcagttattttcccagagtggatacaattaatcgtttctgtcatataagtgccttgtgcctctggacaccagtaaaatcttacaatgtttttggcttaaatcgactcagttcaccctaaaagtaatgtttgtttgtttgtttgtttgtttgttttttaattaagccactcaagacagtgcctgtataaagtggctttaaccccaatacttgggttatccaaggatagcagagttcagttgttggatgaacagtatcagacggcagtgtgccccacaacgagggggttccagcccaacactctgatagaaagtataccttccctttattttctttttccaagattaaaaaggtggcaacctacctgtgtcggaataacaccatccagactatggaagagcttctctttgagctgcagcagacagagccagtgaaccccatcgtccagcactgtgacaacccacctttctatcgattcacggccagcagcaaagcctcagcagctgcttcaggtagggacaggccacctgggaacacaccctgtcatgccactgcactgaacaggtttgagtggctcttactctgtgttttcctgggaatgcattcatttaagagattgcttaagaatagctctctgagctgggcggtggtggcacacgcctataatcccagcaatcaggagacagaggcaggcagatttctgagttcgaggccagcctggtctgcaaagtgaattccaggacagccagggctacacagagaaaccctgtcttgaaaaacaaacaaacaaaaaagaatagctctctgaaggggtggagagatggctcagcagttaagagaactgtctgctcttctggtggtactgagttcaaatcccactaccacatggtggctcataatcatctataatgagatctgatgccctcttctggtgtgcctgaagacagctacagtatacttacatataatacatacataaatctttaaaaaaaaaaaaaaaagaataggtctctaccaggcagtagtggcacacgcctttaatcccagcacttgggaggcagaggcaggtgaatttctgagttcgaggccagcctagtctacagagtgagttccaggacagccagggctacacagagaaaccctgtctcgaaaaaaaaacaaaaacaaaaacaaacaaaaaagaataggtctccaagcacattgtaattggattaacaaatgacttcgtgaggataatcatgaattagtggcccagtgtcttccccaccacagggaattattttacattagacactgcagtctcttaggaatttcagttctgaacctgctgtataccttaatggagtctccttgctaacattctcccaggattgacttgaatattcagtgaaatccaaaatgctcaaaaatctgagactttttgaggactggcataataacccaatgagagctcaatgtatacaaactttgatcattatttttatgagatttatctatttatttttattttgtgtgtactgcctacatgtgtgtatgtgcactgtgtatatacaataccctcagaggccagaagagggcatcagaccctggaatgggagttacacatggtcatgacctgccttgtgagtatagagctctaaacccaggtcctccccaaaagcagaatatagttttaactgctgagccatttctccttccctggctttgctcatagttagaagtgtatagaactacctttaggtattgtgtatacgatcccgtatacataaaacagaaatgaatttcatgcttaaacttgagccttgcccctaagacagttctatcacacctgtgcaaatattccaaaactcaaaatagccaaagtctgacacatcctggtcccgtgaattctggatttcagatgctcaccgagtcttactgctttccgccaatttgtatctgttcacttcatgacaaacataactccttccctcaagtttcttgaagcttcccttcacttgatattgaatctgtttcaaccctgtcttttcctactctcgtgtgctctcagtttatcctgcctcttagtgaagtgggttgttttgatttgttttgtttttctcagcgagacactagcctcggaatcagaattctacttggaattcctttcatatcattagttggataatccctggacccataaacatagaaagtgcaagatatggcagtgcctacctttactgccagtgttggggatgcagagggaggaggggcataaactgaaggccagtccaggcttcatggcaagaccctgtctcagtgtcaacagtaaaagagattctgttcacagctgcagcagacctaccccatgtaaggtcacgacctgaggctagaagcctctaagaatgttatcaattcgttttatgaggaaggaggaatttggtttggccaacacagatgtctagaattctgtgccctgggctttgaaacagttgtttagaatgtctgcgattgtaaatgatgtaaaaaaaactgtcaagcaagggattttacaggaaatcctttcctgcgttgcttccgctctgaggcctcccgctctgcatactctgtctctgatgtctcccaatcccttctgcaggaaccacctccagcagtaacactgtggtcgccggccaggacagtttcccagaccctgaggagagcaagatactgaaagaatccgatgacaggtcagtgtgtgcatttggcttgatgtccgctctaacgttcagcaggagtctctgcaaaggcgtctgcctgagagtaagtcgggtttcctaattcataggaactgaagcccatcgaaatgcttgggaacacagactgacgttcttcacaaaatcagagagtacggcattcttctggtgcctgaatcctacttagacttggggttcataacaaccactggttggaggatggagaggttgctcagtggtttagatcatgaacccaggttctgtcaccagcacccacatgacagctcacaaccatctgtaattccagtgccaggagacccagtgccctcttctggctccatgagtactgtgtgttgtgttttataaagaccaggatatgttttgtagaccttagtatggtgtggcaggaggggatacttcagcaggcccttgatgagacatccctcccccagaggtatgacaggatgggcataatatagaatagagcttatttatttggggtcatgggaagagagttgagaagggaataaaggcagggaaaaaaaggagacagggacagggacacggggaggagactggccaggaacatgtggaatggggaagggggaaggggaaaaaggggtgagagagagaagaggagcagagagctgtgagggggttgagaggaggatgagggggaggccaaacagtctcttctatagtaagccaagcctacctggctgttgctaggtaactgttgggcagagcctagaaggaatgccaacactgtgcacacatggtacaaatacctgcaggcaaacactcatctgcatacaataaaaataaataaatctttgcagaataaaagacacatttgggggggggggcaggcatggtggcgcatgcctttaatcccagcacttgggaggcagaggcaggtgaatttctgagttcgaggccagcctggtctacagagtgagttccaggacagctaaggtacacagagaaaccctgtctcagaaaaaacaaacaaacaaacaaaaacaaacacattttaaaattattttttgcaagtaggcacaaaccatttgtaattagagtttaggcatgttatactttcaaattattgtatggtttcttaaatgtcttgaggaagttctctgtagcaacaatactggagacaggctaacttggaaggaaagaaattgacttagctcacagttgtaggtgtattctaaaaagcacagtttaggctttggcatagactccgctggctgcatcaaatcatagcaagagcatttgtgcgctctctctctctctctctctctctctctctctctctctctctctctctctttctctctctctctctcacttgctcgctcgcttaatcattcattcacctgcttttgctctcgctcttgctctttgtataaggccaccagaatgacagggtctccatcctagttcttacataatctagctatcatcccttcttttcatatacaaatgtgtataatttagaggccagattgcctcagagtagagagaacagggtatacattaaatgttacgtagatgaacggatgttttactcgtcgtctctttgtatacaaaacacccagcaatgtactgctgggtccatcttttttcctaagcatcttccttgtaaatgccacattgagatgaagtttccaccctcttaatgaggagggagagtcaagccctatgtgagtccatggagacagccagttcaacccacagcaatccccactctcactggacttgtactctatcacattcttttcttttttcccccccttttggttgttcaagacagaatttctctgtagctctggctgtcctggaactcactctgtagaccaggctggcctcgataccccaatgcttctgcctcccaagtactgggattaaaggcacgtgcaatcactgcccagctgctgtagcacatcttaattagccaagaacacccttttcctggggcaccaagaacccattctttcataggagccctgcaggaccctgtgttgcaaatgattgtgaagagagcaggggataaacagtctcagggttggtttggttggttggttggttggttttacttcctttcattctatgtgtatgctgtttggcctgcacataggtctgtgcattacatctgtgcctggtgcctgcagaggtcagaagagagcatcagcttctcctggaactggagttgtagatgcttgtgggctgccttgtgggtgcgaaggtcaaactgaggtccaatggaggagctgctggtgctgctaaccactgagtcatcctctgaccggactctgtaaattctcagtcatttatcttgtagactgagtttcccatcctcctttcctttgggatagaaaaccgctctgtttctatatcttaacatctcgtttcagggtctttttgtaccattagagttgtggaggtcctgtgtggagatttttgttatgtcccttagcgctgagaatcgggttatctgtgtaagataaagatgaagtagcattgtagagacattgtccttggaatatcttgtaatcacagtctcgggaagtagtggcagggaattgctatgagcttaagattgcattacagttccaacattcccccatctcaaggggacttgtttctgcttgattttggcttcataaccattatatgggacccctgtacatctgtctcgtcggtgaggtacaaagcatactgtctagcacgtgatacttttccccatgtcctcctgagccatttcttctttttttaaagatttatttatttattatatgtaaatacactgtagctgtcttcagatactccagaagagggcacttttcaggttctcaggatgaacatcttggtcacagccatagaactggcaaagaagggcatagtcacactgacccacagtagtcacacatatttaccaggcacatggcaatattctgatatttcaggtcagtcttaaattgtggttttacccactcagaggtatcatggcaccgacaatctctgtgtactgtcacctccggaaggttgacaccagacaagccgtttaacctccttcagcctctgtatccctatttgtaaagtaaataatccttacgtcaaaaatgagaggcaaggagctggagagatggctcagtggttaagagcattggctgctcttccacgggtcccaagttcaaatcccagcaaccacatggtggctcacaaccatctgtaatgagatctgataccctcttctggggtgtctgaagacagctatagtgtacttacatataataaataaataaataaatcttttttttaaaaatgagaggcaaattaattaaatgaggctgtgcgtctgacattggtgcagcccagctcttttctcataatcaagcaacaaacactcaaaatcaaaatcaatcaaaaaataagagaggcagacaaaatctcccaactatcacataaccaagaatcctctgagtattttgagggaaagtttaatttatccatagccccaggttgcttatgaaaccgccgcgtgtatctctgcctcttcctgtctctgcttgttgtcactgagcaggtctgactggccgccgagcctgtcccacagtcttcggataacggagccaggccatttaaaatcgtgctcaacttcattcccaaacagatgttagcttttgcagctggagcacagagttatcctaaagcattagtattctctcaaagtttggacttttccctatgaacaggacaggacctctgaccctcctgactgaaaagagaaatgtttcaggtagaatggctgtcatagtcctttaagaaaaacgtagcaacccaggtggctttggcctgtaatcccagcacttgggaggaagaagcaagtagatctctgtgaggtcgaggctaacctggtctaaatggggagttccaaccatccagggctacatagtgtgactcccatctaaagaaagaggaggaggtggaaaaaggaaaacagaaagcaccatcattagaactaagtggtccctgccccgcccccaaaaagggaaaaagccaacccctaacctgtcacatctgctcctgggcaacagcgcgttcacacaggacaccacttcacagctgtgttttgtttttgaaggtttagcaatgtgatccgagcccacactcgcctggagtcaagatacagcaacagctcgggaggctcgtatgatgaggataaaagtgagtaccagaggctgcggggttccggcagcacggagctggtactggggaaggtctttattattaaaggcgggagagcctaaccggtcctggggagtctgtggtcccgctgctttccacggtggtgctaggctgaagaacgcctggtaagacgttatctcactgaaaaaaattggggggctgggcagatggctcagcagtgaagaggacccaggtttggttcccagcacccatatggggcctcacagctgcctgcaactccagctccaaggggtctgacccctattctgcccaccttgggtgtacacaaatttaattatatatatgtaaattttttatatattaaaattgagttttggaactgtcctggaagtgattaagttttcagccttgtgcatctagggtctgagtgtgggatatgacctcctgttgaaaccccccatgtcatagtctcagaaacccttgctaagctaggagatggattcctatgggaatttcctgaagccacagtcagttgagtaaactagaaatgttaatacacttgtagcttttggggttggggggcagatagcttctgtagaaccatcagtataaatataagttgtctaggagttaaggaaaccagagaaacaaaggacacaccaacaaccggagtctgtgttgtggaactttcttaaagaattgtttaaaaaaattatacaaaataaatactaaagatatagacagtgactttaaatagaattggtgcataaaacaaaaataaaatacatctgatataatttttttaaaaagaattgctatatttctaattgtttacattacgggtgctttgcctatctgtgtgcctataccacctgtgtgcggtacccatggaggcctgaagggtgtcattctcccgaggactgaagttgcagatgcttgtgaactgccctgtggacgctgggaatcaaagctggaccctctggaaaagcagcacagggttcagtcctcagcctcacatagcagctggtaaccctctgtcactccacttcctggggatctgacgacttcttctggcttcttatgggtaactgcacacatgtggtgcagagacacgcatgcaggcaggcataccacacacatacaaataaaaataagtataaatttaattgagtcttgaggaggttaaatggtatacggacaactgccccaccgtgcggcaaacatggtggagcaacacccacttctctgtggtgaggagagaaagccctcagccagccagctgctctgaagtgtgtccctatgctcagggtgcagggtatggacttaaatcctgccctgccttgcagaggttggcttagggagcccagtgctggtttaaatgctgctatctttccaaaggcaaggtgttctagggatcccagtcccaaagcatgatgacacctcatgggcaggtggcatctcaaggtttgagcaaagcacccttagatgtagaaatatttaatcttgacctggggtttctaccctgcctttgaccatttagttcccagattaaaaccacacacacaacctttatatttacaacaacccttaaactgtacaaaagctggactgctgcctaccctccgtgctgttagaatctactttcctatcgataaccccgagtcattgcttactgtgtccgtctgggatgctcttagctccagccagccagccctcagggccatgttcttatggctcacctaccccatggcggcttctccttcctcctcccttaccttcatctccctcgtggtccctctctgacccccaagcctgggaaacctaaaccccacatatgactcttcttcccaggtattggctgttggcatcttgatttaccactctgaaataacttggggagaaggtgtacttgcgggctctctcatctctgggacaaccaggtgtcaggagctcacacttagcattccaatagatagcaaaaggataaacctcaacacccgcacatcatttcttttgatttctcaaaacagccataaataaataaataaataaataaagtattctctactatgctcttgtgacagagcactgggtgaggttaaaagagagactagaagaacattccagtcagaggaacagtagaaaagaagttcctgagactagaccaagtcttgtctagccatgtacagaacagcaaggtagacatcgtgcctggggtggagggaacagtgggggcatgggaggcagttagccataaaagaggagctcggtagccttgactcctcaggtcattttgtgggctgcaggcttccttaagggaacctctggacagtggacaaggaaagacacatggccagtttttccaaagatggctctctgtagaacacggggtgtgtgtatagtagaagcaagatggcagtaaggaaccatggtaacagaggaaagtggaccagacacagagaacagtaaccatggtaacaggagagtggaccagacacagagaaaagtgacagagctcggacacgtggtcagatggatacaaggggtgtgtttacaggcagatctctccaaatgtgttgaaatgtcagtttcctcagcataaaatgggggtgctcgtagtagatagccatgactagactcttgaggtaaaaagtacacaggacagtgcctgatgtggtaactgtctgggtcagtcccttgtgttgttgcagaatgaccctaggtctcttgctctatgttagcttgaaatacagaattgcatttctctgcagtggaaatcataattgaacattttttatataaattattatttatttattttatatatgtgagtacactgtctctgtcttcatgcacaccagaagagggcatcagatctcattacagatggttgtgagccaccatgtggatgctgggaattgaacttcagacctctggaagagcagccagtgctcttaaccactgagacatctctccagccccatgattgaacattttttttttaaagattcatttatttattatatgtaagtacactgtagctgtcttcagacaatccagaagagggagtcagatcttgttatggatggttgtgagccaccatgtggttgctgggatttgaactccgaaccttcggaagagcagtcgggtgctcttacccactgagccatctcaccagcccgattgaacattttaaaatgtatttttctttgctctataatgaagaactacaaatcgttaagtaataatttatcaagtaattacataatcaactaattctaacccagttgatggtgcaatccacacatactgagccgacattctggcaagcatgcacttacaagatttttcctaaaagcacggactatggtaaacataagtcttttccccagaaagtaaagcagccatgtcctcctcaccctgcagatgatcccatctctccctacaccggctggttgttaagtattacggaagccaagcagccacagcccttacccatgccgtgcagtggaggatgctgggcccccttggtcgactacctcccagagaccatcactccgagggggccgctgcacaggtgagcagcatgcataagcaaagggagacgggagccttgaccagacttctctatcagtgagacggggacttttgccaggtctcacaaaggaggccctttttgaatccgtgtgaccttgccgaccagcttctagaacattagcagtttagcgaaatctcagcctatgaccctccgaattttaactctataagatcgtgagacttaattcaatgctgcttgttagacggcaccacgcaatgtatacgagtgggctcaacctcgatgtctcctttttcttaagttcttgttgctagaagattcacggttctgtgataagatttatggatatttcctgtagtggggctctgtgttgtctctggggagctggagagatggcttcacagaaggcctggattttatggccagcacccacctggcagctgctgctaaatcctgttccagggggaacccagtgccctcttctggcctccatgagtactgcatgcatgaagttcacatttagacactcttatatgcagagtaaaattaaataaatcttaaagagtctctctcccttgtataaatatttctatcatttttttagtgatcctatgcagcattgaattgtgacttgacctgttggtgtattttcatcctctgtagacgttcatgctcatttttctgttttgatgggcaggtgtaatattgctgtgatctttatgactgagatggtggtggatcacagcgtgagggaagactgggctcttcatcttccattgttacttcatgctgtctttttgggtaagactggctctaagggggattctaaccaacaggatgataaacatgcagaggtctgggcagtgctggtgaacatcttttaatcccagcactcaggaggcagaggcaggcagagctctgtgagttcgaggccagcctggtctacagagtgagttccaggacagcagggtacacagagaggccctgtcacctaggcatgtgtttcgttacacataggttacactctgaagtgagccctttccctcctcagttcctttcggtgttcatttctatcatatgtaacgttccaggtcatcagttatcgtgcaaaactggcatatctataatctaaacgtattaatgatgcatctttcaagacacccaaaatagtgtggacttatttaggggtctttggctgaggaaacagatggaaagccatgaagccttgtcaaagcaaaaagagacataacagggaatgtggcaggcttagcagctagcttgagatgtccaagtgtcaggcaagaagtggaggggaaccatctagaacgtctgttaagttagagagcctggtgtggtgacacacgtgtatctgtgatcccaccactcaacggctgaccgaggatctcaaactcaaaaccagcctgcacttcccagcaagacagagctcacaaagacatgtttctattaaacaaataaacaacaacaacaacattttaatagcagatgggggaagagataaaagaaacccacagagaggtcaagaaaaggtcacctgtcaacatttattcaagcacttcatttaagtcacaaagtatcttatttttccataagcccaacttctttatgttgatttctcccagcatcccagagtcttcgctatccacagaatctcagtgagctttagcagctgtttatattaagagactatgccctctgttccaggtttggaccattatcggccagaagtcttcgagcacagcaaaaagctgctgcttcacctcctcatcgccctctcttgcaacagtaactttcacgccattgcctctgtactcctgcagacccgcgagatgggggaagcgaagacactaaccatgcagccagcttaccagccggagtatctctacactggtaagaggagaattgaagctgtgtagcaagtgcaggaagctgtgcagttcatgatgttatgctcaactttctgcatgataaaatgtttcgtgtaacatgcctccaaagcaccttttcatggctgagtatcttaaagtgcatttttcataaaccttttatccactgccctgtgagtatgttcctattgatgtatttacacggaaggatgaagttgtgaaataaggtgactatgctcctcgcccccctcctgccccccgcctgagcaggacagggcaagcatgcaggtgtctctcttgtgctttcttattaccctgaaggggtttttgctttatggagactatgttttactgaaatctgacagaacacaaattttaaaaatagagaaaagggaggtagttgtatgtatacatttttaaaccacagtataactaaagatattcagtgttaaatatataatgaaaagaacagtattctcttataagtctttgaataccatgtgatatagctcattaaaagatgctaatataaggttagggtatagatcaatgatagaatatacacttagcacacatgaggccatgggtctaatcccaagcaccaaatacatatatgcatgtatgtacacattgtatgttcatacacacacacacacacacacacacatattagatacacacttaatcaagctcatagccacatttactcaaaaacgttaaatataacttacaagcagccattggttaatatttcttaaagaagtcattttaaattgtccaatacttgagactaatttcctgacagtatagttggtgactgacctttggtagctcggttatttattggtcaggccagtgtatgtataatacatatatgtaccacccctttgccacaacagccagccaaaccccaatgtgagatacagcatctctccccatggtgccagacactggtgtgcgcagcagtgcctctgaggcctatcataagcaaagaaaaaacatttgtgccaggcagtggtggtgcacgcctttaatcccagcactcaggaggcagaaactggaggatctctgtgagttcaaggtcatctggggctacacagagaaaccctgtcttgaaaaaaaacaaaaaagaaaagtgatcgctattgatcatgacgacataacctcatagcctcagtccaaatcaagtggtttttgttttgtttttaaagacttatttatttattttatgtatgtgagtacactgtagctgtcttcagacacaccagaagaaggcatcggatcccattacagatcattgtgagccaccatgtggttgctgggatttgaactcaggacctttggaagagcagccagtgctcttaaccactgagccatctctccagcaccctcaagtgttctttaatgtcaccttattcatacctacctccaagcccctgcaaccttgctggcaccttagccctttcttcctttgccttctcgtcccactaggcggctttgacttcctgagagaggatcagtcatccccagtgccagactctggcctcaactccagttccacctcctccagcatcagtctggggggcagcagcgggaacctcccacagatgacccaagaggtggaagatgtcgaagcagccactgaaacggacgagaaggccagcaagctcatcgagtttctgacgaccaggtaatgggggcgctgggcgtccggctgctgctccagacggctgctgttgaaaaatcgccagccctttaaaccacacagctgggaaatcgatctttctgtttggaagaagtcctacttcctcctgattgatactggccagagtcaagggcaggtgctgcgagaggtgtctcctatcccatcgatggaatgataggtcggcagggagatttggcatataatgataagatggtgcagcagacagtaatgctctgtgatgtgaagtcatgctgtcctttctgaggacttcagtcttacacgttaggctcacatctgtcaacagcacggctgcctcttagagtctgacagtaccacatggtggtagtcacctcaagatctcctggaactagagttacagatgtttgtgagccatcatgtaggtcctggaaattgaacctgggtcctctggaagagcagccagtgcttttaaccactaagccatcaatccagcccatccttactgttcaaacacaagcttagataacagaagccattttctgttggtccatggaatcttacaccttggcaatgattccaaacaccaacataaacttttcttattggcaaattcagatattttatgtcattgtcattccccaaacaaaatatagcacctacagtatgccaagcaccgtccttttttataggagattttacatttatgcattggttgattggtgatcgattggtggggaaggtgcaggtagaggccagctacccagaatcagtactcttctcccgccatataggtcccagggatcgaactcagatcctcagacttggcagcacacgccttacctgttgagccctcttgctggcctgaaacaagagattttgattgttgtaaagaagtttaaaattatggcagtagggccggtgacatgactcagcaggtaaagggacttgcccagaaagtctctcaacacgagttcaaatccccagggtccccataaaggtagaaagaaagaaagagcggagtccacaaagttgtatacagacctccacacgtgcgctgccgtggcatgcgcgcccatggattcacatcatcatcatgcatgataattaattaattctcactaattgaaaaaatcaaaagcaaatccccacaaatcagttatttttgagtaaatacagaagttttaatatgcttcttctagttaattactaagctactacagtttaaatatatatatatatatatatatatatatatatatataggaatataatatattactatatattatattagccattataatatattattatgttatatactataatatattataaaacatatgaatataattaatacattatatatgtatatgtatgttgtatatatgtgtatatatacatacacacacacatatatatgtatatatatggctggagagatggctcggcagctaaaagcactgctgctcttccggaagactcaagttcaattctcatcaccaaaatcaggtggctcacaactctctgtgcctccatctcccggaagacctggcgccctctcctggcctctgtgagcactgcatttatggtacatatgtacacacaggtacacatgcctaaacatgattaaaaataataatgtaattttaaatagaatacacttttatcttgtgagttagaactccttgtgtgtcttttaacacaaaacggcagccatgtgtttaacgtcagtatgttttgttttagggcattcgggccactttggtgccacgaagacatcacacccaaaaaccagaactccaagagtgctgagcaactctctaatttcctgcgtcacgttgtctctgtgtttaaggattccagatcaggtacctcaccctgcccgccagtgttctctcatggagctcacaatacatcataccctgccaaacttcagctaacagcaataagagttattcctttttgtccatattcatgtgacaaccaaacatgtcaaaaggcctccggtaccccaccaaaaaaaaaaaattactattttcactgggtcttctattcttgtctgtctccttagagagaagaaacaacttagtgaccccgaacaattgtgtctttaggttgccttttctttcccacctcctcaggggggtttctgactcctaagatcttgctttgacaagaccagtcaggtgatatttgcagccttccctgaagtgtctgcgtttccggatctgtgcatcggcagagcaaacactttggcacagggtcttggatgtctttagaattggttagatgcatctctatctttttcctacttaaaaacgtatttctaaaaacacctctctacaaaaagaagtaagccgggcatggcagcttgtcctgtaatccggcagtctgaggcaagaggactgtttcatgtacatagtgaatcccaggctaccctgaactacaatgtgtaagatcctttctcaaccaaagggaaggaggagaggaaggccactattctatatatacttacatgtaaaaaaaaaaaaacagttcaggggctgaagaaacagctcagtcggtaaagtgcccagcactgggtgtctggcaagaatgcacctgcaaccccagcactcagagaaaagggcaggtagctctccagagctcactgggcagccagtctggctgaaatgggccaactccaggttcagtgagagacactgtctccaaaagtaaggagagagcaccactgaggaagacacctggcatcaacatgtgggctccaagtgtgtgcctgtacatacatgtatatgtcaacatacagacacatatgaaagcaaaagaacaataggcggctgatagaaggatagtattaaaaaataatgcgtgtgtgtacgccgactgtgtgcctgacatggtgcttaattcttgtaacctccctgagagagacggcctgttactcacgagtcaaagagagggatgtgggctcttagaaagcctgtctttcccagagtcacaagccccctgattcagagccaggaccattctgtctcaaagattctacctcttcctatacttcccatgattcatacatttctttttattttgaaatggcttgatgttctgttatttcattgtctgcttgtttatagattgttttccttcatttttaatttttttgtgtgtctggctgttttgcctgcatgtgtgtatgtgcaccacttgcatgcagtgcctgtggagaccagaagagggcagcagatttcctggaactggaattacaagtggttgtgagcctccatgtgggtgcgggaactgaacccaggtcctctggaaagagcagcaagtgctcttaaccaatgagccatctttctagggccttatattaggcacttgtaggcactttcacggtgcctaaggcctggcacatgctaggcaagcaagccctttattactgagctagatccacaccctgtttgtttcttaggcagagtcaaatgcagggtagggggatgggggactgttagcttgttctaactctcctagtctcctcgtgacttgggtgcaccagtgtgaagtaccagggcttgcccttcgttcttctggccacaggtttccatctggagcagcatctgagcgaggttgcgctgcaaactgctcttgcaagctcttccaggcactatgcaggccggtctttccagatcttccgggccctcaaacaacctctatcagcgcatgccctgtctgacctcctgtccagattggtggaggtgatcggagagcatggtgatgagattcaggtacggaagtgagtgaccacttatgtgcccctccgtgacgtcgtagcactccccggaagtccatagaaggtgctttaaccctcaaaaccacaattaattaattaattaattaatattttagcagttagcctgtagcctagtcaaccaaacaggttccaggacagtcagagaaacacggccaggagggatgggggttgggggaggggagcaaggagaagctaatccttattatttccaaaagtcacccccagggaactgtttctacaaactcagcataggtgatcacattttgtgacaaaggcatcctttcagtgtgtgttgtctggtggcaggagtggtgggttttctatggtggatggcaaggggttggtttgtattggatggggttgttttgtgacatttgggtctttgtaccctctgctgaggactcagttacacagtgtgtccagtcagggcagggatccgcgctgtcgtacctaaaccaagctctgcccttccctgtccggattatctctaagttgatctggagacaggacagggacagagagtcatgctaaagaccccgtaggtggagctcagagccttgggggctgagcaggttagacccaagggtactgcgtggctgatagctaaggccagccctctgcacacctggctctctcccttccggccatcagaagttccagtcagttacacagggacaccgatcccctgacctcaccttgtttcctaatctctagcttccacacattgtccctcagtggctctcccttcccttcagcagggtgccactcaccctgtgcctgctcacacacacaccccacccctgccctgctgtgtttttaatccccttgaggttgcccaacttggggaaattaatccttatggttactaactacctcctatgcagtgtaattccccaagcaagatttataatccgatctgagactttgtaaacgaatgccgccatgactatctgactttcagaaatcgagagtttgcctgaggttagttcatcctcaggaagttagcagctccgaatgctgtctctgtgtgctccacagggatatgtgatggaagcgctcctgaccctggaggccgctgtggataacttgtcggactgcttgaagaacagtgacctcttcacagtgttatctcggtgagaatcagatgactggtgtgtgcatatcagatgtgcatatcagatatactgtactgagtgttggagaaagaacaggtgtaggttttaaaatctacttagggcctaaaaagtgtacttgatattttcttttattaagaaaaaaatttttagattaaaattttttaattaaattttttaattcaaattttagatttaaatttttttagatttttaatgtatgaatgtgcatcacccaagtgactgggagttacaggttggtgtgagccatgaaggcagctcagggaattgaacccagggcctcagcaagagcagtagtactcttaacccctgagccaccctttgttattttcttaaatttaaacaagtaaaggggttgttatcacagatacacacatatactcattatatgtgtatcttaaaacatggtcccaacacctaaatggtagctcataaccatatttaattccaatcccaggacatctatctgatgcacacatctagtttttgaaggcaccaggaacacatgcaatacacattcatacatgcaagcaaaactcatacatataaaaataaaaaataattttaaaaagaaattttctttctctgccctagcctgaaactcactatgtagaacaggctgactcagagatctccatgcctctacctcctgggagggggtgggggtgaagtgggtaaaggcatgagctactacacctgcctattttattttattggttattttttgctttgttttgtttgtttgtttgtttgtttgttttttcaagacatggtttctctctgtagccctggctgtcctggaactcactctgtagaccaggctgccctcgaactcacagagatccacctgcctctgcttcccaagctctgggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcaggaaaatcaaattttctaagtgtaaaaatatttcctttgcagtgtgtacttaccttcttccttcttgacaacattctgttctaagttaagaggagaaaaattttgtgtttgcttggttgctggtctgtcttattttataattcttcccatccaaattcaaacagaatgcatatgaaagctcgctacatctctggagttttaagattttccattattgaaagtttgtattgggtgtctgtttttggagattgttcttgctaaggtttatttcccatagccttaacttaaaagccatttaagtagaaagtagatgccccgcccccgccccatccaagtactaaccaggtctggccctgcttagccccaattagggtggtggtctctagggattctcccccatagctgcttctcagagcacaagagcgccagctcttcagtggtacccactggcattccgctgatttcacttctgtttgtacctagttcttcatcgccagacctaagctccagcagtaaactgacagcgagcaggaaaagcaccggacagctgaacgtcaatcccgggactcctggcagcggcggaggcggcggcggcagcggcaacaccacgactgcagagcgaagccggcaccagagaagcttctctgtgcccaagaagttcggtgtcgttgaccgatcctcagacccgcctcggagcgccaccctggacagaattcaagcttgtacccaacaaggcctttcctcaaaaaccagaagcaattcctccctgaaggagagcctcacggacccgtcccacgtaagccaccccaccaacctgctggccaccattttctgggtcacggtggccctgatggagtctgattttgagtttgaatacctgatggccttacggctcttgaaccgactgctggcacatatgccgctggagaaagctgagaaccgagaaaagctggagaaactccaggcgcagctcaagtgggcggacttcccagggctacagcagctgctcctgaagggattcacctctctcaccaccacagacctgaccctgcagcttttcagcttgctgacatcagtgtccaaagtccccatggtggactcgtcccaagctattggtaaggccagcgccacactgcctgtagacctgttggtggctgcattcagctttagagaaacaagctaataccatatgtctatgtctacagtattaaatactggcaatcgagtaacaggaacagcaattttgtgtgtgtgtgtgtgtgtgtgtgtgtgtgtgtgtgtgtgtgtgtgtgtgtatgcgtgtgtgctctcgcatgtgtattcatatatgtgtgttcatgatttcgggtcaaactgcaaacattgtcaactgagttccttgctcttgtaaatttctttcctaattcccaaatcttgtttttctcttcccttctctgtcctcttgaaaagattgcattggctttttattgttctgaattaagcaaaatcaacacaccagctttttaataccatggcaagtgactaagaatgcatttcactaattaggttttaacagccatgctgagcaataattttttgaaaggtctttgctgttgcatgactaaggcttaaatatatttttggcttttttttttttttttggtttttggttgtttttttgttttgttttgttttgagacagggtttctctgtgtagccctggctgtcctggaactcactttgtagaccaggctggcctcgaactcagaaatccgcctgcctctgcctcccaagtgctgggattaaaggcgtgcgccaccacgcccggctatttgtgtttgttttttaagatagggtcactacatagctgtggttgtcccagaactcactatgtagaccaggctggtcttgaactcacagagatctgcctgcccttgcctcccaagttgctagaattaaaggagtatgctaccacatccagcttacatttttatttttacagaatcttaaacggatgcttcagctcaggtcagtctatgtcagtaagatctgtgtgagttctccttgcacacaaacaggtgacgatcctatgttgaaatctcaagtgtactccagtgtctcctgtagtccgtgtcttttggttgtgtttttcatagatttctttatcagatcatctttaccctcctccacaaaactgatggtttagctgacagagcttgcttagcttatacaaagccttagattcaatttttagtaccacatacaaccaagtatggaggtacacacctataaacccagcattctagaagtggaggcaggcaggtcagaacttcaaggtcacccttaatgatgattctggcctgtgtgaaaccctgcctcaaacaactctaacaaccacaagaccaatttcacatagccttcgaacaaaataaaatcagtatattccttcccactgttaaccagtcacagcataatactcagctattgccactgtgtcttctctcatccaggatttccgctgaatgtcttgtgtctcctgcctcaactgatccagcattttgaaaatcccaatcagttctgtaaggatatagctgaaaggatcgctcaggtatgccttaggaccgtcagagagtctccgcgccaggtggaagtggctggtttgaaggaggcagtagttgtctcaaaacttgatatcactcataatgggcatctctcggtaggctgttacaaattggctttttaaattttgtttgcattattaagaaaagcaagtgggagccgaatggtggtacagtgcacaccgttgatcccagcattcgggaggcagagacaggtgcatctctaagttcagggccagtctggtctatagagtgagttccagggctacacaaagaagacctatctcaaaagaagaaggaaggaaggaaggaaggaaggaaggaaggaaggaaggaaggaaggaaggaaggaaggaaggaaggaagtggggaggcagggagaggcagatggtagctgttgagaaggctcagcaggtaaaggtgcttgctgccaagcttgccgaccagaatccatcctggaatccacatctaggcaaagttaatgaacacgaagcaagtggaaagatttgtgagggaaagtgtgtactagtgaatgactcgatgaagcatctccgtcgctacccaaaagcatatgggctcttctccagacgatcaggacttagaatgtttgctaacgtcccttcccgtccattggaaacgctctaaattggtctgcttctcttcaaaggtttgcttggaagaaaaaaaccctaaactttccaacctggctcacgtcatgaccctttacaaaacacacagctacacaagggactgcgccacatgggtcaacgtggtctgtcgctaccttcatgaagcctatgccgacatcaccttgaacatggtcacctacctggcagaggtaattgttgacgctaaggataacatcagtttaacatccatggttcacatgagtatagagctttgacagtaagtgtcgtgccttgtgctgggagaccaaggtctccaaatgctaatggattcattttaaatcctcacaacacatcagtgagtggggtattctgtgaagaagctgaggctgggctctgttaactcatgagctgtaagttcaagataactgaccctagatccatcggcctcccttcccatcagcatggctgggataaacttgatcctagcctggcatgagagcacacatctgtaatcccagaggtaagaggtgggagtggggaatggcagtcagatctcatcaagaacttagtatgtcgctaggcatgttagtaattgattgttctaaactaattaacaaattataatctagacagaaaatatcattgcctcttgtctgtacaactagaagcatgtgtgtttctagcacaatccttacaaactcttactctgagcttctgtaccatggatgtgagatgtctgtagcattttacaaggcagacgatctcatgtatagcacctccaagtgaccagcattttaaacacccctcctacacagcactcttgcttccaataatcccctggtcataccttttcctgcaagcaaactcacccttctctcagcacccagacagtatgaggaaaaccaccacatataccctgctaccaaagcaggggacatacagcacccatcctgagggggtaatgagtaagatgaccatgtaggagattttgtctagaacgtttaccataaacattttaaaagtacaaattggatgcggtgtgtacatatagtagaataatattctgtcttcaaaaggaaaaagttatgaagccagagagatggctcagtggttaagagcactgactgctcttgcagaggacctgggttcaaatcccagagtccacatggcagcttacagccatctataactccagttcctggggatctgatgtctccttgcatgggatctgagctcacatgcgacagacatgtatgcacatacatacattcatacatgcaaaacactcaaatgtaggaaataaatctaaaaaaattttaatagatgcataaattgtactgttcagccattagcccaaaactgtcagcagccttgctatgacgacctctccggcttcctgccctgtggagtctatcaacttctgttctatttctttccttcattcaggtcctggccttgcccttgcacacacacagacttgtattgctctgctctgtctgcttgatatttactttgtgtgtataaatacttgatatttacgcatgaacgtgacactccacttaacacttccctgtcccattgcttacatttgtgatttgtttgtgcggatggccctgttgccacattatcaagggacacttggtgatgtgtcaagtggtcactcactttttaaccaagatttactatttcgttttaattgtggggggaggggaggcaggtgagttctgtacctgcagaggccaaagcaggggatcagatccctggacctggagttacagggggctgtgagcaatctaacatgggttccgggcatcaaaccctgcacctctgcaagagcagggtgtgctcttaaccactgggctgtctctccagtccaatcatggctttgtattaaaaagcactttatgaaatagtattgtatggtctcatttcctaaagtagaagtaccccatcaaagggcgtggctatgtgggtgctcttagctctatacatttggggactcggtcttcacaaaggctttctcaatctacaacattagagatgatctgtaaatatttttgttttccccagtgcccactgaattttgctattctatgtgtccttttgcataatgatctgtttacacttttgcactgttttctttgtgtgttctcttgttttgtttttatatcttctttccagtcgatgtagtcatttttcccacacaatagattaatgtagctctctgctttctcgtgtgtgtagactgctcagttacctcttctgatgtgcgatttcaacgtctacctgcatggtttctgtcagttctttgcagtaaatctgaacagtgaacttttaaaataaagctttttaaaagtatccttatttttatgtgttaaaggtacttgggcatgtagtaccttcacaagccacaagagggcgtcaggagctcttgattagaattgacagttgtgagctaccatgtgggtccaaggaaacgaacccaggtcctctggaagagcagccagtacttttttttgagatagggtttctctgtgtagccctggctgtcctgggactcactttgtagaccaggctggcctcgaactcagaaatccacctacctctgcctcccgagtatatggctaactgaggaataagcgattaatgattttaaatctgttttgcgtaagcagattgagcttgttataatttttcctcacagggataggagaataaagggataggccatatatttcgttagtggatctaggataatagagattcggattattccgtaacccggctgagcagccagtacttttaactgctgagcccttacactatcttttgacttcataggcacctgcatgtatgcagtgcacataaattcacataggcacacacatacacataaatacatagctcttttaaaaggctttatggagattgcagaggtgttaaggagttaagaacactggctgctcttccagagggtcaaagtttgaatcttagcacctatatggcagttcacagcctaactccagttccaagaaatcagataccctcttctggcctccgtaggcactgcaagcatgtggtatatagacttatacacaagccggacccccatacataaaaataaataaataagtataaaagtaacttttactcgcctgatgtaattgttgtctctgaggcatactgtctccacctgctaaccttcctggtcctggaagcctctagcctccatacaatcttatctaggcctagagtgttttcagcctctgagacttgctcctgaataagctccccctttcttgttctttcaaattgatctctggtgggctggttcaactcagctgttctgacttaaactcctctcccagctgactgattcaatctggcttctcagtttctcctgaatgacctcatgctaactttggcaatatgttctaatcttttggctcattctcattctctggctctctctttttctccctctaacctgtctctgtacaactgtcccagtaacactggctctggnnnnnnnnnnnnnnnnnnnnctcctctttcttctttctccacactgctctctctctctcttttttttaaagatttatttatttattatttatttattatatggtatttacagacaccccagaagagggcattggatcccgttacagatggttgtgagccaccatgtggttgctgggaattgaactcagaacctctggaagagcagtcagtgctcttaaccgctaggccatctctccagccccctgcactgctctctcttaaatagcttccctttttacttaaccaatagttttaagtcacggaacaaggtttacacaatggcctgttatcatgagaattcacctagaccttcagaatttagctttacaatacatagcaacagactaaacctcaataacatagtgaaacaatatctcaaaacaaaaacaaacaagaaatatagacctttttagtttccttggtctccaatgctaaattatctaattgacatctttaatgatatatgaaatatttctttatttcattaaccaattctgaatattctcaattcctaacctttgccaagttgatgagcagcaaattatatctttaaatttataatttcaatagtgccccatggttttccttttgaggtttattttctgatttttttccctactatttgaattctatgtttataattccagacctccctggaactgccttcattatcatctattcaataactatgattttggcctggagtggttacatgcgcctttaatcccagcccttggaaggcagaggcaggaggatctctgtgatttagaggccagccagtacttcagagctttcaaaaaacaaaacaagagaagacagaaatggctaggggggtttgtttcctgtcctaagcacactgcagtgataggggtgtggggaaagcttgggtacttctccaatggctaggggtcctgtttcccgccctaagcacactgtggtgattgacaggggtgtgggaaagcctgggtacttctccaatggctaggggtcctgtttccggtcctaagcacactgtggtgattgacaggggtgtgggaaagcctgggtacttctccaatggctaggggtcctgtttccggtcctaagcacactgtggtgattgacaggggtgtgggaaagcctgggtacttctccaatggctaggggtcctgtttccggtcctaagcacactgtggtgattgacaggggtgtgggaaagcctgggtacttctccaatggctaggggtcctgtttccggtcctaagcacactgtggtgattgacaggggtgtgggaaagcctggggacttctccaatggctaggggttctgtttcccaccctaagcacactgtggtgattgacaggggtgtgggaaagcctgggtacttctccaatggctaggggttctgtttcccaccctaagcacactgtggtgattgacaggggtgtgggaaagcctgggtacttctccaatggctaggggttctgtttcccgccctaagcacactgtggtgattgacaggggtgtgggaaagcctggggacttctccaatggctaggggtcctgtttccggtcctaagcacactgtggtgattgacaggggtgtgggaaagcctggggacttctccaatggctaggggttctgtttcccgccctaagcacactgtggtgattgacaggggtgtggggaagcctgggtacttctggacagttgctagagctgactggctgctctttgcctcccgcagttgctggagaaaggcctccccagcatgcagcagccgctcctgcaggtcatctacagtctactcagctacatggacctctctgtcgttcctgtcaagcagtttaacatggaagtcctgaagaccattgaaaaatacgtacaggtaagcaagcactgggtcgatccactcattagtccaagctaacgccatccggcaggggaccacacgtccttcctccatatccctgacacaccaccaacagacaagctgcttgttggctacaccctgagtggcatttttagaagaaagacagaaaaacgacctcttttctgccttgcttcaagggcagagctttcttgtgggcacacgggctgaggattagtagctcctaccttggtgaaacagtcggggaatgtccggcattagtgtcttatttcagacagaccttcgagaaagacaatgtgcacatgcccagttccaggcctgcttgctgctttggaatttagaaacttaaggctgaaaatactccaaaaaacaaccaatgaatcagagaaataaatgaagaagaataacaaagcgtgaataaatgataagagcataatagcttgttatgcttgcttctgcgtctgtatatatgttagcatttctataacaagcagcccttcaaatattaataaaaatggccagtgcacacctttaatctcagtacttgggggacagagacaggtggctctctgtgaattcatgactagcctggtctacaaagttaattcccagacagccagggctatacagaaaaaccctgtctcaaaaaaagaaagcaaatataatatatatgcaaaaagtccagacatggaaggagagacacagggatctctgtgagtttgaggacagcttaatctacataatgaattccaggccaggccagaacttgtctcagtaaactaatcaattaaaatttatggtggctactccgggaacaccaggaaaatgatgccttaacggctcatgtaggtttctttaaaaccttgataatgtccagaaactgtccacagttcggagggcgctttctccaccatcctccccacagaggacattgatatgagtgacctccgaccggtgccagaaagccaataagttttctgccatcctgtgaccgaccagagtctgatcatagaacttctggagctgcaggcccacttgcagggcgaagcggctgcgcctgcggctgcgcggtaccattttgaggacattggcggggtgcagggggctagggctgcgcacgtgctatctgtgcagcctcactgcttgaaggacttatccccgagaggctgctgtcaggatgcctgggtccttcctggcaagcagcaggtagcaaaggatgccgcactgcatcaggccttgcttcggccgccccaggatcagactgatcttttgctcaccttcagtcagtcccccccccccccagtgtccgtgtcactgcaggtctcttggccctggaaatctgtcatgtccgcctcggagcctgggtaactttgaacacctggtaactagtttgactcttcaatgatcccaacctctttggtccccagtaaagacggttgaaacacaagtgctactgaggacttggggacccagttcagagagggggagtttctttctgcttcttccctggatgtaaacataagacacctcctctgcagaaataaacttgctttatgaagaaaaaaattaaaatttatacacacacggggctggagagatggctcagcggttaaaagcattgactgctcttcagttcccagcaaccacatggtggctcacaaccacccataatgagatctgacgctgtcttctggtgcatctgaagagagcaatggtgtactcatatacataaaataagtaaatctttaaaagaaatttatacacacacacacacacacacactaactaaccagtgtctggaccaagatgtcagctagtagacatagagatgtcctttgaacctggctcagaggcactgggcttcttgcactgggccagcatccacccagcagcacacagggtcagcatcagcaaactcccagagaccacctctttaaagccctgtcctgagactacatcagaaaaacagatgaagacctgcatcctgaaagctaatctgttctgtgcagccacacggatggaagggggtccagattctacctccctggggtcagcgcatgccacacccagcagtggaggcatctgtttctctctcctgtggcatcttaacccttccttctaagagatgtactcagtgcatcaggcccagatgtcaagggcaaacactggatttttcttctggttaatcacattgacaaaaccatatagtgttcattttagacaatgttttccagaaattatttaatgtaaattttaatttctaaggtttttttttcccctccacctcatttatcaagagctaatgggaattgtgtcctcggtgtgcattcattcacaggttagtacccacaggaggaggggccagttcagagcacatagcctgtttccttgggatattaagatgctcactttggagagagatggctcagggattaagagcactggctgctcttgcagaaaacccaagttcaagttccagcacccacatggtgatttacacctgcctgtaaccccattgcagaggaatccagtgcctgtttttggccttcaaaggttcaagtacatggtacatacaaaataatataggtgcatgtacatgcacatacatacatacatacatacatacatacatacatacatacatgaggaggatgtactgtgaggtggagagagatcagtaatcccagtgaagaagagagagagcagcagcaagacccagggaaaccgagagaccgagaagacaggacccggagacaatggattctgcccgtgaatgatcagtgctcgcccgtgcaagtgaagcttttctccttttgtcagcataagcttgcaggctggagaggtggctcagtgggtaagggcactgactgctcctccagaggtcctgggttcaaatcccagcaaccacatggtggcttacaaccatctgtcatggaatctgatgccctcttctggtgtgtgtctgaagacagctactgtgtactcgatatacataaaataaataaataaatattttttaaaaaataataataccttgcaatttttaactaagtcagttgttcccaacatgtgggctcccattggggcacgaataaccctttcacaggggccacctaaggccatcagaaaatatatattgacattacaactcgtaacagtaacaaaattgcagttatgaaatagcaacgaaaataatgtcctgactttgggggtcaccacacatgaggagctgctaaagagccacagcgttaggttgaaaaccactgatttaaatgacgtcagtatgggcacagcgggtctgtattatctacttactccctcagtgtggttcatttcacttatggacactctctgtataccattagtcatttccttactacagactttctttatgtctttaagtcagtgagttctgactggtcatgagattgttaggtagtgagcgttggatctgaaaacactggactcactattaaccctttggatgtgtctcgccaacagagcattcactggagggaagcgttgaatatcttgaagctggttgtctctcgatcggccagcctggtattgccttcctaccaacacagcgacctctccaagatagaactacaccgggtgtggaccagcgcctcaaaggaactgccgggcaagaccctggacttccacttcgacatctcagaggtcctgacccgctgtgactttttctgtagcctgagcataggacgctgaagggtaaaaacagttgcctagagagaggaagaatttgtttggatctaaaaacatagagacggtattagccagttcatctgaattcctcagttcccagggacccagaactgctccagaccagtaggaccttaggagctagggacagaaggacagtaggaccttaggagctagggacaggaggttctggtcagtttctgccacttcaaggatctctagttgagacctcgttggaggcagaatgtagaaggtgctctcccgcctgaccacacactgtaggagcctcggaaagtgagcgttatcaagtattattaagaatactttggccgggcggtggtgtcgcactcctttaatcccagcacttgggagacagaggcaggcagatctctgtgagttcgaggccagtctgatctacagagtgagttccaggacagccagggctacacagagaaaccctgtctcaaaaaaacccaaaaaaaccaaacaaacaaaaagaatactttggccctgacattgtccatttgaatagttgaaatggtagaaataatttagataaaattgtcaataactgggagtacatattgacgaccagagattggagagaaggaaatgaatttttaatcttttattattatacgacattattgcaagtttggtctggtgagagaagcctgtaatttcggcacacaggaaacaggggcttcaacccaaagccagcatggtctagagagcaagttcaaggcaggcatactgggcttagagagagacagagagaaggagagaaagagaaagagggagagggagggatggagggggagacagagacacagagagacagagacagacagagaaagagatggagagagacaggcatgcagacagacagactcagggtggtggcgaaaagaggaggaaggggaaagagaatgattctttcaagcttaaacatctgaaaattggcttcgccttcttcactttgcttctgtcttcatcgctagagtctaaagcataatgaggtcattgcattggtttcttgctgacaaggagagtgaggagatattcattaagcaaatggctcagaacaagtactgaacaccaggaaagtgagccagcatttaacactgagtttttgtatctgatctggttctaatcagatctttgttttgttttcgttttcaagaaagggtttctctgtgtagccctggctgtcctggaactcactctatagaccaggctgcccttgaactcacagagatgcacctgtctctgcctcccaagagctggaattaaaggtgtgccacctcacccagcttccacatgatcagtttttaattatttctgggctgagcaagttccttgtcctgtagaagtgttgagatgggatcgtaatgtctctgtatcattctttctccagactccaatcattgggagacggtacgatgaactccagaattcctctggacgggatgggaagcctagggccatggccgtcacccggagtgcatcctctacctcctccggctccaactccaatgtccttgttcctgtgagctggaaaagaccccagtattctcaggtaccactccatgtgtgaaactaatctctgccattcaccattgccccaataacgttgccaactagaccccggcccttccagcaatgggtctcactcattgacaatcaatccttttatctgtggacaggccatgggctgttctgactcttgcctcttctctcattggctctacctctgttatggcttgggaacaaaatctggtctggcttccctttcacatggcagccttcagatgtggaaagcacttctgacccttgcccccaaacccatgtccaaatttatcctccaaacaccatgtccgataaagagaagccagggccacacactcaaagagccttccagaaattctcctcagagcataaactttaagcatagttgacatgaatgtgccaaactttgcaaagacagcagaaggaactaccagaattctctgtgtctagttatcacagcctgggactgggtacatcctgagggtaactgccgtagtattgatgccccgtggctgtcaggtaaaatgccttgcctgcattgttctgaagtattttagtggcatgtgccagacactcactggaaagttattttaagtggaaaaggaatttattacgccatccgtgttagtattgtgcaaaagattcaaaatacctgaggagttgggttaataaaggttgaattggctcatgagtcgtgctgccccctccaagagcccactcccaataacctagcttcctcccgctaggctccacctcctgcggagctgccctctcccaatagcactgcaggctgctgactaagcctcagcacacgggctttttataaaaactaaagaccaggatggcaaaagcatttgtcttggctgtaagcacagctgtgccctagtgcccagatgttaggatccagagccttgaattccctctccttactgccccacctccttcccttcccaaggtcatgacccctgctgagacctttgatagctctattctcagagagaccctttttctagggagctgcagcaaattctaatgattccagatttttatggtttggggttctgatgatttcatgctggagacccaacctcttctgacatccacagtagccccaggagaggagcttttggttagattgatttgttttttaactctgtatgtatgagttgctgtgcctgcatgtgtgtatctgtgcaccatatgcatgcattacctacagaagccaggagagggcatcagatccccctggaattgaacttacagatagttgtgagctgccatgtgggtgctgggaattgaacccaggtcctctgcaagagtaacaagtactcttaactgctaagctatctctccagcccagaagaagaaacttgcacagtgtttgaaagtggcagcaaagagaccttcccagaatagaaagcaagcctaagttatcggaagtaggccatgtgggtactgggcaagtccaatactgtgtctgcacaccacacagctcactgtcatctccagcctgccacagaacctagtgacacagcacagtggctgatggccacagtcatggtgaggaaggagaagaggaaagttctgccctgtgccttgttgcactgatttcagaattagagaatgagactaagagctagggaaatatctgggaaatctgccatccttcagcaggaatgtctgcctgcctagctttgaaatgaccccatagtgactaattctctaagttgggatgaaagatgcactgagccaagttccataaagaaaatcttaagccaggagtagtggtgcatgcctttaatcctagaggcagaagcaggcagatctgtgagttccaggacagccctgcctcaaagaggagggaaggaggaggaagaagatcttagggtaaagagcaccctccagaactttccatctaacaaagcaaaatcagataaaagggatccacatgattgctttgtgaccggttcttaagtacattaacaactctaggttcacgttatctcttgattctaggagagactccatacataagaggaaaagaaactttttgaagaaaaccaaagggatttaaatctactcagttttaactctaccatgctttatgagtaactgagagctttcagtgcacagacagttatctcactagagccaggaaatgcttgttctgtaacaaaatagatttatttctgatggacggaaagccaagccttcctgaaaccaaaagctcttccacacaggaagagatctcaagggaactcttggatgggtatggaaaggtctagaacttgattttcatagagcacacatactccctaaataacaggtctgccctatatggttcacagtcactttaaaataaacaaataatattcattttattattgtgagctgaagagatggctcagcagttaagagcaccggttgctacaggggccctggattcccatgcacccacgtgtcagctcagaaccatctggcgccctctgctggcctcttcaaccatcgcacacatgtggtgcacatacatacatgcagacaaaacccttttacccacaaaataaaaattgtttaataaataaataaaaagagggtcctcctctgtgctaagagcttttgcctggagggcctgcctctgtgctaagagcatttgcctggcatgcattgcaccctagattttactcctcagtaccacaaaaaattttttttcattttttaaaactttatttacttgagggattatctttaccagctgagccatctagtcagcccaaataggggtttacgtaactatactgtatagttttacatcatcagagaggaaggaacctaatcaagagaatgcatcaggaagatcaggctacaaacaagcctggaggccattttcttcattagtggtcagaggggaaggacccagcccattgtgggcggagccatcaggagatggtggtcctgggttctataaggaagcagggtgaccaagcaaaccatggggagccagtaagcagcaccctccatggcttctgcatcagttcctgcctccaggttcctgcccggttttagttcctgtcccgacttcggccagtgatggactttgatctggagatgtaagccagacaaaccctcccccccccacttgctttttggtcatgctgtttcctcaaagcaataaaaaatcctagctatagcaactgccattcactctctgtggccagaacctgtgtatatgacggcagatttgctcatgggacccagaatgaaaacctcccctgtgttttccgtcttccagaaaagaacgaaagagaagctagtgcacgtcctctctctgtgcggccaggaagtcggactaagcaaaaacccgtcggtaagttccctcctgcgccacggctattgtggcatcgtattgcttctgcctttggacttctctgtcattggtgttgaagactctagtatggctgacaggtctgataggcgccatctgcattcagctcccactttcatccttctcacaccatgaattgtgatctcagagacaagggaagacctcactgcacacgcacacacacacgcacacacacacatgaacctgtctgtcacatcaccaaacattcctctccgtctactctgtgaacagatgaaatattggagacccatcaagacttgccaacgtgtcaactggctactcctttcagctgggaaagctaaactgggtttctgtttaagtcacctttgtcgtatgacttcagtatctgagggctgcgcccatggctttgctcagtgcaccatggcccacagcagagagaaaccagagccactctggtttctgccattctgaatggctggccagggctgttggggcagctaaatccacactagccctatactctctggccacaatgtttgcatttgcccgtagtggaccctagtcattaaagcagcgcttaccaggaaaggcgcctccctggaggtaatcagaccaggctgacggctccacaactctccatttgattgtctcgcacactctttgtgatccccatgtgtgtcgtgttgcatacatacacacacacacagaaaacaggtgaagtgttccctatctgcagtgcctgggaatgggtgcttccagctacagtggattttagatttgggtaaatttgagatagaactgacccagtgatcacccctcaaaatcgtggaactttcatctttaaaagtttcagtcttgccaggtggtggtggtggtggcagcacaggcctttaatcctagcactcaggaggcagagcaaggcagattctgtgagttccaggacagccagggggctacacaaggagaaaccctgtctcagggggaaaaaaaatagaattgtagctgtaatccaggtgtggtggcacatgcctttaactccagcacttgggatgcaaaggcaggtggacctctgtgagctcaaggccagcctggtctgcagagtgacttccaagacaacccctgtcttagtaagttaattaattaattaataatgaaagtttcagatttaaaacattttaagatttggggttttcagatctgagatgcttaatctaccatccacaacacaaggctatctctttaacaagtctttttttttttaagctgtatttattattatatgtaagtacagtgtagctgtcttcagacataccagaagagggcatcggatcccattacagatggttgtgagccaccatgtggttgcagggatttgaactcaggaccttcagtagagcagtcagtgctcttaaccaccaagccatctctccagctccaaagctatctttatacactagaaaaagaaaaaacgttcatacctactcattctttttaccttggaaagatatttgtaatatttctgttcttataatatcgtgcccactttaaaggaacaagagaacattataatggttatgtaaagtgtcaacacagactatagctctcccctcaaaagaattaagacagtttcttcttaagctcttgagccacattttagtggccatggcctgggaacacagattcaggttgacctgactgatgtgttccaccatggaaggtttagaacttacgacatttaccaaatgcaccgtagaagactgaagacaggcatgtgaccccataggtgggaaaatccctgccgctggatgtcaatctgataacattcttaccttgggcaggcctgctaagaatatgtttcaaagttttgacttattaatcaaagggtgaacaaagaataggcattaagaagacagattaaggtgcacacctttaatcccagcactcaggaggcagaggcaggcagatctctgagtctgagaccaccctggtctatagaacaagtcccaagacaaccagggctacatagagaaaccctcttccaaacaaaaaacagaaacaagaaaaacaataacagcaaagactaaaaatagtccaaggtgattttagctctggatcggcagcattctaaccctccacaataatgaggtttcatatctgtattcagttgagactggctagcaaaacctttgctgtttattagttctttggagttctattaagtcagacatggtggcttatacctctaaacctcaggaggctgaggcagcctgggctacatagtgagtccagaccagcctgcaagacggaatgagaccttatctcagaaaacaaaaacaggccaaatcaaccatttttaagaggtctattaaaatgtctcagtagccgagtgtgggagcacacaactttaacctctgcacttggtgtttatgcttgcttttctgattttgctgggtcttgagcctgtgttaatcccagcacttgggaggcagaggcaagcctatctctgagtttaaggactccctcttctccacagagcattccaggtgaccaggacacacagtgagaccctgtctcaaaaagttaattaacaaattaaaaataaaatgtctaaataaaaagaaccaaaacataaaaatttggcttctctttattaatccttcccgattcctggtttacctttcaaagggttaaatcctttgttcccgtggtttattttacaataatatatcatgacgtcatcctttgaaaattatttatatacatttgacgtgtgaagataaatgatttctaacctcagtcagttcaagaagagtggaaaattttagctgttccagtttgtctgcgaacacatgcttagttgttttacacacatacacacacacacacacacacacacacacacacacacatatacacgtagtgtcccaccatccccactaagagatagccattcaactctagagtacttttgtagttgtatgaagttgagtgtttgctatccaaaggcacctgtccaacataaataataaaagaacattctaaaaatacccacttaaggaattaggtgtgtactggagacacagttgtccagggaaccaatggccatcgctcactgcacaaacaactggagggcggtgagtttctcaaaagaggcttcttttgattcgtaggtgattttttcctcgtgtggggacctggatcttccggagcatcagacaagcctggtgtcatccgaggacggcccccgggagcaggagaacatggatgacaccaacagcgaacagcagttcagagtcttcagggacttcgatttcctagacgtggaactggaggacggggaggtacggtgtattctctgtctcaaacactcgctgacctgcctaaacgaaagtgttgctttctctactggccacactctctatagcaagttctctagttagaaagttgtgaactccgttttgcatcaagttctgcaaagaacagctgcctcactgttgtacaaatcaccccgcccttcctgtctgagcccgaagcaaaagttgccaacttgtttttaaatggcaaagatctgaatcgtaatgactacacaaagactgtgtgtgtagtctgagggagaattttttttgttttgtttttaaatcacaggaacgcatcatttctaagcctgggacctgggcaaaatatgctaacaattccatttctaattgattcagtcacttcaaagcctgctgttgccacccctagagatcggagccctcaggctcctgtattcctgtgttgtgtttaatgaaatcattagtgcttagaatgaaatatgaagcatgagacagatccgctgtcttagcccttcggggttgcttggtggtcggcattccagacatctggggcagctgaattcaagtcctggcaggcgtgtgcagatctgtctgtttggaatggcaataataagattcattgctgttatctgggggcctgggaggaggagaagaaacaccttcgattgtacagctcagggcacgttccctgggagaagcagtgccttgcctccagggaatgaaaattcaagattgtgacatctaatgctgcattggtcaattctgacttaactaaatgcactctctgttccaactgcagcctttacagttaaaggcccaaagtgaaagttgattatagcctgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggagtcctgaaatgcctgtgagccagtgctgcgtgctctgctgaggtcagggctccttgaccgagcagctgacctaactctggtctttggttagagttcaaggtcagcaccctctgctttccagaagttcaactgacatcaaaggcagcatcctcctgtctcagccccaggatggtattacacagagtggcctggaaggcaattagacataattccagaacggctagttcagaggcagaatacttatctaacaagtctaacaggcttgactgcctgactatctcagccccaagaaaagcaaaacaaacaaacaaacaaacaaacaaacaaaactgaagctgtccagggacaataaatgataaataccagaatgtatctttcattatctctgtattgtcctaagcaacagcaactgacaactgaaaatcacgtaggttactttatcacctaaggttaggatgttagagagctgaagaggaggctcagcagttaccagcaccagctgctcttctacaagacctgggttcggttcccagcacccacccagtggctcacagccatctgtaactctcaggtccaggggatctgacgccctcttgtggcttctgcaggcactgcatgtgaatagtgtacatcatgtacatccgtgcaggcaaaacactccatacacagaaaatgaaatcagtattttcaaagattaatatttgtataaggagctcaagaaaataagaaaaatgaatctaaacaaagtagtaaaaaaaagaaaaagaaaaagagtaaacacttttgtaatcccaggtacttgaaggcaggagggtctcctgagcccaggagttcaaaattagcctagtcagcacagatgacccttgtttcagaagtaaagaagaaaaccctttgaggaagctttgcagtttctggactaaaataaaagacacagagatgttgagagcacagtaaaatgaaagcatttgagccctgagtcctcatgacttcaaggtctgccccttgggccagtgggtataattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaaaccaggtgctctgcaagaaaaaaaaaaaaaaatggctgataatggtgtctgggcccaggcctatgacagtatatcatcttaagcaagctgacccatgaccctatcactttaggactcacttaagtagctttatttggaaaaatgtatttgattatttatttatttgtttgtttatctatttatttaattttggctaggggtagagcttaataggatattgttttgtttttttgtttttgtttttgttttttggtttttcgagacagggtttctctgtgtagccctggctgtcctggaactcactttgtagaccaggctggcctcgaactcagaaatccgcctgcctctgcctcccgagtgctgggactaaaggcgtgcaccaccacacccggctcaggagattatttccttatcatgcacaaagacctggttcaattgctggctctctaacaataacatttttaaacacagtttcgttttaaataatttcaagaatattatctttgacacttcaagggtatttgtcaatattctgctatctcgggataaactctgggtgttatgtttaaatttgacagctatatgtgcaaatggtccatctggaaatagctgctctgtattttcacacacacacaatctggcatcatgaatcaacagggttttggctttttaccttgtatgtgacctaaggcacatggtgggcatctggtgcagaggcaggatgggtggctccaaccgagggtagtcagtgctatgctgagaaagctgagcttggagctagaaagatagctcagtggctgctcttgcagggtacccaagagcacctacagggcggctccagttcctggagatcttacaccctcttctgacctcccctggatagcacacacatggcgcccaggcacacatgtagatggaacattcatacacataaaacaagaataatttttttaaaaaaactaaactgacttttacacactatagactttattgtgtatgctagaatctgaatccaagaaccgttagcaatgataatcacgcttttgcttctcttgttctttccctgtttctcttcccccttctctccattctctctctctctttctctctctctctctctctctctctctctctctcacatacacacatacacttgctcatggccggcctctactctctctctcccccctccctctgcctctctctgcctgcactgccctcttaactcccctccccgtgccctgaataaactctgttctatacttaaaaaaaaacaaaacaaacaacaatgctaatcacatgttctagctttacccatagtccttaccgagagctacacccctcagctaccacaagggaaataatttcaacagctttgcctggaatagaccggtcacatcctctatggagatggatattacctgtgcctcccagttctcatgcccagtgggttcagtttcccccacatcgacaagagcatctgtgcccagtatagcagcctctgacctgtcatacctctgggatgctgcaggctccatcaatggaggagacctccagagctgtggcttgtgggagccttcccaaactcatctgttcatttggcacaagaaaaattgttgttgtcagtctatgtttacagacttctcacattctttattttccttatttccattcccctccttttgttgttgttttgttttgtttttacaaattacatttctttttccttttaggaccttttggtctttacttttttttttttttccatattcctactgcagtggttacgttaaagaattaactgttcccactaggaagaaacccaaattattcagtagtaagttcttacagccatctgcgggaaacaggtacaggtggagtttccttatgcagaatgcttgggactagacatgtttcggatttgagtggttttatttatttggaaatatttgcatatgcataatatacacacagtttcttggggatgagcctcgagtctaaatgctaaattgacttttatttcctctgcatttagcctgatggtaatttcatacagcatttttaggggggctgggttttgactgtcagctgtaccatggaattttccacttgggacctccattgatggccctcaagaacagttgggatttcggaacacttcaaagtagggaagaccaacccacatagcatgaagacagacccaggttcagttcccagcaccccagcagcgcaaagccatctgtaactttaatctcaggggatccgactcccttcactggcttctgtgggcactgcgacacggtgtacctgcatacacacgggcacacacataaaataaaaataaataaatccctgaaaataccataacaggacaaatgatggtaacactttctatatctgcaatgatgtatttaggaatcttgctattgctttcttccacaaatggtcaaaacaaaacttggacaggctgccggcacctgttagagttgaggtctgtgacaccaaggactggttcaataaacctgccttatctaaaaccaggagccagaagaggagaactaagcctcctgctctctgcatgtgatacccacccatggctcttggactagtgtgctgctcgctgacctcaggagccattaggtttcaaatgaccatccaatgagatggagcgctggaccttactcagatgactcttttgtttatcatcagagtgtgccttagttagggtttctatagctgcaatgaagcaccatgaccaaaaacccaaactgaggaggacagggtttatttggcttacacctccacgtggttgttcatcactgaaggaatcaggacaggagcttaaacagggcaggaacctggaggcaggagctgatgcagaagccatggagggtgctgcttactggctccccatggtttgctcggccagcctgctttcttacagaacccagaactaccatctcagggatggctccacccacaatgggctgagccctccgccattgatcactaatttagaaaaagccatagagctggatctcatagaagcattttctcaactgaggctccttcctctctgatgactctagcttgtgtcaaatgacacacaggaccagtcagtacagtgtagatatcgtcctttagtcctgattcgagagaaccgaaccccacattcattttatctaatacctggcgcttttgtagagaagatatgagctacaactccaggagttaaaacttccttgcctgactatgcttgttctcactgagtcagaatgggcaagtctgcaggaaatcttcagtgccaaggaaagaaatttaaccacttcccagctcgggcaatttaaacttgagtcttaagcaaaagccaagttgtggcttccgattagtgcacagcccctcaaacttggcacagctctcacagacttttaactctgcatttttctgtggaatccgttgtggcaaaacagtctagggtgtttacctaacacgcttctacttaacaacagccaaggcattccggaatctgctctgagcacacttgcttcccctccagaaaactctaactaaacagaggctggcgggggagggaaggtgcaccctaattttagttattttaatattaataatctccctcttttttttggaacagatttttgaaaacacaaaattttctagggtttaccaaaatcgactttaagaaatatgtatttctctcaaaaaaagaaaagaaaaaagaaaaaaagaaaaagaaatatgtatttccttctgggtgtgatggtgcatgcctttaatcccagcacttgggagagagagaaagagagggacagagacagagacagagacagagacagagacagagacagatggatctctgtgagttggagggcagcctggtctacaaagtgagttccatgtcatctaaggctatatacaaagaggccttgtttcaaaaaaaaaaaaaatatatatatacatatatgtatacatgtataactaacacatcaaagagaaagtgtgtcttcacttttacttggggaagtaacacacatttccagaaaagcttggctttctttgtctccttattggtaaacagaagtctgagcattgaagcagatgagggcttgagagtcgatggtgacctcgtttgtttctaagctgggactgactgtgtgaaggtgtgtgcgtgtgcgcgtgtgtgtgcaggaggacccggggcatgaaaagtcgtttgtggtgtgatttcagggggagagtatggacaacttcaactggggagtgcgcaggcgctccctggacagcctggacaagtgtgatatgcagatcctggaggagcgccagctctccagaagtactcccagcctaaacaagatgagccacgaggattccgatgagtcatccgaggaggacctcacagccagccagatcctggaacactcagaccttgtaagtaggaactctcccactggagggttgggaaggaagccttgggtttggtttgctttttttttttttttttttttttaaattaactcaggagtttggtttccagccaaataaactctttatggctgttgacctcttcttcactgtaggtcactgtaggcatttggtaccctgaggccaggtcatacggggttgcccacggctacgttaatatgctaatgacagtcaatgatatagagagcttaggaaaatgatacctgtcaaccaagtaccggggaccagtgatgtgcgttctcctgacaggaacttcctttacattttctttgctttgccttctaaacagatcatgaacctctccccctccgaggaggcgaatcccatggagctgctgaccagtgcctgtgactccgcccccgcagaccctcattccttcaacaccagaatggcaaacttcgaggcttctttgcctgatataaataatctgcagatttcagaggggtcaaaggtgaagagatttgtggaatttctattgtaaggacatggggggaaagaccaaaaaaaaatcctgttaagagtttgtagagggaggttcaaagtggaggggctttacgcctctggttttagtgaaatgactgaagctcccacccggtcctgtgttttgaagttgttttatgctcacaaacttgagcagacgtccctttggctgagagatttggcctgaggcctttgtaaaatgaaatacttgaccactgactgactgcaaaagcaagtagtggagagagactgtcgtggcgctgggagtgtggtggcttttataaaacagttcactaagtgaggcgtaggagtacgcgagcactgggggggaatttttcctcgagtaggaaccaattatacaatttgctcattgattcagtgcttgccttttggcaaacgatagaaatatttaatgtcaatcacacagaattatgccaaatctgcataaaactctcctagctggactccctgagaggaagagttatctaatatataatttccctactttaaaaggttggctttaagacaaaaaaaaaaaaatcttgtggatattttacttaaggtttagtttatcaaaattcacagaaaatatcctgccccatgaaaccattcatttggatgttgtaaccacacatatgacctttagtgtagaattttatttctttatattagagatatcaaaatagtcttatcactattagaatagaattagtcattcctgattctgattttggctatagttttgcaactttgaaagagaaaaaaaatatggtgggggggtaggggggagaaatactgataaaggaaagctataacactttctataccattttacaatatgccgaaatcaagaaacccctgacaaaaaaccaaaaaaagaaaaaagaaaaaagaaacccctgaaagctttgaaccaataatattagagctgaaaagaattatttctatgattgccccaactcaaaggaaagaataagaactgtaattgggatttcttggcattggaactgttcgtttttggccaaaaaaataaagccccctccccctgaacaaactcttgttctagattgaaaaatactagaacattaatcccaagatcaagacattttaagttaaatttcttgggaaaccatcataaaacatatgtgacatgctgagcatgttatttctcggcatgagtaaagtctctccatttttcttttaaatgcagacagacagatagatagatgattgattgatagatagatgatagataaataaataaaatattggctctcacttttaaagacacctccattttctcatgacctaaattctatggcatttgatatagttacggtgttagaaaagacatagattcatccgtcagaacttggtaccaccaaagacatgagctatcctggctctctgattacagctttaacattctggcttgcttttcctcattaaccctaaagtcagaatactataaaccatggtcagatgttagcccgtggtaaaggtctaagtcacagacatttctatttcaccttgacttgatttttaagatgactcacagaagcacgtacgcatgtttccttcctctgcctttctgatgtgtagcccagttgccttccttcctctcacagaacagcctgttctccagttgactcccccacccccaccccgcctcagctcaagtccagcctcttttccgttggactgtgtgtatctcttcccttcctctcactgacccaagatcttcctgctctagagcggttacttgttattgtttattgctctgtggttaggtgactgctacactctcaccttagccactctcctaggaggggacagtgctcctgcatgcaggtgggtggcggggtgctttctgtataagaaagcctgtcaccacggtataaggcacactacagattcccctctgaacctctgttgtgccatgcaccaaggcatttataatccagcctttattggaaaaggaatttcctattggagaataggtctggatgtgcctgatgggctgcaaaatcagagtttatctgtgtctgccttctctggtgtttgaaatgacagaggtcttgtgaggtgggcctccagggacaggtccaggcatcagcatacataacatctgttctgggggtgccaagttcttatgaatacaaaagcaaatagcttctcttccagctctaactctgttgaccaacctgacactgagaaaatactttgtacacagagcagaggttgctaatctgtaaatttggaagctagacaggatagaggaggtgtctctctgacaatatttcttttaaagatttatttatttcatgtatgtgagtacactgtagctgtcttcagacacaccagaagaggtcatcggatcccattacagatggttgtgagacaccatgtggtttctgggaattgaactcaggtcctctggaaatgcagtcagtgctcttaaccactgagccatttctccagcccctctcagacaaattgaagttagtgtgaacttacatataataataaataaatctttgggccaggagtaagcagggccatagagaacgggaccagagtgagcagagatcctgagttcaattcccagcaaccacatgatggctcacaaccatctgtacagctacagtgtgctcatatacataaaataaataaatagctctttaaaattgtgtgactgcaggctgaggcagtccccgaagaggaggacaccaccgtgcacgaagatgatctctcaagctccatcaatgagctcccagcagcgtttgaatgcagcgacagcttcagcctggatatgacggaggcggaggagaaaggaaatcggggcctggaccagtacactctcgccaggcaagggagcccgtggggaaccgggtggcatgagtatgcactgcatgctgtgtggcatgcatgcccctctctagctacacactacacactagctacacatcctcataccgcagagacctcctaacatggagcctggcaggaccttactgagatgcaatcatctaaccccatggagggctttccatagggctaagaatttacagagctagagagcaacatgaaaagcccctcccccacaaaggccccggggccctgaagctttaaagataagatatgagctaaacttgaaaatgaattcttcccgagttaaagacacaagcaacaggctttttttttttttttttttttgagatttatttatttatttcatgcatgtgagtacactgttgctgtcttcagacacaccagaagagggcatcagatcccattacagatggttgtgagccaccaggtggttgctgggaattgaactcagggacctctggaagaggtctttaaccactgagccatctctccagcccagcaacagactctttacaagctaaattcctgctctttaactgagtctctggtggcatggtggccagtgcctctaacagcagtgacttgcataagcacaaagggaagacggagaggtaaaaacatcataccttgcattgattcagcatctaccgtaagtcacagattacagtgcggcttggatctactttaggagagaggcaagatgttatacttgtatttgtgaatactgagaaaaatgagagcaagtcaaagcccggggctacacaaaggccatcagaggaaaaagctgcgggaatagcatggaaagagcgggaccttccacatcctcctgtctttcttcctgcctgttctgttcactgttagtcttcattcctgtcctgccctccccatacctcggtattcccagagtttgtacacatgaattccttgtctgtctgcatcagggacaagtttgaagagcccaaagttagaatagagttgttttttgggttttgttttgttttgttttgttttatgaatgcaaagtgtagaaggatggtagtgctgagcttgggaacaaacatttactgtgaggcctgggccctgggagagcaagggcttgctgagggctatgagatgttctaagcctgtgcaaaagaactggaaatgccaggcatttccaaaggtggtgaaccccttagaggccagcattcaggaggcaaaggcaagtgattctgtgactttaaggctagccaggtctacatggtgagtttcaggccaaccaagactatctagtgagaccagttttaaaccaccatccctacctacccaacccaaaaaaggagggatcatagaaatgccagaagtaaaaaaaaacaaaacaaaacaaacaaacaaacaaaaaatgatttcctaggaaccaaaagacctctagtaaaaactaaaccctagaaggccttgaaaggaataaagagcccacagggctatcttgccaagctgacaggcaagtgtagaacttgtacggctatgtacaagagtctgccatcttttgatggtcccggtgtccatgttttccagcttcggagaaggtgacaggggtgtgtctccccctccctcgcccttcttctcggccatccttgctgcctttcagcccgccgcctgtgatgacgccgaggaagcctggcgaagccacattaaccagctcatgtgtgactcagacggctcctgtgctgtgtacacatttcatgtgttctcctctctgtttaaggtatgggctcctggagcatcctgaggatggccgatggctgtgggcttcacaaggggctgttgtctctctccactttcctaatgccaagaacctttttttttttcttttaaagatttatttatttattttatgtatatgagaacactgtagctgtacagatggttgtgagccttcacgaggttgctgggacctctgcttgctccattcggccctgctccctctgacccaaggatttatttattattatatctaagtacactgtacactgaagctatcttcagacacaccaaaagagggcgtcagatcccattacagatggttgtgagccaccatgtggttgctgggatttgaactcaggaccttcagaagagcagtcagtactcttaaccattgagccatctctccagccccatggagaccttttaatagagtttctcatgttgtggtgacccactggccataaaattatttcattgctacttcctaactgccatttttctactgctgtgaatcataatgtaaataactgatatgcaggtaatctgatgtgagatccctaaaggggtctcctgccacccacagaatgagaacagctacctctaggagtgtgtaggtagagactagtttctctagctacagcttttattcatcctttattgccttacccttatgaagacaccaaactcaagtgatctcaggtcagctgtcgttaggggaacttttatctctgccaccccattttctgttgatgttctcaatggtaagaaaccatggtagtttagttagggtttcttttactatgataaaataccatgggcaaaagcaacttgggggggtggacagggatggttaaattggcttttaactggcagcccacccttgaagaaagccagggcaagaactgtagcagagactatggaagaacattactggcttgatcccttaggacaaaccacttgatatttttgtaatagtttaaaattttttttagtaccgggcaaggtagctcatgactgtaatctcgacctttgggaggcagaggcaggcaggttgttgcaataccggagatagcctgggctacatagtgagttccaggctatcctgggactacagagacagttgttttttccttttaaatatttactatattattttttttaatttcatacatgagtactagtttagtactattgctgtgaagagacaccatgaccatggcaattctctataaaggacaacatttaatcaggacaggcttacagtttccaaggtctagtccattattgttatggtaagaagcatggtggcatatagacagacatggttgtggagaaggagctgagagttctacatctggattggtaggcagcaagaagagactaagatcctgggcctggcttgagcctttgagacctcaaagcccaccttccatctattccaacaaggccatacttcctagtagtgccactccctggtgaccaagcattcaaatctgtgagcctgtgggggcccattcctattcaaaccaccacaagtactgcatttatttcaatgccacccatgctcccactccctcacgatgtcatggcctcttctttaattctgcacacacatgtgtatgcacataggaatgcaacctgctaaattcgttgaggattgctcatgtgtatatgagtttaaggctgaccatcccagggcccatccctgggaaagactcgtttccttttctcagtagccattgattgcttgctggtaggtcttcatcaaggagtgggtccttgtaagatactttttactgtgcaggtctttttaggtaaccatattgttgaaatgtcatgcatgcagctgccctgtgacatagctagaagatactacctcataacagacatacccgtgttctggctctcgtggccccctccccctttccatgatgtcccctgggcctcaggtgtagcagctgtgatgtatcaactgtgagtgggtacccagtgtcattggtttgctctgttctaaccagctgtggatttctgtgatggtttccgctgggaagagaaggttctttatacccacttctctgtgggtatagagtcttgattatttcacacagtattacattttctagttccacccgtttataatttctttttatttctttttttaaaatgtatttattttatgcttgtgtgtacactgtccctgtcttcagatacaccagaagagggcatcggatgccattacaaatggttgtgagccaccatgtggtagttggaattgaactgaagatctctggaagagcagtcagtgctcttaactgctaaaccatctctccagcccctagagtttcatttttcttttcaaccgaataacacgcagacacacacatacacctcctaatagtgtatatataccatattttcatgatccattagtcagttgaaggatatttaggttgtctccatttcccaatgtggtagtttgaataggaatggcccccatagacttgtgtttaaatggttggtccacagggaagggcactattagcagtgtggccttgttggtagaagtgtgtcactgtggagttgggctttgaggtcttctatgtttaagctatgcccactgtggcacacagtccctgctgcctgtggatcaatatgtagaactcttggctcttccagaaccacgtctacttggatgctgccatgcttcccaccatgatgataatagactaaacctctgaaactgtaagccagcccaagtaaatgtctttctttgtaagagttgtcttggtcatggtgtctgttcacagcaatggcaccctaactaagacacacagctattatgattagatcagccatgagcacagctgagtgagtatttcttgagtaggaagaactcaagaaatttcctttgggcatatgctgcagggtggtatagcagggtcatatgataggtctatttttagctcgttgaaaactctccacattgatttccaaagtggctgtaccggtttgcaatcccactagcgataaatgcatgttcccctttccctactagcatttgttgtctgttgttttcttgatttttgccattctagccagaggaagaaaccatcaaagtagttttaatttgtatctccctaattctgaaggatatgaaacacttaacgatattccttagccattttcgtttcttcttttaagagcgctctgttcagttgcagggctcttttttaatcatatcatttcttgtcttgactcattggtttgtttgattttagtcctttgtatattcctcttccagatgtatgttgatattgatcctctatcagatgtatagctggcaaagactctcccccagtctggggcttacaccgctgatggtttccttagctgtgcagaagctttttagttttgtgaggtcccatttgccaatggttagctcctgagcaaatcttgtcctacccagaaaggcctttcctcaaagatctagtcttctaaggtactgcctatgtgcccagctatctatcactttctgcatgctgggtttcacattaatgtcgttggtccatttggtgttgattttgtgtgcagggtggtagagaggggtttaatttcattctcctgcatgacgccatctaattctcccagcaggatttgttgctatttcctttaggcgtatgcagctctgtaatacagctcaaaatctggaccagtaagccctatgcattggcctgctcagaattgccttgattctctgagctcttctctgtttccatatggattttagtatttctttgctacaactattatcatttctagttttctgggagggttttggggatcttttatatatttcttcccatatcatctgcaaataggggtagtttgaatatttcttctccttttcatatctctttaattttcttctttggttatattgctctggctagtgcttcaagcactgtgttgaaaggcctagggataggtggtggccctgtctccttcctaatgttaatggcatgaccttgagtttttctccatttatgatggtgttgcctgtgggtttgtcatatatagcttttattatgttgcagtgtgttctctgtggatcccctggggccgtgtactaggactcaagcttgcgtcctctgcaagagccccatgcatgttctcttagctgctgagccatctctctaaccccactttttgtttgtttttgtttttgaggcatctcgtgtaacacgggctggccctgaattcctgatcctgtctctgactccccagtctttgattacaggtttgcaccaccatgccccaaattatttgaaacttctgtaccacacacacacacacagagagagagagagagagttattttttactgtacaagttgagcttggcctttgtgaatgatccctctcctgccttgcagaatattcaaaagaggttctgcttcctaacctgtgatgcagccagttaccttggagataacctccggggaatcgggtccaaatttgtcagctcttcccagatgctcacctcctgttctgaatgccctacgctgttcgtagatgcagagactgtgagtatccctgtcctgctcagcacgttcatgtatggatttgttattatagtgtgtatgcatgtatgtgtgtgtgtgtgtgtgtgtgtgtgtgtgtgtgtgtgtgtgtactttccgtctcctcagcccattctgagttattctgactttctcatatgattgtatgactctcacagaggtcaccagggagcctctaactgactatcaggtcagaagaggaagaaaactttgcaactctgacttgaatttttcttttctagacacagcctcccaagttctcaggcttgctgtcagctataagaggcggtcagctataaggggcagcaaagtcagtcttgcccacagcctgattggtccctcagcaaggaatgcaatatgaaaaataatttcattttaaattattttaaatgcaaattaaatacaaaatgagtttacagatctctctggaagtctgtcttccataacaaaataggaaatattactgatcctgatgacagagtcatgcataaaatgggtaccacatcttaacattggtttccagtggaaggcttgggttgtaaactagtttccagttccagcagtagccaaagtgaagccaaatccattccttacttctccatctccttcttttctgtttgtatactagacctttccgttggtatttccatctgtttttaaagcaaactgtttcctgtctttagctcctttcctgtgggctcctggacaagctcaagttcagtgtgctggaactgcaagaatatctggacacgtacaacaacaggaaagaggccacactctcggtaagcctgtgtctctgtgcatggcagtcagttacaactgaaagagcacagccgtgggtgtgggtgtggttgtctgtgtgtgtgactctgtgtgtgtggggggggggggtgtctgggggggtggctatgtgtgtgtgggtgtggctatgtgtgtgtgtctgtgtgtattgccagttcctacttcagagtcacagaactacatataatactggttatagccaaatgcacgtgacctttgtccaaaggccaagaggctcaaatcgaaccaagaaaagaacaatcaatgttcagctttcaactttaccccaccaaggtccccactgagaaaccagcacatacgtttgtatctgctcagtatgtcccttgagatgcattagaactagtttcctgggctggagagatggctcagtgattaaaagcaccgactgctcttccagaagtcctgagttcagttcccagaaaccaaatggtggctcacaaccatctgtaatgggatctgatgccctcttttggtgcgtcagaagagagtaacagtttactcatataaataaaataaataaataaaatctttaaaaaaaaaaaaaagaactagtttcctttgtccaggatttgaatttaggtctctagtctgtgaaaaagaccatgaccagaagtaagctggattagagaaggccttgtttgatctaagaaagcatcatgaagggaagtcagggtaggaatctggaagcaaggactgaggcagaagccctggaggggtgctacttgcttgctttccatggctccttcagcctgctttcttacatcactcaggactacctgcctaggactgctactgcccacagtggactggtccctcccctatcaatcactagttaagaaaatgccccatagacttgccagcagatggagctgatggagtggatttctcagctgagagtcccccctccaagctatgtctaggtttgtgtcaagttgacaaaaaaaactaaccagagcacctccttctcatgttagcttcacacagatcctccagcccctggtcgctctgagcagctttctttccctgtcctcctgacttcgctttgtcctagctattactctttactcttttatccccgctccatgatagaactagaagtcattccatgcaaaacacctgctttctgacagggagaggcccagagactcagggaagggagtcagctgtaaaaaatgtgacaaggtgtatgtatgacacctacttgtatctatgacaaggtgtacatataacacctattgtatctatgacaatgtatatgtatgacacctacttgtatctatgtcctccaatgaaattctccaaacactgtaagaaagaatatggatttcgaagtcagatggacttcagttcaaatcaaagctcagttaccatctctctctctcttttttttaaagatttatttatcattataaataagtacactgtagccatcttcagacacaccagaagggggcatcagatctcattatgggtggttgtgagccaccatgtggttgctgggatttgaactcaggacctttggaagagcagtcagtgctcttacccattgagccatctcaccagccccagttaccaactcttattggtcatctgattataatatctcactggaaaattactgtgaagttgtgacagtcatagaaactgtcatgtcatgagtccattctgtatggctgacagctcactgagttgcaggttgtccctgctgctgctgttgctgctgctgttgctgctgctgttgctctgttcacctgttttggttttttgttttttagtgtgaggtgggaacttcagggctcactgtgttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgccaggattaaagacatgtgccatcacatctggtaatgatattttattttaaatgacaggagagatggcttagcagtttagagcactggctgctcttgtagaggacccaggtttggttcctagcacccacatgatggctcacaagcatctgtaactctgaacccaggaaatattcaatatgttatgtagtgtgtgtgtgtgtgtgtgtaaatcttaaaagaaactgtgaacctccagcaggtattttaatttcagcaaatctttaccctttcaagattcctttcctaagtcattccagcaaacttgtagttactcttgttagaagcttgatcaagtcttcccaacaaaccgcacgatttaaatgtcctcaggacatctgtggatctacttatgtcccatctctctttttcttgacaacagtggcttgccaactgtaaggcaacgtttgcaggtggctcgagagatggagtgattacctgccaacccggggactcggaagaaaaggtaacaaacgccgtatgtctctcctgtggtctggctctgtggtggttttgagcctcatacgaagcatggagcttgagaagggaagaggaggaaggagttgtctcccacattcacatgataccaaagggaaagacaatgcatccataccatgaatggttgtgtgtgcatctataactatgaatggttgtgtgtgcatccataccatgcatggttgtgtattgatgggactgagggatttttgttttctcctctctggaaaaatagcaacataagactaacctttttgccagatgctgttaaattgtgctaatcgtttcctaatgagcctttcttaatccggaatatgaaaccacattccaccattccttgctgaactgcttagttccctcaatgaaatggttcattgaagtaaaggaaggttgtctattgacttgtccccaaacactgctaaaaagattttcccacttagaatagccctaagtgcattccacataccagcagctgattacgtacatatatgtgatatgatgcaggaaactgggaagaagactgagattaaactattcattctgcaattaggttttaagagcccctatttgggttttatggatccaccagaggctctgccctcctcttgttgtcagggagacagatggcaatccagacatcaaggaggcatagcctgtggtaaggaaagcaagctgttagcacatacagcagaacaaaggcatcaaacagaaggtagccctgggaaggaaggcttcctggttgggatgtgagtcagaagagatctcagatgtgaactagaggtaggtagctgtagaaaagggtaaggatgagaggctttgtaaaggtcctgaggcagaagggattgtgatggtctaagaactgaacagaagccatgggactgacaagcacagagagacaaggcctaagaagctccaacgagcatcgcagaagcctggttgtgagggctgggccctgcacagcaacggtaaacgatctgatccacaatgtgagcagcagggaagtgagcagactaaggctgctgggctgcacataccacacagacaaactgaaggggcgagggagcccacgagggaagctaggaggccgcaacccagtccacatgcagcaggtgtcacgctggaatcacatcaccaccgagaaggcttctcagatcacacacacgcccacgtaaaaagcaggctgtatcagtgtataaagagctcagtaagatttggggtgacaattttccacctaacaccaatagtccgataccaatttggtcactgtcaccaaacaactttagagtgccgagggccaatcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccctcccccaccccccaattagcccagagataagtgactaaggatgccaaaaaggtatctgtaaggctgagaaatcttagatgggattattagaggtagtttctgctctttttgagaacacatttctatttcagactgtagtttcctgagacttttgttttgtttttaagacacagctcttctgtgtagccctggctatcctggaacccactctgtagaccaagctggcctcaaactcacagagatctgcctgcctctgcctccaaagtgctgggactaaaggcatgctccaccaccgccctgcacatttcaagacagttaatataactccttcagagacaatgcttacttaaaagtgaagttaagaaacactctagggtttccatcaatcccgatgtgtgcacctgtgatgtcctgattcggctgatctgaatatatctcttaaacacacccacacacacacacccctactttttttttgacaggtaggattccctatgtagccccgactgtcctaaaacttgctatgttgaccagttggcctcaaactcatggaaatctgcctgcctctgcatcctgtgtattgggagtaaagtcatgtgccaccgtttggatacttttaaaaaataaagtattactaggtttcacattttatggccacctaagaggactgctcctggctccagcttgtttatccttttactccatcgtgctggccaaagtcaggccagaaaatagtcaatagtaacaattcagttggaagaatacattaatacatttcagacctatatcaggaatatagtttgaaaccaaacctctgatctgtttgttgagtgctagccctacaaataagtgggaactaaagctagatcatcctactttcaaatatactcacttcgctattttacttctcccagctctccataggtcttcatttctacttcttgggtttccattcaccttttgtactcatattccccacagcacttccagctctctcttcacacacacacacatgtgcacacaaacatgtagaaacatcatagtttacacacacacacaatctaaggatgttctaatgttgcaagtgatgtctcgttaggggacggccactgtgcacctgacctcccttagctgaaccatggtcctgtggcgtctggtgcttgttactgtacttgttgctcctgatctcttgtaaatttcactcagtttgatgtggcagctctaggtatacagtaaaggcttgagaataaaaacgggaggggggtaatgctttcaggtactgtgtgcatgtggcctcatttgcccctttacgactgccctagttttctcctcttgctatgatgaacaccgtgactgaaaacaacttgggaggagagggtttatctcaccttacatcatgtagcctcatcactgagggactacaaggcaggaactgaaggaaggcaagaacatggaggaaggagccaatgcagagatcatggcagaatgctgcttactggcttgctccccatggcttgcacagcctgccttcttatagaacacacaaccaaccacctgcccagggatggcaccacccacagtgggctgggccatcccacgtcagtcaagaaaataacccacagacttgtccaccagtctgttgtaggcatgtcctcaacccagggttccctcttctcgggtgactctggttggtgtcaagttgaaaaacaacaacaacaaaacaaaaaacaaaaacaaaaaacaacctatccagcaaacctacatccctctgcatttaggaatttttcattgtgcatttgagatgagctaaatctgagtagcattcacagcttgccatatcccatctctccaagttgtctctagcctactcttagaggcagaacacacacataggagggggaaaaggttgattgtggagttagagaaaaatggggggaaagcagcatctagtctgatgtctttaaccggctagtaaagtcaaccaggtctgcctcagttgtgcctttaacctgctagtaaagacaaccaggtctgcctcagctggcactagcatacagtttcagatatcctgttggtttgaggactcagtggtcaccagggaacttggggggcaacaatcagttatctggggaagatgcttttaatctcatgtatgtaatcattctggaatcttaggccagttattgacttaggcttcttctagggtgagatgcagtatatgctaaatagcacggagaacaagcaaacagtttgcttttgtctcgcaagatcatttctgttctcgtgcacataccagcctactttatgatgtttgggggtcgtctcccaccccacctccctgccttcaccagtcaagacagaaaaacctttcacaatttgcaatttctcaacaattaaaaacagattcccactggtccctctgttctagagtatctccccctggtggttgaagctcacataaacttaggtcaggaagctaagactctggccagctgtggtctctcctggcagtattttcagcctccaccctgtaaagtagcaaacactgcttatcactctgtctctgcaaaagtgtccccatgggagatgaagaggtcttgcttgttagaatttatgtcagttggcatactcatgtgcaaactgtatttttgactctgagtgcaagcataaaaatttacactcagcgcatcttgtcctcaatcatcattccagctattaggatcttcctgcaaaaaacactctgtctgccatttttcttgtctcaatacagcacaggaatatggactgccacccatgaccttatacaagctgaacaagtcaaatgttgagccaggctgttctccagtcagattgaaaccctctaaacctcagccttcagatacggtctacctatctgtcttccaaaagcaaatctctctcagcctggctaaagttatgtctgctaggattttaaaatagtaaatacctcaagatgtattgtctgtatcacagactttgaggtttttttactttgaaatatactcatgaacaagactggaaaaaaaaaaacatttttttctttaggacaaaccaaatggctgtcaaccgaagatgtagagtgttggcagagagcttgcctatcatgtgtaaaaccttgggttcaatccccagctctgcaaaaattaaaaaataacaaaaagcaggaaagagggaaggaagggagggagggatgaacggtaggcagtagttgtcactgtatcaagcccaattagtattaagaggtaagtgactaacactccttgcctgcttaaatttcatgcactcacatgctaagacacaaagaaaatctttttctttttcttttttttttccggtttttttttttttttttttttttttttttgagacagtgtttctctgtgtagccctggctgttctggaactcactctgtagaccaggttggcctcaaactcagaaatctgcctgcctctgcttcacaaggactgggattaaaggcatgcaccaccacttcccgacacaaagaaattcatcagtagcctaagttactttctatatagaatctaaactttatccctgtcttagtcagggtttctatccctgcacaaacatcatgaccaagaagcaagttgaggaggaaagggtttattcagcttacacttccacactgctgttcatcaccaaagaaagtcaggactggaactcaagcaggtcaggaagcaggagctgatgcagaggccatggagggatgttacttattggcttgattctcctgacttgctcagcttgctctcttatagaactgagaaccaccagtccagggatggcactacccaccatgggccctcccacccttgatcattaattgagaaaatgccttacagctggatctcatggaggcatttcctcaagagaggctcctttctctgtgataagtccagcctgtgtcaagttgacatacaaaaccagccagtacaataccatttagctcacacatgtgactttcaaccattagctaagatacagtaagccaggtatagccatgcatgcctataactccatcactcaggatacagaggcagggggactaaaatctcaagtccaaggctatcttcaaacttgcagcagtcctcctgcctcagcctcccagagtgatgggctcacagtgcctctgtgcctgcttctattcagcgatttgaaaacttcctgcctcagttgtttaggatttcttttttttttaaagacttatttatttatttatatgagtacactgtagctgtcttcagacacaccagaaaagggcattggatccccattacagatgttgtaaaccaccatgaggttgctgggaattgaactcaggacctctggaagagcagttggtgctcttaactgttgagctatctctccagcccacaaagcaggctttaaggtatttctcttttaaagcttttagagagattcatgaccagaatcaacaacaaccaaaaatatctcagtaaatttacagacactgcatacctatcacagccatgaggtatttatgataggtggagggaaggagaccaggaatcaaaggtgggggtctaggtgcaccttcagtagcatctgtagccactggggatgagttgacactcactagtcactggacagtgtctttaaattcactacattaaactgatagcccaaaagtttcggggtttgtttggttttttgttttgttttttttaaagaattttctgtgccaaggactacaaagggagtaagataggtccttaaatattttgaaagttcagaaccaagatatatggactcatacatagttggtattgatgaagctgatgtctatggcaggggctaagatggtgtcttactctaagcccaggttggccccaaactctcagtcatcctgtgtctgcctccagattgctggaaccacagatgtgctccacaaaacctggtctaaactgattttgaaagaaaaaaaaattgaacatttccttcagattgtagtacccccttcccagctaccaaaaatttccacaaactaattctatacttacggtgtcatttggtgacatttacaaaatggtagttgtagctgaacatgatatccttggtaaattttcaatatcttaagttaatacctagttctggattgcttttaggaattatttagtcgataaaaataattataaattttatttatttattaatttttggttcataagtgtgatgatgggatattcacacattatgggacatgtccctcccacagaccttgttacaatattagcaattacatatgagaaaactatctccataaataatcaaaagtaaaatgcatggaaatacttaccatgcggtgtgcttgtttgggagtagcatgctcaaaggcgtttattcctctgagacagcgctatctagcagtctcctactgcgcgctctcagtctgagggacgggaaatatcagtgattgggagtgtgctctgatcttgccaaagacctgggtttagttcccagcttgaatgttgggtgactcagctgattgtaactccagctcttatgggactccaatgcctctggtccccaacagtactaacactcatgtgcacatacccacttgcatgtccaatatgaaaggcaatccaattggcgggggacagtggttttttagatttctcagttccactcacattaatgcactcaaatcttcaagaacaacaacaactaggttacttctagtctcccagacagactcgggaaatcccaaggactgaaagccgcgtttgttcagagtcgcgttgcccactaatgcttgtttttacccagaccgctgtgcatgttgaatgggtacaacactggcaagcgctggccaggtctgggccagccaagctaacactgctgactacagctctgctcctggaagagggctgtgctctctattgcatgccacactgaccctatactttctttcctttcctttgtctcctgcaccatgcttgctgcgtagcaaatggaatctcttgcagtaagttaactttctttcatattctttgtccactgaggcacggacccatgacgagccttatttttactgttaaccattgtatctttcagcatggtttccctttttggtttaattttcttttctttggtagattgagacatggcagcttatctgtagccttctgaactgttttctctcccaaatagaaacctaccttgctatgaatgctcattgtctcaacggaaaattttaaacaacaaataccaccatttggcatttaggaaagtcaagagttttcatggctaggtttcaccctaaattgggaagaaaacattattttttaacactttttaaagttaattcgcaagatagttacattccataccagattttaaaaggttcccatttacaaagagagagaaagagagagggagagggagagagagattaacttatcataaggaattttacatttaaaccaaagacctagccagattcaacttcttcactttaaagctatttgccagtatttggggaatgggggaaagaaaaaggctaaatagaattggttttctcttagaaggagggaagagttgggggaaggggaaagcttcattcagcatagtcttatatatgtatatagatatagttagcatcaattttagtaacttaaaaattagtatcaagtcaagcagtggtagcacatgcatttaatcccagcactctggaggcagaggcctgtggttctctgtgagtttgaggccagcctggtctacagagtgagtcccaggacagccagagatacacagagaaaccctgtcttgaaaaacaaaaaccaaaacaaaaaatcaaaatcaaaggacatcagtgatagcaatagaatatactccataaaactgaaaattcttacaatgtatcctcttcaccagatttaggggaaagtgtttttgtttgtttgtttttaagacttattttttattttatgtatgtgagtacactgttgctgtacagatggttgtgaaccttcatgttgctgttgggaattgaatttttaggacctctgctcaccccagtcaacccagcaaaccctgctgcttcggcccaaagattgatttattattatacataagtacactgtagctgtcttcagacacaccagaagaggcatcagatctcattatgggtggttgtaagccaccatgtggttgctgggatttgaactcaggaccttcagtagtgcagtcagtgctcttacccgctgagtcatctcaccggcccaggaaatcattttaatttgcctctatgttcagctctgagctgagctctctatagcccctgagcacaggtcccatttaccctggcttcccgtagcctcttccaaacctaacagtggagtcttggcacatctgatttatagcagatgttcctctcaatggagaatactgagccctgatctccaatgtgccaaaggctctccctgttatacaccattgtctctgagagctaactcactgtcgatataagacaggctgtatagaggatctcaactcagagagtgctgtgaaccttgatagtgggatgacttgggatttctttctcatctatttcagactgtgtggcttgtacttctgtagacttcaggagtggctgccccctcaatgcatcccagacttacacagtcgtttcccaagtagcaactcaacttacagacttaacacctagaactagttagtattttgcccattggctcttcctttaatgaaaaggattcttggctgtttaaaagcagcctgtagcttataaaaaacaagccaacacaaatgctcagggataatttataggtatatacatatatatactgcatatacaactgaaatgtggtgtcccccccccaattccttttaatagcccatcctaattagtcattcagtgtcatataaaaaacaacattctgtattgtactgtgaccatctcactgatgctactgagtgggtttgggttcgttttatttggaatggaaacaaagaagcaatccagcggttcactcctcacagctttgtgggttgagctttaacagctgtttctccttcccgtgtgccctccccacccccaccccgtagcaactggagctgtgtcagaggctgtacaagctgcatttccagctgctcctgctctatcaatcctattgcaagctcatcggccaggtgcatgaagtgagctccgtgcccgaggtgagtccccgaaccacttagtggtttccttattggttttgttttgttttttcctctgtcttccaccctactcataatggtacaaatcaggtccctctttgtttggtgttgctggaaatattaaaaaaaaagatcccgcatgttcccgtgcttgcgcctctgccccagcgatctggccagacatgcactggcaggcaatggccgacctgtttttaccttgtagaggctcagattcagaactccagtctctctacccaacttgctaagttcccacccatgggcaggttgctaccatgccaatcccaggcttcagatcccccacgacctttgtggtacacatctggaagacccacactttgccacagtacctttctctcttgaacccagatgagcctccatgtgaaggaaaacaccacatgaacttagttcagaaacaatggtaactcaatctctgggagcaataactaaaacataatcctataaaccttattaaaatccgattcctccagtggcgaatcccttgtagattcgccatgatactgggaaactcctgcagctacatcttacccctctgctgtccccattgcaagaaagacctaactctctcctgcttcctctcttcatccatccaacccagannnnnnnnnnnnnnnnnnnnccacaacatttccccctttctgttctaataaaaaaaaaaaaaaaaaaaaaaaaaaaaaaacctttctctcaatatagagcacaactattaccattttgtaatttataaggtataagatagacctaactcccagtccatcaactttgtcattaagatggaacattgtcatctatcctaaattaaaagacttatcattctacacctgactcatttcctggctttagatcatatgccatctgaaaaccatcttctcaaatctgttctctcagtgtaaataccctgggttggctatgagactataagtggtttttaaagcacatcagaaatctgagaatgaccaacattaactgaaaatatataggaagcctaacacagcttccagaactgagacaaattgtagagacagctgcctacctatacagccccaggaagtcaggaagatggagtatgtcttcagccttctggcccaggatcatctgacagacccagagaaacaggatattaaggactagcctactctgtctcagaatcaagctgtcctaaacctgtaatttcgtcctttctttggacagcattatgtctgtagatgaaaagaggcaattcttgcataattgctgtctcaccacaactggagtaactcatagatgctcagtttcttctttgaatccaagacagggaaagctgtcaggagcagactagtctcaacagcaagtgaataaataacactaaatgtcacattctgtgaatttctgactttttgaaaaccaactatcaatataaagtaatctggactgttctccgttaactactctcaactatttctaattacagcctctgaaaacaccctaacaataaactcagagccatgaatttgctttttggaccttaactcacaggcttctatatattttgtaccaatgaaaaccttgattttgcatcaaaataaattctataccaaaataagaaattatgacttcagcttagtaacaattaaaaagatttctaccaaatgagattatggctatgcaatcaatttcagctattcctccctattccaattatgaccatttctacattccctagaaagacaacctataataaccccctccagccccaaagccaagggaattggggcgacgactcttcataacttcttcaagctgaatataggtgttgagatattttgaattgtgggggagggttaggggaaataggggagttatttggccttaagaaggccacaacaatgatggatttagtctctgatgcttgtgtcctgactagatctggctgaagtccaaggcatcaggagttcaagtaggtcagttcaagcatgtctgatgatgaaattcaccaaggctgtatattctataatatacaaatctcaaagcaaaattttagtatcatcaagataacctttttgtttgattctctggaatctacttcaggggatctccctctatcaaatctgattcatataactctggaatgtgtaaacaccttaatcaccttttccaaaaacacaaagacaaaacctttttcccaaatcagcatatctttgagcccataaccagaaaaacctttattttgacctctctcccagaggaataatataaccatgaaactcgacatcacacccattttgaaaatcaaaacaatctaaaacagatgaagaaagaaatttaaactaagatactgtatgtgcctatactaggcctttcctatcttgcaaaggacaaaaaaaaaaacactcaagattcctgtggagcccatgttagcagaatatgaacttcctatggctggttaaataatctataccatctttccgtttggccctctgcccagcaccacagacatattttattaatacctgtataatctctatctgttgaactctctacctggagccacagacatagatagttaatacctgttcaaagcaggcaatgatttatcactgcactctctaccctggagtcagtgactaatattccctatcctaattcaaattaaaacaatccaaaacaaatataaataaactaaaatactgtatgcctatacttaggcctttcctatgttaccaaaaggatataaaatccaatattcccatggagcctacgttagacagaatgtgagtatcctgcaagacaagtaaagcagttttatatcatcttatggttcggctctctgcctagagcagccgacttgttataccatctatttgttcagctctctgcctggggccacagacatttattttattaatacctgttcactgccctctctacttgaagtcagtgacaaattttctctatcctaattctgacccacaggtgaaattctccacgtgattcagacaaaatccatatataaatctatcctaaaagcaaataattccaactttttataagtacacagttcaatcagtctctgccccaagaagtaggcaacttccattctacagctctctgactgagagcagccagtattcctcatagcatggaacctcagaatctagtatgtttcaatcccccgcccttgagtccatgtgactcctctcagagctacccagctactcacaaaaagagagagagagagaaagagagagagagagagagagagagagagagagagagagaagagaagagaagagaagagaagagaagagaagagaagagaagagaagagaagagaagagaagagaagagaagagaagaggaaagaaattaaaactctaactttccggctaataatcttacatttctttggattcttgcccaacacgttggtttgccacctgttgcagcaaatgtttaaaaagattaaaccagcatcttcccacgcttgtgccgctgcccctgcagcctggccggccatgcactggcgggcaatggccgacctgttttcatctcatggagattctgactcagaactccacagtttggtttttgggtttttttttttttttggttttgggtgccccccacatacaattattattttgttcaagcacaagtgagaaagaaatacatttctattctcgactctgaatggttttctagaacaggaccacaactaagatagagagagtgaggtagccccacatttggagggcaaacccccttacccctacagttaccctggatgctacacatcaccctgctgggttttgtcctaggcatgtagcctttcacacttgcttattgtgaggtaaggaagaatgtcttcaggcttctgttccttgctttagcatcaggatgctctagtgcatctgaatctaaaattcaaatcattcgagggcaccgcttctaaacgggctccagttttcctaggactgaaagcaaaaggatggtaatgtgcactggggaagtgtggagagtgtatacctgacagtggtgtgtgtgtatatatatgtgtgtgtgtgtgtgtgtgtgtgtaatatttatataacccaagcctttatatttttcacacttgccaatggggttttgttgtagttttgtctgttctgaggcaaggtctcactggtagcccaggctaacctcactgggtagcctaggctggcctcaaatcctattgatccttctgcctcactcttccaagtgctgggattgcaggcgtgtaccaccatacccagcgccctcgtttatacagatactgaatctcttcttaaccagaccctcatgaccaaacttctgtatctaactacattacatttgtttcaaacagctgctgaacatgtccagagaactgagtgatctgaagaggaacctgaaagaggccactgccgccatcgccacagacccactgtacatcgagggggcgtggtcagaaccaaccttcacctccacagaggcggccatccagtccatgctggagtgcctgaagaacaatgaacttggcaaagccctgaggcagatcaaagagtgcaggtggctccactgttcctcccaggggcgcttgtgggaaacacagacttaatccttcccgtttagtggttagggaccactgttcttccataggatccaagttcaggtcccaacactcacaaggcagcttccatcaatctgtgattccctttccagggaatccagtgccccctgctggccgctatgagcactgcgcacatttttatactaaccaagactcatacttcccaactccatgcctctaaatctttgttgttctttcttcccccacagaagcctgtggcccaacgacatctttggaagcagttctgacgatgaggtccagacactcctgaatatttatttccgtcaccagactctgggacagacgggtacttatgccctggtggggtctaaccacagcctgactgaaatctgcaccaagctcatggagctgaacatggagatccgagacatgatccgcagggcccagaactaccgggtcctcacagccttcctcccagactccagtgtgtctggcactagtctctgacaggagcctcccgtcccccatggcttctaagcttgcagtgctgccatgctggggcgacctccttcagtgtcttctcggccttcgcaaggcttggacggaccattcccctcttcttacctgtaggactttttctaaagaagatgactcaacttccaatgtgtagcaatactgtccaaaccgaggcagcctaggacctcctgagacagacagactctacccatcctgatgtgtggctacccttcaccaagcaaatgcaaccaacccactcctggagacatgacttccgttgcattaccaaagctgaccacactgaacgacctagtcctttctagagacagttttagattaacaaaagtgcaatgtttttcttcacatgaaaaaaatttatattctaaagcttgtacattcattccccttttttcacctattttgcttcctttgggttttcttttctttctctctctctctctctctctctctctctctctctctctctcttccttccatccttcctccctccctttctttctttctttctttttttttttttttttttgtgggatgtgtttgtttggtttagtgagttgcaaaaagggggcaggcagaatgaagctggccactgaaaccctgtgagatggtcaaaagctgacagcctgtgtgcttgaaaagggaattgtaaatgagttacaatttaatatacactgtatctaaaccgaggctgctagaaagtacctttctgaagttgctaggctactgtttctgaaaacccctgatctctctgtgccgggagagatccagatggattctttttaaggatcatggctgctttttacaaaaaggttgctttaataagcattatttatactatagaagaatgagtgtccgtttgcattacctttgccattttgtagaaaagcaaattctccacaaaagtcccaagtcgtttcctctgtctgcatgcatcccttaatagccatttggatagccggaagtagagtcataaagggaagatatgagttgccaccttaagaatgacgtcatattttatttgtaatatatgtgtaaagggtctttctaaaaagttccttcctcaaacccaacactgtcgagtgttagatgtgggcatgtgatctgttgcacatccaaagcatattcagagttgatctatgtaacttattcactgtgtaaatacatttaaagtttttgtgatgtgatctcagttgataattctgttcagaattgcctttagattacaaaaagagaaaaaaaaagacatgttgatcatggattttatttctagtgaaattaaaatatttgcctttgatgtttgtatttttatatgtgactgtaaccatgacaaccttgggcagactatgtgcttgtattctgtgaatgacgcacaccggagttgtgcagtgtatggcccctggatccaaagagaagtataatctcctaggaattgggcgccaaaagaagaacgtgatttcctttatagatagataaacctgagtgtgtggatgtgtgccatgttcatgctgtagcctggggaggcaaggtaaaagcattgcagttacaagtggctgtggacaccacgtggatgctggaaatcaaaccatggtcctctgtgagagagccagtgctcttttttttttccaattttttattaggtattttcttcatttacatttaaaatgctatcccagaagtcccctataccctccccacacccgagccagtgctcttaaccgctgagccatctccccaggccccaatcccttttgttattttttttaaagatttatttgtttgtttattatatgtaagtacactgagctgactttagacactccagaagagggcatcagaccacattacggatggttgtgagccaccatgtggctgctgggatttgaactcaggacctttggaagagtagccagtgctcttaatcgctgagacacctctccagccccattttgtgattgtctgtgcataggaatgcacacttgagtacaaaccaggagtctgatcctcctggagccggacttcagacacttgtgaactgcttgaggcagccactatgactttaactcaataagaaccatatggccctgcagtggtggcgcacacctttcatcccagcacttgggaggcagaggcaggcggatttttgagttcaaggccagcctggtctacaaagtgagctccaagacagccagggctacacaaagaaaccctgtctcaaaaaaaacaaaacaaaaaacaaaaaaaaaagaaccatatgggttctaacccctaagggatctcttcaaacccaagactgtagctttcaatcatgtcttattgatcaaagagaaaaatcaacctgggcatggtagctcactcctgtaattattacacacaaacagaaacatataaatgaattttatgagcatgatgcttccttgaccacaaaaatgcccttctaaaacaataagaagtttctctgttttcgttttttgtttttttgggttttttttttttttttttttttttttttggcttttcaagacagggtttctccctgtagccttggctgacttgctccctatcctcacctgagaaaaggtcctaacatttcctactttacacagctgctgtgagccagatgtgagagtgcagactgaaatctcagcagttttcaggtgaaacctaggagtcgtgggttcaatgtcatcctcaactatatactgacttggaggccagctggggcaatgcaaggccttgtctttttttttttttttttttttttttttgaaacagggtttctctgtgtagccctggctgtcctggaactcaaaaatccacctgcctctgactcccaagtactgggatgaaaggcgtgccccaccactgctgggctggccttgactttaaatggctgttgtactaagttaaattgttgttgactcaaaatattttgacagtttagacagaagagtataaactgatctatgatttcatgggtcctaagtagagcttatagttatggaatatcttaagattagcaaacaccagaacacacagaagaacataacagggtatgtggtcagcttgaccctgctctgagtcaagctatttttcctgtgtcaataatatgaaatgactagcacacatggaacaaaatggccacagctatgctaggggagcaggctgcaagtctcttctagcttcttcagacttctgcccacatccacacacagatatatatgtatatacatgatgaacactaaagcatttttaatacacagttcaaatacacagagaatgaaaccaaggacaataaatatatgtagttttattatgggtgtgtatgtgtagatacacagacacatgcatagacagcaatccaggcttgtggtgaaatcaggtcatcttgatgctaaacaaggaaataaaaaacaaaaaatattatcaggctactacaggtagtaatgaccctgagaaaatggcaattatattgtgcaaggctagtctggaaatagaaaatcacatatccaacatagcctcacatgcaggcttgtccttttagggccacagattccgtacagagagagagctgctgtctctatcaagtaggtgacaagttggtaagaacagacagctagagaaggtgttctcagccagcttgaattttaattcaactgtggttgaacccataatgggaaaccaacattggacaatttgaggttatcataactaaatgactagaaccacacatacaattagaacaatggcatcacaatgtagccactgtacacacattagaaaggtaaatgatgttccttgggaattgaaggtgtagccacacatccaaagaaaaattcagactgagtaggctttctgaatactgccactgattgcccagaagtctttcttagcattaattccaaatttccttattgtttttcatccttttttgtcttaacgttgtatcatccgaggagtaaaggatggggctccattggcagggtgcttgcctagctctctagacttaatccacagcactgcctaagactggaagatgcctggaattccatttctcagaaattgggagggtccaaatttaagaccacccttaactatgtaatgggttcatggccagcacaggtttgtctagggactatgtgttgagccagggtctctgtgtagcactggctcttctggaactggctatgtggactaggctggtttccaactctggtttcctgcttctgcctctgccttgatgctgggattaaggactggcattaccacacacaggctcagtcttgcgatgtatatatggcatctccaaaatacacaagctggacaggggtggtacatgcctttagcctcagtacttggaggcagaagcaggtaaatctctgagttcaaggccagcttggttcacagagcattccaggaaagccagggctacacaaagaaaccctgtcttaataaacaacaccaaccaaaccaaaaaaaaaaaaaaaaaaaaaaaaagtatatctttagactttttctgtggcatacagaaaatagtgaggaaatcctttactgttaacaaagggcccacaacagggacgcagtcatgtacaccttttaatctcagtactcaggaaaacaaacaggatctctctgagagttcaaggtcagcctagtctacctagtgggttccaggatagtcagggctttgttgagaccctgtctcaaaacacaaaaatggaaatagggcctatgtgaacaattccatttgagtacttataccaaacttcctaaaaatacacgtgaaaacatcaatgtaacaagagagtggaagccgagaccattatacacacggtaagtaaatttagctgacagtttgagatgctaggaatccagagttcattggtttgggcagtgcatcaccttgttgggaagacttacattactgtgtccagagtctcttctccctccctctagcaatactactgggattctgtcattaggtctctagtctaagatcttaataaatcatttcccaaaggtccttttctagacaccagagacttactgccattagtgcagatttagagggggaaaaaatgcctgcatcgagttcagggaacaaatcccagcatccaactcccagttcttactggctcctaaactcgtatccttctcacaaacaaaaatctcattgaataatcccaaagtcttaacttatcccagcctaggttcacaaggctcacctgagatagttgtcaacaatctcttctagcggtgaccctgggttatggaaacaagttacactcttctaagatacagggttggacaggtgaagggatggtctaattgttaatgaactcaagggggaagcagagccaagccaatggagccaacaacaaccccagccctcaaagctaccttctctcctgtggggctttgctggacgcttcccccacttcagtcttctccgtctgcgctcttcttcttgggctcgacatcatcatctcagacccgttccacagatactccaaccggaaggcagtcttcttcctggactcactgggtgtcctcttcagtcgcggtgaaagccgggactctgtacttttgttctcagtgccttcacaagcccaggcacagctgtgacactgcaaagccatgctgcttggaaaggctgcatccggagcctccggaaccatggctgaactcaaggatgtctttgcctgcaaactggagtccccaggcagcttttcagatctttcctgggattccctcgagaaatccttctcagtgccagcattcaacacaggcaatctctgtttatcagctttaatctccttggcctgggcttcttctggaaagtctttcctctttcgatcccggtggctcctcctctgcctatgccgctccattttcttttagtaagttttgtcttcaaacgatccctttgctctctcatctgaccataagccactaagagcagctaagcagcagcctgggcagtttgctgtttgccgatctcctctgctaggtactctggttgatcacttggaagttcagtcttccaacatgcctctggacagggacacaaggaagccaaactctttgccacagggaagcaaggatggcttctactccagttccctagagagttcttctctccatcagaaacctcatctgcacgatcttcagaggatgcgtttccagcagccttctgggtctcagagccctcgcccgcactggaggctgatcttacagtagcctgcagctccggactcttccttcctttccctcttaaccagtcccaaaaggtctgacacctggtcaggagcagtggaatgaagaacattttacttgagaaagaaaaaagggagtctacttagctcttgtcgttttgaaggctggaaatccaagagttggtatagaaggtacgatctctgtctgtgtcaatctgtgtctgtctgtgtcagtctgtgtctgtctctcttataaagccaccaggaaaacagaggccctaccttaccttacctgcctaattgaatctcattatccaaaggctttccctctgcagacagacacatccatcctgtaaacggtaacaaaaaactggggcgtgtggtgagactgtggtggcacacacctttaagcccacaggacagagagaccctgtctttaaagaaatcaaaaaaaaaaaaaaattggcagtcagtacttatatccgccttcaatcccagtactcagcaggcagaagcaggcagatctctgtgaattcaaagcctgcatgatctccagagtgggttccaggacagccagacctacatagaaaaaccttctctcaaaaagcaaaaatccaaaaaataaacaaaaaacaaaaagtgaaaaattaaacattaagcaaaaacctgaggatttgcgactgtcatgttgctcagcaggggaaagcatttgctgccaagcctgaaatccagagttcaatcccaaggtcccaggcagtagaaggagaagagccagcttccaaaaactctaccttccacagaaatactgtggcacacacacattaaaccacaaagagtcaaagtaatacgtgtaaagcagtaaaaaaagcttagcattgtgttcctcattgggacaggcattatatatagttagctctattgaaaatctgtcccaccatatggaatgaaaattagtaactcatttacacatactaacattgttactctatttttactttttctttctttgtttgtgttctttgaaacaatgtctatactgtatccctgattggccccaaacttaactagtagaccaggctagatcagactcacagagatccacattcagggattaaaagttttccaccacacctgctgtccgtgcattaaatttcctcggaggtatgttttcaaagaaaagaagaagtggaacatggcctaagacacttttaatcccagcacacataagacaaggcagaggcaggcagatctctgtgggtccaagggcacttggcctaaatagggagttccaggatggccaggtctacatacatagcaagaccatgtctataaaacaagacaatactattcaggtgtctgtcagctgacacttggcattagaagcatgttctaccctactcaagaccattcactgtgcaccctacctcttcatttatgtccttccctgttaaacaggagacactttttagaactactgagattgaacccagggccatttgcataagaggtaagcgctaacactgagccacaagctcagaccaagcaggcaagattttgagtgttgtttcttttctgtgagaacatcccagctacccacaatgattctggacatgttcagcagctgtttgaaacaaatgtaatgtagttaagtactgaaatttggtcatgagggtctggttatcagagattcagtatctgtataaatgagggcactgggtatggtggtacacgcctgcaatcccagcacttggaagagtgaggcagaaggatcaataggaatttgagaccagcctaggctacccagtaaggccagcctgggctacccaaggagaccttgcctcagaacagaaaaatataaagcaacaaaagcccactggcatatgctgcacatagaaaggattgggttgaatcactgcatggagttggttgtaaacaccatgtgggcacaaagaatcaaaccatggtcctctaagagagcagccagtgctcttgagagacctccgagggagactctcactcaagtctcgggataatagcggacccccaagaactcaggagagaccaaacttgatgctaaccacatgaggctttattcggggaaagccaaagctctggggacgactcatatcccacgcaggggtagaggagtcgacttcgaggggaaaggggtcccagtttttataggtcctcaagagggaaaggagaaggagggagtaggggatttccagatctaaacaatgtctattctaaaatgattggtttctcaagaaatgggtatgggagggaaacaaggaaagagtctaatgaaggtgcagtaactccggattggccccgactgtggttgctggagagattttccgactctatcccagcaaccaaatcacaaacacctggcagtgaggtgcagcagtgggcacacacctgggttcaaggaacggttagatcattggcagacacacgggttcaaggagcggccagagcattgtgcacctctatttttctaaatcagtgaagctacttctactaacaatgaaatttattttgccaatttcagggcttctgtgaccttttacattctgtcagggtcttttactcttaactgctgagccatctctccagaccatatcccttttgtaactttctaacacaagtgccatgaatttaactgagggcctctacaaggacaatatgggctctaaccactgaaggatctctccaaacccaagactgtaactttcaatcatctctaattgagtaagagaaagatcagaccagggcatgttacctcacccctgtaattcctacacatagacaggttcatataaatgaatttaatgagcatgatgcttccttgctcccaaaaatgctgttgtgaagccagtgagagcatctctgttttttaaaacactaagttgtagagaaaggatcaactccattcccaccctgactgtagccctgatctccctgcaccatcccacttccggtctatctctgtgcaccagtccactgctggtgtccatctgatctcttcctagtcattcaaatgagtttctctaccttagtcctatgttccctacttcatggattgccatcctagtgtgagagaaaatgtaaacactggactgagaacgagggacctagcctatgttctattaagtttaatcttcgctctgttccatgacctctctgctccacctcaccacctggggaaaaggtcctaacatttcctacttaacatggctgctgggagccagatgtgagagtgcagactgaaatctcagttttcaggtgaannnnnnnnnnnnnnnnnnnntatagcgaattggaggccagctggagcaacacaaggtcttatctttaaatgactgctgtggtaagttacaacagtgtctgacacatgctaggtgttagtcccacctgcgctataattatggactgtaggaaccaaggaccttgcccccttgagtaaccctacattcctactaactataatactacttgtaaaaatttgtcacatagttaatcccagcactagggagggatgcagaggcaggcagacaactgtaagtttgaggccaacctggtcccaaagacgttgcattgctccagctggcctccaagtcactatatagtctatacagcaagtctcaggacagaaattttgtccccctcccccaacaaaaatcagccacatttttaataattttactttcttttttaatatttatgtatttaatgtatgtgagtacactgttgct

SEQ ID NO: 248 - DNA, 8582 bp, Mus musculus
cttctccagttggcaacggttacatcaaacctccagtcccacctgcttctggcacgcacagggagaaaggaccaccggccatgttgccgatcaatgtggacccagacagcaagccaggagagtatgtcctcaagagtttgtttgtgaacttcaccactcaggccgagcgtaagattcgaatcatcatggcagagcctttggaaaagccattgacgaagtctctgcagcgtggagaagacccccagtttgatcaggtcatcagctctatgagctccctctctgagtactgcctgccctccatcctgcgaacactcttcgactggtacaaaaggcaaaacggcattgaggacgagtcacacgaatacaggccacgaacaagcaataagtccaaaaggtacctgggtcccaacactggcaatatgcacattgtggctgatctgtatgctgaggtcatcggagtgctggcccaagccaagttccctgctgtcaagaagaagttcatggcagagctgaaagagctacggcacaaagagcagagcccctatgtggtgcaaagcatcatcagcttgataatggggatgaaattcttccgaattaagatgtaccccgtggaggacttcgaggcgtccctccagttcatgcaggaatgcgcgcattactttctggaggtcaaagacaaagacatcaagcacgccttggctgggctctttgtagaaatccttgtcccggtggccgctgctgtcaaaaatgaagtcaacgtcccctgcctcaggaactttgtggagagcctgtacgatacgacgttggaactctcctctcggaaaaagcattccttggccttatacccactggtgacctgtctcctctgtgtcagtcagaagcagctgttcctcaacaggtggcatgttttcctcaacaactgcttgtccaaccttaagaataaagaccccaaaatggctcgcgttgccttggaatctctctacagattactgtgggtttacatgattcgaatcaaatgtgaaagcaacacggccactcagagccgactcataaccatcaccaccacgcttttccccaaagggtcccgcggcgtggtacccagggatatgcctctgaatatctttgtgaagattatccagttcatcgcccaggaacgtctggactttgcaatgaaggaaattatttttgactttctctgtgtgggaaaaccagccaaagctttcagtctcaacccagagagaatgaacatcggtttgcgggcgttcctggtgattgctgatagcctacaacaaaaggatggcgagccgcccatgccagtgacgggagccgtgctcccctcaggaaacaccctgagagtgaagaagacatacttgagtaaaacactcactgaggaggaagccaaaatgataggaatgtccttgtattactctcaagtccgcaaggccgtaggcaatatcttaaggcaccttgataaagaagtggggcggtgcatgatgctgaccaacgtccagatgctaaacaaagagccggaagatatgatcacgggcgagagaaagcccaagatagatctcttcaggacctgtgttgccgcgattcctcgcctgttgcctgatgggatgtccaaacttgaacttattgacttgctagccagactctctattcatatggatgacgaactgcgccacattgcacagaactctcttcagggactactggttgacttctctgactggagggaagacgtcctgttcggcttcacgaacttcctgctccgggaagtaaatgacatgcatcacaccctcctggactcctccctaaagttgcttctgcagttgctcacccagtggaaactggtcatacagacacagggaagagcctacgaacaagccaacaagatcagaaactcagagctcattcccaacggctccagccaccgtatgcagtcagaacgaggcccgcactgcagtgtcctccatgctgtggaaggcttcgctctcgtcttgctctgcagcttccaggtggccacacgcaagctgtcggtgctgatactcaaggagatccgagctctcttcctggccctgggtcagcccgaggacgatgacaggccaatgattgatgtcatggatcagctgagttcttccattcttgaaagcttcattcatgtggcagtttcagattcggcaacactacctccgacccacaatgtagatctccagtggttggtggaatggaacgcggtcctggtcaacagccattacgatgtgaagagcccctcccacgtctggatcttcgcgcaatctgtcaaagacccctgggtcctgtgcctcttcagtttcctccgtcaggaaaacttgccgaagcattgccccacggccctcagctatgcctggccttacgccttcacccggctgcagtccgtgatgccgctggtagacccaaacagcccagtcaacgccaagaaaaccagcacagcgagcagcggagacaactatgttaccttgtggagaaattacctcattctctgtttcggagttgccaagcccagtattatgagcccaggacacttacgagcatccactccagagataatggcaacgactcccgacggtacagtgagctacgataacaaggccattggcacaccatcagtgggcgtcctgctgaagcagttggtgcctttgatgaggctggaaagcattgaaatcacagagtcccttgttttaggatttggaagaacaaattcccttgttttcagagaattggttgaagaactccatccattaatgaaggaggctctagagagaagaccagagaacaagaaacgccgagaacggagagatttgctgaggcttcagctgcttcggatattcgaacttctggcagacgctggcgtgataagtgacagcacaaatggagctttagaacgagacaccttagcgcttggagctttgttcttggaatacgtggacttgacccgcatgctcttagaagctgaaaatgacaaagaggtcgaaattcttaaagacatccgagcacattttagcgccatggttgccaacttgatccagtgtgttccagttcatcacagaagatttctcttcccccagcaaagcctacggcaccatctcttcatcttgttcagccagtgggctggccccttcagcatcatgtttacacctctggatcggtacagtgaccgaaaccaccagataacgagataccagtactgtgctctaaaggcaatgtcggcagtgctgtgctgtggccctgtatttgacaatgtcggcctctctccggacggctatctgtataagtggctcgacaatattctggcttgtcaagatttacgagttcatcagcttggctgtgaggtcgtcatgttgctactggaacttaatcctgaccagataaaccttttcaattgggccatcgaccgatgttacacaggatcctaccagcttgcttccggctgcttcaaagccatagcgactgtgtgcggaaacaggaactatcccttcgacatagtgacactgctgaaccttgttctcttcaaggcctctgacaccaacagagagatttacgaagtctccatgcagctcatgcaggcatgtatcatccacacatgtggaaatttccatccttgggctcaggatgcagttatctgttcctgcgaggaaacatgcacagagtgttctccagacagagcagttaacctactcagtgtgaagatgaacgcacttgccgtgttattacaagcattcctgagtgtgtcgctagcccttctgtcgtgtgagctggcccggatgtaccccgagctcactcttcccctcttctcagaggtgagccagagattccccacgacacacccaaatggacggcagatcatgctcacctacctgttgccatggctacacaacattgaactggtggacagcagactcctcctcccggggtccagtcccagcagtcctgaggatgaggtcaaggaccgagaaggagaagtgactgcctctcatggactaaaagggaatggctggggctctccggaagctacctctctggtcctgaataacctcatgtacatgacagccaagtatggagatgaagtcccaggagcagaaatggagaacgcttggaacgctctggccaacaatgagaagtggagcaacaacctgagggtcacactgcagttcctcatcagcctgtgcggggtcagcagcgacaccatcctcctgccctatattaaaaaggtggcaacctacctgtgtcggaataacaccatccagactatggaagagcttctctttgagctgcagcagacagagccagtgaaccccatcgtccagcactgtgacaacccacctttctatcgattcacggccagcagcaaagcctcagcagctgcttcaggaaccacctccagcagtaacactgtggtcgccggccaggacagtttcccagaccctgaggagagcaagatactgaaagaatccgatgacaggtttagcaatgtgatccgagcccacactcgcctggagtcaagatacagcaacagctcgggaggctcgtatgatgaggataaaaatgatcccatctctccctacaccggctggttgttaagtattacggaagccaagcagccacagcccttacccatgccgtgcagtggaggatgctgggcccccttggtcgactacctcccagagaccatcactccgagggggccgctgcacaggtgtaatattgctgtgatctttatgactgagatggtggtggatcacagcgtgagggaagactgggctcttcatcttccattgttacttcatgctgtctttttgggtttggaccattatcggccagaagtcttcgagcacagcaaaaagctgctgcttcacctcctcatcgccctctcttgcaacagtaactttcacgccattgcctctgtactcctgcagacccgcgagatgggggaagcgaagacactaaccatgcagccagcttaccagccggagtatctctacactggcggctttgacttcctgagagaggatcagtcatccccagtgccagactctggcctcaactccagttccacctcctccagcatcagtctggggggcagcagcgggaacctcccacagatgacccaagaggtggaagatgtcgaagcagccactgaaacggacgagaaggccagcaagctcatcgagtttctgacgaccagggcattcgggccactttggtgccacgaagacatcacacccaaaaaccagaactccaagagtgctgagcaactctctaatttcctgcgtcacgttgtctctgtgtttaaggattccagatcaggtttccatctggagcagcatctgagcgaggttgcgctgcaaactgctcttgcaagctcttccaggcactatgcaggccggtctttccagatcttccgggccctcaaacaacctctatcagcgcatgccctgtctgacctcctgtccagattggtggaggtgatcggagagcatggtgatgagattcagggatatgtgatggaagcgctcctgaccctggaggccgctgtggataacttgtcggactgcttgaagaacagtgacctcttcacagtgttatctcgaattcaagcttgtacccaacaaggcctttcctcaaaaaccagaagcaattcctccctgaaggagagcctcacggacccgtcccacgtaagccaccccaccaacctgctggccaccattttctgggtcacggtggccctgatggagtctgattttgagtttgaatacctgatggccttacggctcttgaaccgactgctggcacatatgccgctggagaaagctgagaaccgagaaaagctggagaaactccaggcgcagctcaagtgggcggacttcccagggctacagcagctgctcctgaagggattcacctctctcaccaccacagacctgaccctgcagcttttcagcttgctgacatcagtgtccaaagtccccatggtggactcgtcccaagctattggatttccgctgaatgtcttgtgtctcctgcctcaactgatccagcattttgaaaatcccaatcagttctgtaaggatatagctgaaaggatcgctcaggtttgcttggaagaaaaaaaccctaaactttccaacctggctcacgtcatgaccctttacaaaacacacagctacacaagggactgcgccacatgggtcaacgtggtctgtcgctaccttcatgaagcctatgccgacatcaccttgaacatggtcacctacctggcagagttgctggagaaaggcctccccagcatgcagcagccgctcctgcaggtcatctacagtctactcagctacatggacctctctgtcgttcctgtcaagcagtttaacatggaagtcctgaagaccattgaaaaatacgtacagagcattcactggagggaagcgttgaatatcttgaagctggttgtctctcgatcggccagcctggtattgccttcctaccaacacagcgacctctccaagatagaactacaccgggtgtggaccagcgcctcaaaggaactgccgggcaagaccctggacttccacttcgacatctcagagactccaatcattgggagacggtacgatgaactccagaattcctctggacgggatgggaagcctagggccatggccgtcacccggagtgcatcctctacctcctccggctccaactccaatgtccttgttcctgtgagctggaaaagaccccagtattctcagaaaagaacgaaagagaagctagtgcacgtcctctctctgtgcggccaggaagtcggactaagcaaaaacccgtcggtgattttttcctcgtgtggggacctggatcttccggagcatcagacaagcctggtgtcatccgaggacggcccccgggagcaggagaacatggatgacaccaacagcgaacagcagttcagagtcttcagggacttcgatttcctagacgtggaactggaggacggggagggggagagtatggacaacttcaactggggagtgcgcaggcgctccctggacagcctggacaagtgtgatatgcagatcctggaggagcgccagctctccagaagtactcccagcctaaacaagatgagccacgaggattccgatgagtcatccgaggaggacctcacagccagccagatcctggaacactcagaccttatcatgaacctctccccctccgaggaggcgaatcccatggagctgctgaccagtgcctgtgactccgcccccgcagaccctcattccttcaacaccagaatggcaaacttcgaggcttctttgcctgatataaataatctgcagatttcagaggggtcaaaggctgaggcagtccccgaagaggaggacaccaccgtgcacgaagatgatctctcaagctccatcaatgagctcccagcagcgtttgaatgcagcgacagcttcagcctggatatgacggaggcggaggagaaaggaaatcggggcctggaccagtacactctcgccaggcaagggagccccttcggagaaggtgacaggggtgtgtctccccctccctcgcccttcttctcggccatccttgctgcctttcagcccgccgcctgtgatgacgccgaggaagcctggcgaagccacattaaccagctcatgtgtgactcagacggctcctgtgctgtgtacacatttcatgtgttctcctctctgtttaagaatattcaaaagaggttctgcttcctaacctgtgatgcagccagttaccttggagataacctccggggaatcgggtccaaatttgtcagctcttcccagatgctcacctcctgttctgaatgccctacgctgttcgtagatgcagagactctcctttcctgtgggctcctggacaagctcaagttcagtgtgctggaactgcaagaatatctggacacgtacaacaacaggaaagaggccacactctcgcaactggagctgtgtcagaggctgtacaagctgcatttccagctgctcctgctctatcaatcctattgcaagctcatcggccaggtgcatgaagtgagctccgtgcccgagctgctgaacatgtccagagaactgagtgatctgaagaggaacctgaaagaggccactgccgccatcgccacagacccactgtacatcgagggggcgtggtcagaaccaaccttcacctccacagaggcggccatccagtccatgctggagtgcctgaagaacaatgaacttggcaaagccctgaggcagatcaaagagtgcagaagcctgtggcccaacgacatctttggaagcagttctgacgatgaggtccagacactcctgaatatttatttccgtcaccagactctgggacagacgggtacttatgccctggtggggtctaaccacagcctgactgaaatctgcaccaagctcatggagctgaacatggagatccgagacatgatccgcagggcccagaactaccgggtcctcacagccttcctcccagactccagtgtgtctggcactagtctctga

SEQ ID NO: 249 - protein, 2859 aa, Mus musculus
SPVGNGYIKPPVPPASGTHREKGPPAMLPINVDPDSKPGEYVLKSLFVNFTTQAERKIRIIMAEPLEKPLTKSLQRGEDPQFDQVISSMSSLSEYCLPSILRTLFDWYKRQNGIEDESHEYRPRTSNKSKRYLGPNTGNMHIVADLYAEVIGVLAQAKFPAVKKKFMAELKELRHKEQSPYVVQSIISLIMGMKFFRIKMYPVEDFEASLQFMQECAHYFLEVKDKDIKHALAGLFVEILVPVAAAVKNEVNVPCLRNFVESLYDTTLELSSRKKHSLALYPLVTCLLCVSQKQLFLNRWHVFLNNCLSNLKNKDPKMARVALESLYRLLWVYMIRIKCESNTATQSRLITITTTLFPKGSRGVVPRDMPLNIFVKIIQFIAQERLDFAMKEIIFDFLCVGKPAKAFSLNPERMNIGLRAFLVIADSLQQKDGEPPMPVTGAVLPSGNTLRVKKTYLSKTLTEEEAKMIGMSLYYSQVRKAVGNILRHLDKEVGRCMMLTNVQMLNKEPEDMITGERKPKIDLFRTCVAAIPRLLPDGMSKLELIDLLARLSIHMDDELRHIAQNSLQGLLVDFSDWREDVLFGFTNFLLREVNDMHHTLLDSSLKLLLQLLTQWKLVIQTQGRAYEQANKIRNSELIPNGSSHRMQSERGPHCSVLHAVEGFALVLLCSFQVATRKLSVLILKEIRALFLALGQPEDDDRPMIDVMDQLSSSILESFIHVAVSDSATLPPTHNVDLQWLVEWNAVLVNSHYDVKSPSHVWIFAQSVKDPWVLCLFSFLRQENLPKHCPTALSYAWPYAFTRLQSVMPLVDPNSPVNAKKTSTASSGDNYVTLWRNYLILCFGVAKPSIMSPGHLRASTPEIMATTPDGTVSYDNKAIGTPSVGVLLKQLVPLMRLESIEITESLVLGFGRTNSLVFRELVEELHPLMKEALERRPENKKRRERRDLLRLQLLRIFELLADAGVISDSTNGALERDTLALGALFLEYVDLTRMLLEAENDKEVEILKDIRAHFSAMVANLIQCVPVHHRRFLFPQQSLRHHLFILFSQWAGPFSIMFTPLDRYSDRNHQITRYQYCALKAMSAVLCCGPVFDNVGLSPDGYLYKWLDNILACQDLRVHQLGCEVVMLLLELNPDQINLFNWAIDRCYTGSYQLASGCFKAIATVCGNRNYPFDIVTLLNLVLFKASDTNREIYEVSMQLMQACIIHTCGNFHPWAQDAVICSCEETCTECSPDRAVNLLSVKMNALAVLLQAFLSVSLALLSCELARMYPELTLPLFSEVSQRFPTTHPNGRQIMLTYLLPWLHNIELVDSRLLLPGSSPSSPEDEVKDREGEVTASHGLKGNGWGSPEATSLVLNNLMYMTAKYGDEVPGAEMENAWNALANNEKWSNNLRVTLQFLISLCGVSSDTILLPYIKKVATYLCRNNTIQTMEELLFELQQTEPVNPIVQHCDNPPFYRFTASSKASAAASGTTSSSNTVVAGQDSFPDPEESKILKESDDRFSNVIRAHTRLESRYSNSSGGSYDEDKNDPISPYTGWLLSITEAKQPQPLPMPCSGGCWAPLVDYLPETITPRGPLHRCNIAVIFMTEMVVDHSVREDWALHLPLLLHAVFLGLDHYRPEVFEHSKKLLLHLLIALSCNSNFHAIASVLLQTREMGEAKTLTMQPAYQPEYLYTGGFDFLREDQSSPVPDSGLNSSSTSSSISLGGSSGNLPQMTQEVEDVEAATETDEKASKLIEFLTTRAFGPLWCHEDITPKNQNSKSAEQLSNFLRHVVSVFKDSRSGFHLEQHLSEVALQTALASSSRHYAGRSFQIFRALKQPLSAHALSDLLSRLVEVIGEHGDEIQGYVMEALLTLEAAVDNLSDCLKNSDLFTVLSRIQACTQQGLSSKTRSNSSLKESLTDPSHVSHPTNLLATIFWVTVALMESDFEFEYLMALRLLNRLLAHMPLEKAENREKLEKLQAQLKWADFPGLQQLLLKGFTSLTTTDLTLQLFSLLTSVSKVPMVDSSQAIGFPLNVLCLLPQLIQHFENPNQFCKDIAERIAQVCLEEKNPKLSNLAHVMTLYKTHSYTRDCATWVNVVCRYLHEAYADITLNMVTYLAELLEKGLPSMQQPLLQVIYSLLSYMDLSVVPVKQFNMEVLKTIEKYVQSIHWREALNILKLVVSRSASLVLPSYQHSDLSKIELHRVWTSASKELPGKTLDFHFDISETPIIGRRYDELQNSSGRDGKPRAMAVTRSASSTSSGSNSNVLVPVSWKRPQYSQKRTKEKLVHVLSLCGQEVGLSKNPSVIFSSCGDLDLPEHQTSLVSSEDGPREQENMDDTNSEQQFRVFRDFDFLDVELEDGEGESMDNFNWGVRRRSLDSLDKCDMQILEERQLSRSTPSLNKMSHEDSDESSEEDLTASQILEHSDLIMNLSPSEEANPMELLTSACDSAPADPHSFNTRMANFEASLPDINNLQISEGSKAEAVPEEEDTTVHEDDLSSSINELPAAFECSDSFSLDMTEAEEKGNRGLDQYTLARQGSPFGEGDRGVSPPPSPFFSAILAAFQPAACDDAEEAWRSHINQLMCDSDGSCAVYTFHVFSSLFKNIQKRFCFLTCDAASYLGDNLRGIGSKFVSSSQMLTSCSECPTLFVDAETLLSCGLLDKLKFSVLELQEYLDTYNNRKEATLSQLELCQRLYKLHFQLLLLYQSYCKLIGQVHEVSSVPELLNMSRELSDLKRNLKEATAAIATDPLYIEGAWSEPTFTSTEAAIQSMLECLKNNELGKALRQIKECRSLWPNDIFGSSSDDEVQTLLNIYFRHQTLGQTGTYALVGSNHSLTEICTKLMELNMEIRDMIRRAQNYRVLTAFLPDSSVSGTSL

SEQ ID NO: 250 - DNA, 370469 bp, Homo sapiens
tccataacatcaagctttttaattgtcatatttaaatctgtattattactgtttttttgtttgcttaataccagtttctgagaaactatcttactcctgtatacgtgaggttatgaaaaacgccaaccccaaagccaagttggcatttaaatggccatgagttataacatttttcctctgactatacctgaaattgcacagaatagagctagcttgatgtaggagatgacaaggacattttaagtatttttcgttaaatgtgtgggcatcacctcaacaatcagtgcaacatgagattcaactgcaaagctactgaaggtattcttgctgcacttccttctggagggttcggatagaagagcctgaagaacgtcagcggcatcagaaagcatgggaagaatctccaggtttttcgttttgtccagcccttcggtgtgtggtaagccggcacctaaaccaactaagataaccaatatttatcctgatcttgaagttctttgggctaaaatatttcacaatttttgtgggtagcttgtgaggaaactctttctgtcaagaaatgcttccccctccagcctccattttgcctcttcactcatttactctttccttctttctctaatgtttgttgagcaccttctctgggcaactcactgtaacaatgaatgtgttacctagaaatgtcaaaggagacattctttctgacattcttggagtcttacagtgtataaattaaaacttaaacataattcagggtaagaaagtccttgtcagagtgagaaagactcacataactcttgggcatatgtatattttccactcactgttcatgcaggtgatagaatcagaagaactattttcacttttatttattaattttattagctggagccaggcatagcagctcatgcttgtaattccagcactttgggaggccaaggtgggaagatggcttgagaccaggagttgaagaccagcctgggcaaccatagtgccaccccatctctacaaaaaaataaaaataaattagacaggcatggtggcatatgcctagggtgccacctactcaggaggctgagacaggaggattgcttgagcccaggaattcgaggctgcaaggagccatgatcatgccactgcacaccagcctgggtgacagagtgagaccctgtctcaaagaaaaaaaaattatattagctggaatccatttccaaatctttggtcaaatgcactgagagaaggtgtagcactgccttttaaaaaaagttttatttacatataattgacatataataaactgcacatatttatacaatttgataagttgttttgtttttgttttttgttttttgagacatgaatccaacaccaccccttcaacatttcatccagtgtcttggtaatcccccactcccgtccctccaccactatcgccaggcaaccactgatctgttttctgtcattgaagattagcttacattttttagaatttcgtatcggtggaatcatacagtatgcagctttttggtctgctttctttcactcagcctaattattttgagactcatccatgctgtagctttccttttattgctaaatagtattctattgtatagatataccagtttattccttcaattgttgatggacattctgtttccagtatttggctattataaaagtaaaactgttatgaacataatatacacgtctttgccttcatttctcttgagtaggtactaagagtagaatggatggattatatggtaggtgtatgtttagatttttcagaaatttctaaacttttttctgaaatgattttaccattgcatatgtgaattccagttgctccacatttggtttggtcagtcttttttaattttagccatcctaataggtaggtgtggtatgtcatcatggttttaatctgcatttctttaatgactaatgatgccaaacacattttcatgtacttatttgccttcttcatttttatgaagtatctgctcatgtattttgcccatcttttagttgcattgtttgttcttactgttgagcatggagatttcctcacatattctggatataagctctttactaaataaatgccttgcaaatattttctcccagtctgtgtcttatctttagattctcttcacagtgtctttcaaaaagcagaagattttaattttgataaagtccagtttattaattgccttccatgaatcagaggttttctcttacattttcttctagaaaatgtatagttttagagtttacatttaggccagtggtccatcttgagttagtgtttgcatgtggtatgaggtatagatcaaagttaattttttttttgcatgtggatgtccaagtattctatcacaacttatcaaaaagactattttttctctacttaattgcctttgcacttttgtcaaaaataagttgtctgtttatttatgggtccatttctggacttgctgttctattccactgacctttttgtctatccttatgccagtaccacactgtctttagtgtagctttatgtcaagtcttgaaatcagtaggttttttgttgttgtttttgtttttttaagatggagtctccttctgttgtccaggctggagtgcatgatctcgggtcgctgtaacctccacctcctgggttcaagcaattcttccttcctcagcctcccgagtagctgggattacaggcatgggccactttgcccagctaatttttgtatttttagtagaaacgaggtttcgccatgttggcaaggctggtcttgaactcctgacctcaggtgatctgcctgccttggccttccaaagtgctgggattacaggcgtgagccaccacgcccacagaaatcagtagtattaattctccaacttttttctttttcagtgtcattttggctattcttgatcccttgcatttccatttgaatttttgtatcagtttgtaactttctaccaaaaaaaatttttgctaagattttgactggtattacattgaatccacagatcagttttgttatagcttaacaatactgagtcttctgacccatgaacataatatatctctccatttacttaaattttctgtaattccttttagtaatattattttagttttcaatagacatatctgtcacatctgttgtcagatttattcctaaatatttaatatttttatggcattaaaacattttaattttgtttctcattgctagtatagaaacacaattgatttttgtgcatttatcttatatcctgcagccttgctgaactcacttattagttcttataacttttctataggttccatcaattttctacatagatgattattttatctgcaaatacagttttgtatccaattggatgctctttattctttttcttgactgataacaccatatagagccttcagtacaatgttaatagaagtagcaagagtagatgtcttgccttgttcctgatcttaaaaggaaagcaagcattcagtctttcatcaagtattatatcatctgcaggctttttgtaaatgtcttttattaggttgaggaagtttccttgttcttactctgttgagtgtctttagagagggaaatgggctaaccagaggtagttagttaagacataaagggccaagtgccatgtcaaaggtagaatgcttaaggaactaagcctccaagtagccagacctgttgggagcctgaagcaataactcaagaatgagataatgaatactgccactggtcagtgtcagcaggggtgaggaagaagacacagatcaaaagatgtttaaggggtaaaaatgacatgatttggacagaataattccaaggtttctggctggggtcactgggtaaatgtggtgccattttggtaaaataaaaaatacagaaattcaggagctgcacatttggaggaaccagttttatacatgctgagtttccaccaggaaatagtatgcaattaaatatagatatctaggacactatggagaagtagggggggagcttggacttagacatcatcagctcacagatgcaagttgaaaccgtaggtgagaatgcctaaagatggtggagccactgatgcagcagccggctcagttacagtgggcacgtgacagcctggttctggcaaccgcatttctgaagttaaacactgtcctagtatttggacacacaaaaaataaaatttttcagttcttttatgaatgcaaattttagttcaatcccttaaacagaagaataagacataaactaacagtacttcctctcatagaccatgtgggtgtgtcaggggtagtgtagagagggagatttctttattttgtaccctctcaccaaagagagccacacaagcctagaaaaaaaaaatgcgcccttacaccttaccttaatttgagaaaaggccaggcatttactggcattttgctgggacttgcacatttgagcaaggaagaatgcaagtgtaaatgaagttagatttcaagccagtaaaaactggttctgaagctttttaaaaaagataaagtctgcgtgactttaaaaactgtgttaagagtctgcttcagcaaatccctctatcacagtttctggaataaataaagatggtttaggagaaggattacttactggagctagaaaattttaaattttgttaggaattaccaacttgttttaaaaggttacagccaaatttttaatgcagactttttcaaagtctgtattattatctggaagatgtctgatatatgatggtgttaaaatatatattataacaccactgattgtttttccttcagctctctattttctcagattgtccaatcttgtttttccagcatccatacttctgcatgaggtaaggtcctgtgttggcacaggattgctctatttgccattctgtggacattcggtgctaatgtcacaccttagtgcctttgcccagggtccactcatctgccttgtgaacttattacttctcctctgagaaccctttcccatcccctctctccatcaggaagagaagactgaaacactttttcgtgtcacctctgcacagagcagtcattctgtattgcaataatttgtttattgttgttctgctccttttttagatgaaaagattctgaagaatagagatcttgaacatagcatggtgccagacacataacaggtattcaataaatgggcctgccaaagagagggagggaggaaaacagactttttaaggagcccctgaagaatctgagcagaagggacctgagacataggaagacaaatgagaaataatagtgtcatggaagccaagggagcagagaattgtaacaggggaagacttatcattagtgttcattcctattgagagccaatgagatactgaacatccacattgtatttttaggatctaagaaaagatttcctcagccataatcataccacaggtaatactgcaaacattgttacccatattgagcaaagatgtgttggcaacaagaccttttggagggagaagtcagttgacctgtttgacttggtgatatccatcatcctgatattctatactgttattttttcctagtggcaaacccactgattagtaggtcatctcagttgaaaactgaatagagttcaaaaataagaaatgtttgcaggatatgcagtatagctgggtcagattgagatttggaattaatttggtaaatccatacaggcctaaaatcttcttggcggaccatttctatgaaggtgacaatgagaaaaatggtgacggttgtaaaattgtattgttctcaatataattgcagctatctcacaacaagcaaaataattcagttctatttaaaagctgccaatagggctggacacagtggctcatgcctgtaatatcagccttttaggaggccaaggcaggaagatcacttgaggtcaggagttcaagaccagcctaggcaacccccatctctacagaaaaaaagctaccaaaatccacaaggaaagcatggctacaaagtgagtaaatgtctttctacagactgtttgaacaatctgagggaaagaagattaaagtctaaccaagaagaataaaatttccatgatattataacaccatttaatataaaatacacagcatcttgaaggataataaaataattcaaaagagattagtatattggattcataggagaatagagatctttaaaaacataatggtcagccaggcatggtggctcatgcctgtaataccagcactttgagaggttgaggcaggaggatcacttgaggccaggagttcaaggccagcctggacaacatggtgaaactccatctctacaaaaaaatacaaaaagtagctgggcatggtggtgcacacctgtagtcccagctactcaggtggctgaggtggggggtttgctcgagcctgggaggtggaggctgcagtgagccatgattgctgccactgcactcctgtctgggtgacagatagagaccttgtctcaaaaatgatgataatgataataatggtcattaaaacagaaaatgtccatttatgtatttaaaattatttatttatactatcagttttgaaattcctcttagcccaaagcctgtctcatcgttcttctgaccacctgaaaaaaaaattccactttggctgttgctatacagaaggagagatggacttaacattgtaatctataaatattctcatgtagacaaaccaagctaaatgttctgtggttgattgtcattcatgtggcagccaatttaactattttgaaagaatgatttactttactttttcatgttcacagatttaatactacttttgaataaataaaaattgttccttgtttacattgctctaatacttgaacaatagaaaattgaagttgttctcacttttctccattaaagaagtgtattaaatgagctagatccccatctgtttctattctctatgaggggaaaatgagttgggcaggagagagatgaagttggacacatcgggaacttctcttgcctctcttaggtcatttactttttagaggtttagaggacttgatgtacttctgaaatagggtagaggattttttttcctaatcataatttaaatgtcaggaatacataatgtttttatctaaaatgcattttagtgtgaaatgcgtcaacatggatactagtaggaatgcaattactttctaatatactctggcaaaaatttgaattttcttgctttttctctttcattctgtgaacctcaaagacctcctgacaactgttacatagggcaaacctagttaagtgagccagatcactccttcacagagttgatgcagtgagaatctgcttgaaaccaataattgtttttaggaaagtagagaaagacttttaattccttttagatattacacacatttaacaattgttatggtggtatagtttaaggcatgaacttgaactttggagtcagataaaacccgtgttcaaatcttctctcctctaattcctatgtgttttactctgtctcagcatcttcatctataaacagggtgattaggaggaatcaatgaggtaatgcatgccaaaggcttagcacagaatctggccagttttaagcacgcagtaaatgatggctattattataatgcattccaggtgcatatgtacttcattctgtgttttcagcgggactcttaaagacaaaggcacactatgcagacatacctggtgtacactctgtgtgataataacacctttccttagagacttctatttaatctcatacatgctcttatgttggccccatggtaacagtgtgattgagaaagacacactcaccaaatagtttgagcttctgctttcctgattgatgaatttctcccagttagcacccaatcttttgtgcctaggattctatcttgctttatatttgaaaattaaacactgttcttgaagtttgggttgtaggaatgtatgttttttcctcctattatatcattatctcaaactttaaaaaatgcttttactttatatttccttactagaaaaaatgtattatcattagggtgagggagattcaggcagtctcatgggcttttagaaatggtttcatacaagtcactcattgttttgaagttcatggtacatttcagcttgacaaagttattctaggtcctgggagggaagtggtgcagatgattctcagaactggtgaaataacttaataatctaatacataaatatgattgctggattataattatagttatgattgctagattataatggtaactctcaattgggcatacttgtaaggaaaaatgcttttctctccagaaaatctgttgtggtttggagacctgttgctgaaagggcataaagagaacaaaacttgtattagtgtggaagtatattctcaagttggtaaacagaaccagctcctaaatatcaacaaatattaaaacgtatttagcatctaggaaaccaaaataaacagtgatttctgaaatgacccctaaatcccttataatgttatgtatctattgattccaggcactgggaagggaaaaggcaaatctcatctcacattgcaaccagacagaacacaaaaggggtgttgtgtgtatgtgacagagagagattgctgatggacatgggcatagcatggccatagaagctatctgccagctggagcacagcatggctggggaagatgaattatagagtgatgatttctgcacagtcagttaaggaagaaagtgcagaacatttccacatacatagagcaagagggaagggagcaaaggacataaaaatgcaaaatccaggagagagagagagagagaaagaagctggatgataggacaagcaggaatcttgagtgaagaaatgctggtttttcttagaccaccaaacccattgaccattttagtttaaagctaggcagaatccccgcaaggataataacgttgactttttatttgtgagtggaggcctgtcattacttctatggctaaggcttgttttctagacctctgactccactgccaggcagtaggaacttctggagaagctatctgccagctggagcacaggatggaaggggtgggtggcaagcaacagcgggttcccagcactgctgcctgacacacgcccacaaccagttccttcctggtcatcaccagtcatctctcatctccctcttccagccaacttccagttggcggccagccaaataagacactgactaaagaaggatgttcgttctgtgttatgtgtatagcttgaaacttaaaggtatgagggaatgtaaaaatgcttccccaaaactgtttaaaatccgtaagagtttgggaaatgatacaaaaaattagacttgtaatttatgtaggcatctattcttgaatagtgaactgtgtttgctttatggtgttgcacccatgaagctgaaatttcatgcagcaaccattacaccacttttgttaccatccactctgagtcacatctgttcaaattccccagtcttctgccaactgatggttttttttttttatctctcctcccctgtgctattaactgtagaaaggaggggctacttagtaattctacacctgttaaagtccacgcctatcaacttgttaagcttcccaaacaagtgcagggtaaagcatgagaacatcagagtctggggcggcggcggtggctgcaacggtggctgtgacggtggctgccgctgggtttggctttctggatttttgttcagagtcgctaatgtatcccccacaatggcagttgatgacagcaatttatattccagaacgaagaacaaactaaattcatctcaaaatgattataaatcatcaagaaggagtagcctgccacctgaactactcataggaaatgacattagaggaagacttcaaagaaacattaagaacttggatcccattcacctgaggcacccgaagaagagaccatccatatttccaggtaggaattgtttacatttataccatccaattgaaacaaaaccaaacacacacacacacacacagattatatttcccttgttacaatcagatgttcatttaaaattaacttgggttacattcgaagactttaagtaaataaacatgtctgaatataaaagaataattgtttgatctgaaagcacactatcttcttcgttttattttctttattgattgtaacatctttaaggacctgtaaataggcagctattttattatttgttggcatcagcaggaatgtggaactactttgcttgcaatcctgaagaattccattgatgtatttcattctctggcatttttttttttgcaatattattggattgttgagtgaagttgatgtttgtgtgcaccaaaaattaacaccattaaacactccaatgcatgcttcaaattcctgtcttgcatcagagcctaaaaccatttgtagtaaaaagctcaactgaacagtgtggatggtgaaatatattagagcacaggagacatggatttcagtcttgataaagggactctgatgtctgccccagatgtttatgtgtgcatattatagatacgtagattgtcagagatacctgtgactgcgaaccttaattgagctaagtgatcactggagagtataaattatatgaattatatagccaatttggtttcaatactatttgctttgggatttccaggaaaaactgaaagtggcctttttgttatggctgatcgatttattggagccttctttatgggggacagatgagactaaattattttttggttttctgtattcatagagttaacccaacacttagggctaactctatgaatgtaggaagccaaaaaataatttagtcgagttttacttcataaaaattatatggactacccaaaacagctgactctttatactgcttttggaaagcgagaagataaagatgatttagagatgtgggactcaaaattacatttcttaaggaagctattttaataaatttcttcagttcagtgatattgccctagtgtcacactcttctgcagaaaagaagcaaaactcagcctggagtgggccagaaggtgtcagtgtgtgagtgtgttagggggaaggagagggggatggtatgaaaagtgctggaaagaggagcatttgggtgcctgaagtatttcacagagcacagtcactttctgcctgttcgcttggatctcctaagggtaccaaggagctcaggcctgctgtgtttcctaaaactacatggtatgatgtactttctgatgaattggttcactagcccttcttccagaaccttcttgcagagcagttcttcaccttttgctttttcttctcttaacattattctttggttaattatgtctggattcaggtaccttataattcatcctgcacttctctgccaccaccgacatagccccacccccatacttcatggccttcttctttccaaacaactggatccaggggaatgcctcactcctgcagccagcattcctgctttgccctctcgttctataaggtcatctggccctggctggtagctacagccacaaacttatgagaaggcctcttggcttgaatcttacataagttgtcctttctaagatcttgagttgacataattaatttgacaaggtggagttgtgaaaagagcactcaacttcagggaggtgagttccagtctagactatgtccttaactacctgtgtatgttctccaagctacctcactgacccctgtgacccctcaactataccacctgtttctgctctttctgtgcccagtactctccttaggggcagcagcagaagaggggcgtttcccacccctctcccaacctctccactagggtctccagtggacaagttacagagtcacctgcccaaacttcgtgcaatacttactggctacttgatttctaaatccccgctatgtaaaccacgactccaccctcagtcaggcaggtttcactaactgactgatttttacagtggatgatttagaaactccactgggccatcagttttcccacagtgcctgcgtaccacctgaaaacagaaatgcacacagattgtgataaccattcccattctagctacgcagtggcacgtaaagaataggcataatagatgtggaacccaatggtcagagaaattaaggcacatctcaaaattaataaacatcaaaactaagattcagaccttggtcttttgactccaacactgaagctgtttctactctgttccactttactccattgtcaactgttatcatttgtctgatgagattcaagacttgaagacatgtcagtgttccaatcagctttcactctgacccttatatacatacagacaactttatcctctgcctgaagtcttgtattttcaatcctgcaccaaattattgattgattcactgatcacttcattcacaaaataatcattttgttcttacattgtgttaaggataaaacttcaaggatctaactgcatattaccctttttttttttttacccattgctcctttagggccatctcacactgcagatagttacctaaaatgcacatccacttgtttcattctcttgcgtaaaattcctcaaggttaccactgctgttaggatgaagtccaaactctttaatatgaagtacaagagatgcaaattctggccactgcttccatccccagcctcttttccagccctccttccccttgtgtttcaacaaattcagccactttcagatcctcatggtccttcacatttgcaattctagtgtaagtactgtatactctacctgcacagtttcacccaaccagtttctaccttggctttgggggtcaacttgacatcccctcttccaggaagttttcttgatgccagtgtttgggttgggtcctttctgcatccttctcataacacctggacttttccctatcatagcacttatcacactatattgtcattgtctgtttacttctccgtatctcccacttgccagtgacccaggaatgatatcagtcttgttaaccattgtatacctagtacctatcacaatgccaggcacacagtgtgcattcaataaatatttattcaattgactcaaatcacactgaatggaattaactcctggtataccttgtgtgctctggcttctcccagactctgtctgtggcattctccctcacctcccaacatacagacacacataccacacacacaccctgcatttctgttatgccttttcttccattcttccgctggttaaaggccaaatcctaggcttctatcttcttcctctgacctcctttagttttccttgatgccacctccttgacctcagggatgcattatagtaactttatgtttgtatgaaaactctctgaaaagcagagactatctcagttgcttccttgcgtggctcatttgtctaggaggggggaaattgcgcaaagtaggtatcccatcaacatctagtggttaattaactgatttgctatgaagctgtgtcaactctgtggagcctatctgattctggctccaagaaagaattagttggtagatagagattgccaaagggaaaggtctttatactgatttttataacaatctgaactcctagctgggggaaaatgcaggtatggcttatcttagtgtgtcattcattcattattaggattctactatatgccgggaaccattctaggccttggaaagaaagcagaaaaccagacagtttctggtttaggctgatgggaaagaattttcccagcagagtaccttgcgtattgcacacctcaataaatatctccagagtaaaggaatgaatgaccctcgtggtcacagcaacgaatcttaaaagaagaaaccaatatattttaaagtcatatttatataaaaacattaaactaacattttgttttctgttaaaaaagcctcaacaatagaatgttagtgtgagttatttggctgaggtctaggctgggtcctaagagaccaggccttaagagtctaggcctctgtagcaaacaggcagcctgttttctagttccttctgaaagaactccagcagctgagttcatagcagtgggcctagcttggtttaaggaagcaaaagggagagagagaagtggtcctgacacacatcatgcccacaggcatatcagattaaaatgaacatctcaccctgcacctggaaaaaaggggggctcaggcaccatgtgtgatgggttgttcattcagcactcttaaaccaacaagttgggatgtttaatcagctagttcttatactatcatgctgattttacaattatctgttgtgaaaagcaaggaaccatctgcttggaggaaacaggcagctccaggtacttccttgttgcttagtcagaggacaagtgtgatgaggactgttcacgaccaagaggaaaagagagccctggccaggactcacatagcaggaacaccagcatgtaggctaacattgcttctcgtttttaagtcaaagttctattccaaacacaagttgttttttttctcaaatccacaatctaaaaaacttacttaaaattattttatttttataattaaatggattttgagcatttctaaagttagactgctgtatttgttttctttctgcatgtaggtttttattggaaacataaggtagtcataggaacaatggtggctagatgctttctgaccttcctgcgggtaaacagcctctgtcaaggaactgtagagatgggggtctggtctgggttccctcctcagagcctcctcatcacagcacagtgaaggcactctgtgattaggcgtgtctccttaagtgttatgttctctgttagaattctgtcattctggaagcctgcagacaggtgtgtttgatgacgtttcagtggggccttcaggagacatgcagaacttatggtcagggcatccataaacatgtgctatgaagagagtgcctcctgagattgtattcagtggccttaggttgcaaatgggctcagtggttacagtttgtgaggacaggaacagtgtcttcctacaccgtggtattccccacaacacttaccacagggttaggtgcttaagagctggtgaagtcatcaggcaaggtggaagacagacgacgtgcaagaagtgtgtcacagccactcagctggccacacccctgcccatctggtcacgcagcttccttaaatagctgcttctcaggcaggccttgctcaaggccagagtcaagggagcctcagagacaagagtttgaacacttcctctcatgagaggacttcagcccagggatttcacaaagtcagtatctgcttcacaattggtttcatgttctgatcccccatcttactaaacatgtaatctgggacaagccactggctctctcagaacctgtttcttcatctgtgaaatgggaatgcaaacaccagtttcaccagctgtcttaaacccaaatgagataatgcataactacaaaatgatacacaaatgaggttgactgtactattcttattccttgatggcattaaaggttttttttttcataattagtactttttctttgaatgtgtgagtggtagatgcaattggaacccttttgcaactcttcttggttggaaagttatctaaagttgctaatcagaccctctgctaatgtaaattctatatactgagacactgctaaacacccattaattttaactttctcattaaaaaggatgacatagaaacccttctttgtagtcaatatagatgtattttctcaaagtgaatcattaaacttaagggctttgtcatgtgaggcctctgaaaattgtacaatattagaaacatcaatgtctgtgtttaataaacttactggtagctttactgtgttgaatgtctccacctaattttgtttgtttaaaaccttgcttttggaaatttagcccttcaacttttctttaacaaaatcttggaatgaacttctgatttaaaaaaaaaaaaaaaagcttatatataatgttgtacatgagctcaccacttgaaagtaatttacttaaataatgagattaaattttaaaacctttgagtgtcaacacatttttatttaaaatttgatatatatggcctttcctgtttaaaaatactgattaacaaaaactgagatagcctgtttactttttatttatttacaataaataaatacaataaataaaatttatttatttattggacaagtttactgaggatggagtttttggttttgttttgcttcgttttctaaaaaaggacggaaacacaccctttccttaggcgtcctgcgtcccccgattcctgctccctggttgccgcgtccttggctggcgtcagaaaaatggctacaaactttctagtaggtgagaagatctggttccacaagttcaaatatggcgatgcagaaaggagattctacgaacagatgaacgggcctgtggccggcgcctccctccaggaggccagcatgatcctccatgatattgccagagccagagagaacatcccgaaatccctggccggaagcttaggcccaggggcgtctagcggccccagcggagaccacagcgagctcgtcgtccggatcgccagtctggaagtggacaaccagagagacctggctgaacgtgctggagaagagcttgcccggccactgggccacagccccgcagacccagcacatgtctcccatgcgccaagtggagcccccggccaagaagctagccacaccagcagaggatgacgaggacgatgacattgacctgtttggcagcgacaatgaggcaacacagctgcggcattaccaatgaggagcggctgcagcagtacgcggagaagaaggccaagaagcccgcgctggtggccaagtcctccatcctgctggacttcaagccttgggacgatgagacggacacggcccacctggaggcctgtgtgcgcttcatccagccggacgggctggtgcggggggcctccaagctggtgcccgtgggctacggtatctggaagctgcagattcagcgtgtggtggaggacaaggtggggacagacttgctggaggaggagatcaccaagtttgaagagtgtatgcagagtgtcgacatcgcagctttcaacaagatctggcctgagtgtgtgtgtgtgcccgcgtgcatgaggccctgacacaattaaaaactgagaccggcaaaaaaaaaaaaaaaaaaaagggacgaaaacaaacttaatgaagctattagtggtaacctggttacttttaaggaaaactagaatgctaatactatattatttatgtgcatgatttattagcaagggggaaactgtttttacctttatgtagggactgatagtgagcccagtatgagcagaaaatgttagatttatagctcaactttagatttttctccttgtcatgaaaaaagaatcaaaaaacagggttctgaattcaagacttgccttataagtatattgagaaatgacttgaagagatgtggcctaaaagcagttccttttcaattgttgctctatagctaatgtgtagttacagatttgagagcttccacataattttctctcacattcctaaataatgctctaattatatattcatatctggactatgaaaatatttttatatctgtgtaatttaatatttactcagtatactccagtaatactttttaagcacttgtagttgtctgtctaagtaatgcttttaaaagtgtttgagaggatagtggccatccagttactcagttacaaaagaaatggccatacccaacgttctttgtttcaaataatttgggggaaagtagctacctaaggaatctttgcttaagtatttaattgttatacctccatctttttttataatctggaagaatatagatttgggaatagaggtttaaaaaatgggatgaaatggatagtttttggtgacatgaacgtaaaaactctcattacaagatggtcagagctgggcgcagtggctcacgcctgtaatcccagctctttgggaggctgaggagggcagatcacctgaggtcaggagttcgagaccagcctgaccaacatgaagaaaccccatctctactaaaaatacaaaattagccgtgcttggtggcacatgcctgtaatcccagctactcaggagacaggcaggagaatcccttgaacccgggaggcggaggttgcagtgagctgagatcacgccattgcactctagcctgagcaacaagagcgaaactctgtctcaaaaaacaaaaacaaacaaactgggcatggtgatgcagacctgtaatcccagctacttgggaggctgaggcaggagaatcgcttaaactcaggagatggaggtttcagtgagccgagatggccccactgcactccagcctgggtgacagagcaagactccatctcaaaaaaaaaaaaaaaaaaaaaaaagatggtcaaagtatttttcagtcattattttaatgtttagaatttccatcctaagtggtgttcattcttttgagttaaacaactgattgtcaatgtacccttgaacatcctgggagttcaaagcacatagatggaggaacaacaaagaagatgtgtatttttgtcactagattagatttattggtgtgttctctcagctatcaaataacttctctcccaccttgacacttaagacagactaaagtcatcttaatgaataattaatactgaataaagctttagagtaactgatttttataagcaagaaagaggcaatttcaagatacactatttttaggttttaagtatcaaaatagatgccgaaggaaaattaaaggtatacctaagaaagactacatctattcaacaaaaatctaaactatgttgttgcatgtgtattgggtgcaaaacacggtacaaggactcaacaattgttaagacactgatacacagtaatctgctttcctatctaattttttgctaggagagcagaatgctttaatttgggttttcctgcttcattgacatcagtatttaagcttccctattgcaccagctaatggcaatactgacactatgtcatctggtagagaatccctaattggcaacgatgtattttcctccaggaaagtaccaggggccttaggtgtcctccacatcagggtttcttagttgggggtttgtatgctttttgtaatttatgtctgttctccacactctaaaaaacagctaagtggcaaacggtcataagtcaaatatccctcctcaagtcccaactcaggaacagtttctggttttttgagagtacattggagcccctgcataacaaaaggaatattaacttaccaatttagggctgttgttttcaaacgattgtgcaaatctgaatttctggaggaggttttccaaaatccacaggcactggccaagagatgtgatttaccaagtctacactgggccaggcatctaactgcagtgtgaacattttcccaggttcatctgatgttgtcccatcccctggtcaagaactactgacttaaagaaagtggaaaagatcttcaaagatcaaagtttatttgtaaactattctaagtttcacgtgtaagaagcaggaggcagctatgcctggcagacctctgttgcttccccttgcaatccagtccccttccacgtacccacccaaccactaccaccctcgaagtttagtgtattctctggcaagagaggaacctgtaatttgagtttcatcatatgcaaagtgcctctgtgtccccactcataactgtaaaaaccagaactgcagagtgcagaggtccaaacacacccatattacggtctttgttctaaatcctgctcacaccatagggtaaaatattaggactcgctctgtgcctctcaaccatcttttttttttccttttatttttagttgacatataataattgtacatatttatgggatagagagtaatatttccatacatatatacaatgagtactgatcaaatcagggtagttagcatatccatcacctcaaacatttatcatttctctgtgttgcaaacatttagaattctctcttctagcttttttttttttttttttttttgagatggagtttcattcttatcactcaggctggagtgcaatgacgcgatctgggcttactgcaacctccgccttctgggttcaagtgattctcctgcctctgcctcccaagtagctgggattacaggtgcacgccaccacacccaggtaatttttgtatttttggtagagatggggtttcaccatattggtcaggctggtctcgaactcctgacctcaggtgatccacccgccttggcctcccaaagtgctgggattacaggcctgagccaccacacccagctttggctttatgagaatgtacaataagttataattaaccacattcaccctacagtgctacagaacaccagaactcatttctcctatctagctgtaattttatatctgtagaccaacctgtccccatccttccctcccccttgcccttcccaacctctgatacccccaatcctactttctgctttcattagctcaaattttgggggggctcccacaggtgagtgagaacatgcaacaatgaattttttaaaatggtaacagtgcctgttagaggcagctgattagagtaagttggatgaatgagaaacatttcaaggtttttaaaaataaaagctctcaacaatacagatgatattataaaatatagaaatgtttaatgaagaagagttaatgaatatcatcggtgatactgagtgctgcacagaaacttcattactcagaattagggtaaactatagctacatattttcttttgttactgaatcacatccatatgaaacaaatagcaatctggaaacttctcaaaagaaatattctcgaaatgtgattatttataataaggatgccatgaatcactatatagttatttaaacaaaaggcaaggcagttttggaaaactataaacattgcaaagttatggccttgtattttttcttattttctgctaaattagaaagaaatttgctgtttcaaatatactcaagctgttcagttcttcaacaaaaagtaggtgactgaaaactgtatgtttaactatgcttaagttaatatttatagtaatgatagaagccattttattggcaatatatcacttcctgatttccacaccaggcattcccacatgcacaaacaggtgtgtgggaggaagggaaatgggcaagaatgatttccttcaagaggctactgagaatgaaaactcaaaatctgcacaaataggggtggtggaaggagagaaagaaaactccatgccagaaataacatgcttagcagagagagagagagaagaagaagaaggaggaggaggaggaggagaagaggggggaagggggaaggggaaggggaagggagagagagagaaggaaggaaggagaaagaaaagaaagagaaagaaaagaaaagaaggaagaagaggaaggaggagaaaaaaacagcagaaataaagtaatgtggcacctatatccacagacatatcttccagcaggtaaagtgtaaagtagtttttattttgaaaagttgattgatacacacagggctagataactgataaactgcagataagaaactgggtttggtgcttgcctgtgggaaatgaggatgttccttaaatgtcacctagatggttaaaaggaagggaagtatgagtgagtcactgccgatttgatgagtaagggttccttctttaaaaggttctttgggatgggcacggtggctcacacatgtaatcccagcactttgggaggccaaggtaggctgatcacctgaggtcaggagttcaagaccagcctggcaaacatggcaaaaccttgtccctactaaaaatacaaaaattagctgggcatggaggcaggcacctgtaatccccagccacttgagaggcagaggcaggagaattgcttgaactcgcgaggcagaggttgcagtgagccaagactgtgccactgcactccagcctgggtgacagagcaagacttcatttcaaaaaataaatgaataaagtaaaataaaataaaatgttctttgaaagttcccaaacattgaaaataatgatgaattaacagaagattgaatgaaatgagatagtaagaatcgaaggtttctgtttcattctccccacaaaacaacaacagactcttttatctctaaccaactgctgcctttggaggttttatagggatgttggctggggtagaagtggagaacgagacagggagagagagattgaggcttttaagagttgctggctactccttctgttgcacttctccttgaaaggcctccctagggcagtctacctcttattgctctaaaattaagttaggatctagctctgttgtagttgggcagcagaggtagacattatgccaatatatgccattttgatgttcagatagaagtccagcattgtgagttactttcattatgtgtgaaaatacggtgtgtagaagtaggtaaaaatttgctcaaaaattcactacattctttcaggagctatagcaaagcagcaatttatgattttgtttcttttaaatgtggaagtttgggattcacaaatgctatgaaatagataaatacataaaagttgtacacaaaatgcacattaaccagctgactagaattttgccccaaccccgaactggaatgtttatgaacccctaatctcttgtactctgcaattctaacctcagtgtgccacattgctgcatgttactcattgctgaatggagtggcacataacatctatttaaatgctgcataatagaactatggtatcgtttaggactttatataaaagttataacatttgaaatgccatgaatttcatcccagtggcaacatttctgtagtcagcttttaaggaatatgattagatgagatgtatactccacttttaaaatattttaattatcagaattatagaattacatgtttttttttttaagtcacatagattcttcaagcttggatcttaccaagcctggacatcaatgagctatttcagtttgttgttgttgttgttttaatcaatgatagggcatcttggaaagcctatggcatttcctcaaaagtttccttcttattttccctcctaattattaatcttacataagatgtgccaagattgattcttggggatttactattttttgtttatagatcaagcttcaaaaagtgcatggtggttatgctgttgaagaacttagacaagaaaataactcacttggcagtgagcacagtggagaatcaaagaatcaatgaattgtggatctgaaagaaatagagaacatcaaattcagtgcactcattttacagatgaaaaactgtagacctacaaagacagttgacatggagggtcttctgattcccataatgttctatagcatcatccttcatgagatcatcacagaaacctagtttaagaacctctgggtcatttttgtatgcatgaaaagtgagaagaaaatgatacccacaccttcctgtgggtccagaggccagcaatccatgcatcaacctgtgtttattaaatacccacatgccctctgctgtgcaccagatattggtgggcagggctggtgtgtgaattaaaaaatacacgtcagtcagacttggtgagacacttactcacaggtgagccttagcctagtgcacagcatcaagacctcaactggttttattttgcagtccatccttaagagagaaaaagtctttctttgatgaaaatagccattaggtgcaaaagaggagattttagttcaaggtattatagctctagctgaaggaaacacacaggaaatgtgattctcctcagagatgtgatccaggagaaaaccaggatcctaaacattcctttttgaggaatatgtctcaggaaatattccttttgaaaggtaagggtctaccaaatggtcaccatcctcacagacagatttgttacaactcccatttcacaatgaggaaactgaggcgtatggaaaacaatctgttaaaagttaagagaacaaatttgaaactgggtgaaaaattgcaacttcttagctttaagttctcctttaccaaatattctctgaagtttattccattctcatgttaaaaaaaattgtaaccaaaagcagcattactactatgtatcttagtagttgaacaataaagtgcatcatttttcccacacagataataaccaaattcttatttaaaaatcaattaagaaacctctaattaaaggggcagtgaatggaaacagtagacttggcctaaatatgcttgtggagcagctgggggcctgcatctgtcatgggtaaaatactttactcatttgtgggaagtgggtccccttttgtaggttgtcagggctcaatttagtccctgaaaaagatgtcaccctattattttatgtggtcctcagcttaaaaaggtgtctaactgtaagtactacacctctaaagagagatgttagaaataatcactgccttggaaaaaagattctaataaagcaaattttaaaaacaaatacaaagccaaatttctcctaagcacaagagtttgaatatgtagaaggtcattttatttgttttttgtttgttttgttgagtagtagaaggaaaagatcatatgacttcatataacccacatggcatctgggagcactttgctcttaaaatttaagtagattggtcaagcttccattccatacatagtctcaggctcaatccaaagatttttataacttttcagggacatgggtccttgtgcttaagtttctgctcctgtgaatgttttgtttgtttgtttttccttttttggtcgtttatgattttttttccctgatattgtctctattctgtactgtgtgtgggttcagaaatgaagttcaccttcttgccttgatttctgcaaataaaaactcaacccaatcataaaagcctctgtatgtgtagtggattctactggatgtctggagagacaaaaagaattccagaagtagatattcattcagcacaaacaactttgatttaacagcagagggccctattcttgaaaagccctctcaaccaccctccccttcaagatttcttaaagcgtgttctaccagtattcaacctctggccatcaagatggctcttttttccttctcttccatctttcctttcaaatttctttttaccgtaatgtccccagaattttattttcttcttcctcgatcatatagagcatatctgctctttccagccttactcccaagcccttcttcagacctatcattgcacatctgaaaccaatcaaggtacccctcataaaccaaaggaccacctgagactgctccctttcagcccatggttatcataagggtccatgagaaccatctgcaaatcttgttaaaatttcagatgctggtttatcaggtttggggttggctgaggaatatgtatttttaatagtcatgatttgattctgttagagggatcttcagcttattctttgagaaactctgtagtctaacaagactcatcctctgcagaaggcagttggagtccagagagcattttttttctcttttgcatatacggtaaaccttagtccaaacagagccctggaaaatatgcatggtgattggagttaaacatccctgcatcatcctgttgctcagactatcttgcttaccaaagaccatgctctttttagaagctctatcaattaaaactttggtacactcatcaggaagggataagactcatatttctcctgtcttaagaggatttctcttgctatgaaaatggttgtattcacttgaacaggcacagtgactggtttagttaagggacatagaagataaaacttgtttggggacaacccagggaacttaaaggatcagtgagcaagactatcttgttagcagagttccacattattttatatttttattaattaatagtttgtgataagttcatatgttaatttgagtaacagcattactcaatgagggtagcttttttgcaactcattttacattatagctttgtcctttttgaaaaataatttaattacaaaaaatcagaaaactgattggagggtgattatcaagtgtataaattatccatactatgaattgataaatttccttatataaatgcattttaaattattcattttataaaaatgagatgtatgcttttcaggaagatatcaactcttgtgtgaataaataaatatctgtattattcctaagaagtttactgtcttttggcacgcttctgtcatttttctgtcttaattattagctctttgaatagaagagctaagttttctatttttttcctttccttgacacatgtatccagtgatttctgcccacagtgggtgctcaggaaatgctgatgcccttcatccccataactatgttatattctcctccttccattaatagtgtgtgaatctaactaataatttacccacctagtgtgccctggattcttccttctaaagtgggataaaaataatagctgatcccaggaatgtctaccatcctaaagactcctggagtctagaactgcattcctgaagtagttctctcatccactggtagattttctgtaacaatctgccttttttttttttttttcttgatagtgtctctctcatgtttaagcttttttcggaatcaagcccacattcttcagcacggcattgaagactcaggagccctcccagtctggccccatgcacagatggaaggctttctttcctggtccttatccttctctgcacaatactccagtcacaccacaccatggactgctctctgaccctcatggcattccagtggcgttatgctctcatacagccttcctcatttgcccaccttgcttgtctctgactcatattctattccaaggctaagctcaaatgtcatcatatctctcaaactgtccctcacactcccacccccacatgatttagttgtattctgccttttgttccacaggtctttgtacatcatggtattatggtgtttaagtctgtacatatgtatttgtattgccatccccaacccaggctccaagccttctgaaggtagaaaactgtatcacataaatgaagaatgaatgaatgaatgaatgagtaaatatttagcctatctgtctgaactgcctgctctgtcttagccattggaaacatgcttagaactaaatcattttctaagaaacaatagtcttccttagtattaattttatattatttttctctcttctctccaagcccttatcacttggattcttgctattttacttttgctttaagatatccctgttgtcttattaactactttgagtcctacacagatttatgtaagtgagaaatatacaatatcctatgtacctcacctgagctaaataaaatcattttccatcaaaggaagcatcactgttttcacttctcttttccttactatattttggataaagatgatgtaggcttttcatgcgccaatcaagttgcataatgtttttgagtcagtattatttaccaatttatcttgcttctgcatatattgttggctatgattatatgacagtttctcttgtctaacacacatttacaaaatcaaaattttctaattctctttagttttgctggtgtcattatgtatgccatagttgcaaaattgtgttttgtgcaacaatatagaagaataaaatacaaaggatgaaaagagactcaacaaggagagataatcttaaacttgtcataaaataaaagtgaatttcctaaaattattaatatggtgacaagtatatacaaattttgcattaaataattgggtgtaaattcttaaccctaagaaagcttattgaacgatggctttttgatgtatggaatggattgtttaccaaatgaagcaacataacagatatctctggaataaccagctttacagctgacagcaaactccttaggccaaagactttacatgtttggcacattgtacttattgtacatcagtgctgtttaaatatttaatagcagttgctcccatacctattcctggctggtctagccttcctgacttgtcatgttcgtaatcaaatatgtatttctacattaatcatttggggtgtggtgccacttttaatcccaggtgggatgatgccatcttctgaaggcttggttgtgctctgggtgactagaataaagataattagctatgaatatcaaacattactttttctttttcttatttaaaaatatgttcctttttagagatagattctttgcggagtgagtgtatttttttctaaagatgaagtagtcactgtttttgaaaatactctaggacctgggcttcatcatccaggctttataactaatgacgtgacctgacctctctggtcagtttggttatctgtaaagaaatcctcctgggctaattgcaaatgtttccagccccagagttttagtgttattgcctatttccagttgtaatatttgtgcttatttacttagaagaaataaattagtttacttttaatttttactggggaatgtaaaaaaaaagtgctcctacttaaatgtttaatctgttttgtgatttatttctttaaggggaatttacccaatattcattatatagaaaaagagtcatggcaacatatgagaactccaaagcatatacatatagaataacctagctatttaattatgtaaattttaaaagaaaaacaaaatgtagtgatagaaaagaacaaaatctcttggatctggagaacaaaagactactaattgtgtgaactgtgacccttgggttctttatcaattaaacaggaatctttctgtttaccagagaacaagaaatgagataaagacatgaagatccattgtgactgtggacactacgataggggaaaagtttctttttaaaaaaattttaattgttgtgggtacatagtatatgtttatatttatggggtatatgagatgttttgatatgggcatacaatgtgtaataatcacatcagggtaaatgaggtatctttcacctcaaacatttatcctttgtgttataaacaatccagttatactcttttagttatttttaaacacacaattgaattactattgactgtagtcacactgtcatgctatcaaatactagatatttttgtgtaaagatagtgctaacagactgatgctttgttttctggcaaggggagtgccttcatcttcatccactcacactttctctcctgacctctcttctgacttttgccacaatttccttatgtctggccacatttggagttaccatttttgctcatgcaaaacaatatttgttgttgttacaacaacactaatcagcccacagaaggatttaatcgttatttgttttcattaatagcttcttccagacacccaggtgtatctgccaaaagtgaagtagtaaaggccccatgaaaatgctatacaaacccttttaattttactgactttgacttcctttcttatcggggaattcccagtctccgaagttttgtttatgcatgctgcagtttccaagggtgactgcagtgaactggaaaagttctatctgaagccactttcacttgtatgaggttcaacagtcattcagagaagtgaagcccagttaggtttttctgcaggagcacctgaaggttctgcttacactaaatctttggagttaggtagccttcaacacctaacagcaactactgtgcttcccattacaattatttatgcctatgttactttcacatttaaattattagtattatatatcaatgtgtagatacaatagggataatacccagaaacatataagccatgtgcacaatttttctttttcttttttttagagacagggtctcgctctgtcacctaggctagggtacagtggcacaattgtagcttactgcagccacaagctcctgggctcaagtgatccacccacctcagcctcctgagtagctgggactacagctgtgcactaccacgctggttttttttttttttttttctgtagagatggggtctcactatgttgcctgggctggtcttgactcctggcttcaggtgatcctcccaccttggttccacaaagtgctagaattataggcataaaccactatgcccagcccatggatgctatttttaagtgtgatgttttatttatctctctaaatatctttaaaaatgaatacttcttccaaggagtccctgaatactaattttgacctttccatcatcgactaagatcatctttccttatctaatcttcatttttgtgttagtaatacttgtaatttttattgtcctgatctttgctccacatttttctcctcatgactgtaattcatagaatcatgcaataaatcatttattcattctgcaaacactttttgagtacctattacctgccaagcactggtctagatctggctcataagtattgaagtctcctgctattgttatagagctaactgttttttccttcagttccatcagtgtttgcttcatattttttggagctctgttatttggtacatatatgtttatatttttggggggggtgtggtgtggattgatccttttatattttgggatgtccttttttgtctcttataacactttttgatttaaagtctttttttgtctagtactaatatagccaccactgctctctttttgaagctatttgcagagagtagctattctcattctttcacattcaacctgtgtgtccctcctagatctaagatgagtctcagcatatagttggattcagttttttataaatccattatgctaatctatgtctcttaattagggagtttaatttatttaaaattaaagcaattgctgataaagacttgctattgccattttgttatttgtgttttgtaaaccttatagctatttgtccctcattcccttttgcctttcttcttttgtgtttacttgattttttttgtagtgacatgttttgattgccttctcattttcttattgtatattctattttcctagtggtcaccacggggattacagttgttatttcatcaaataagctctctgtctttttctctatctgttctccttctggaactctcataatgcctatattagtccacttgatggtgtcccataaattcctctgtttctgtttatttttcttcactcctttttcttttcttaatcagataataatttcaaataagctatcatcaggtttactcattcttctgcatgttcaaacctgccgttgaacccctctagcaataatttttcctttttttttttttttttttgagacggagtctttccctgtcacccaggctagagtgcaatggcgcgatcttggctcactgcaacctccacctcccaggttcaagtgattcttctgcctcagcctcccaagtagctgggattacaggcatgcaccaccacgcccagctaattttttttttgtatctttagtagagatgggatttcaccatgttggccacactggtctcaaactcatgaccttgtgatccacccgcctcagcctcccaaagtgctgggattacaggcatgagccactgcacccagcctctaccaagtttttcatctcagttattgtgtttttcaactctacaatttttgtttggttcttttaaaaactttgttgacggtctcattttgttcatgcatcgttttcttgattttatttagttgcttgtctgtgctcttctttagctcattgagcatatttaagacagttgttttaaagtttttgttaaatccaaggcctgtgtttcctttagagtcagtttcttgagatttagtttgttccattgagtggaccatgtttccctcttttttgtatgccttgtgaccttttgttgaaaattaggcatttgaaagaacagcctcctctcccagtctttgcagactggctctatgcaagggaagacctccaataatcagcttctcatgatatctcaaggtcctttcagattttttctggaaatgtctcttccaagggccggcacatgtgctttcccctccaatttccctctatacacagatgctttaaatgctgtaatttctctaagagtctcactctgcttcttctcagggccttagatgttatattgtattcctctgcccataatattttgcccacaggtgcaatctccttgcagctcaaaacccagtactcctgccactactttcagcagccttcaattgatatttaagttatgctactactcccttcagtgctcctagtcaggtcaaacagaaaccagtcccttggacagctgccagacaagccataagattgcaagcaagttccactctttttcttcttccctgagagaggaagtgggactgggtggtataccgtgctatgttggggagtaaggtgacaaaacgtcctgttgtcaaaacaatgggactcaaaagtttggtgttcttttgtttttttaggtactcacttggttgctgcagcttcttaactggtttctagagttcctacaaggctacgttggtccctgggtttctctttatatagtgtttctatagggaaatgagggcctatagcttctagtctgctatcttgctgatattacccttgctcataagtaactcataaatcagggataaagaaagatatataatgagaatgacataaacagttttgtgtttagaataaaataactcttaagactaaatactcttgtacaaaaagaataataaacttcagaaccaaagaaaccattagaaactcctcacgtattagattaggcgagaaatggtaaaggcttaaactaagacagtagtacatactcaataaatactcagaaggtgcaattcaaagattcagtagtctattggaagcattggccagggatgtgaagatggaagagatatggaataaagaaatagacgaataggttccattaactctgtgattttagataagttacttagcctttgtgaacttcagtttcatcatctataaaataggatggttgtgaaggctaaaaggataacacatttaagtgcctagtagatagtaggtaactaataaatgctaatttctttttttaaatatatctacctctgaccaacgtatctagattatgcagtttattggatgatcatgctactcactgaaatgaagaatagggaaagcacaaaacaatcttttaaatctttgggttttttttttaactcctgtgcttcagtaataatacacattagacaggttctatataaggagctgtttgcatttttgtttatctctctcaaaccaactgtcccaagcatcttaaaattattatctgattcccagaacattccccttaaattgggcagtgtgcaaggtcactttttgcactctggttggctccaggctattcaataaatttggagtaaagtgataaaaataatttcagtctcctagctctcaagccaatgttttgttatcaactctgagaccttttaagaattctgtgagaatcttctccaaatggctctaatttgacagatttacagccatgtaaatatatatgtgcattcatgatgacagtttaaatgttgtaagtagagtttatgaaaggaaaattgaaaaaggaatttcaaatagcccccttttccccattaaggcactgaccgttttataaaatcatgcttgcataggctaagattcacactgctatcaatactagggaatgtaagttttcgtgcaactgctgtttcatatggactgtatatctaacttaacaaatcataatgtaggttttaaagaatgaaacgagcaattttaaaacctattctagtaacattatttttagaataatcaggataatttaactcttaataaataatgcaagagttatgatctatgcatcaaattttaaaagatggtaattatgtatgcagatattccattctgataggataaaaatctattggtttataaaatgtgaaagctcagaatttgggataattcaggcctccagccagggagtgatgtgagcagttagtacaagcataccctgggctctttcctctatgtcacaccccaccctcccacaccaccaagaaatggaattttccacagtggtgtatttgatttgttatatgttttgaattattttcaagaagaacagaagctataaaaatttcaagtagaatcatctagtttttttctcctcatccttttgctgtgatacatatcctgagtcttatttcttatcttgtgaactagccaaatatgtcagcaaaatgtcacctcctatagagaaagtaacaaagacatattttttggtacaataaaaatgacaaaatacaaatggaattcttattataattcattcttactcacatggagatatttttgttcggcaaagtcctgatagctagaagacacagctgttcactgggtgatgcttcaatctattttaacatgtgatattgtattattcagagatttgactcgagaacagcataggactgcatttctaagagatgacacatggacatgcacagacacagataataattttgccttgtaaagcctcatctcataaaaggcctggctcagatgataagattgctcatgaagtcctgatgtaattgacacaggtgccatctaggtgatcgctgacttcccagactcatgggcttcaccaccttcgggtgcctttccccactcggtgcagtccttcctccttccctgttccaccaatgccttccttgtcctaattaactccaagactctttccgaacatggcttaggtgtgagcccttctgggaagatgccttgggatccaagctgagttaagtctccttcaaagtactccctagcatcctctgccaaccttggttctaaggttcattctcatcttcgttctagtcatttgcctgtgtccctcattagaccgtgaggtccttgaggataagtaccacctaatttgccttgttattaagaacacctagaatattgtctggcacctaggcaggactcagtgagcatgtgttaaatgaatacatggacagatgaatgaatgattgcatcctgatctgtaaatggcatactgccatgtgtatacacgagtaacagctaactctcaccaacttctttccgtgtgccaggcacggtggttggcttcttagtaatattcactcatctaatccttcaaataaacctttgagatagatatctttattttctttgttctgtggataagaaaatggaggcaaagagagttaaaatgaccaagacagcactatgcaggcagatttcaacctttgatttgttgggccctttacagtcaggctacacttgaagttatgtggctgcttattataaaaatgtgttgaaatcacgaaggctgaaggaatagctacaaatctgtcttttactatactcttagtgctagtggagaaaaaaactacataattcttaatacaactctgtgaatattttggttcattttcttcaattatttttttcacatttaaagtatattcttatttcctgtatatgtatatataatatttatattaacgctatattatattcatacttgcattactgcattgtctccataaccataatagttaatggtgtgataatattccatgtcagttgatatctgtagccaagtacctgctattggacatttgtttctctctaacaatgttatgatgaaaatatttgtgtgtatggggaatttttgtgacttttccttcacttttcataaaggaatttcagaatgaaagccacgctaattattgaaccataaaagaatccagagcccagacattcaacactatttctgtaatttctagaggtgctgtatgaagaaataaagattgattgtgatgagtccttgagttgaccttcattagctgggtaatctgccttggggaaatgccccagatccaacaacccagagtacagtctgaggaagaacccatagtttatttcacattataatacagaaaaaatctggagaaaactagtgtccatcatagtcacaaatgaaagtcagatatcgtcaaaaagggaccatgatatcatgaaaggtttgtgtggaagagagcgaggagccccagtgtgaaaaccttgcctacattgttttggtggttctggaggactttacgctggaaatctcaggaattaaaacgtcagctagtgtcactgatgtctgctttctggcataggtggctccagagccattttacactgaggctttctgaaacatttcagagagcagactgctgcctggatgagggtagagatcatttctatttttgttttcatgttcaacactgtgtgtcaagcacttagcacagtacttggcacatggtaggtgctgactaaatatttgttaaatgaaggcataagtatagtagagagcacacactttagaatcagaaatatttgggcttgtatctatcatttgcatactgtctggccttagacaagtgacttaacctctcatagcttcagtttctcatgtgaaatgaggacagagtgatttaccttgcctggtgctttatacataattgctcaggtgtaaggtgatcagtaagaagtactcacatgggagaaaatccagagatcacctatggccaaacagtgccttgagtaagagatataaaataggtaagaagatgggggagagaagtacacaggaagcataaccttacccaaaagcaaaagagcagcaggaaaaataggaataaggtgtggcaggaactcattaaaaatacagtagaaagggaaagaaccagtatttctgattgctttctggaattccttacagacctgatgagttatttcccacttgttgacaccttagttccttctttgggtagtctcatttttttcatactggtttcttttgtacccctaggtagattatcattatagaacacataaatagacacagattttgtgacatggggattttgaagtattgtcttttagtagatcctgccattttttaaaacatgtgaaatttattttgaaactctcacttggcttccaaaggactgcctagaaatctttttagaagactaacttggaataaaatagaaattacagtttgataggaatcctagaatcctaatttgtcccttgccttagagctagtgtactccagttaggctctgtgtgttcgtgtgtgtctgtgcaggtgcatgcacatgcgtgtatgtgactcagtaaaatgctgttacatactgcatatgctggatgagaactcttgaaaagccaagactaaaaaacaacaataacaacaacactcccagctcactgtatgctgatctgctgaagacacctccttactctattgtcatttcatattcaaggatttccctcaatgctgagcttcctgtagagcatttctttttgatcttccactcttccattatttgaactgcaccttcgattttataaagcctgaatgttgattagaaaaaacctgttggccgggcacggtggttcacgcctgtaatcccagcactttgggaggccaaggtggacagatcacaaagtcaggaatcgagaccatcctggccaacatgttgaaacctcatctttacaaaaatacaaaaaattagccgggcttggtggcctgtgcctgtactcccagctactcgggaggctgaggcaggggaatcgcctgaacatgggaggtggaggttgcagtgagctgagattgtgccactgcactccagcctggtgacagagcgagactccatctcaaaaagaaaaaaaaaaatttaaaaacctgtcaattccctcatagacctccaagatctttatcactgggtcggggtaccaacttccttgattctcccaagaatggctatgtctttccctttaatgtataaaataaatttctcttatttgtgatttttttttagcttcagtttttttctttaaattaaaaaaaattataaagcactccaaaaataaaaaatattacaatagatagctgtacaccagccctcaaaatgaaaaatgctaatatttaagaaagtaaacctcacctcacatatacagctaaatttctatccccatcctttccccattactcctcccaagaaataaccattgtctcctgacattggtatactttattcctatgaagtgtattttatacaagagggctctaaaaagtacatggaaaatgtgtattatgaaaaaaactatgcatggatttcagattttgacacactaagaaggataaggcatcagtttgaaaagagcccctgtcagaccaacatgaattctgctaaaatgaagcaagaacaaatatcaaatatatactgaagcttgagtggaagaaaggttaaatcattgatgctttatgaaaagtttatgaggataatgcctccaaacaaatcaacagtttacaaatgggtaatgtgttttaagaagagacaagacaaagtcaaagataaagcctacaacagcagaccatccacatcaatttgtgaagaaaaacaattaatcatattcatgccctaattggataggaccaatgattaacagcacaaacaatagccaacaccatagacatttcaattgattcctcttacacagcttacacaattctgactgaaagattaaagttgagcaaactttccacttgatggtgccaaaaccattgcaccctgatctgctgcagacaagagtagagctttcaatggaaattttaaacaagtggcatcgagatcttcaagcatttcttcaaagaattttaagaggatgaattttatcagttgattctaaacacaaaacacaaagcagtggctaccggccaggcgcggtggctcacgcctgtaatcccagcactttgggaggctgaggcgggttcatcatttgaggtcaggagtttcagaccagcctggccaacatggtgaaacgctgtctctactaaaaatacaaaaattagctgggcctgttggctcacgccagtaatcccagctactcgggagaccaaggcacgaaaatcacttgaattcgggaggcggaggttgcagtgagccgagatcgtgccactgtactccagcttggccaacagagtgagactctgtctcaaaaaaaaaaaaaaaaagaaagaaaagaaacaatggccaccaaaaggtggaagtggtccagtgaaagcaaaagcagaccagtcaacagcagaggtcatggcaacagttttttgggatgttcaggccattttgcttgttgactttctggagggccaaagaacaataatacctgtcaattatgaaagtgtttggagaacattagccaaaactttagcagaaaagtgcctgggaaagcttcactagagagccctttcctaccatggcgatgctcctgctcattccactcatcaaacaagggcaattttttgagtttttatagaaaatcattaggcatttaccttacagtccagatttggctccttctgattttttgcttgtttctttctttcctaatcttaaaaaaatctgtaaagaccacccatttttcttcagttactaatgtaaagaagactgcattaacatggtcaaattccccggaccctcagttctttagggattgactaaatggctgaaatcatcacttgcaaaagtatcttgaccttgatagagcttatattgagaaataaagtttgcatttttaaaattttcatcttttaatcccatttttccatgaactttttcatgtcccttcatatttttaccacatatatatttatttaatttttatttttatttttattttattttatatatatatatatatatatatatatattttttttttttttttttttttttttagacagagcctcgcctctgttgcccaggctggagtgcagtggcgccatctcagctcactgcaaactccacctcccggattcatgccattcttctgcttcagccttccaagtagctgggactataggcgcccaccaccacacccagccaatttttttgtatttttagtagagatagagtttcaccatgttagccaggatggtctcgatctcctgacctcgtgatccgcccaccttggcctcccaaagtgctgtgattacaggcgtgagccaccatgcccggccaccacatacatatttattgacaaaaatatatcttgccatgagcccaaggccttatttcctgtctccagtcagcctggaactgaagctcccaggttcccaagactagccactgttgccagcctctccttccagggccaccatggtgtcacctcatgtgctcactggtattcaattattgggtcgtttctggaaccctgtaatttctccttttctaaaaacttagctatgcatgttaaaaatggtgtcccatatttcagcccatgtatctgggtgattttaacaggaagattttcatgttacgtattccacaacactgcagaaaccagaggttctaacttcattttcataaaccaaacgtttgcctataataatccttttatactttggggttttttcaattaatttttaaattgacaaataaaacttctttcatatttttatggagtataacagtacgtttatataaaaaaaatatatatacacacacacacatacacatcgtgaaatgactgagtcaagctaattaacatatccactacctcatgtattttaaagtctggttttaacgttttggtaagactgtgccttctgtcagtgtgcatcagggcctctatctagaataatgagtccccccaggcctcagtttcctcagttgtcttctaactgtaagattcaatgattgtgatgaactgtagtaacatgagacaagtgtttagtacttgacagaagtttttacaatagcattaactaaatgttagcataataccgcataaaatttttagcaattttattataaaaacacctttcagccatgcgcagtggctcacgtctgtaatcccagcactttgggaggccgaggcaggcatgtcacctgaggacaggagtttgagaccggcctggccaacatattgaaactccatctctactaaaaatacaaaaattagccaggtgtggtggcatgctcctgttgtcccagctacttgggaggctgaggcaggagaattgcttgaacttgggaggcggaggttgcagtgagcccagatcacaccactgcaccccagcctgggtggcagagtgagactctgtctcaaacaaacaaataaacaaacaaaagcaaacaacaaaaaaaagcctttcatttccttctttgaaaaaaaaaaatagttctccaaagtgacggtagatattttctttaaaagacctgtatgatcatggagtaaaactatttgcttaataagtgaacatgaaagttttagcaaattacctcaaaagtttgcattttttttttcttagtagtgggcattttgtgtttctttcttgacaatgcttcttttgcccttatccactccttaatcaagattagttctaagtttttaattataagtaatttactttgtaggtcaagatagttgaatcctgactgattaccggaagagtgaaactagaaatcccatttaagtttcacccaaaacattctattctcacagagtcattttgtcttttggaaactctgggttggaactccatcccctggaccatgttccacctgtgttttccaatgtccctcatgctttcctgcagtccacatacttgttttaaggccagtaaacttgaagtattcagtggcttttagccaaaacgaggaatacaattgagtaatttcaaattcttcctgattaaatatgttgttatgagatttggggagataacacattccttgagctccaccacctgtagccgcacacagatacacagtcacaaggttgtcctagcagcttcccgctgggagttgcatgatgtgggatttacccatacagagctccagaatcaccagcagagcctctgctggctcccagttcctagcccagaggtttgcacttagtttcaaaccatgactgagacacctattttattctaaaagtagtgctgaacagttctatttctcccttagaaaatactttgaaatacattttatattgctttggggataaacgtaggcttaggaaaactgagtgtgatggaaaacaaagggtctgttaaaaggactgtttggtgagataattctggcaggtaattctggaaaatttaaggaaaccttgatgtataagtgtatcctgagattcttgggaaaggtgagcctctaaggtcctcgtcaagcaggagttgtaatcggggttctcttttggaggatgggtaaagaattgaaggggcatccaaaccaagcaacaggaaatctggattctaatcatggttctgcctcaaaatgtcattatgacgtagggcaaatcgcagaccctgtggtccagttttcctcatctggaggtttgtggaggtgagatgagatgacaccgtaagtccttgtccatctctaaagagcatgtactcatcaaattcctctccaaatacaaccaattttaagtttgtttcctttagtactggcccaaatgttatggaagcctggtacatatcggtgcctccttgttttttatagacagactgctttcaccttatggacttaggctagggattgagtaacctgctccttattccctgaaagccattcgatttcctctagattcctttcttcaggtctttgcagtagttcaatgccgacattaactttttaacatctctgttctagtttaactatcaaggcatctattgctcttgtttcgtccttaccaccatgcaccataccattgacctgcttctaggtccatttatttattcatgtattcattcaacaatcgttaagcacctccaatgttccaagccctacatgaggcggggctcttttccactttggggttgcaaagtggacaagaacacagttcctaggaatatatacgtctgagcactgctctggtggagatcagcaaggtgacatggaactatacaggaggcagttatttgctctattatgtttctgaaacagaagatctcaaaccttcagacctttaaatccactgttatccaataaaccacaagcccattataactcttgatttatttctatattattgaattggattctgcctcgtattccagttagtcactgcaatatggttgcttacttttctgttctccgtctagtttcttcagaaatggtatttatatttatttctctttgctcaaatggatatcataaggaaaatgtgaggaagtcagctatgtttggaaatcattccacacaaaaaattgctgtctaagacattgtacttaatagtcagtttctaacaaaaattacagataaaaatataatatctagccaatcatattttgagttagtttactcatatatatatttctgttcttaaaagcctacactaaggacatttaaatgcttaattgatgaagataattctgaagatgtgacatttgtttagagtgtagctagacatgaagaggaaaagcaggaaaagaaatttagatggaggtatgatgaaggatggcaattaaatgccatgtttttctgaaaagaggacagcttttttatctcaataatttaactgtaaaactaggggagcacttaaatttgaacaaaccaacatctactggtgaaaggagtaattgaaagctaacattcctattgatagttaaacgctgcatagaatgaagtagatccaaacagcttagtcaaagtaaaagtaagaaagaattttaaggtagagtacacagtgcatgtaatggaaatttgaagtatataaactgaaggcaataacagaatcatgcattagaaggaataatgctgtggaagccatgcatttgaaggaaactgggtggtggcctcagctcttctttcttccatcccaagaaagcccgctgtgatgccccaatacttctggtgaattgttaaatgcttctttgaccacttctggaaatttttgaagacaaggagatcccttctttgcaaacagtttattctataagtgagcaactgtgattgttggaatttttttctcataccgcaatcaaattaacctacccataccatctaccaagttatttgctctgaaggcacatgaagttgagtattcttcatgataacagcgctttgcatattggttcttctagatttctcaacgagatatttctcagttttaaaatcattctttctaggagcttgtttttatacttttcagtatcttgggcctcaatttttcaaggtccctcttaaaatatggcactgatcactccagatgtggttggtctgagcactgccaaaatgactggtgaactctttattatcttcatccagctcaaggttatatttcctttggagggttagttcttccatattaatgtttataaagagagtttagtactttattatcaacctttcttagctttgaatgtatccgttctgtttatttctttctatttaattcacaaatgctaattgagcaccatgctattttaggcacagtgctgggccctggggacaaatgatgaataagactctggcaggagaattttatgatgttctagtgggagtgacagacacataaaaataattataatgtgatgtgtgatatatatataaactttagtgctattagaacataggatgtggagcaaactgcctggggaaactggtaatggttaatcattcactcaatcatttgataaatatttgccaagaactgtctatgtgtaaggtacataatagacactcatttatgtgattatgaatccctctaagtaagaagtctatatttttctagattatgggagtttaataaaaggtttttataaaattccttactacattttctttttgtcttttaatctggtaattctaccaggatatgaaaggaggttgatataaagaataactattggttgctaatgattgttgatttcctttcaaagttcttaaaaactacttgttttataatttgccctggaatgtgaacaaagaataaaattcatgttatagttttacagtttgtacgatatgccttttacctttctttggaatttaccactgcttccctttgttataattcctccaagactaatagcagcattttcgtgatcacatttgtagtttttttagggtgctcatttgtgattttgtgggggtcatgaggacttgaactcagagtcccagggtattcctttactgtctcttatttatactaggcttttattccctctaactcatgtttgttgtaatttaaaaataagattcagtgatggagaagaaagacacaaaatattgtgaggaatttagtactccgacctcagttctgaatccttccctcctccattcagtagatatttataagtgcaagctttgttccagatgctgggctttgcacagaccttaatattccttcgctctgccctccttggatccccactgctactgacctggttcaggccctcatcatttctcacctgatcttttgcaacagccacttaactcatctacctgcctccagccttgtccctcttgctccatcatttgccaggcagagttctctgatgcgaaaatcttactccccttcttaaaactttcatctgtctaccacctacaggataaagccccaaatcccccactgctggtccagagctgcttaagttcccttcatcctccatgctgtgtctcctgtcagtgtctgtaaaagcttccatatattgcatacttgttacatgccaaatactgagtgacagatacaacacatgttgctctatctgcaatgccttccttgtcccagtcccttcacctagctcctagttattcttccagactaagctcatgtgtcacccttccaggaagtgttaattaataccagcaaccgcccacccgcatcccttccctatatagtttgagatgggaatcccttcctgctcccatgacagctacctctgtcactgtctttaccacattatttatgtgtctttcatccccagactagcattgtccattaggaacataatgtgaaccacacatataattttaaattttctaatagccacaataaaatgggaaatattaattttaatatatttaacccaatatgtccagtatgctattattttaacgtgttgtcaatataaaaatgattaatgagatggtttacattctttgtttatacttagtctttgaaatctgatgtgtgttttacacagtacatctcacatgctcgatagccacgtaggacgtagtggctaccatactggatagtacaggtctagactatgactcattgaggacacaaaccacatcttgtgtccctggcacaaagcccagtgcctggcatttagcagatactccattaatgtggaagtagaagagtagaatggagcaatctgcatcctgtataaaaagtaagaacagtctttattaaggtacttttctcttttgcatttccttatgatcaatctctccctattctgcaaggggcgcttttgtttctagacagttaggtatattgcaacagaaatacaaagtataaaaaggaattcgtatttagttttctgatatccaaagctagcctttgtttttaagaaagaaaagaagtttttctggatttttaaagttcccatagatatatcaaaaatttagaccttatagattagcaggtatactaacatttatttgtactattcaatatgtacaagaaagtcctttcacctgtccccagtgaaaataaaattttgtggtagtatacataactatgtgtataatatatagttattatatatataatatatatagtgatatggtttggctctgtgtccccacccaaatctcatcttgaattgtactcccataattcccacgtgttgtgggagggacccaataggagataatttgaatcatgggggtggtttcccccatactgttctcattgtagtgaataagtctcacgagatctgttggttttatcaggggtttctgcttttgcatctttctcattctctcttgccaccaccacgtaggaagtgcctttcgctcccaccataattctgaggcctccccagccatgtggaaatgtaagtccaattacacctctttttcttcccagtctcgggtatgtctttatcagcagcatgaaaacgaactaatacagtaaattggtaccaataaagtagggcgttgctgaaaatatacccaaaaatgtgcaagcaattttggaactgggtatcaggcagaggttgcaacagtttggagggctcagaagaagacaggaaaatgtgggaaagtttgcaacctcctaaaaacttgttgaatggctttgacaaaaatgctgatagtgatatgaacaataaggtccaggctgagttggtctcagatggaaatgagaaacttgttgtgaattggagcaaaggtgactcctgttacattttagccaaaagactagtggcattttgcccctgccctagagatttgtggaactttgaacttgagagagattatttagggtactggcagaagaaatttctaggcagcaaagcatttaagagttgacttggatgctgttaaaagcattctattttaaaagggaaacagagcacaaaatttcagaaaatttgcagcctgatgatgcagtagaaaagaaaaacccagccggtgcggtggctcacgcctgtaatcccaacactttcagaggccgaggtgggtggatcagctgaggccaggagttcgagacaagcctgggcaatatggcaaaaccccatctctatgaaaaatacaaaaattagcctggcgtgctggcgggtgcctatagtcccagctactcgggaggctgaggcaggagaatcgcttgaacccaggaggtgggaggttgcagtgagcccagagtgtgccactgcagtgcagcctgggcaacagagccaaactctgtctcaaaaaaagaaaagaaaagaaatacctattttttggggagaaattcaagctggctgcaggaatttgcatgagtaacaaggagccatgttaatccccaagccaacggggaaaatgtccgcagggcatgccagaggtcttcacagcagcccctccaatcacagacctggaagcctaggaggaaaaaatggttttgtgggctgggcccagggtccccatgctgtgtgcagcctagggactttgtgccttgtgtcccagcagctcctgccattgctaaaaggtgccaaggtacagctcggcccatggtttcagagggtgcaagccccaaaccttggcagcttccatgtggtgttgaacctccgggtgcacagaagtcaagaattgaggtttgggaacctccacctagatttcagaagatgtatggaaacatctggatgcccaggcaaaagtttgctgctggagtggggccctcctggggaacctgtgctaggacagtgcagaagggaaatgtggggttggagcccccacacagagtcccgactgtggcactgcctagtggagctatgagaacagggccagaccccagcatggtagatccactgatagcttgccctgtgcacctggaaaagccacagacactcagtgccagcccatgaaagcagccaagaggggggctataccccggaaagccacaggggcagagctgcccaagactatgagaacctacctcttgcatcagcatgacctggatgtgagacatggagtcaaaggagatcattttggagctttagattttgactgccccactggatttcagatttgcatgggccctgtaacccctttgttttggccaatttctcctgcttggaacagctgtatttacccaatgcctgtacccccattgtatctagaaagtaaatagtttgcttttgattttacaggctcataggtggaagggacttgccttgtctcagatgagactttggactgtggacttttgggttaatgctgaaatgagttaagactttgggggactgttgggaaggcatgattggttttgaaatgtgaggacatgagatttggaggggccaggggcaaaatgatatggtttggctctgtgtccccacccaaatctcatctttaattgtactcccataattcccaagtgttgtgggagggacctggtcggagataatttgaatcatgggggcggtttcccccatactgttctcatggtagtgagtaagtctcacgagatctgatggttttatcaggggttccacttttgcatcttcctcattttctcttgctgctgccatgtaagaagtgccttttgcctcctgccatggttctgaggcctccccagccacgtggaaatgtaagtccaattaaacctctttttcttcccagtctcaggtatgtctttatcagcagtgtgaaaatggactaataagtataagatatatatatatataactatatgtgcagttatatataatatagcatataataaatgaaactgttcaaaagaaatacactattcaaggtggtcaaatgacttaaatgaaactgagaccttatcacctgatcatgtagtgcttagataaaagatgttgtgttatgaagaacaaaaacatccttaaaaaattaaaagtgttagagtacattaattatattctaggtttttacccaagtacacgagattctttaacatgcggattctttctccaccttcaacctcattcagaatgttctaacactgaaaaaaatgttgtcaaaggataaacatacaagaatgctatggaggaagaataggattcagaggttcctgagagaagacaaagggctggtttgttgctcttttacctactagaaaagataattaaggccaggtgggatgcatacagtaaaagagggcacctgaacaaacaagcattgaatttggagaatgcctacgagtctgtgctgggctacgttcccaagacagactcagaagttacctgccctgccaggtacctcctaatctaccctctccaaagggaagattttcttcatggctgtaggaagcgcctcttgaaagctccaaatcttattttttttctacatgatgaattggcacagtactaagtttgactcattatattaaacaagaaatttttgatggtggaatggatccagagttctttgaaactgtccaaatggtcccgcataaaggaaacacttcacagtcgtttcagtgtacctacaactaaaaaattggtgtcagtctctagattcaagctgatggttcctgtgggagaatgcaaattcaaggtgaattagaagatgtaatgtgagatgccatctgtgaaataagaaatggaacactttatttaaattcttggtttcttgtagccttctaatcagaaatgtaaaagaaaggcttggcatagcattctggaataatactgtgactccttttgcctttccatgtgatcttattctttttgtgtttatggaacgtagataagatgctgagtgctgcattctgcattttttgcctcaggcatttaacagaatgccagctttccatgtgcatggacctgcactcactcagtacctactacttggcaagccgaagtcacccactgtgtaccctttcccctaatgaagcttccattatcccactttaacacctgtattctcaatttactgtccctatcaaaagctctcaagaaatgacctgaaacctttacataaatctagtaaagcaaattatctcgttgaaggctttggctagtgaattaacagttgagacttctgtgctgtatgtgcctgtgtttgtttctaacatgatgaaaagacttcatgtctgtccttttcatgggatgaggatggattaactcgggaggaaagattgtgacttattgatggaacaatgggctattcaaacactcaaaaaagagtggtttcttttatggaggggaggagggtcctaaaggcttggcactcttcctgatgagctgtcaaaaaggaatagaatgaaggtgatggtttgggtagagggtgaggtgaaaagaaatggaaagtggtgaaccttactccgttgatccccatgggcttagggaacagagatgcaggttctggattccaagtgttgttggatccagctgtgaggcaggacctcaaggggaacagggcttaggctctctgaatggcaggcactgtagcttcaaccttgggaggctgagcaaagggaatacatctgaggccagcttcaggtaaaggaggtggcattaatgtgaggaacttcacttcaaaatgtcccaccattctaggcagaaagaggaacaagtaagattgactttcacagtgaggaacaatatcagacagcaaagtgattaacagcagcaatgtggggccaccatgaggccagaggacttagttggaagtgtttaatataaaatgattaattttatgtacgtgaatttcttctcactggaggaaacaaaacagaacaaaacaaaaatcttagcagtgagggctcaaccctgttcaggagctagaagcctggcaaacatctggttggaactgtcaaagaaaaccactggtcctcaaattacccaagggaaggggagggaacaccagagaccaagaactaacagtgggagcaaaagctagttctgactcaggtttaattggaaaaaataaagtgtaatgtttacttgaccctcaagtattgttccaatgcgtattcatagtcccataaacaacacagatggccctctgcttcccacaaatacaaagcctacagaaatacaaagtttcagtggcattccagcccctctacatgaagctccctgccatcttccagccacctggtgtcattgcaatttccttatctgctccctagaaacagtagaaagatgctagtctggaatttcttaaaattttttttgttttttttgttttctctgagacagagtctcgctcttgtggcccaggctggagtgcagtggcatgatcttggcttactgcaacctccgcctcccaggtccaagcaattctcctgcctcagcctcgtgagcagctgaaaccacaggtgcacgccaccctgcccagctactttttgtatttttagtagaggcggggtttcaccatgttagccaggcctgtctcaaactcctgacctcaggtgatccgcctacccagcctcccaaagtgctggaattacaggcgtgagccactgcacccagcctaaaattttttattgatatgtaatagttgtgcatatttggggggtacatgtgatattttgatatatgtatatagtgtgtaatgatcaagttagggtatttgggctacccatcacctcaaacatttttctttgtgttgggaacattataaatcttctagctattttgaaacataaaattattgttaactataattttcctgctatactatcaaatactagaagttattccttctttctaactgtatttttataccccttaaccaacttgtcagttcttcctaccctatcccatcccagcctctggtaatcatcattctactctacctccaacagatccatttttttagctcccacgtatgagtgaaaacatgagatatttgtctttctgtgcttgatttatttcacttaacacaatgacctctggttttatccagccaggttgctgcaaataacaggatttcattctttttatggctgaatgatattccattgtgtatatatacattgtctgtatccattaatctgttgatggatatctattgattccatatctcagctgtcgtgaatagtgaaacaataaacatgggaacacacatttcaaaatactgatttcctttttgtatatccagcagtgggattgctggatcatgtgacagttctgctttttagctttttgaggagcctccctactgttttccaatttttaatgggtcccctgtgtggagaagaagagcttttgaacaacagacctattgtataactctctcgacctctcatttctcccctacccaggggatattatgtctttctgcaccacataaatattttatatctcagtaagaaaaaacttattttgcatgttatcaaacagttatcactttgtcatttcttggcctgatatattcattcatttcccaacaaatattcaacaaatacatcaggcactgtgcttagttctaggaatacaaagatgaggttgtggacccaaaaaagttctccagcttggaaagaaaccagtttcttggagaaccagttccccaagatggaacgcttaccttcagttgtgaaagatatttgacattatggttttttgttgttgtttttgttgtttgagatggagtcttgcactgtcacccgggctggagtgcagtggcacaatctcggctcactgcaacctctgcctcccaggttcaaatgattcttctgcctcagcctcccaagtagctgggattacaggcacccaccaccacattcagctaattttttgtatttttagtagagacagagtttcactatgttggccaggctggtctcaaactcctgacctcatggctgcctgctttggcctcccaaagtgctgggattacaggcgtgagctaccatgcccggccgacattatggtttcttatttacatctgtttggaaggtgctatagactgactgtgtccccccaaaattcatatgttgaaacttaatcttcaatgtgaaggtattaggaggtagggtctttgcgaggtgattaaatcatgagggtggagccctcatgattggatttagtgcccttataaaagaggccccagagagatccctcactcatcctgccatttgaggatacagcaacaagatcgctgtctatgaatcagagagcagccttcagcagactgaatctgccactgctgtggtgttggacttcccagcctccagaactggagaaataaatttcggttgcttataagatacctgatatgtggtattttgttatagtagcctgaatggactaaaatagaacaggtaagaatataagtgatggtggggtgcagcacctcacgcctgtaatcccagcactttgggaggccaaggcaggcggatcacaaggtcaggagatcgagaccatcctggctaacaaggtgaaaccccgtctgtactaaaaatacaaaacattagctgggaatggtggtgggcacctgtagtcccagctacttgggaggctgaggcagaagaatggcctgaacctaggaggcggagcttgcagtgagccgagatcacacgccactgcactccagcctgggcgacagggcaagactctgtctcaaaaaaaaaaaaaaaaaaaaaagagaatataagtgacttcaggatgttttgaagacctattcaaaactcatcaatacaatattgtttacttcaactattgaataattcaaagtaatttataatcagccattatggtgccatatgcctttttcacagacacagtggctaaaagactatacagtctgaagtgggatcattcaaattcttttttccagttcattgcatctctaactgtgaagcatacagtgaccaaaacagaatgtcatgggagaggggattcagccaaaacaggagaacaagcagcatatgggtcaaaacttcagaaagcctacatataggcatgtgaacatattttgtcctcttacaacataggtaccaaagaagggaagaaaatacataggactggattcagaacaatatgagaaaaacaaaggccagaacttccatttctcaaagagataaagcctggatgagcaaaggtgactgtgtttgctaacagacaacgacatcacctagggaaatgctgaatacttctcaaattaatctctggttgcatataaatattcttctgttgacgagtggattaatagataatttattttgaaaaatagaagcataatggtatatcttaatttaaattctattatttctgtgatgtaatttcaattcacttcctgcagttttgctcttttctttagtgatgtttaacatacttgtcatgagagggtaatactttcttttaggttcagtacttggacaatggtaattagaggatgtggaaacttacctgacacagtaaagtgcattctggaatgtaaatttccctttctccatggcattctgttttcaacttaactattgcttatgtatgctgattttaccagaccctagagttaatggggaagaatgttgtaatctcagacttagcttggacaaaaaaaaatttttcatctactgtattggttggccaaaggtttttaccttgaattttctgcatttaggttatcttttgtgtacttatagttcctccattatttttagaatatttggaatatcgttggttacaataaataggtctaccagtatgctggaacatgcgagagttacagacgataatagtaagaatgttgttttctaattgtgtagcacactagacattcatatgcattgtcttatttatcaaactaagcatatgagtcagatagtactactatttccaatttgcaaataaaaaaacctgagactctcagaggttatgtaatttactatgaaacatgtttataagtggcagagttgggttcataccaatactggattttgacttcaaatccagcattgattacatttttttcctcaaaagttactactttttgtatttccctgaggcagtctagcgtttttgcaatctagagaactggatttgaatcttagttcctccagctactagacacatggcttgaaaaaggtgtttgagctctcaaagcctcactgttctgaagccataatgtccacatgatggtggactaaactttaccttttaagatgttgtgaagtccaaatcaaagttatattcaagcatgcagttaccactcaataaattatagttatttttcttattattctcagaacaattcttaaggagacatgttttttaattgtggtaaaatatacataatttttcacccaggctggagtacaatggcgttttctcgactcactgtaacctcgacctcctggagttaatccatcctccctctttagcctcccaaatagctggaactacagacatgcaccaccatgcccagctatttttttgtattttttttagacatggtgtttcaccatgttacttaggctggtctggaactcctagactcaaatgatccacctgcttcagcctcctaaagtgctgggattacaggcatgagccaccgtgcctggcctcatcttgacctttttttttttttttttgagaccaggtctctctctgttgcctaggctttagtgcagtggcacaatctcggctcaccgcagccttcaccttccaggttcaagcaattcttccacctcagccccccgagtagctgggattataggcgcaccaccatgcccggctaatttttgtattttcagtagagacaaggttacaccatgttggccaggctggtcccgaactcctgacctcaaatgatccgtccacctcgacctcccaaagtgctgggattacaggtgtgagccaccatgccagaccaaccatttttaagtgtacagttcagtagtgttaagtatattcacattgttttgcaaacaatctccacaactctttatcttgcaaaactgaaactttttacccatttaagccccccattgcctcctgcctcctagtccatggcaaccatggtttctgttttctgtgtctacaaatttacctattctggataccacatataagtggaatcataccagatttgtctttttgtgactggcccattcatttagcataatgtcctcaaggtttattctttattcatgttgtagcatgtgtcagaatttccttcccttttaaggataataccacatcttgtttattcaggaacatttgggttttttctacctattggctattttgaataatgtttctatgaacatgggtgtctaaatatctctccaagacccgacttaattctttgggggtacatacccagaagtggaattactgaatcatctaagtcattctgtttttaatatttactgccatgttgttttccatagtggctgcaccattttacattcccaccaacaatgcataagagtccacatttctctacatcctcttttttctatgtgtttgtttgtttgtttgtttttaatgtacccatcctaacagatgtgattaaggagatactttaagaattgacatatgtaatttccactcttttaaccctcaagcctaagatggtctatctgacctaattcttcaacctcttttcgtgtgtgtgtgtgtgtgtgtgtgtgttttgaaacagagcctcactctgtcaacccaggctggagtgcagtagcgccatctcatctcactacagcctccacctcccaggttcaagcagttctcccacttcagcctcccgagtagctgggattacaggagcgtgccaccacatccacctaatttttgcatttttagtagagacggggttttggcatgttggccaggctggtctcaaacgactgacttcaggtgatctgcctgcctcggcctcccaaagtgctgggatttcaggcatgagccaccgtgcccagccacttttcttgttattcccactactagtactctagcaaaaaatatcctgtaaccatggtgagccttcaaggcatggtatttctgtttggtccttctcagaacacctagcagcaaattttgtatccatttacacactgagggtcaatctttctctttttccatttctttcacagaataaatattttctgtttatagttcaatttaattgacaggcatagttaggggaattttcaagtaataatgtgtctggggttggttccttctggtgggttcttggtcttgctgacttcaagaatgaaaccacggaccttcgcggtccgtgttacatctctgaaaggtggcacagatgcaaagagggagcagcagcaagatttattgtgaagaatgaaagaacaaaaattccacagcttggaaggggacccgagccggttgctggttggggtggccagcttttattcccttatttgtccctgcccatgtcctgctgattggtccattttacagagtgctgattggtccattttacagagcactgattggtccattttacaaacctctagctagccacagaccgctgattggtgcattttacaatcctagctacagagtgctgattggtgcattttacaaacctctagctagccacagagtgctgattggtgcatttaacagagcactgattgttgcgttttacaaacctctagctagccacagagcactgattggtgcgttttacaatcctagctacagagtgctgattggcgcattttacaatcctcttgtgagacagaaaagttctccaagtccctgcccaacccagaagtccagctggcttcacctctcaataagtcaaatgtcaattttagttttccggaacgataattaagaatttctcaccctatcttctgtgtctgttaatctcattcttatttttcttctctctgtggtgcattttggacaatttcttcagataggctttcagttcgccaattcattctttcagctgtgttgcatttgttattaaatttgtccacttaatttctagtttcaattgttaaattttatttctagaagtttgtttctttcctaacatatttggatattttataacatttctggttccttgcacatattttcgaacttgtttttaatttcttttttttgctttttgagacggagtctcactctgtcgcccaggctggaatgcagtggtgtgatctgggttcactgcaacctctgcctcccgggttcaagcaattctcctgcctcagcctcctaagtagctgcgattacaggcatgcgccaccactcccaactaatttttgtatttttagtagagatggggtttcaccatattggccaggttggtctcaagctcctgaccccaggtgatctgctcgccttggcctcccaaaagtgctgggattgcaggcgtgagccaccgcacctggccgtttttaattcctttaaacatagtaagtacagttattttagagtctgtatgtagtaattccattatccagaatccttgagggttctatttctgcagtctattgtttctgctaattgttccttatggtgccttgtttccatgtgtgtttaactagttagttttttagtgtgaactacatatatatatctcttttttgggggggtaggggaactttatgtgtgtgaattatttaagcctaggacaaagatgtattactccagagccattttgcatttgtttgtactagcaggactgcctaaaggcactaccagtcaagaaccactcaaaatcaaatttgggacctgagatactttggactacctaagtagcgtgaatttgagctccaaactaacatgaggactggcttatgagtccaaattatcagcaatgattctttctctctctgctcatcaactagatttgaaactcttttttttttaatctgctgtaagtgtgggggtgggtgtcattttctacttacaccgagggtgtagccctttgcagtcttaactttatgctagagaggaaattttattagatgactctccacctggaggcaatctctaggttttttacctgcacactgtgtggtcttgacaatcaaagctaaagttcctgcagttgagcaaatgcccccagagagaaagtcagctgcagtgctccacttcactctgagttctttcattcaggtattaggcctaagaactatttactctcttaaaattcatcagtgcatttaagatactttaaatattttatccagaatgctaaattgtttccaatgggagggtcagtttatatacctattctccatattaccagaagcaaagtccctccccatatttttaccaattccatcttttgtttccaatttggtgaagtttggtagaattggcaatgagtaggggaaaaatttgatccaataaaaatcaggaaaatatggttaagcaaacaactaagttattccttttaaaacatatacttcctgtgcacctgagctagctctataatcgctgtacaataacagggtgacctcactgccctcgctcagagggtagcttcaggctgatttcatacatattcacactgtgcaagccactgtcactccataaagtgtttaggaccctggacctctggcttggcagtgtccaaaactgctaaatgttggattgagggatgctcacactggaagagcagatggaaagtggatagggatgggagacctggtgactgtggggcggtaagtagaatctttgagacagactgaaacattatcccagaaaagaagttccagaggcaaagggccagcaggtgtcctcactagaaaagagcaagaaagataaatcttgctgaattaatcttccctactgttcctggctgttcttgacagatcttttcacctggaccctcctgccctcaaccatgacttccccctacctagactcagctttatccgctctgatccttctctgctttccttccctggtcagctattgtttatcaagcagaaaagtctctttataagtaggcctgcagatcttcctctgtggagcagttttcagagcctttggagtgagacagacatgaggcaatagttccaggatttaaaaaaaaagaaggctgggtgtgatggctcacgcctgtaatcccagcactttgggaggccaaggtgggcggatcatgaggtcaggaggtcgagaccaccctaaccaacttggtgaaactccgtctgtactaaaaataaaaaaattaggcgggcatggtggcgcgcacctgtaatcgcagctactcaggaggctgaggcaggagaatcacttgaacccaggagacagaggttgcagtgagccgagatcgtgccactgcacttcagcctgggagacagagtgagactccatctcaaaaaaaaaaaaaaaaaaaaagaaaaagaaaaaaatcctggagcagttaaatgtttagaaaagtataaggatggacaaagaatttattcactttttagttttctaagtaagaacattaaaaaaaaaaacaaccttactgcatatcaacttctaatgttgtatcagtttgctacgtaagggaccacccctaaagcagcaccacctcctgtgggcccttctgtctgggcctgctcacctggagcctgacagttcagatactctcactcacacatttggaccctcagtttgggcagccaggttggctggggcctctcttcagagggtctctgatctcaagaggccaaccagggcttgttcacataatggtcaagggttcccagtggcaagagagaaaatttcagggcacaagcccttttcaagtccttacctcacctttgctaatgttgcattgtcaaagcaagtaacacaggctagcctagattcaataggtaaataaatagattcctcctcttgacaaaaggagctactacgtcacattgcaaagggacacacaaacaggaacaaatttgtgaccatttgtgctgcagcctactacaaccataattgtcatttcatagaaaaagatcatcttaccatggaaagttagaaaaaaagttcttcaaatgtaaaatatttagctttacatatatatatttatatataaatataatatttatataaactcacagcattttccttattttattttatttttcttaataccctggactggtgaaaactttattcttagcagcactgttccagagaatggtgtttggaactatgttaagaaatggaatctggcagcattgcctaggattagagaaaagggtggggagactgaaggagggaagccagataagaatgcagataaagataatgagagcaggaagtaggtgagtggccactggaataaccagaaaggagggaaatgtgataactagctcagagtagccctttagtaccaggataggatggggtgtgtgcctgtgtgtgtgtgcgtgcgcgtatgcgcgtgtgtttgaaaggatggagtcctgattctggggctttcgttttctattattggtgacaaatcaccactaatttagccacttaaaacaacatccacttgttatctcagttttctttggatcaggaacccaggcatgggttaaaacttgatcctctgctcaaggtcccacaaggccaaaatgaaggttttgatccagatgggcttttacctggaggctacggggaagaatccatttccagactctttcagggtgttggaggaatccatatccttacagttgtgggactgaggtccctctttctttgttggctgtcagcttgtcttagtgtgctcaagtgccataacaaaataccacaggctggtttaaacaacaggcatttattttttcacagttctggagactggaagtctatgatcaaggtgcctgcatggtcacattatcatgaggatgctcttctggcttatagatgccttctggctgtgtcctcacattggaggggttgggggagcaagagagctgtctggtatctcttctaagggaactaatcccaccaaaccaggatcccaaactcatgacctcatcctaccctaattgcctcccaaaggctccatctgacaatatcatcacattggaggttagggtttcaacatataaattaggagaggagggacacaaatattcagtcataggacagctcctggggctgcctgcctttcttccatgtggcccctccacctttaagccagcagtgaccctaatgcttcaggtccctctgtttccttcttctgccaccaaccagagaaagctctctacctttaagggcttatgtgattagatgacacccacctggacactctccgtattttaagatcatttctgctgtctaaaatgatcctgggatgatatttcatcatattccagggattagagcaggacatgtttggggagcagctttataatttctgcctactgcatcatttcttatcaagagaaagtccctctccctcttcctctccctctccctctccctctcccctctccccctcccctcctcctccccctccccctctcccgtctccctctccctctccagtctccctctccccagtctccctctgatgccgagccgaagctggactgtactgctgccatctcggctcactgcaacctccctgcctgattctcctgcctcagcctgctgagtgcctgcgattacaggcgcgtgccgccacgcctgactggttttcgtatttttttggtggagatggggtttcgctgtgttggccgggctggtctccagctcctaaccacaagtgatccgccagcctcggcctcccgaggtgctgggattgcagacggagtctggttcactcagtgctcaatggtgcccaggctggagtgcagtggcgtgatctcggctcgctacaacctccacctcccagccgcctgcctcggcctcccaaagtgccgagattgcagcctctgcccagccgccaccccgtctgggaagtgaggagcatctctgcacggccgccatcccatctaggaagtgaggagcgcctcttcccggccgccatcacatctaggaagtgaggagcgtctctgcccggccgcccatcgtctgagatgtggggagcgcctctgccccgccgccccgtctgggatgtgaggagcgcctctgcccggcctcgaccccgtctgggaggtgaagagcgtctctgcccggccgccccgtctgagaagtgaggagaccctccgcccggcagccaccccgttcgggagggaggtgggggggtcagccccccgcccggccagccgccccatccgggaggcgaggggcgcctctgcccggccgcccctactgggaagtgaggagcctctccgcccggcagccaccccgtctgggaagtgaggagcgtctccgcccagcagccaccccgtccgggagggaggtgggggggtcagccccccgcccggccagctgcccggtctgggagggaggtgggggggtcagcctcccgcccggccagccgccccgtccgggaggtgaggggtgcctctgcccggccaccccttctgggaagtgaggagcccctctgcccggccaccaccccgtctgggaggtgtacccaacagctcattgagaacgggccaggatgacaatggcggttttgtggaatagaaaggggggaaaggtggggaaaagattgagaaatcggatggttgccctgtctgtgtagaaagaagtagacatgggaaacttttcgttttgttctgtactaagaaaaattcttctgccttgggatcctgttgatctgtggccttacccccaaccctgtgctctctgaaacatgtgctgtgtccactcagggttaaacggattaagggcggtgcaagatgtgctttgttaaacagatgcttgaaggcagcatgctcgttaagagtcatcaccactccctaatctcaagtacccagggacacaaacactgcggaaggccgcagggtcctctgcctaggaaaaccagagacctttgttcacttgttaatctgctgaccttccctccactattgtcctatgaccctgccaaatccccctctgcgagaaacacccaagaatgatcaataaaaaaaaaaaaaaaagaagagacagggtctcaaaaaaaaaaagagagaaagtgaaagaatcaaggagattttttcataatatgttattacacaatattacacaataatatgttattgtgtaataactgtcacctcttaggattattgttagatgcctagaatatcatgtataagaaaatgcattgcaaatataaagccctttagggatcatatctcttatagacagagtgaagggctggaatgagcacagattcatagaactggagtttgaaattcacctccaccactggtcagtgacctcaaacatcctctcctttggggagttttattaattgctaccactaggtgtcacctacccagctggagagaaaataaagctccctgaggctgggagctgcttgggacttgagacctgtgcattgtacaacccctgggagatttgcaagcctggagcaatctggaggaattcaactcttccaaaagagtgagcaaccgattagctttggaaggggcttatcatcagtgtaggcaggtggtggtgacaggggcctgtgatggttttgtcacctcccatggcctggttgttctggctgggaagtgaagtgcttgcttgccctgccagcctcagcagtgtattttggtgccctcgagaactggggtggatggcatgagccaaagagaaaaccaaaatgctgacattgacatcacagccacttttagggtccaaggggtagtggtggaattctttgttgccaaggattctgtgaggcttggctctcaggacctggaccatggctagtgttcctcactggggcaaacacatgaactctagatacagtcatgaacttggcatgagggggaagagccactgcaggaggtttgagtgcagaactaccgctggtgctactagaatataaatgacttgcaaaagacaacccttgccatagagagctctcctgcaggatgtaggacacagacttaaaagagacaactctaaatttatgcttattatctgtggtggtgaagtgagctccaatgtgagggaatacatgttcatgtgtgcttttttttttttcttttttgagacagagtcttactctgtcgcccaggctggagtgcaatggtgcaatctcggctcactgcaacctccgcctcccaggttcaagtgattctcatgcctcagcctcctaagtagctgggattacaggcgcccaccaccacacctggctcatttttgtatttttagtagagatggggtttcaccatgttggtcaggctggtcttgaactcctgacctcaagtgatctgcccacctcgatttcccaaagtgctgggattacaggtgtgagccactgggcccggccacatgtgtacttttttagcactagactctaattacctaaattctgtagaagtaactgccaatagccttataaccaatgccactgaagaaaatatggactacacaagtttaaaagtttatttttatttaaacttttttaaactttaaaagtttattttttaactcatataatctctatacagaaatcaccaaagtttcaacaacgtaatgttagatgggatgtttcagattttttttaagaacacacaaaaaatgcaaaaggtaaattataagtgaaatgattttttttaaccacggtttatgagaaagttggtcttgagagttattctcagaagctgggatctcaaaaagggcattagaatatgaagaaatagcagaaaattttttttgtttgtttaaatctgcccaagtatctaatgcattcactaaatcaatgtgtcaagggctgaggaagatgtccgttgcaggcatgcctcagtgatgcaagagaagccaggatctgtgactacccctcagaccccaggcctttctctctgctggcttgctctatggtagagacttgttccttgagcaaacactgatttccctttgccagtaactctcggcctgtgtccagaacgtaaatgcataaagtagtgtaaaaccccatcatctgtgcatgcacctgtcccttcttaatctaatttataatcagaccatttccccagaaatccttgtttctgctcagccatgacaggcctgagtcattttattttttatattagaaataaatttggtaatgaaagagctttctggtacttgcaaaggtataacagtaatctttggcatttttgagtttttactgtgtgctttataaccacgacattgacccactgacatagatattattgctataccccactttatagaaaggtgagcccctggaaagcagtatggcaatcctcaaagagctaaaagcagaactaccattcaacccaacaatcccatgactgggtatatacccagaggaatataaatcattctgccataaggacacatgcacacgcatgttcactgcagcactattcacatagcaaagacatggaatcaacctaaatgcccatcaatgacagatgggataaagagaatgataaagatgaaaagacaagaaaatgatgaagataaaagaaaatgcatagtatttcatatactccatggaatactgtgcagccataaaaaaactgagatcatgtctttcatgggaacatggatggagctggaggctcttattctcagcaaactaacgcaggaacagaaaaccaaatactgtattttcttacttataagcaggagctaatgatgagaatttatgaacacaaagaaggaaactacagacactggtgtctacttgacggcagagggtgggaggagggagaggagcagaaaatataactactgggtactgggcttaattcctgggtgatgaaataatccgtacaacaaaccctcgtgacatgagtttacctgtataacaaacctccacgtgtacccccgaacctaaaataaaagtaaaaaaaagagaaagttgaggctcagagggtgcagtaaccttcccagtcacatggcaaggctgtagcctagcaggattcccacctggggtccaggctccaggccctgtactctggtgcctctcactactatacctctcaggaagcgtgtgctcacctgagtttgtgcctggagcccccatgtgcctttgacggtatgatgggagcatgtcacaggctagcactctgaaagggtagtcattggcccttcacttgtacgagatgaaccttcaccttgatatctgccttctcctgcccatttcggtggcagaactggtttttcaaagcctcagtttcttaattggtggaatgggtccaattttttcgctgcttagaactccagtggggtattatgaatcttaaatgagacaatatatagtcatgtgcttgttaaactataatgcaatacctcataccagatgttattgtcagtgtaattataccttataattccactttaataaaaaatgagacctaaattatatttttccttgaaattacattgtcctgttctgaaaaagaattacttttctttccttgccatggttggggctttcaaaaaaagaattacttttagattcttttaaaaatatctagattctattttgcttcctgacagatattttcccagttttgtgtttcctgtggaggagggggaaagtacaccgttaaaaacaatcctagagagctttcttgcttggcactaagatagaatttagttgggaatctctactagggctgcgctgacatccttattcagcctagtatatgggaacgttttgagataaattcttgatcatgtaaaagagattattttaagagcagaagtcaggaggaaacatgcttcctggcttttatgattaccttatctgggcataataataagctctcccttgtaggccactttttcttccagaatgttcaagaatgtaggttacatggttcagttataataacactttaagaacacagtaaatcaaattgcattgcctaaaagtccgtgagtgtcatggcaggtccaggacagagtggcctagttgcatagattgaggttgctgagtggctccactcagcagcagcaagaagaatccagtgtcacttcaggccaggatgctcccactcctgaagcaacccaaacctatgcagtaaagagataaaaaatgacaaccaaaggatggatcacctctctaactcagtcacatctttttttccccgaggaaggaatcaaaattgtattagtctcttaagaaacagacatgttatattctacaaatagggttaatattgtgtacaaaataatatttgtgaacaaaagtcttttagctggtgatacaccaaaagaaccatttttgtgggttagtgttttccttcccaataaaataattttttgagctgtagtttttgttcagattattaatttgtcagattttatagcctagccagtgtgtttttatttagtcttactaaagtgccatgagtttcaatgtggctcaattcttgcttaaacttccctatgctaacatcatatattgatcctgaagtccaaggtgatgtacctcaaaataacaaatgtgcagagcctttatttaaaacaaacagtttccctttcaaatgcttgggatttttatgtattcttattgtaaaattgttttaaaatagaattgtggaagcacccaaaatgaatcaacattatagttatttactgagtatatattaatatgattttaattttgatattgatatgatgaatcaattcagttatccccttagcgcctttctgcctcagttaatctgtttcttaaatgttactgccttgttcttgcaatctgcctggtggcccatcagagttgtcccctgagaattaaatgaaatgggaataccttctctattaaattcagggttttagtgtcagattacttttagtttgcaagaaactacatataatatttgcatattcagttctatatttgccttcaagagttgtgttgcaaactcttgaaggcaaatatatattttaagcctgtttgggttcctattgtttaataaatatgtcttcatagtataaattgtcatgtcttcttattccctgactcctctcctgattgaattttttcatccctctcaagctgactataacagcttctttaggaactttgtctttagatttctttgaagagcctagagctaaatattttcagcctattagacctacttcctttttttgtaacatttaggcatgcctcatttactgtcttgaagtggaattcaaagataatacaactcacctatacatataacttttaaaaatatatatgtatttaaatccctatctttaggatacaagagaaaggtaagaacagtaatccacagtaaactactctgaatttcaacccatcagtactctgacaccattacatgggaggcatgctgagatagtaggatgtgtgtacctctcacacagccaccatggatgcaccgcctcctcagccccaggtggactgtcacaggtatgggccaggtgtgggccaggtgatgccctatataatttcccctgtataatttcccaggtgttataatttcccaaattgatggtcagttgctgttaaagcttcaaacacaaccaagtacagtttttcctcaacttacatgctaatgcatgccttgaaaatattaaagacattaaacttgggcaaaaatattttctttatatgtaaaacagatagcttccagacttagatcattgtaagttttttatctccaaggatgacaaggaggagtatttgaaagtcaggtgagatgtgggacaatttttcattgtgcaggagagcgccacactttgcagggcatcaagcagtttctgccttctgctcatggaatgtcagtagcaccctcccccatcactaggatgacaaaaccaccccacaaattttgaaaaagcctacacagtgagaaacactattatagaacattgaggctgctttgtaatgagtgtgattttgctttattaaagagtataattattgtagaaatctatgttatagccaccttcatattgaatgatcatcatttgtcttgctactagatcataagcctatcaagggccaaggtgtatcttactgtgtcaaggggatctaacagagtgtcaggcaatatattggtgattggtctgttgaataaataaaagctcgtgaacaatctcctctattttcaaaggaactgatattttaattagtaatacataccactgttatcagacttcattgttaaaatattactgttaagctattaaatgctggattgtacaaacctagaacatagctagtgatctatgcctagttggagcaggttatctttctttgtgtgttgaaatttttattgatatcatttaaaaataacatgtaacaaaagagttgctagcagcatttacagactgtgtgtttttttctcctttaaagaaaattatgcttttccattgttacaaaactattgggagcttcttggtacaatagggcagagagaaacaataaagacagtctccatcccctggggtgttgtcatccatttggagtgatggactaacatctagaaccattaaagctaatgactaagtgccatgtggaatagtgatgttgatagatacagtaagagtccaaggaagggattataatgagtaatcaggatagtcagaaagctcatggaatgataggacttgagctcatcttaagtgatgggtggaatttgaactggtgaagaggaccacatcctcagcaaagggagaaaaatgtaacaaaggtttagaggtggcagttaacatgataggtgtggaagacaggcagcagagcagtggccagggatgatggtgggttggaggaggaagagtatggctattggggaaaaatgtaaggaaagttggttggcagagtgagggccaaactcaaagattattttgttttggccaaaattaactttaaaagatctgatgttaatcttatgttatacctttttaaaaaactattctcttcagaggtttgttttttattttacttatttgtgtcagtaaaaataaaatgttcacggccagattttggattgaatgcttagtagtcatgcaagtatcaaaaagcaagatttagataagagaaaatgttatctttttttactgtatcattttactattatattttatgattttttattgccttcattcagttaactaaagttagaatagatgagaatatggagttaaaggaaggccacatggagagctaagcttgaattggaatcaggagtcacttatagctgtgccacctagggcaataactttactacaattcacttcagtcttcccatctttaaaatggaggtaataccttacccataaacacactacaggtctgtggattaagtgtcataacagcctattgtgtggcacaaagaaggcacttaatggatgttaggtcccttattggattaaaataagatatttaacttctttaagagtaggtacaatttgtgttgagtcatagaaccattaaagctcataaaaattacatcatatcaggcaagtatgtattatgagtgaccttggattctctaaattcagtttcttcatctataaaatagagataaaatactcgtaaaattatgaggattaagtgagataatgcatgaaaggtactcagcacagtgactgctgatacctagcaatcatgcaataaacactatcattagtataaggatgttataattatgatgcctacatgctacacatttatactgtctctatctttactacagtcctaagtggtatgtattattaatgttcttatgtttatatgagcaagaactgaagtatagggaacttaagtgacatgctcagagtttccagccggttcatcagtgagattggacttgaccatagatcctctgaatccgaatcaggtgtggtttcgccatgctagtgttgcttcaatcctttgcaatgtgcaggataaccccttccttcaaatccccctctaaaaatgatttatggctgggtgcagtgactcatgcctgtaattccagcattttgggaggctgaggcgggacgatcactcaaggccagaagtttgagaccagcctggtcaacatagcgagacatggttgctacaaaaaatttttgaaaaaaaattagccaggcatggtggcacatgcctgtagtcccagctagttgggagactgagatgggaggattgcttgagcccaggaggttgagactgcagtgagctatgatcatgcctctgcactccagcctgggtgaaagagcgagactctgtctcaaaaataaataaataaataaataaataaaaataaaaatgatatatataacagttcagaaatcactggacagaataatgaacgttgcttgagacccagagcctcaagtaacattttgtgtagtaccagccctgcctagagctgactgcccaatgacgaaggtaaagatgaaacagataaccctgttcctagcaactccactttgtttgcaatgcatttttcccaatgccttcatgctcacagtgcaggctgtggaagttgggtgggaaatttgacgattaggatttattcaacacagtttgccttttactattgatcacttctttccggaattataaacatgtttgatttattataatctatttcatagccaagtttccaaatctagttgtcaaccaatgttaatagtttctttggttctatttagagtgacaataaatattttggaggcacaactaatatgaacaaaggtactgcaaatgtagacatatgttgggttgcagaagttgccataatagacccatatgtagtatcgctcttggcacatggcagaattttagcaagttgaaaataaagtttgcaggagcaggcaaatgttaaacatctgccaaagtgaattatgaaacagaaattgtatttaccaaaaacgtttgtgctctttaattacctgaacattgtaatcctcagtatttcagagctatgtgaaaaacctaaaatcttaacattaacattggaactcatcttcttcattggagtggaagttggagggtgtcctgtctttcttactctttcgtattcaaggacaggcctattttttttttaaactgctgtgaggtcgtctggtgattttttttttttttttaactgaattgctgtgacaaagtatacagctcatctgctggctcagggtctctgccaaaagaacctttggaataacaacagcagaattcatgagattcctgtgagtttcattctgttctttgaatgctggcttattgaaagatatatgggcagccacaggcacagctagaattaggcacagccagaattcaccatctgccactgctctcgggagtataggaagatgatgataatttttaagattattaattattcatcttagacatttattaagactccacagtcttcagctcttggagctcatgctgtaaattaaacagacctaagaaatagaaatggaaccagaagaaacatctatctcctttaaaaaaataaataaataaactgaaatgggttggctttaagaaaacaatatatgtagtcaattttacttaaaatttattttttctcaggtgttagaaggtacaatggatggataacacattaagcttgggaaaatgcaaaatataagtgtatggccctgataactttgatagaatctttagatgagaacaaatttagaccttttctctgaggtctgtgaacatgttctatgaacatgtagaccttttctgtgaggaatacctatatttgattcattagtaaaagtaaaaccagattaagaaaatttcaacattgaaaaaggaccttgaagtagcctaaccatgtgccctgtgcatgcagcttctcaataacatcctcatggcagatgtgttcagcttctgcttaaatacctcccatgacaggaaaatcattacttccagaggaaattgatccactcaacatatttaccgaacacctgtttactgtgtctgatctggtagagcttacacctacccagaagagtcagacagtaaacaatacattcaataaataagtaaattatatatcaagttcattccattttcagatgtgttattttgttagaaagcttttccttatatttccttacacataatgattgtttaggtgtttgaagaaagtatttgttgccctctcgagtcacctggttttcaatgtacgctcctggttggtgaaacagttgttcctatgtattagtttgctagggccaccataacaaggtaccgcaggctgtttggctaaacaacacacatttgttttctcacatttctgaaggctagaagtcccagatcaaggtgctggcagggttggttctttctgaggcctctctccttgccttatagattgccgtcttctccctgtgtcctcccatgctctttgtatgtgtgtgataatcttctttcctttgtttgtttgtttgtttgtttgagactgagtcttgcgctgtcacccaggctggagtggagtggtgcaatcttggctcactacagcctcctcctcctaggttcaagccattctcctgcctcagcctcccaaatagctgggattacagggacccatgagtttcaccatgttggccaggctggtctcgaactcctgacctcagttgatccacctgcttcagcctcccaaagtgctgggatttacaggagtgagccaccacacctggccgctaatcatcttaaaaggacactagtcatattggattgggtccaccctaatgaccttgttttatcttagttgttactttaaaagccctgtctccaaatacagtcacattctgagtacagagggttaggacttcaacatatggatttggggggcacaagtcagcccctaacacatatcccttgtcttttggaacccacagaagtgggaggataattccatgaatataaccaggcaagatggtcccatcccatgttctagacatctagtttacctttgatagtcccagcatggttgactgatgttgagcttgcagtctatgagaaatcccaagtctctacacagcttgtttttttaggcttgtcttctcctatcctttgcataatttattcttttatctagtcacactggggatacagcagggaaccaagtagacattgtccctgtctcttggaacttaacatacattagtgaaggctgtcagtgaacaaatgagcaaacaaatatataattacaaattgtaagatgtactataaagtgaatgaacagataaatagtagaagagacatcctactcttgatagtttttttttttttggtggggtatgcattttggcatttaccctgaaataaaacattatttttaatatatctggcctattattccaccctaccccaaccatttatagaagagatcctggctgttatttgttatttttagtgccctcatccttcactttattcctaaatgtgataaatatgacacctctggctttatcccagtcatcaataaaaatacctaacgggacagaacagtaccattgttgtcctagagctaacagtaatatccattagctacacatagataaagatctagccagcatatataaagtgagactcttattggaaatattaacaagattaatgctgcccactgctaagttttctatttcaccagctgagtcttaaatgttcctctggctgtaccacattgatcacaaaaggcctttcaagttgtctgcctgatgatttttaaaaggtcaaattcatttaaagtatttcactcataatgtggggaaatagaagttgttctgaatctaaccagaaagaacgtcacttacaaaccagaatgcctacgttttgcagggccgaggatccaaggtgatgttcatcagctcctttcacatggatctaacctgcccatgtaggcccactccaatcacctggaaagtgtgagtccaaggccagaacctacccaggccagttctgtgatgccctctttctccttaccttgggcatccttggctttaatggccaattctgtacttgctgccctggctctactggtctcccacatagacagttcccacgtttgtgtttggccatcgaacgcagtgtttgggtaagaggcactccagatctctcagctgccagtccactgagctgattctctttttagttggagtagggagagtttaatcaaatttagagaactggggattggaatcatccagcaggcacatcacccttggtcatcacagggttacccatccagagcagtggagaaaatgaaatgttttcagaggcagtcaaacttgacctttaatttagcatggaccatagcttgtcaaggttcatcagcagagcggtactgttgtaagcatttgctaatgtagacattatttgacgttaatttacttgctaatttgacacatttttgtataacacagaataagttaaatcgcaacaaaatttatttatttatttatttatttatttatttattgaatattccttaaacacctatcacatgctaggcattgttctgggtgctaaaattacagctgtgaataaaatagacacagctccttccctcgcagatcttatattctggtgggggagggcgggagactaagaccatgtaaatatgtattattcagagagtgaaatatgctttgaataaaatatagaaacagaagaaagtcacagtgacaggggaaggaaatttcgccttatattgggtggtcagggaacatcttattgataggcagagcctgaagaaagagaaagagcaaaccatatggatacctggagagaggaagtttgggcagaaggaagagcaaatgcaaaggccctgggctgggtcttctcaaggaaaagcaaggaggccgctgtggctggtgtggggctggcgcttattctacactgctgcctttcagaaagtgtaacaaagaaccagatggctctttgctagacttgccctattttgttgtggttgttaactaaaaatacatgggaaaagggtgttttttatactgctaaggttgcattcttgattggctaaggagttaaccccaggatgtgtgtgtgtgtgtgtgtgtgtgtgtgtgaatgatatatatacatacctatacacacacacgtttgtttaatgaaatgggagagaagttgagacatacctttttgtgcttcaatgtgagcctgtgagagttagtagtttagctgatacaaaacccctttgtaatctattatgcagcctgttattagcaatcagtcctacaagtgctattattttcatcctccaagtaaagcataggagttgggtaagggtcagagtagtttgaaatttggataagaactcaaattctttactgacttccctcacacctacatctaacttctgcaggagctatcccattagttgtgaatgatttaataagcaaaacctggggtgagtttacctcctgaggccagttcagtttttagacatagttggcttgccctgagctcttcttggcctatttctgggcattatgcatcctgagaaatatcgggattttttttctgttacaaagcaaacacttctcatgcttccaagtatttacatgtatcaggccctaagtggtggccctatcaggagcagagtgtgcaggcgatgttgtgcagggtgggcatggctcagcctgtgctgtctgtgtggttccaatggttccaatatcccagcggggctgtgcctgtccaccagcctgctggttaccacagcagataacatagtagactcagggtttaagaagaaccaccacccagagcaaatgaataaaactgtaactgcttcatggctagactctctgaagaaatgcctctgatataacctcagttggtcctcagaagaaagtttgcaaaaacaagaacaatgtctgaactcattccttgaccataaccatcaaatttaaatgccacagtttctccatgtgggaaattcaaagacattgtggacctttgcatgatgtgaaggtgtgttaatgagatagctagctcctttttggaaaagaaaacctcagagtaagacataaagtctttcttggctgcagctgttctttcatgaatgatcagctaggtaagcatgttccagtaaaattaagcctcaccattgacaagtgtttggagggcattgtaagattcatggatacatcctgcgtctgccttgttgttttctacgggttgaacatacggcatttaaggaaattttgtggttagtaacagaagatttcaaaattaatctctagaatttatatctcttagattagatattttaataaaaacacaatattccatactgtcatgtgattgctagcctttggtttgtatgaaagaattgtttcactctttctgtagatttctacaaaaaatcacttggcagatacataccaaaagaatattgtattttatatatttaatatattgaaagggatgctgtcatacccaatgcttctgagctcacccacaaaaataaacctcatgtttatacttaaatttatttattcagctagcatgttttataatctgttatgtaccaggcactatgctagaggctggtaattcagaaatgagagactcagccttccacttccatcaaggggcttacagtttagtggggagacagagaagtaaactacaaacacaagatcaggtaacaagtactactgtggcccaaagcaagggtatttcactttgcctggggaagtcagtcaaagcttctcagaagaatgggtaagggttagagctggaattaagaggaaggaaaagcagaatgtatagtgcaggacctaacagtagttcacagcctggtgttttggcagacttgcagacagttccctatagctgaagcacagggttgcatgaagttagagaggtgggaaggggtcttgtatggcaaccaagggttgggctttatctcaaaagggattgagaaatgttgtaacaatctggcaggagtcatgaggactgagccaataggaaggctattgcattgatccaagtgaagtattacaaataccttaagtaatagaatgatggtaggaaagaggatgagaaaacagatacaagcaatttttaagaggtagattcaacagggcttgctgagtctttgaatctgggagatgagaaggaagaaaagtcttgaatttctaacttgagtgacttagaaaatgatgatgtcattcaggcaataaaggagaaagtaagaactggggaaggaaagtggttagctcagatgaagccatgttgaatttcaggtacctgaggagtatccggattgaggtggacagtaagatgtgaagaggtaacatatggatgggaacttccatggagaggtctgaggtgtaaaagtaatttgggaaacgtcagacaataggtgaagctgtgggttcagatgattcatcctaggcaatatttatatataagaaggaaaggggctgaatatggagttctgagttattcttgccattgcagggagggatagagaaggagcccctaatgcaaagagaccaaatagtcacagaggtaggaggacagaggagacatatgtcacagtagccaagtaaagtgaacgtctcaaaaaagaagacttgaccagtaatgccaaatgctgtcaagaggccaagtagggtgaggactggaaagttccatagggcttaggcattggtagttatgacacactcattcccaatgtgctggaatggcagtaagttggaatgaaggggattaggagggagagacagagaagtttctaagaaacttggctgtgcgaagtaaaagcgaaataactaaacatgaggaaagagctgtctgctgctggttgccgctgaatctgtcaagctgatttctcccaacctgagtgaacaagagcagcaaggaatgccctgccccgcataacatgtgctgtgtttattgtgtcccccttgtgtcctagaacaggagtaagatggtgaccaaaataaacatagaatgtacctagtgaaattgatagtccaaacagggagaaagcatattgaaaactagctgcacaataaatgcataatttgtgataaagtatttgtgtcaataagaaatgtcaactgtggctccagatttagaccacggagttaagggaaagcttctctgaggaagcaatacttagatggatgaagggcaaatagaatttagccaagggaagagaggagggcctctaggcaggtggaacagcaatgctgagccctgaggtgcaggagtcctgggtagcagggaaggtgcaagatgagactgaagagttaggcaggaaccaacaatgccacacctggaaaaccaggaaagtgtaaggtcacggaagcaagaaaaagagagttgcaagaagaagggtgtggagctatatcaaacgctacggagatgccgtttcagttaagggctgagaagagcccactggctaagtggaagctgttggtcaccttagtggaagtgtggccaaggagtcagcctgaagtgggctgaagggggaagaggagtggaaagaggaactgaaggctgcgtataaaggcagctgtgttgagacattaagcgatgattgggaagtcaggaaggtaggctaggaatttgtattagtctattctctcattgctgtaaagaaatatctgagactgggtaatttatagagaaaagaagtttgactcatggttctgtgggctatacaggaagcatagtggcttctgcttttggggacctctcaggaagcttccaatcatgccagaaggaaaaggggagcaggcaccttaacatggcaggagcaagagagagtgagggggtaggtgttgcacacttttaaaccaccagatctcatgagaactcaccatcatgaggacagtaccaagagagatgatgctaagcctttcatgagatatctaccccatgatccaatcacctcccaccaggctccaccttcaacaacggggattacaattcaacgtgagatttgctggggacacaaatccaaaccatatcagaattggaaggaaatgtgggataagataagggtttttgttttgtttctgtttgcttgtaagacaagaggtattggctatgttttcataaaggcaagaaagattttatagaaagggaaaggttaagatgccagagacccataggagtgacaatcttgggcaggaggcagaaacagggtcaggagaggggacaaaggtggctttgtggatttgatggcagaaaaatgggacttcctatccggtgccatgtaggaggcagggtcgtccctgagaacgagatgggaggagggaagcaggaaggctgtggagtgcacagggcagaaatgactgttgcagtgagggatgcttgctgggcccaggaaggcctggtggggaggtctgcttccctgacctgcctgtggggttttccactcaccacctccccgttgaccctgccagtgttcttagaagggtgtaagaatgttgttttgattttgttcccgtgtttttccaaagtcaaattgtaccacgttatagaatttcctacaaatcctgaatattctgacgtgggagcaagtgctttctgctctggtaattttacgctatttgatttcaaattagtttcgtgatttgtttcctcccatgtttaccctttgagttgcttattccctttggcttcatcatttgaaaaactcatgatttggtgtccgtcttttctggttttttttttttgcaaccacgtctcacagtttagagccttccatttcattttatggaacatgttgtaaagttggaatctttcatgcaagcccacttgcaaaaatatccaaatatttttgccttatgtatttcttggtattctctctttctctctctctctgtatttcttggtattctctctctctctctctctgtgtgtgtgtgtgtgtgtgtgtgtgtgtgtgtgtgtgtgtgtgtctgtgtctgtctgtctgtctctgtcactttcaggtagcattcgtggcaataacgagaatgtctgctggaccctttacctctctcttccctcccctctatatacctggtgctcaccaggtccctgctgctgttttgtcgcttgactttgtatcatattgagtttctgtcctgggttctctgcttgtactctgtcttctccttttcataatcactccaggtccctgccactttttttctggacacccagagtctttttctttcttccagtgacagtcagaagttgggggagcccccttggatgcatattgttggaggttcctaagttcataccaagtatctttagaaatcaggaaggatgaggaacagaactaacattttatgagcatctactggtattggatgcatttcttatgctaccttatattaacctttaccataaccttgtggtagggagtattgttttgatttcatagacagataagtcaatcccagaaagattccataacttgagaaatatatcagggccaggactaaaactgtccttgtttcctgcctgaagctcagggtgactgacggttatcattgtcaatgtctagacacgaaatattcatcccagttaggcatgggcctaggtgttacctcagatcttgaactcacgctgtgatatgaaagtggtctcctagcagtcaggcatcttgagtcctggagtccagacagaaggtgcctctaccactaggtggggatgtagcagcaccacaaatgagtacactacaaatggaaagaccctctagaacaaaggcgttcaaacttaaaaaataagaataatttattgcagtgaaacaacatataattaaccattttaaggtgactcttctgtgacattttgtacattcgtggtgttacacaaccaccacttctatctagttccagcacatttccatcactccaaagtaaaaaccccttcaccattaagcagattctcccagttcttcactccccgtagcccctggcaacagctgatctgcattctgtctctatggatttacctattctggatatttcttataaatagaatcataccatatgtgacctttttgtatccagccttcttcaattagcataacattttgggggttcatccatgttgtagcatgttcccaaacttcattcctttttacggattaataatattccattacatatatatgccacctttcgtttattcattgatccattgatagacattgaagactttgagctattacgcatagtgctgctatgaacatgcatgtacatatacttgtttgataacttgttttcatttctttggggcatgtgtacacagtgaaattacagggtcgtatgctaattctatgtttaactctttgaggaaccatcagattctttccatagtagttaaaccgttttgcattctcactagcagagtatgaagatttcaaactttttaaaaccatgactcgcaatataaagtacattttacattgcaacccagtatttaaccgtgtgtatgtatacatacaaatataacagaggtttcatgaaacagtactcaacctgactgtgaatgatgccctctaatgtattccctcctattctatgtcattaggaaagtgtcttggtttgacccaccaaattaactccacaactcaaagttaatttgctatcagttgaagtcacagatattttcatcatcactacagttgctttaggcatattgaaatattatttatgatcattattttatttaaaatttcttataattattacgcctctggataatgttatttaaagcaccatttgaagaagcaggtatatacgataccacaattttgtgtttttttaaatagttgaataactatgtttcaaaataattgctttctttgtcaccctgtgtcttccacattttattcatgtaaacacattattctgagaaggaactcatgggcttcgccagactgccaaaagggctcatggcacaaaaatacttaggaacatgctagactacactgtccaataagggagccattagccacttgtagctattgtgtacaatattgtgtacaatggctgcaagatggatgtggctagtccaaatgcagatgtgctgtcaaatacccactggattccaactatttggtacaaaaaatattaaatgtctcactaatattttttatattcattaattattgaaatgatttttggcatattgggttaaacaaaacagattattaaaattaatttcacctgcttgttggttattttaatgtagctacttaaaaattgaacactgcgtgtgtggttcgcattgcatttctgttggacatcactggcttagcaccagatcggagttccaatcttgttgttatcacaggaccagtagtaatcactgttactgttactgtcattactctgctgcgggacctaccctgataaatttcagtttcctcctctggaagtgtagatataaagccaaaggagagcatattgctgtgcttattctgtattcagcctttttcctaatacatttctcactattggaattgtctagtcatctcatctttcatccagaagtctggtgaaggcccatgtccatgtcccttcccttatgcttctgctaccccttgttgtaatgaacacaaaatataaattatatatgggaaaatcatataccaaggtaaggatataagaattcatagacaaataaatatttaaaaataattttaaaggataagaaaaaggggaaactcccttgaggagcaaagaaggtggaaaataaggcttgtggtagggtggagtagtaatttgaccacagttgccacccatcctgtatttatccaaaggccagagtggcatttggataagactcaggcaaaccaccagcacattcctggagttgatgaatggccacttaaacagcaggacacccctggcatgtccctaaacccaaaactaaaagtccagcaggctattacaatgagggaaggtgccagcatgtgtctttaagggcgatgggctgagcagggaccactcaccctcttatttgtctgattcttacactgatgggagccctgagaatctaatattagcatcctgggaatacaaagccctttcatctacataatctcctttaagatcatgaaacaaccttatgtaaagggcagaatcatgtgtaccttataaatgagaaagaaataggtcaaacacataagtggatcactgaggccattactgggtggagcagggtttatctgaccatgagcttgagtttctccacagctaacactgagggtcagaatcatgaccctccacttctgtttccttgggcttctcagagtgatctcacccctgtggacggtctgcaaagatcattactcttgacctcacttctgcctcctaagctgagccgtgcagttggagtcgctcttcccactagcctgctaagctgctgccttccatcattcagacagtttctgacagccccaccctcctacacaaagccctgcctgtctggtcaaaggagggtggtgatttcccaccctttctaaaaacacgccttgtaagactttctctgtcctctaaaatatacttgctccttcagagtcacattttctactactgtacggttaaacatcgtctgtgggaggaaaggtgatgtatgggtttttctgctccactgttgtcgggcttagaccaccatcttctaaaaggcagaaacctggggtctgtaccagacagctccatgaacagatggtcattttgaagtctttgaaggtgaaatctgtgatgctcagtgaggtatacacttctttttaaagtggtagttccaaatgaagtgatgctgtaacatatccttaattccttagaccactgtccttaatctcagttgtaataacctggcgtgtgactattgtttattcctggtttacaagaattgtctagttatatagtttctattgcttttcctctaagctgaacaaagcactttgatactacttcattaatttcacagtagacagcttgatcgtttttatattgatttatcgctttctaatccccaattattttttggtcctatgtcagcttctcctgccagtagacagtgtgtgttttcatggatactcttgacatgagctttattagaacataaccaagaaggtgaatctgttgccaaaaaattaaataatgtttgccaaagagttacacagaataatttattacccagtgttctgcttttcctatgcaatggttcctcccagtggtatagaaaaccaaagattggcttgccctaagagatgaggcagtttggggatgggaaatagtgttcttcttttagtagataaataacatgtccaaggttataggatcgggatcaaaataaaaagcagaatcatgagtttcctgattcccagcccttcaacctttgctaataggtaactataaacatggtcatacctagaaagaaaaaattttagcacctagaaggaaaaaaacgtaaaatttaagtagcatgcgctaaaaaactatccaaaatttctagttttcctcaatttcattgatttgaaaattataggttttaataattatgtacattaaatggtatcttaaggaaaagttgatctttcccttattacttaaaccctactatttatttttgtgtatcagattggtaacattggtgggaatattcactctagccataaaaggtatttaatttttatcaccaaataataggagtatcacccaataactttaatacaactatgagaatgctctatttttttgttttgctagattatcattcatacagggaagaaccagcattttcttagttctcctgtagatggcgaatctaaagggtgatgacgactgatataaatataattgttttttatactgttaagcattatgtatctgcatttttggtaaataataatatgcaaagttaatgcctttttttttttttttggagatggagtctcgctgtgtcacccaggctggagtgcagtggcaggatctcggcctaccacaacctccacctcccgggttcaagcaattttcacgcctcagccttccgagtagctgggattacaggtgcccgccaccacacccagctaaattttgtatttttagtagagatggggtttcaccatgttggtcaggctggtcttgaactcctgacctcaggtgatccacccacctcggcctcccaaagtgctgggattacaggcgtgagccaccgtgcccagccgcaaatgccattttttgcttcttcagaagggacttaatattttataattatgtattaatagttggctcctattgtggccatttatatttgacctgtttgtatctgaacgtaaataatttctcaggttgctggtgatattcaaaaataggataataaagttatcattagtgttgtatgctttcatgctaaggggcatgaggtaaatgctgtcatgttttctctttgcatacatgtctttaaatacattaaatactaagtgtgctatgaccttattctgcagaaattgaagtcgaatctttatgtgtacaaaatatgtatgaaccacaacatctcctggttttgactacaggttaatgatatccaaatatgcagacactactttgagaggttgatgagaagactaaattaggtaaattttgagatgatactaacctaaccggaacctctaatcaaatggaagtttaccctgggcaccaaatgttatatgacttaatattactaaaatgttaagtaatagtgtttgtatgtgcatgtgtttagactttctttacctttccgaaacttccagccttgtgggcaggtctaccttaccttggtagccagcagagggggttgggggtagggatctctctatgatgacaggttctctctctcctctttccttctcttctctttttctaacctgactatggagttaaggaggcattttgtgctgcatattctgggttcatttctcactacagatttgctacataacagttgtcatctgcctaggcactcatgtaatcctcataacagatttgtgtgacaaggcactagtttacagacgaggaaaatgaggccatgagatgctcaacaactttgccaacaatacagcttttatatgatggagcatggtctggtctacaatgtcactccccttctaattaatatcctttgaatatttgttctttttttttttttttttttttttgagacagagttatgctcttgtcgtccaggctgaagtgcaatggcaccatctcaacaacctctgcctcccaggctcaagcgattctcctgcctcagcctcctagctgagattactggcacccaccaccacgcccagctaatttttgtatctttagtagaaacagggtttcaccatgttggccaggctagtctcgaactcctgacctcaggtgatccactcacctcagcctccaaaagtgttgggattacaggtgtgagccaccgcacccagcctgaatatttgttcttgaagtcaccattcagttgtctggagcagggttgagggagaggcgcaattttcctttcactagcatgcaggcccgggttaactggtgccctagttctaattcatcctaatgatgtctcagtgccacttttagagaagtgcccagcaggtgcccagtaggtgtgcccctttgttcagctttgtctatgcatgccctctgatatacagcccagccccaagcctcaatattaggcctgaataaataccattcttttaccccactctagacctgtcaaaacaccttggatgacaatggacacatggagggggcattccatgtgcagagcagaaagcagggtaaattccaggctttttttcctccactccctgctgccacttctcggagtcttttattgtcttctgcttaaacccttcaggggcttcccattgtgctagaattcctcctgattcctttgtcttggctctgggttccttataaaaccccttcgcaggggagctgagtaggaaagaaaaaatgagttctgctgctatgtttcaatgataacaattttagaagacatgatttttcttgtttatgtttgaatctggacaacaacaagctttgctataatgaagttgtgttgcattcaaaaaatttaaatgtatttcaattcattgaaaaaaattatttgcagtggatagtaatggagtaaatgtttttcaaaacttgctgaatctatttttgtgaagatttatatatgtgggttggattttttaaggtaatgattattgtgtttgatgcttaccacatggacattgtgtggcatcatttcatattttttctctaatatttcttaggatgggatagatccgtccaaatcatgcatcaaaaataggtcaaaagagaagtttgttatttatctcaacactttgtcctttaggttatctctaaaaagcctcttattctactgtttaaagaaaaacaaaaccctttttccatactcatcaccattgattgtaactgctgtctttctatctcaattcaggggatgcttaatttgatttggagctgttcttaagatacaatgtataatagtgggaatataatatagttcatgcttttttggaagttgagactgctgatcaaaaattgataaagcaattattttcttgcatttagtgattttcctttgtttcttcaggatgctagtgaaacatttctgcctaacacattctgttcatgaatgtacatgtcactctgtgacagtaattacacatgtgtacccacgtgtatccgtctacaagaaaagggggtggattccaatcgtaacccaatcaactcaatcagatgctttaaaatcattaggtaatggctcttgatgttggcatgcatccagactgtttgcaaggctttgtttccacattttttttgaatgccacacaatttagcctcaaaaaaattttcaaaatgcttttaaaaaaagagtaaactaagtatgaattaaaacaaaaaattgcatttcttatacatttttttcccacaggcagcagataacagtcagacatgacaagcttgctcattcacttattcactcaacatatgtttattgcatgaggacttactgtgtgctacagagatgtaaggaacacaaagctgagtaagacacaggtcttctggagggagagacgggacagatggttataattgggatcaagacaggaggagagtaaatgccatggattatgagatatagtctctgtatcctttaccaccctcatcccactctgctacatggcttgctaggacataggtacataggtgaccaataggtcactccttctgaccacctccttcccattgaccacccagagctaccaccagcccatgtggtatcttgataaaaaaaaaaaaataggcaccccttcctctggattgagtcctgggctgatgcagacccatgccagggtagaagcagcccactgccacctctgtacctgccaaattggagagtggagttcagactagatttccatcctcagtcaccccatctccactctaggtcagacatccttgtagagaccaccgcctgtataatgaatcaaattaatgtaaaaaataaaggcattcttctcttggtttcttggaattggttacagtccccagggaatacatcacccaggacaaagccaggcaggaagacagtgaataggctgggagagtcagtgggacctgaagcgcctctgctgtgttagggagtaccttagcatctttcctgaacttttatttatttatttatttttattttttgagatggagtcttgctctgttgcccaggctggagtgcagtgacataatctaggctcactgcaacctccgcctcctgggttcaagtgattctcctgcctcagcctcccaagtagctgggattacaggcgggtgccaccacgcccagccaatttttgtatttttagtagagatggcgtttcgccatgttggccaggctggtcctgaactcctgacctcaagtgatccacccgccttggccttctaaaatgctgggattacagccatgagccactgtgcccagcctcttcctgagctttctctaaagaacttggtaaccatgattctcaccttgcttgtgatttttaaaaaaataaataaataacaaagttatgacaagtgactcagggtctaaaatagacctaaattttactagctatatgagtttgaccttattttatgcctccttaagcctcaattttctcatctgtaaaatgggactaataatagtacttacttcataggtttgaggtgagtattaaatataaaaatatatatatttttaactacaatatttatattcaacaaatgtagatggtgtcatttagtgtcatcacttgtgtcaggccactttccgactttttccccactctttgataccattttctaaggccttccacttttcctgttatctttcactcagtccccaacatctatgcctaattccatgcttgacaattcattgtatgttctcctaatatttttaaggaaggatccctcatttttacaggtatgaaagctgagatagctttaggtcctcttaaatcataactgaagtcactagcaagccaggaacacattcagattttactgttgcattttaaagtacctctgtccaggtgcctcttctgactaatttttttatgcccccccagagagagagaagacaaaaggataaatgtttcaactcagcttgcagcgggtgtcattctatttgatttgcaggcctttcaacaaaacaaaagcccttttctgttcttttacaatatatgtcctctttaaaggtactcgaatgaagaaaaagcatacactggacaagatttcaggttctaagagacagaaactgggctcttagatgctgattcactcttcacagtgaaagctagatggcattgaaaacattattttctaagtagcatttacatttttatgaccgtttcccttgaaatatatatgagtggcattctcagcaagttagtatgtttatagtagttaaatactgaaaacttatgtatttaagtattgaaaactttaaaaagccagttaaaaattttttaaaataaagtcaacagagagaatctctatatatttgagtaacaatatacaatagcatgtttgcttattgcaactgattttaaatgtctccaacttgctctccccaaatagttaccactggtgttcaaaagtaatatatcttttaaaccacataaagagtaaagaaaaaaaagtatttagctttttaaaaaaaagttctattctagagtcactaaggattcataataagaatgaatgggccaggcgcagtggctcatgtctgtactttgggagaccaaggcaggtggatcacctgaggtcaggagttcaagatcaccccagccaacactgtgaaaccctatttctactaaaaatacaaaaattagccgggcatggtggcgcatgcctgtcaccccagctactcagaaggctgaggcaggagaatcgcttgaacccgggaggcagaggttgcagtgagccaagattgcaccactgcattccagcccaggcgacagagtgagattgtctcaaaaaaaaaaaaaaaaaaaaaatcaatgtagctaaaatttaatgaagtgttaactatgggcaagatactatgctgagcccctttcatacatagtgttatttattgtttccaacaactataggaagaaggtacaaccccattttacagatgaggaaacgaaggcttagcaaagttaatagcttactttggggctcaaagctagtaagggctggtgccaggagcgaacatggggccctgccttgagagcccatgccatcgttaatcgcagggcactgtgcagcctacctgttcattcactgccatctgagtcttggcaagcatcagatgggcgtaggtatgaaatttattttcagatataataattgtttcaaggtaaaacctttgggtcttattttacctagaatccatacattcaaagtacaagtgataaaatcagttcagcaactctagtatgcacatgaattaaaaagaagtcaatctggtgagagatttcatcagaataaagtgtataagtggagttggaaatctgagtgattgagtgcttgccatttgggtaagtgtaatgagtttgaaaaactaattgtattgatgaagtatcttagggcctttcagaacatagttctagaagttttatttagtgttgaattttaaaaattctttgtcctaacaataaaagtacattgtagtctttcccttccatttttaaaatgaactgttaatctaggaagtcctgtttgtgtgttgatttggggagttagcccaacatttgctatgttaaatacttattaacatggtttattacttttttctgttttttagacaacattaatcatgaatgtactgggacttgggaaggatcctgtggtttatgagatagttggccaaatcccacctcttccaacataacctgtcattattaaaatataatactcttatttaatcccctggtcaagctaaatgataatgtgaaacaaagctaaccaaaatcaggacacctgatatcaagaattcatgaaatcaagagccattgtagagcaaggaatctaatgcttttgcttcttatccttttcatacaaataaaataagcttcactgggcttagtgagtcttagaaatgagaggtttgagaataagatccattgtggagtgtgtgacattacaaaaacaagccaactaagcagtgtgtactgtccccttagagtgcacacgttcgggctccgatgccccttgaaaagactgcatttctgggagggaaaagtaaaaatgcagataccaccatgcgtgtggaaggcagggaagaaaaagcccagacaagcgtcctcttgttgagtctctttactgcaacgaggctgacggatggggtttttcaaaacgtcgctgcaaccagatgcaaggctgcagctttgcttaccgcagcgtgctgcagttgtgtttatttcagggacagacacaaggggaagcagcagccagagcacacccgggccgctcacgggaagccttgctgaagagagaggatccgcagaagctgggaaattcctcccgcagcctaggcggagactgagccgcggctcaggttgagacagtgggcaggggcagggggcggcgctcccggcccatcccttagccccgcggcggccgtgtgggccggaggctgcctgcaccgcgtcagggaggccggcctagaaaccctccctcccagaagaaagccgatcccagttcaggtggggtcttcctcggttgcgtacctggctggagccgagctggtgggcggccggcagccggcgtttctggtgatgacagccccgaaatgaaagcagcgcggccgccgcctccgagggctgcagggagatcagcgtccagcaaataagaagcaagtcctggacccggaggaggaggagcggccgagcatctctctctgctccgccgtgtcctttagatgagcactcccggccggagccggaggtggatccgcagagctgcctctgggcgcctgaccccgcgctgacatcacaacctgtgacaggcgcatcacgcccggtacctgctcccggccgctgcccgtcctcccagcctctttgtatgccgcagacatggccagccagcaggattcgggcttctttgagatcagtatcaaatatttactgaaatcctggagtaatagtgagtaatagaaaataacctttttgtttgtttgtttgctggatgttgcataaggctggagacagagaatctcaactggacacacatgtttgtgagccgcggaagtttttctttttttcttttcttttctttttctttctttctttctttctttctttctttttctttctttctttctttctttttttgctcccatctgctgtgaaaatcaaaatgtcagagactgaactagctttccttaagtgcaaaggctgcaatggaattacagtagattgtgtttgattaaattttcaagtgaggcagcccttcagactctgggggagctcaggatcaggcattcctggctgcatttcctgccttgatgtttatttgatttgttcaggctttctctaaatattttgtgaagtgtgatttaatcaaaggggtgtggcagggtttcagagtactttgtaattgtttttttagggtattgtctgaagaaagaaaagtatttaatagtccaaaacctaggacatcctttttgtatatagaggcatctgcagatttatttcatctctccctcttccatgtggatgatgttctgaatgccatttaatatttgaatttttaaaaatcctgatgtttgctatagtccaaatattgtgcttttttgaaacataaacaagtgaggttctgaccctaattatttattaggatagcagaatatgatggctcctgaagttccatttctgacctacataaggattttagcaatacgctatttcaaaaagacaacctctaagctgccgtggatctggaatcaaattaaaatgaggccttcaggtgatcaatgatgccttgtattttccgaactgtttaaaaagaaagtcttctctatttcactaacagcctttgtacttgctttggataaaagatcagcaggtattactgatgctttattgttttaaataaaaaaattttttccccgtgaaaattttaatattgtattatgtgcatactgattaacctacctgtgctcaaagagctagtgattaattgtctcctacacaaatgacctgtggccaagattgttcttatataaacaaaacctgggcaggagaacctgtgctgcaattgctttgaggaaaagagctaaagtaccttcagccttaaggtattcagggatgtgcatctctaaatgatatccatagaaaccattttttccaggtcattttgcaccactgtatacactatggggcttgtctgaagctgtttttctacaagtgggaagccatttgggagtaatactgttgcccaaacagcattctttacttgtcatagctataaatcatttaacttggactcattatttttataatactttacactcaaggatgaatcttcctttgtctatctgctctttgattaatgaaaagaatttgacatacagtgttctttatggagcagttttccaataactgaaaaaactcacttttgagttgacatcagtacgtggtttttaaacatatttgattattccaagaccagactgttttcttccatcaatttttgtcattgcatcattaaatagaaaattatgttgtgacaatactgaggccaatgggatttcttttaaaaatttctctccccttgtctattttcaaatcactctagataaagtatatattctctccacccttcctaaactcctctccccacatacatacttcaggaaatgattcaaaatgactgttcatttctactttgagaatatctgtgatacaattttgaattcttccaattcattcagcaaatatttattgaatacctactatgtgccaggctgtggggctacacaaggtgaataagacacagtccctgcccactatattaatttttttatttcagagtagtgaagttggtggctttccagcattcttttgagggggagaatgtttttcagtcctttcttgaaagaggaagaggaaatatactttgtttatcttctttaagcttgttacaacactaacctgcttacaatctagcatagttctcattgctaagttttacatattttgagcagcaaagagagaaaggaatttgtctgtgtagaaggcaaagtagaaacagaagccctaaggctcaacatactcagtgtaaccttggctgagaggatgcaccatgaggcaagcggctaattgcacctgcatgcacctgcacgcgcatgcctggcctcacaagtttgagaggtgaggatgtctgcccacatacctgaatggagactcagcctcttaattatatggtggtgcttatttacaaaagtgcagtaattaaaaagcaataaaacaaactctataactatgactggctgttttgcaaggtgttagaagaaaggtaattccataagcgtttccaggtaaagctttccatatttttttaaatggcacattgtggggaaaatgtaattatatatatattagtcccctccaaagaattcacaggccaataaatagatcagtcgctggctagtgagatgtactagctttcattcgatgttcattttggtgttctcctctttatcggcacgtctactctgtcatgctgccctttgatttgaatggaggtgggaattaaaatggccttgatgtctggaaataaaatgtcctatgtagacctgaatatggaggctttcctgtccccttggatgtctgtcctgttgctcttccctgctcttatccagcctttccccagctgtctagtggttctcacggctgcggccccttgttaatcatggccacagcctccacatgcccttctcagtttaacctggaatgctccagtggtgtcctcacagtcaaaggctgctccccagctcccttttgcctctgagtgtcagtggtagccactcaggaccctctttgagctcctcgttcatcctctctcatgtttttctgctccagccaaccaagcttaatctactcactctcctctgtatttaactaacatgctcccaaattcatgcctgtacacccatcagtctcctaataaggcctcgcttacctagaatgtaaaaatggcagggccaaatgggcttcagatctcttgctcctgcacttgcatggcttcggacagttaagtaatcactctcagtttcctcatctgtaaaatgtacgcaaaaataatgggtacctcataggagtaaatgaggtattaagatgtaaagcacttagcacaatacctagcacattgtaaatgcccaataagcattaaaataatattcatgtattctaatgccctcctcccttctaaatccacttcaaatcggatgtagaccatgtcttcccttagccttggcatccaaagtgggttattttatgagtaatcaacacttgctacactctagagaagagaactacataaataaatgtcaaaattagttggttattttgggctggttttttttctcccagatttacatttttaactttaccccttgactactttaactttctacctcacttactattaaaatatcccacttaccctaagtgcatactttctagcagcttgggagttggtctgggaattttcttagtggcagaaagtcactttggcctcttaggtttgctagagaacaagtttaaagtggatagttcaagctattttccaggagagaagggcttgctgtataccatttcacagagctggtgtgtgagcccccacactaatctgaaagctctaaagggcgtccttgtgtctctgtccaccccaggatgcctgatgaacacacagggcccaatgaatgaaggtacattcagaatctgttcaacaccttgctctttccagggcagtgtgaatccttcctataacatatggcaaatcttgctacaccatcgagggaaacttttgaatgcccattaactctttcgcatatttagaatttcattgacaaatgaactgctctggggaactgaacaatctctttgcagtaggaaggtgttggtgtgcattgtgaaatgtctaatgttgctgtagaaaaatcttgcatcacttaggagcatcagattcagcatttttcaggtatgttgtagtgagttaagttgtagtgataagcccaggatctgttcaacctagaaatactggttagtatgaggtcagctctggggccaaagagaaaagtcatgtgcaagtgaggttagaaaacatctcagattctctgcagagcagtgtttattgatgcctgtttatgttgcaagtgtacctgaaggacactatgagaaaagcttaagaaaatctcaaaattaatttcagttttaacctctgtatagacttggttgaaagaagtggaaaactaagaaggttaactgagttgcctaaatccagcaaaggggtacagatcaagtgcaagcatatttaattgggttctttaaatagaggaagtacccagcactgctccaggcaattagaaggagacttactccagtgtcccatccacaccctctctaaggccacggggtcacttctgctaacgtagtttacagctctaaggaaaaataaaaccccaaatcaacatccatgttctcaaaatagaaaggatctatccctgggcttatgattaagacaaatcagagggttttttttttcccattcaaatgcatgaacagttcttgaataacaataactgccactctgtataaaatactatgctccatgatttatatagagggcaaccacaaaattgtttttcccaactgtgacactttggagagtgaaagttaataattatgctgagacactgggtgcaaaccgggactgccctcagcaaaggacgccatatgaccactctgtttattatcttcactctttccaataaccctgtgagtttaagtgtcatgcacattttcgatgaaaaaaaaaaaaaatcaggacttgagatagagatttgctcaaagccaggatggtagtaagctccataaacccctcccccagtccaggtgataattgcattgtttgttttaatcactcaaaggaccaaaggataaagaacactgtgaggaacttagtgctttataggtactttcatttttagttttgttggctgatgtccctgccagttcttagccttcttcaccctctctccttccctccctgctctttgtctctctgtttctctctctctctgttttacacacacacacacacacacacacacacacacacacacacgtgctggagagcaccatcccctcagcataggcctatttgaaagaccttaagtgttcacaagtcttttccgtctattgcaaacaatacatagacagttctgtgccctatgatcatttgattaaatgtatatagacattcacaaaataggattatagtaataaggcacatttcttctgttaggagtattttatgtgtattttccctagtttcaaaagtaaataaaaaagcatgaatgatgtttactttagaatggtagtttgcttgccttgctgagcgttctctgatatattgtttttctgtttaggaaacagtagcaaattcactaattgtctttagcagtgagatcagggagaatatttccagggataatggaaatctatctataattcaggtatctcatttacttgatagctctggcctgctccatcataaaatcatgtacaggactggcagcaccaagataaattttgacttacttgcctgctcttgaatgctgcttgatgaagtcccaacaagaattgaaagagaaaggcaaacagcagtaggcaagaagagatgacccggataattttacaatctgagaacagctgagacatttgagaaagttgccaatatttagaggtttcaactgatataacatgcaaagattctcctatcctaccctaaacagacagctgtttcaaaacattttaatacccatgactcagtagtttacttttgggtacagtttaaggagtcaaataggttacatatatcctaatcatcttattagtaacttccatatttctgagtcttatgtgatattaacactgaactggtgtcagatgtgagtttgggctaatgagaaatgacattttactatgttaggggctgttctgtagactaatagacaaagatataagctttttatgcaggttctgttactggtactaaaccttacatttatttagtgctttgtagtttgctcagcaccttcaaacacattacctcatttgacgagtgagatgcactgagtattaattagctagtttcttcttaaatgctcctggtttagaataagacttaattcttcctaagttcagtttgtgtggcatgagatacccacatggcatcatgtaggtatattttgagaagtttcagatcagatttaaatgaacaaataataatcttcgtccatggtatttaccttcatgtagaacttttaaaaaatgcaatatagcttggtatttatcacttaagaaatacagaggtaagtctgtccaaaaacatatgtattacgattttccgaatttatttgtaccctagaatttctcttagtcctcttttttaaacatttaaacatttataatttttcttagtgcggtgccttctggaaaccatccaccatttgcacactaccccagtgcagaagatttagcaagtaaccagttcctggaaacgcgaatggcatttgtggaacaagataagacacaacttaacctcattttctttcatactaatgtctttcatttgatagatgccattcatcatattccttttaacattgctccatcactgaactgccagctatgtgaataagagaatgctttctctttctttgagctgaaaaggttgcatcttctaggcttggagaaacaatgggaatgggcttttccataagaccatctttacttacctttcagtgctggattatactgcaaatcttactacctaagcattaatttttcttggttattgctccaacatgcaacagtgtcagagaagcaaggcaagcactatttaatacctgtttactgagcatcaactaagcacaacacacactttgttttgggagcttcataaatgcatcccacctggatccttcatccaggctctcagagcttcctttccttccttgttcgattcagaattcagttacattaatgcagaagtttccaggacttcagggatcctagggagaggtatccaatgatgtttcagagacagagtaggccctagaaaattttattgtgggagaatgtgtttgatagattctgttgactttaactttatggatttgtactttcactacatcagagaaccatcagaagtacaggcaatggtctgtaagaacaatttcaaatatttcttctagcagatggctgaaggagaagaggaaatgtaagctatttaccctggaacacttgaccagatttcagaatatggggcagcaagcatttcagacaggcattccttacattagaaaaatgtgaagaggagttgccatgtttatcagaattttgcaatgggacaaatttaaagccagttgtctttcatcctgagtggttctctcactcttcaaaatacttgggtgattacagagaagggctatgtctgtctgtctctctctctctttctttctctctctgtctctctcccacctcccccccatacgtgtgtgagagagaaaataaattatatatttccgtaagttaaatttaatgatcagatatctcacctatattcttacacttttctatttttcacagaatatacaagcacaggcatttaaatgttagtcacccaaaactccagatgctaagcagtgaaagtttatattctgccagcatatcagactctgtaatgagtctgatttggtttaattcctttctactgtttagtcatttgatgagctgcagatggaaatttaagccaaagccataacatttcagctaatactttttatgctgctgtaagaatttgttgtcatgtcaatttaagagagttgaaatcttttttgagaaggcattcaaatctgcattaagtgcttttatcaactctaatttgatatacaactctgactgcttctgctgttcttaatcaattgcaaagtgcaaagtaatttagcagtggaagacagctttgcaattccaggatttctcagctaatgccataagcacaacattatggaaatatacaattaaatttacattaaaaatttttcctatgcttaagaaacacgaggccaacttctttgagtttagccttaaataggtaaatatgtattttggcagccatgaaaagaatagggtattagattaactagggcaatactttggtaaaattccattggaatgttatgtttatgcaggagagatttggccaatcaataagatggtttattttgtaagtcaaatcaataaaatgtttgaactgtataaatacaagattgggtttttcttctctgtttttctgttatttttctgtgtgtgaccttggctttctcattctctcattttcttatacgaaaggaacaaacctgacacttgtctgtcactgattaatgtgaagggttttgaatacttccactgaaaaatgaggtttcggtaaacatcatgatattcatcagttatttctcctgcaccattaaagccagactgaaggagactgagttgtacattattgaacttgactgataactggtggctggatctcaagcctaactttctaaggttggtcagcttcttggactggcttgcttttcagtattctgaataagaagaagttgtcacactacacagcctatcaggttctttctgttgttactttttgcagttaaatcactgtatatctaactcagtaaatctgaacaggattgtctccaatatgaagtgccagtattcttggtctggacacaggcatgtttttttttctataaagtgagatatggtgtttatggaaattgctggcattctgaaggtttttaaatatatgatgatacagctaaaggatactctcctacatttcagtagatatcatgtttcagttaacccatgatgaaatacgaaaggtcataagaatgcaagaggctgttagaaaatctgtctgaaacatctttggttcacctttacttaatgcctacagcttaggtagaaagctctgtgacagcattaaagaattttaaaacgaaaaagttgctctaggtgaacagattgcctatgaacatagcagactgtaaccagtgagtttacaactcgtgtttacaagtaagagcaccaattaaaagacaaattgaagtttttctttttaaaaaagtctgcttttcaacttttagtttatgaacactacatgtttaacaaatctcccctaaaaatgagggcttgcaattgaatgacaacatggacttagctatagtatcacttgttctaacacccctaaaattaatcttctgctttttttttttttttttttttttttttgagacagagtctagctttgttgcccaggctgaagtgcagtggtgcaatctgggctcacagaaacctctgcgtcctgggttcaagcaattcttctgccttagcctcccgagtagctgggattacaggtgcccgccaccatgccctgctaatttttgtatttttagtggagacggggtttcaccatgttggccaggctggtcttaaacttctgacctcaagggattacaggcatgagccactgtgcccagccagtcatctactttcttaatgagaaattcagcttccttagggagttttgagggtcacacactgagtgttttgtttcactttcctcatgatttggtggtggccctgaggcctgttgtcagcttctcttccaggttgagggtgcaagacaacctgtctcgcttctgttttacttgattgaatacagctgcgagagaataggaaaatcagagatgtttttgtgtcttgcctgctgattttatgtttcatttataagaaaccgccagtgcttatcattacaggaaagctaatcctagttcatgccaattgagagatcaatttttgaaggtgtttgaaaacctggcccattttcatctggcagagtaaactactttgttctcaactaacaatttaaaatgtttgaactttaagaaagatcaaaattataagtgagaatgaagattctagcacattttaaatatcaaaaaatccattttatcttagcttcttttcctttattttgttatctgttttgttaaccatgtcaatccttagcaccactttctagaggggaagaggagtggacatttaaattatattgtctaccattagtcaaccactttatgaaaagaagaaaggaagaagggaggaagggagggaaggagggaagaaaggaaaagaatcagagggagaagagagaaaaaaatacaaattggaaatgattactgtaggattttgaaatcagtgactttcatttctaaatcccttgttactaatcagaattcagtaacatgctactcacaggttcagtgttatggttattacatagaacatattttttccatttagtaatttgaaatgggtgccattttagtatacttttgctataaatgatagaataacctcataagggctgaaagagtaaagactgttaattagcttgcccaacccacagcctggagatgggactgttaattagcttgcccaacccacagcctggagatgggaggttccaggtgggcttagaagctcaaagacctagaccatccaatctctggactggtcacactacatgatcacaggatggccacctcagttccaaatatctttgcttcacttaagtcaggaaggaaggaggcccaggttagggctttcttgtaacaagaagattattttgataaaggtctcagcaaacttcctcttgcttctctctgataggaactgggtcatatgcctacccttagaccagtcactggcaaagttgaatggaatagccaaattgacttagatgaatcgtggttcaggccctggcactgggctgggtacaccttttgtgagacaagggacttatacctgccacctgaacaaaacagagattcttgtaccaaggaagaatgataggcaactaatagtgccaataagtaaaaactacaatggtatgtattagtctgttttcacactgctgataaagacaaaccctagactgggcaatttacaaaagaaagaggtttattggacttacgtttccatgtagctggggaggcctcacaatcatggaggaaggtgaaaggcacacctcacatggcagcggcaagagagagaatgagagccaagtgaaatgggttatcaaaccatcggatcttgtgaaatgtattcactaccacgagaacagtatgggagaaattgcccccatgattcacttatctcccaccaggtccctcccacaacatgtgggaattatgggagtacaattcaagatgagatttgggtggggacacagccaaaccatatcacggtagatgactattattagaaactcaacatctgttgttgtatagcattgcattaagggcaataataatagctgatctttataagcacttatgaagtgtcaagagccgcatgaagtgctgtatatgtatcatttcctctggtctttaccatgacactgttttacacatgtggaaagatgaaggaaccatttgtaagtgatggagctaggattccaacctagactctaggataaacactatattatgtggcctctcatcgtcattggcaagataaagatattggctaccagcaggtgaaattgatgaacctctagtgggagtagagttatattgatgtgtacttcctagcaagttaccacagagatatttgtcaaaaagcagcggcaaagtcttgaaagtagcccccaccaaaaaattctgtattgctttgccttcagtttcaaaaaaggaacacttcctcatgttttcttcattatactcactcaaaaagaaatggagtctttctattgctttaaaaaagaaagcaaattataagaaagaatatttttagatcaatcacttgagccccttaagattatacccaggccaggcacagtggctcacacctgtaatcctagttcttcaggagcctgaaatgggagagaagtgcttgaggccaggagtttgagaccagcctggtcaacacagtgaaaccccatctcttttgtttttaaataaattttaattttaaaataagaccaaaaaaagaaaaaaaaggaatatgtaggtctattgaattatgctgttaggttaaaattaacaagttcaatatttatttgtttaatgctatccaacaatagtagatgaaatgcccttaatatttcccttagataccaaaagaaaaaaatgtttttctgttttcagatatttccatttcatgtggaaataacagtattttccagtaaggtttatattttaatcttattgttcagatttagctattaatttgaaagggctttatcactgactcactttccctatttacagcctccctaagctaggtatcgcaatggttaaataagaatagctagcattcatgaaggactgccatgtttcagccacagtgctaagcactctctcatttaaacttccttacatcctattgaggcaaataccattttgtagaataaaaaccaaatgctaataaagaaataagagacattcacaatcagtaagtgatggtgcccagattccaatctgcttctgtctctagagcctctcttcttgttggcagcccagttagagccactcccgccccacttttcctctgctcatttcccaccaaaacatctgaaagagccagatgcttgcttgcttggccttcagtgcaagcttctgactgctatcccagttgctgggggaacttctggaaaggattttcttcctggaaataagagaaatgcatcttttgccaccctgatagacttgctgcttccagcctttggacatagtttgtgtaggtggctgaaaaacaaaatcagaacaatcatctgagatgattttaagctgaacttgagccaagttcctgcccttaaaagaagagtgtcaagtgaaaaagatctatataaatcaataattgcagtaaaatatgaccagtaatcaatcccatgcaatgttaattgtgtatatgtgggtaagagtgactgttatttgtacattattatacccgctggcccctaaggccaattttcactattttttccccatattgctgatatatatctccaaaataggatattttcttatcaacttgctgaacctgtgacttcatctctctcctccaggacccctatagggcttagttcttcatcagtaatgctgaatttcgctattagtcagtcctaggcaagaaactagactttttttcaacccttcattgttgttcatccaaattgctgctaaaacttgtcttgttttcttcctcgaatgacatctcccacatctggatcttcgtcaccatcacctctgccaaggcctggttccaggtctgcatcacctcccatctggagcactcacaattccttctcactggctatctgctgctactgcctttccaggacagtctttcctagaagtccttcccatagctttgaacgttgatctccacctttttactcttgtaattgtgcatcagcctccatagacagggattgcatgacaaatgcttttggtgtcaatggttgcaagcacactgaataattaaaatttcatcgtgaactgggagtgatcatctaaattaatttcattggcgatgtatatgcaagccatttgttttggtagattcaagagttctgtgggatgcagaaatggactgaatctttgacctgtagcctataatctaaataccagtgatatcattggagtattagtcacagtcattggccagagatgaggtaggagtattactgtggtactacaaacacaatttaagttaaaaggaataacatctgctactctatatttttatgctggcgagattcaaacaggctagatttgacaaggcataatgtagaaattgaggaaaggcttgctgaaagttaagaccaaaagctaagtataatgctctggttaatatattaaatgagctcaggcagaggatacaactacttatgaagtgtacacactccagtgatggaagacccactcaacaattctcaagtgtccctcgtacacaaaacaacagccatcaaactggcccaatgagctctttaaatatcatattgttctgccaaacaaggcccttgttttagggagtgactaagagactgtcacttcttgggccaggagaatgaaaatgctcttcaggctctgggaaaaggatagagataaattgtggatactgttcctaggacatccctctccatttcagtctatgtctgactggcctgtgttttatactgcaagatgacaactcagctgatttattcagctctgtgttttcctgaagttcttgctattgacccacgcaagagacagaaggttagaatctatcttctttgtggacagtgctaagttaatgccaaaagatctaccctagcctgatgctgctggggctggcaaagttatgtgagctcagaagttgagaccaagcctccatctcctctactttaagtggaaagttaacacagtctggaagagtcagccaggagtatcagcccgtttgtgttaacttgcttttattttttcttgctgaaaacagaagtgaattacactcttcactgaatcctgctgcagaggaaaatgatgcaacactggtcacatgacacaaagataaaaggccctttatgcaaacctagttctttattgtgtttccatgtaaggagaggttcaatacccacactacaaagcaacacagaattgttgctcttaatcttggatctttctctacacggagaagccatgatgttttactttgtttttgtctctttttaaatttttctgcctttttgaccacgagattcattaatttttatgtaatacaaaatatagaaagaaattatgtaggctcatttgatttacttttgactaaacaagagttttttctgtgcaatttgggactgttacgatcatgtgctttgtctcagccatatacttgctatgtgaccttgagcaagttacttaaattctgattcctaaaaaagagactctacctgatgtgtatgagctgtatatggttatatatgtatatatatatagagagagagctacataatcatgtatatctctttaaataaatatgtttatctatatatacctactcctagagccataacaattaaaggagttgacatttatgaagtgtttagcatattcactattgtacttgctcaaataaatggtagccattgttattagtaatttgcctaattaatgcttgtctaaatccctctgtaagttaatggttttgtcatgttggctcattgccaagacagtatgaccaggaaccaaagagtcttggagcttttttgtgacatcttcttgacttgaggatctgaactttaccactccctagagaggatattttggtagcaaagtacatttctggaacttcagaaaattaaccatctaaagatatccaagatagaatgtgttccttctaaattcagagctatgtatgatggctgaaaatataacaaggcattagcgtatgctacagttgcagcgttttctaggttttcctttttgtttttctttttttcttttcttttctttttttttggggggggggcagagtttcactcttgttgcccaggctggagtgcaacagcatgatctcgcctcactgcaacctccacctcctgggttcaagtgattctcctgcctcagcctcccaagtagctgggattataggcacgcgccaccactcctggctagttttttgtatttttagtagaaacaggatttcaccatgttagccaggctggtctcgagctcctgacctcaggtgatctgcctgcttcggcctccgaaagtactgggattacaggtgtgaggcaccacacccggcccagttacagcattttctgtgagcatttatgtgaattaaacctgaagcgtgagctttttggatttggaccaaactcttatcctgtgtgtatgagtttcactctaactgacccacttccacttccccttcccctaccctttctacatacttccattgtagcaacagtggcattctgtaactgctttacctgtctgggtccctctgtggctaagaatcaaccgtcttttcatttttctaccctctagcacatcttagggcacattggctctgtgaataatctgttaaatattgaatgagtgaataaaatctcttgagtgggtgtgggaggtctgtgcctaaactttgctagcatgtcgcccctcagtggatgagcacccagcaagcagtaacagtgttttgtcttttgggatctttctatcttttattccaagcaggaactcagcatctaatcttagctctgaagtctctttcctctgtaaccctcacctgttgttttgtttgagtgagttcaacaagctaaattgtaccattgtgttcacagaactctgggcagatatgtccatgaaaagaaaagtgtagagtgaaatgatgttttatttgtataatgatcagccaacttgaggaaacatttcagagagaaattgtttgtttatttttaaatcattcagcactgtcaaggattgctatctgtaaaaatactaactttttcctacatttacctaaatgtcattaatgttacaaggatttaacttacttttataccttctaggcacttttgccaaattggaaggaaaccatgctcaatgaagtctgctgagctaatttaattctttactcacaaggtctttttccacgtggggaatgctgctgttttatatttatttggagacactgatggccttactagaaaaaaaaaatctgaatataaagattttatcttcttgattaaggtgcatgtactcaaatagctgccccaattggacatgcctgaataagcttcaggaagtgcctgagagtcaataaacagtcctccctttcccttcttaccaattattaaatgcttacatgtgtagggtactgtggtacatagagtacacagtgattcagcaggcccagctcctgccttctctgggcttcacaatcaaagacagcctactttgatgaaagggaaggtgtaaggaagttgcaagagaacagaaataggtgctctgcccatgccaggcattgtgctgggacctggggacactgacctaaataatcatttagagaaggaagtgattcatcattttaagagggagggaagaggctgagggatagttccatggagactgtgacatttgaacatgaagactgttacagagaagagggggaaaggcagagggaagaacctgagcaattgcagggagttggggaggtgcctgagggaatgacaactggatcccaagttccctgaaggagtgacagattgtgtatacaaaggcaagttgggtcagatgacagggagcatggaaggatctgccgaaaggtctggtcttattctgaaaacagtgggcaaccccataggtttttttgtttgtttgtttgttttttgggacggagtcttgctctgtcggctggagtgcagtggcacgatctcagctcactgcaagctccgcctcccgggttcacgccattctcctgcctcagcctcccaagtagctgggactacaggcgcccgccaccacacccaaccccataggtttttaagcagggaacagcatgatcacatcccagcaaattcagggactctgcactgagaatggaggtagggacaatcactgcgagaatgacccaggaaagagacaacaaggactcaaaataaagtagtagcagaggagttagatagaagggaacagattcaagccagttgtctggggtagaattgtcagagtttggtatcttccctgggtccagcctgtgtttcattttaatgtatgataaaaaacatgcatgattatgtagctcaagcaagctgctttaaaaaaaataggcagaagcaattatttgatgaacagtgttttaaaattatactcagctagacaatatgctctttaaatagaatatttgcgttgaggttaaaaggtgatggcggggttctctcttgacgatactcaattgatttaatattccaaattaacacagtggtgttgtatagctgctatgtaaagcccctatacattcattttatagttattcccaggtcatagattggcggagattttctttggttttgtttttcaaggaaacacacattttagatggccacatgaccttaaaccatttaaatgtcaaacaaatacctaatggatactgcatagcttgttggattacttcggtatagttttagagtatcaattcatctaagttgtctaagcactttttacatatgacaatctctcggaaaaatatagtgtaattttcatagaaaacaaaggcatcatgaaagctcccaaagataacacctcttaagaaacaagttcaagatgatctctgtcaggtgcttttattatattcagaattatatatggcttggtcctgcagtgacacacaggcattagcagttgtttcacctttctttctatccttcagggagagcagtgtgctttcctgggccatgtatagttgcataataaacccttctaggagaaaatgtctcctaatcttaggggaatttttgaaagcatattttgctgttcttatgccacttcaaactccatcccattaggctagttgaatcagattctcccagtgcctcctccccacccttatgtgaggaagttttagcagtcatgttaacattatgggctgacagggcatgacactgactacttcagaatgccacagagtactctggtgacaattattacatgatggcatcacatcagtcatcacataagaaagtaagacagaggtgcacctaactcttcataatgaaacaacaggttgtaaaccttacacctgtactatcttgtgcactctcagttctctgaataaatattgcaaaataaagagacctaaaattaagttttaattatatccaccacatacgcattttaggaagacccttacaacataacatgtcaacagactctgaaaagcaacaatgaggattattcagggaaacaaatctataccaatatggttgagaatagaggtaataacttaatctgagtggttatacagccataaaactccattcatgtagatacatacttaattatttccgtttccttctgatttgggagctcaaaattattttatcccaggatgtagttgggtgaggaaaatgaccgtttcccttttatttggttaagggaggttttgtggtataagtgggacttttacaaggtctttgaaggagaggatgggttggcaggattgagggaaaagacatgtcaagcaaaaagtgtgtagttgggagaggaagaagcagaggaagggagtggtgagatgactggcaagagcagatggaagggaattaaagagctacctaccggaatgaaaaagaagcccaacaaaaaaccctacagacatttgccagtttagctttctgcttaaatattgagcttgttttccccagcacccgaattactcctgagttttcagatggatgctaactctgtgagacgagtatactctatttacaagatgaaatgattctgctataggagtactctatgtcaaaatagtggttttgttaatgcaagtttgtatcaggaaatcacaatttttcaattcaattttaccagcttttcttctcacatggatgtggttttaaaaaattaaagatttcaacaaatcaaccaatattcattgaggacccactgtgtacaaaacactgcagcagaagcgatgataatttgcgaagtatgaggtgctttctacaaagaagtaggcaaggtggaaatccctgtgatattcagaaagaatgaagatgtcagtataggagctagcacaagacaatgtgtgatcaatcataacatggatgatatggttagagctagaggaagattaagatgtttaaaaattttttccctagtcagttttatatttttggttttgtaatagatttgggtgccatatagaagtatttaatatcagaaatctcttttatgatcttttgctgctcaacttctaggaggcaatctggtatagcaggaagagtacaaactccagagatggaaaagctatattctagtcctttttcctggcatttattgagtgtgctgtctttgacaaattacttcagtgttctcttctatagagtggacataaaggtgaccacctcccagtctcacctggcctgatactttttgaagtgatcaataaatgttattgaaacaataaaccagtatttctaataacttatttgtgaatatatatgactacatgcatttactaatccataaagacacaacactagctttttctgaatagttttccatgtttatctgcaaaattattccctgtgtgtctaagttttataaaaagcgttaattggtctaaagcagtgtgcccaacgcaataccaggcacgcatgtaattctaagttttgtaatagcgacattaaaaagagcttaaaagcattgaaattttcataatttattttatctaattcaatatatctaaaatgttatttcaacatgtaatcagcataactattaataaaatattttaccttctttttttgaggaattcagaactcagtgtgtgttttacaccatcaacatatttaaatttgaataccaaatttatccaaaacacttgatctgtatttgtatttaataaaatttacagttgaaaaagtactttcaaatatgcagatttgtccaaacatacttaaaacatttccaataactgaacaaagtgtcagtttttaagtttgaatttaaattaattacaataaaaataaaaattaagtttctggctgggcacgatggctaatgcctgtaatcccagtgctttgggaggccgaggcaggcagatcacctgaggtcaggagttcaagaccagcctggccaacatggtgaaaccccgtctctactaaacgtacaaaaattagccagtgtggtggtgtgggcgtggagtcctatctactcgggaggctgaggcaggagaatcgcttgaacccgggaggcggaggtcgcaatgagctgagatcgcaccactgcactccagcctggaaaacagagcgagactccatctcaaaaaaaaaaaaattaagttccttagtaacactgaccacatttcaagggctaagcagccatatgtggctaatagctactgtattagaacacaaaggtagaattatttcaaatagtattctcagaaagtcccagtcttagacagaagagttattttataatataaaataatgacattcttagactggattttattttgggagttgtctcttaccgactatgcttagtaatgacttctgacactcctcagcttatcatttggcctgctagatttatgacatatcctttgaatgaagctctctagattacttggcctaaagaatgtatagatactattaaaatgctgcaggacaattgctgtttctttatgtatacacctgacttcatcgtctttgcagacgaactgtctcggtcccagactgtgttagttttccaaggtcccacggcttgttaatggcaacatcagcctatgaacatggacttacaggtccataatgccacagagtccatacttggcctcatttaagtgcacatgcgtccctgatgcactttggacacttaagagtcttccctgaaggaggatcctttcttgggctgtattttttaatcctcaaaaatataatcaactcaaaatacaaggtgaaatatggaaaaacacatgagctagactaggttgtctccttcttgggtagaacaggttgtggggatgaggatattaggcaaagaggccttagtagtaaaaggttgtgtggctctgtgccttctctatgctccttcactgcacaaggagaatcgcttgaacccaggatgcggaggttgcaatgagctgagatcacaccgctgcattccagcctgggcaacagagcaagactctctctcaaaaaaattaaaaataaaacaataaaagatgctttgttaaatgaaaatagttgtttactttcattctaaccgtgcctctagtgaacaagtcactcagaactgaactcccattgtcaggttaatttttataagtttttagatgttttgaacgaaaatatgaaaaccctgcagaagtgtttatcctttactgttaacaggatgtcatcttgaacacaccctttttttttttttgttctgtatgactattcaggaaatgttcacagggactgtgaaggaattctgggaggtatactaactaaatggcaccacttgctttgttgttattaattgtataaatgctttttagaatttatgcatttatcaagtgatcatttttttacatcttgtcttttgattttctgcattcaatttgctaggagtttaaaaactagaccaaaaaaaaaataaaacttgcttgggttgtgaataagagttgggcttgaagtgagaccttgcattagtctatgtatatcaagtacgtagatttctgacacctatttggggcagagaaatgtgttagtttcctcagagaaacccctgaggctgtttaaaggtaagaaacaggctgggcgcagtgactcacacctgtaatcccagcactttgggaggccgaggcaggcggatcacaaggtcaggagatcaagaccatcctggcaaacacggtgagaccccgtctctactaaaaatacaaaagaaattagccgggcatggtggtggacacctgtaatcccagctactcgggaggctgaggcaggagaatggcatgaacccgagtggcggagcttgcagtgagctgagattgcgccactgcactccagcctgggcgacggagcgagactccgtctcaaaaatacataaataaataaataaagaaaataaaagataagaaaccaatgaagcacagcaaaagcaaaccccaagttcttttggttaacttcctgattcttcattatgttttgagttatagatacaaggttaccagctagagagctctgttttactatttatttctttattttattatttacttactttatttagagacagggtcttgtgtcgcccaggctggagtgcagtggtgtgatcatagatcactgaagcctccttcctgggtttaagccatcctcccacctcagtctcctgagtacctgggcccacaggtgcatactaccatgcccagctaatgtttgtgttttttgtagagacagggttttgccatgttgcccaggctggcctcaaactcctgggctcaagagtctcccacctcgacctcccaaagtggtgggattgcaggaatgagccaccatgcctggcctaagatggaaactattttaaaccctcctatggattcctctacgtgggaggatggtttactaaatactctgttctcatttattattaaatattcccaagggccatcagtagcttccaaacctgggtacacattggaatcacttatggaacctttaaaaagacaaattctagccttgccagggattcaaattctgtaggtcttcatgaggccattgagtctgtacattttataaagctctctccatctttgggtaaactttgggattttgtcagacccctctccaaaaaataagtgagttcaactcaagaaacagaacctgtgcagtaatccttcaaaacagtataattaaaagactgagggcaacagaaagatcaaatgaggaattacacatatagaactgggggtacctataagctgagtaatggaaatcaggaaaactttttggaaaaagaacatttagtgtacttctaatacatttaagttagtataccttccagaatatttctcattaacatagaatcccttctgatttttctttccaaggttgggtttaagaatacacctggtaggctgggcacagtggctcacacctgtaatcccagcactttgggaggccgaggtgggcagatcacgaggtcaggagattgagaccagcctggccaatatggtgaaactctgtctctactaaaaatacaaaaattagctgggtgtggtggcatgcgcctgtagtcccaactacttgggaggctgaggcaggagaatcactggaacctgggaggcggaggttgcagtgagctgaggtcgcatcactgcactccagcctggtgacagagcgagactccatctaaaaaaaaaaaaaaaaaaaggaatatacctggcaatttatcagagaatgggtgatctttggaggtttaaagtgagcctctgtataggttcacacagtctgtgcccaataagtatcatacacctggttagtagaatgctgcttcaccagtagcttgctgtcagaggtaccctgtgccaaaacaaaccagtattttcctagtggccctcctaatacacattttcaggttgcatttgtttgctggatatgtctttaggtaatgacatgcttggcaaatgctacctacaactgtaagcctatttaatagccagtacttcccaacacaatgacacattatcttttatgggttccctgcccttattatggtttccacagggaagaggccaggctgcaggtgatgtttgcttatgttgtgctccatttggttcctcccttaaacacagcctcagaggctccttgtctctgaaagttttgttaatacaagtgaatgaatatattctgtactatgttatatcactgaaaaatagtgaaaatacataatccttttggcactggcatctattgttaattgccatatttctgtgaaaatattttaactcttatatttactgaattgctaggaagactaacatgtatgtatctcatacaaataaaatgtgaccattttattactgaaatatttcactgataaactgaggttctaaaacctcagtttagagaaatgttgggtttataagaccaattatgaaaaaaataagaatcatcatcagcaagtgtatcctctcacttcacagttttgaatgaaataggcagggttacaatatgatcattttaaatggtgacttttcctgtaagttggaaaaaaattcttgagttgatgtgcaaaagttatttcttgcttcccatagtaaaatagagcggggagactatacaataaagtaggtggatagagtccagtaggttacatttatttttacttttttttattttttattttttttttaagacagactctcactctgtcacccaggctagagtgcagtggcaggatctcagctcactgcaaccttctgtctcccggtttcaagtgattctcctgcctcagcctcctcagtagctgggattacaggcacgtgccaccacacctagctaaattttgtatttttagtagagacagggtttcaccatattagccaggctggtctcaaactcctgacctcaggtgatccacccacctcggccttccaaagggctgggattataggcatgagccaccacacctggcctagtaggctacatttagtgagagtagttgtatgatctaacctttatgctaataagtagctattggccggtagcctaagaacagtcctcccagaagcaacaaggtaaactaaacacactcaggaacttccttccttgcagattctaagcccgtgaaggtagatgcattgggttcacctttcgtttgcacttaaaaatattcgcagtcagccgggcatggtggctcacgcctgtaatgctagcactttgggaggctgaggcaggcagatcacgaggtcaggagatggagaccatcctgactaacacggtgaaaccctgtctctactaaaaaatacaaaaaattagccgagtgtggtggcgggcacctgtagtcccagctactcgggagactgaggcaggagaatggcgtgaacccgggaggcggagcttgcagtgagccaagatcgcgccactatactccagcctgggcaacagagcgagactccgtctcaaaaaaaaaataaataaataaaatttaccgtcttgccatcaggccacacagaagcagaaaggaaacttttatgaatattagattaactgttaaagaaaaaggaagcatcaactttaaagtcattcattcaattaatatttgagggttgttatgaaactatcaattaagtcaacaatccagtttattttatttattaaatttagtttacattaatatagtttaaaatatatgactttttttggaatcatcggggagccaacaacctataagtaaacttcccctaatcatgaaggttagccctggaaatagcaaatcattttaataattttgaatacagtttttttctaaaaagtattttactgtctctgtatctgttgcataaaatgctatcataatttaaccacatctaaatgaattcagatcatcagtaaatattaattattagagattttataatatatggataccttcagggcttttgaaatgtgaaaggcattctctttctatactaaaatatctgtagcctgctttgctttctaagttttatgtctgctttgtgtttttgttctctgatttttctattaatatcagccatcagctgacagctgtcacttacactgtcagtatgcctgaccttaggatccttcacctgtccatgattttttgcttttaatttaacatacatttgacggaggaacaagattatgtctaatataggagaacatgggcttcaagtggggatagtcaggtgaggtggagggcaccaaaggtgactgcactctggaattcagctatattttggatatgcaggatatctgggtaaaaaaaaatatgtatacattatttgaggcatctcttaaatgtatacaaagacaaatactctaaggctgccattgtttagaagtctcaatcatattaaggaaaacactagaataaaaattaataaatgtagtgacactggagtctgataaacctgtatttgaatgaccctgagcaaccttatttttgttctttttcattgactctaaaatgtagatggtaatgcttaccttataaggttactgtgaggacttagtgaaataatacatggaaagtgcctaacctaggatcagaatcaaggtcagtcctccttccctcaaatgttagcttccttttctacctttttttctcttcacttcccttagtatctataaaaagtaggaaagaagaggatacttttttttttcatattcctacaaggctgttttaagtaatgttcttttagttgaatgacagtcacatcatttgagaggttagtctaataatagcactggagacttgaggatgacaaagtgcgaattttcagttgggtctggactccaatttatttatttatttgtttataatcaacatggatttatttgcacctgaccacttttgacagaattaaaaggagaaattgtagacttctacaattacattcacagatttgtgcactactgtctcagaaacttaggaagcaaaaaaaaaaaaaaaaaaaaaatttatagagaatgtagtattacactaatgagatagtgaagcagaattccattttctttttctttcatctttttttttgttatagatttaggggtgcacgtgccgttgtgttacatggtgatattgtgtagtaatggtgtgggcttccagtgtacccatcccccaaatagtgtaccttgtacccagtaggtggtatttcatccctcacacccctcccaccttttggaatctcccatgtctattattcccctctgcattggattcctagttatatacagaatgagaaggactttaccctcttctgtctgtacacagataactccataggcacactactgtcttttaatggttttgacttcctttagtaaaatgtaaaccaaataccacatattcacctctgtcaactctacagaggcattctaaaccctgaatgtgtaaaatgcaggagtagcatggggcatctttgctggtgtttagctcagcagaatcactttaagtgttcattttggtaaactggacattttctttcttcctgtgaattgtttcagttcatcagtcaattctccttccatgctgttttgtaattacaacctatattgctaaagaaaaccttcaatttaccctgagtaaatcaagaatagaaaattacttgggtttcggtctcttcacagctgaaataaattttcactgaccctcatagaattcttctctcagaaataatgcccatagaaagatcaattcgttacacttttgtttttaagtaactttgcattttccttctcaacctcattaacctaaacctgttttcttctgaaggcagaacacttaacattctccaatattggctccatcttggttttataaatgaagtttttaacaagtcagtttaggctgtgtcttttaaaatcatgtaactatagatttgaatccaatcacttttctttgcaagttatgtcaacagatgttcagtgtttcattttccttaagggtgtatggtttctcgctgactcttggcttcaaatacagattctctgctgttggttttgtctgtaagcatgtaagctgttgaaagctgtttgtattcatggccaagagcccctagttcccagagcaacagtttatcactcaccctgtgttatctttgctcctacctttcttgaatcacaggaacacaaccccagcccgttagatccagggggcagcgtgtgtatttgctatgcatggactgtttatggcaaactgtgtgggtcgggctcatgttcctggagtgctttgagcagctttactaatctgtcagtatagtatgttcttgtggataaatatagacatacgggcactctgtgagttgtaggtcactgtcttactgtgcagctaaaaattgtcccattggtatgaacagtctgccctggacggaaggcctgttttagtttgtcttctactgtaggtctttagcacctgactaaaaatacacctggggccaaaaatataagggccctgcattgtggctgagacacttatggtggcagtgagcaacaggaccatggagcccatcattatgtgttttggctttggaacatggtctgtgtagctgttccagactgttagtttgggtttcttttcaggctcatggagattacaactgcttgttggagacgatcctgtgtgatcagcttcataaaagggcttggtaggtatgaaaggctgttaatatgtgtggagtggctaactggttgttaaatgctgagtatgggaggactcttctaaaggtttcagcggatgggggtggaggtagcagttgcatctgcctgcagggatttacttataatgccattgttcagagacaggagtaatgcttgaggtgttacatttgagattgttatattttggaggcaagatgtcctttttgtatacgagcctgtggaacaggcagccaggatacaatggaatttttctgtgcacttaactttcactaaaagatttggtatgacactgcagtaaaattgctgctctgtaaaaacagctagtatatatttgaaaaataattaatagcatcatatttaatattatagtagaagtgggatttatgcatgatttcttctaaatattaatgttaatgcccttacttgttttgttttaaacattgcagtagacctaaaagcagtttttttcttcatttttggcttagccttgttcaacatgtaaaagataaaatatttttcctttttgtttataaatttaaaaacaggacaccgtatgttaactgacattaaatgggtccaaattgcatgccactgcttttcctttatcagacaataacacagttacattagttctaacataacattttaagcaatattgtacaacatttccaaaaaactagtgagaggaaacatccatgacacagagttaattacatgcattttggatatcggctctttaattttttttagtgaaggtaggagaagttaacttgtgagtggtaaaggcacaacatattgctctaatcaaggagaaagattttgtttactaaagatttgggagattgagttgcttgctaattattccactgcactatctctaatgaaattactagaagtttacatatgatagccttctgtttctaggaaaaaaaaatcctgttagtcattattttaccccttacttttgtggtttataaagcgtgcattaaggaactttttttttcctcccaaggaattttttttagtgtataacaagcatacaagataaatgattaaatttatggtttcaggtatttggaaaaggttgcatcattataggactcatatgaaatgctaaatatttctattgtatggcatcccttgaggatgttactgaccgttagtgtattttggctgaacagaccactcccacagtctcatgaacatgttgactcctttttcactcattgcctttcttgctcataataaagtttatagtgaagttaactttatagtacagttagtaaagttttaggtattaaactttactataaaggcatcagaaacaactaatctgcttctgtgaattggtagatttattaccatcttagattataaatttctggtgagcatgtattaagtgaattttatgtctttgtacatttccataactaagaatttaataaaacctaaaatattttttaaatgagctggtatctaaatgaataagcccatatgagccaagaatttaataaatatttacatgttgataaaatcaaacaccagcaagactgaaaaagatttcacttattcacttaactcatcattgaataaatgtttattgagcttctgttgtaaacactgtactagaagccctttgcttgctatatatagatcttggaactgtatatagttaccatatgtattttataatggcatatatataccatcacatatattttataatgcatatataatgcatatgcatatatatgcatatgtatattagtatatacatatgtatgtgtatatattttataatagaatgcatactataatgtatattgtacttgtgtataggtatataattttatagtataatgcatattatattaacaaagacacctgtaagattagactgtccttcaagtcaccctctgcatcatgtaatccccaaggggaccctggcggggaacagctataactttaatttgcgatgtttatttgtcaaaagatggcagttgctggcactgtctttggcagaccccccaccacgtccagtttgcatagtcttcagtgtccctttatgttgggtccctgtgtaatgcatttgccaattcagctgcagaaaacatcaccatggtgttcttctcttgcccttggtgtttgacttaaatatgattctaataaaatagctcaagaagctggtttgtcgtttctggcagggctcagtctaatgcccagataacagtatgggaaatactactagctccttagcctccagagccttttgaccatgacccacagtaagaaccacactttgcattgtgacccagaactcacacacatacatatctgtagacacagacagagtctgaaaacaacagctttgtgaaacagtgcttccctcctcactgtgcaggatgccaccaatctgctatttttctcttctcctgttttctgttctatttcatcaaaatcaggctggtcggcacccactaaattattttcatgatccagtaacgggccagagtctgcactttaacgaactctgctttaaagattccaacagctaggcattcacaacatacccttagtcacgttctcagcagaaatgacatactgtcatccttgacatactgttctactcctgagcataattggcgctttatttgtcagagtattgctttgttgcagaaagagctcttctggtagttctgatgcgagtcttgggttgaatgtaaggtttctaagctggagacaatgcatgaccttgtacatattaacacttccttactccttaaagcagttaagtatttgttgagtacttgatattaagcctagtactgtgctagaaggtgatgctacaggacgaataaagcaaattccttgcccttgttgcagttaagtgtagtgggggagacagataggaaatgcgtatataatatgtcatagtatgtcaagaggcagccagaaccctggatgacagtaaagatgatacaaactgttagcagaggggagtaccaaggagtggctggccagaacagactctcataatcctagaaggaagtgagcatgtgagccatcaccacattccccccaccattcataaattcctacaacccctctgccccagttctcttccactttgaaggtttccctgactgtctctatcaacagttatttctagttctcagcttaagtgtcactatcccaaagtcctgccccaacccccacaatcacagatatgtcccccctgcatctctcctgcagcagccattgtagcacttctcactttgcaattatagtcctgtgtgtttttattctatcatgcctctctccctgcacactgtcagctgtgtgaagctacgagccatgcctattttgttcccccagcagatagcccaataccccaagtacactgggccttcagtaaatagtcaatatgtgaataaatgaacaaattagtgaatgaatactctcctaaattcgtgtgctcatccattggctgttcaacctggctgttcaacctttggctgttcaacctagtggcatactgtgactgaatagattaaactttaaaaatcttccaagctgtctttttgaatctatcttcatattctccacagaactttgcagaatgccttatactaaggtcttaatgaaaattctttatttaatgatttgattaattgatcacactcatagtcttttgaagcgaaaatagttctgaaagggccgtaatcatgtcatatgataaaagatgcctatgtaaatgacacctccactcatccttgctgtgtgttatgcctgtaaatactcaggccaacattcagttatgcagacagttcagttactcaaacctatgtgattgaacctgaattacagatggtgttcaattctttaatatagtaatttatttttcaaattgaggttctaagatggcattcctttattattgccattgtaaaatataggaaactttttataaatgagtcttatcttttaaaaaatatttattatgaagtgttaaacccaaaaggagaaaaaattaggataatatgtaacatattgccatcactcaaattctacagttatcaagatttagtcatgtttggtttatttgtacctttattctttcactctaattaaaaaaaaatttttttttgagacagagttttactccattgcccaggctggagtgcagtggcacaatctcagctcactgagacctccacctcccgggttcaagcagttctcatgcctcagcctcctgagtagctgggattacaggtgcccaccaccacgcctgactgattttttgtattttagtagagatgcggtttcaccgtgttccctaggctggtcttgaactcctgagctcaagcaatcctcctgtcttggcctctcaaagtgctaggattacaagcatgagccacagcgcccgaccaaaaaaatttttttagagagagtctcaccctgttgcccaggctggagtgcagtggcgcaatcatagctcactgcagtcttgaattcctgggctcaagcgatcctcccgtctcagcctcccagtagctaagactgcagatgtgtgctaccatgctcagctaacctttaaatttttttttggtagagatggggtctcactgtgttgcccaggctgtttacaaactcttggcctcaagtgatcgtcctgtctaggcctcccaaaatgctggggttagaggcataagataatgtgcccagcccttgtttctctttgttaaagtattatgaatcaaatatagacatcatttcattgaaccccatataatcagtatgcattctaggaaatatagatattttctcatctacccacaatactattatcacatctaataaaattgaccgtaattctttgctatcacctaatatccagtccatactcaagttttttataatcctaaaaggtcttttaacaattggtttgcttaaatcggggttcaaacaaggtccacgtattacatttggttgttttatctcttcccttgacctgtagaaactggtacagttttcctatagaacgaacctacttctggattagctattttgcttccttatggtggtaacattaacttgttctgtatctgcattgtctcttgtgaatgcacattagctctaatgttttgaaagcatgatgaatgtggtcacagggcaatatatggttccccctggtcataggttatactccaaagtcatttctgttccattactatgatagaatagaactgtgtcactcccaggtatacatccctaacagttttcagtgtgtaggtacaagaactctgaccaatatattgccacaggttggggattttgagaaagcttctagagtcagtgttctaaagccacttcttcagcaccttaatcatcataacaagtgcaggtctgtttgtgtaagatgtaggatctttttttctgttttaacaggcaccagacaggttcctgccttcattagtcttctcatggtaggtgcagtcatcttttagtttgtgttgtccttccaagcagccgctttttctcccaatttacacagcaacatgagatcagcattctttccagaaacccactggctcccagtggccctcaaaataaagttcacattcattggtttgccatttaagaccttagttctaatgctaataagtattttaaaacctacatttttacaggacttaagagtttattaagtttttcatatatgctcttctttatttcatctagcaaatactgtattatagaattggttgggttcaggtccacaaatattaagtgagcacagttatttacttaattgtgccatgcacggtgctaagtgctggtgataaagacaagagatagtcttgtttttgaggactctgcagttccttggtgaagacaaatttgaacagatatactaagaccaaggatgtgtggtaggagggtgacaggaggagggggtaagaagagacacttggcagatgcctctctgtacctgccatgccattccatttgcccgagttgcccctttctcttccctacgtatcagaatcctacctatcctttaagacctgggtcaaatgccacctattccccagtgtccacctactgcgtggcccagaacagagactaggcctaatgcggggttaggttagacacaagtcagactttcagttcgtttttttttcttaatgttaacaaaagtcttgagtttacaggtaggaataaagacaggcttccccactgtctgcctgcagtttagggagtttccaggcttaaaatttaatgaaaccagagaagtgaagatacaactggaaaggtcaggattatttgtcaagctttactctgtagagaggatagatgatagaatctccctaattcatataatttaagggaaggcaagtgttaattgttaagtgtttgaactgcagagattttgaacaaatgatgttttcatacattttcagggcatacttttatatttcatagaatagtagaggttgaaaggacaatctaacctagcctctttaagaataacaggtaaggacgctgaagcccagttggtccaagttccttccccaaggtcacctgagagccacattagagcttagaccttggactctgagttcagtgttctttccactatattttacctacaaaatgttaactttgttggagttaatgaagcatatcagtttttctataggcagataagattagaaacaattttattaactgattaaattgccctccttttccttcctatttatttccatcagtggtgtcagtgtgtggtcccagggcagcagcaccagcatcacctggggactggttagaaatgcagactctccagtctcaccccagactctgacactgaattggggtaagaggtgtccaacctttcaggtgactgtgatgtgctaaagactgagcaccagtaattcaaattgtaagtcagcagatgtttttttgaagttaagatttaaaaattcaaggtcttgtccaaataatctacacattttgaatttgtagagttcacattaatgatattttgcggcataaaatgagcaagcagaagaagaaattagaaaagagaagaaaatgaaaaaagggagaagagccagcaaaggacacctgaatgagagcagttggtcacttctcttagggagaaaaaggaagttgaaattcaggattatcctgcctctagcaggttattcgatctccttttggtgagaaaggaccttgaaatgtcaatgtaacctcatcttcctttgcgcacggatcttggcagacattctttcaggctctgatgacagtacctactttgaaaatcaggggaacgtccatgtaatcgcatcttagcagatgacagacatttataaaggaaatcactgaagtgttactgtcatatctctcagataaaatactggaaggcagaggaagacagaaaagaaaacagggcagacacttgttgctaactttctctttattgaactgcttcactctctccaaggtattcagtctggggagaccagagacaaaaatggttttgagagaacatagactgaagtaagcaaagaactgtgccttcaagtagacttgctctttgttaggataacaggcagttaaaatttatatcatcaatgtatctaggaaagaatagtctttaggtctttctaaggtatgtgtgtcattaatcagatctcatatatttttatggatcctccatgttcaattcttttttttttttttttttttttgagactgagtctcgctctgtcgcccaggctggagcgcagtggcctgttctcggctcactgcaagctccgcctgccgggttcacgcccattctcctgcctcagcctcccaagtagctgggactagaagcacccgccaccacaccgggctaatttttgtatttttagtagagacggggtttcactgtgttagccaggatggtctcgatctcctgacctcgtgatccacccgtctcgacctcccaaagtgctgggattacaggcatgagccaccacgcctggcccatatgttcaattctttttcgtactcctagcctttcccaaagtccctctaacggctaaaaagtgcattttcattcacgagggcagagaacacagagggagagaccttcatggcctaaggatatattagtctttccggaaagtatacaactattctaatcataggaaaccccattctccaaattacaacgtttatgttgtattttgtcataccctgaagtcccaaaactagcttacaccagagcaaaacctatgggtaaggggacagtcttcaacataggcagctgatttgttttaaaagacagtctgggaatggtgtgataccactataccagcgaatgaggaatggatacagaaactgtggtatatacatacaatggaatattattcagccttaacaaggaaggaaatcctgccatatgcaacaacacagatgaactttgaagacattatgctaagtgaagtaaaccagtcacacaaggacaaatattgcatgattccactaattttttttattatactttaagttctagggtacatgtgcacaacgtgcaggtttgttacataggtatacatgcgccatgttggtttgctgcacccatcaactcatcatttacattaggtatttctcctaatgctatccctcccccagccccccaccccccaagaggccccggtgtgtgatgttccctgccctgtgtccgtgtgttctcattgttcagttcccacctatgagtgagaacatgcagtgtttggttttctgtccttgtgatagtttgcttagaatgatggtttccaccgtcatccatgtccctgcaaaggacatgaactcatccttttttgtggctgcatagtattccatggtgtatatgtgccacattttcttaatccagtctatcattgatggacatttgggttggttccaagtctttgctattgtgaatagtgctgcagtaaacatacatgtgcatgtgtccttatagtagcatgatttataatcctttgggtctatacccagtcatggtattgctgggtcaaatggtatttctagttctagatccttgaggaatcgccacacagtctttcttccaaatggttgaactaatttacactcccaccaacaatgtaaaagcgttcctatttctccacatcctctccagcatctgttgtttcctgactttttaatgattgccattctaactggcatgagatggtatctcattatggttttgatttgcatttctctgataaccagtgatgatgagcattttttcacgtctgttggccacataaatgtcttcttttgagacgtgtctgttcatatcctttgcccactttttgatgggtttttttttttttcttgtaagtttgtttaagttctttgtagattctggatattagccctttgtcagatgggtagattgcaaaaattttgtcctattctgtaggttgcctgtttactctgatagtttcttttgctgtgcagaaactctttagtttaattagatcccatttgtctattttggcttttgttgccattacttttggtgttttagtcatgaagtctttgcccatgcctatgtcctgaatggtattgcctaggttttcttctagggtttttatggttttaggtctaacatttaagtctttaatccgtctggaattaatttttgtgtaaggtgtaaggaagggatccagtttcagctttctacatatggctagccagttctcccagcaccatttattaaatagggaatcctttccccatttcttgtttttgtcaggtttgtcaaagatcagatggttgtagatgtgtgttgttatttctgaggcctctgttctgttccatttgtctatatatctattttggtaccagtaccatgctgttttggttactgtagccttgtaatatagtttgaagttaggtaacatgatgcctccagctttgttctttttgcttaggattgtctcggctatgcaggctcttttttggtttcatatgaactttaaagtagttttttccaattctgtgaagaaactcattggtagcttgatggggatggcattgaatctataaattaccttgtgcagtatggccattttcatggatattgattcttcctatccatgtgcattgaatgttcttccatttgtttgtgtcctcttttatttcattgagcagtgatttgtagttctccttgaagaggtccttcacatcccttgtaagttggattcctaggtattttattctctttgtagcaattgtgactgggagttcactcatgatttggctctctgtttgtatgttattggtatataggaatgcttgtgatttttgcacactgattttgtatcctgagactttgctgaagttgcttatcatcttaaggagattttgggctgagatgatggggttttctaaatatacaagcatgattccacgtatatgcagtatctaaaatgggtagattcatggaatccaaacgtagaatggtggttgcctggggcagggggacagggaaattgggagttgctaatcagtggatataaagttttagttaagcaaaatgaataagctctagtgatctgctatacaattgtatgtatagcctaacaataatatattatacacttaaaaatttggtaagagagtagatcttctgttaacaaaataaaataaaaattattttttaaaaacacaaaaatatatttaaaaaataaaagacagggcgatatgggaagctcacaagataacgtcatcacattcatgggtcagatcctgagttgaccactctgtaacctgggacaagccccttaacctctctgaatctgtatggtcttatctgtaaaagggagattggccttctaggattattttaagaattaaagatactaattcgtctggagatatcatgtagattctgaaacttgaaggaacacaatgtgagaactgtaggagaattaaagtgtaagtgaaaggaggaatgtatataatccataaaaatgggaggaatatttcacattatcagaattttatggaaattaatcagaaattaattaagcttgcctttggttatacttttcttccaatgcaaaaattgtttttcggtatttttttttacatgatattcttttcttggcccactttaaaataagtaattatttaagaatcatctatcacttcgttaagcaatctttttgtgttgctgaaactattgattttttttgtcccaacatttttgatttcttaatattcttcagaagaaaataattctttctgtcttgtttggttgtttctttttctttttatcccaatttactttacatgactttcagggtttctggccatttgagtatttgcagtacctttttacatgccatttcttaagttccctcatacttgctttaatggacaatttgttattgctctatacacagagtgacatgttcgcaaagaagctgcatcaccctttatgttttatgaaatgttcctgtactgctggtaaacaaattaagtcttaggagaaaaggcatttgagagggaaagtgtgattctaaagaaagatcccagctcttgtttactaacagggtttgccttcagaacctgaaaaatgaatgaagtattgagaactggcagaaagaataatttatgtacaaccatgaacaaagaaatctcataatttactcctttgttgaacgataagattacattgatctctataaagttaagttgtttaatcagatcacctttctatgatgagttctactttgaatatttggttaccacatataatcccaggagcacttaaaagaaaaaggaagccattttttatttcaaatactctgggtaaaattccagtaatgggagcagcagtaaaagcaatgagtgttgaaaaattagctctgtgcttgtctgtctttgcaagttggtgaaaaagcaggccaaacatctctgcttcctgaggaatggagtactttgtacaggaagatgggaaagcagtgtgatcattgggcattttagttcatgcccttcacaggctggttaaaattctcatctccaccggaattggcacacagatatggggcaggccaaatgcatggatcaggaaaacagattctgcccgagccatgtgtgcctggattttcttagacaccaagaatacacacagtgttcattccttcctgcggcagccccagactgtagcacctgaatgcctgtaggcagatagagaagagcaggtccctctagccacttactctgtttaatttttccttgttcttttagaatttattgtagtctgacagtgtggtatttgtgtgtatgtgggcgggtgtgtgtgtgtgtgtgtgtgtgtatgcacatgaaatgctggttatgttaccccacctcagtacaacataagctccattagagtaggaactatcactttgttcaccagtatcttcccagtgcctggaacagtgcctgaagcctagtcactcattaaataagtattggttgaaatgaatgagtaagtcagtgaacaatagcttctaatgaaagatggtattacttctctgaaaatctgattgagaaaaccagttgctttcctgtaacatctacgccaccattagcctctagggctcttatatgaggacgctcatttcatttcagtgttataataaaaatgtagctgaactatgagctgtggaggtgtttatattggtgctacagttaggagggtagtctgtcctggaaatgttggtaacttagggaaattgtactgaagatttaaaccagctaagagcaaccagcctaaaaattaagctataagtcagtgaagttgggggaaaaatagtcagtcatgttcaaaaagatcatcagtctgaatagatatgcagtccgaaatagatttaataaacggaaaatgaatgggccctaaaagtataaaatagacttctcataatttaaggaatgggccctgcttaatataaaagatagagacccagtgaacacgggaaaacacttcctgaagtcatccaacaaaatcaattaggaacagaatttggaataaaaataacaaaagaacattaacaaaactcatttaagacaaaagaaggcaatggagaaaaaaattagaacgtgttaaaaccaagattaaaatgtaaatgagaaaatataaagagaagacaaatttcaaacggattcaataattagaaacctaattaatatataaaagtaatgctcttctcctccactccacaccagcccccaccacaggagcactggtttgaatgactttttagagacattgagctgttatatgacgatagaaaggacgaaggaaaggagaataaaggcagatggagttggagctaaaaaattcatcacatggatgccactgaaccatacacttgaaaaagactaagatggtaaattttgtctactttaccacaattaaaaataaataaaaacagattttaaaaaagtcattatatgcaaaaaattttaatgggggtttttaatacaacaaattaagcaacaggaacaattgtttcttcaacaagtatttggatggggaagatgtgataaagattctgtcaggatcctttcattgggagagatccctatttccagagacctggcatgaagagaaggctgacccttggggcagctggatggcactggcaggcagggcccagaccaagccaggtggaggagaccatactgacctggaccctgaaaggtaggaggatttgcttgcaggactgggtaaaaagcaaggaaagcaccccaggtagagagaagttgattcagtcattgcatttgcaaacctggaaaatggggcctcagtgtggctagtactgaatccatgttttattttgttttttcaatcaaaaataaatttcagttaaaaatcagacctatgaaggaatagatttaattcttgagagctaaattcttagaggcagcaaatttttcccttttatacaccaaaagtttttttagttttatctttttgaaatggaaacctttggaaatttatattagtctttttcccaccttttttacctttctgtgagacttaaggtcatcataatgaacataaattgtgacagcagtcaaagccctcaagcctgtgagactgtcatattcagccaactgcatttttaagttctggcagctttctaaattatgcaattttgtttcttcttttgctactagcatttctacccatagaagttacacccctcccttgtaattttctgtttccagactactgtgaatttagaaactagacaaattatcttatgtatagattaagggcaagcaaatgctgtgagagggtctgatgattttctttctaatgataatgctctaatatttacactagtgtggactttgtgactcaaatttgactaccggggaacatgagtttcctggtctgcactatattgtcaccaaataactcaagtattgaaaggtgccatgtcctaatgtttacttttgaaattatcctgaggctaggatttgccatgaattaattagggtaggatgaagagggttactgaaacttggaagtggacctagttcaagtacacttaccccattaactttcatgcatctccagatgcctacgctgatctgtgtttgaaactcagaatgatgagtgacaccccaccttgaatcattttctgctgtggtacagggctctgctgggctaggatagttccagctcagtaaggctgttcatatagttttatctttttcaatatcacatttgtattcacaaagatgtctggctttgaagtacaggtgaataatattttttatgatagcagtgaattggctcttcagctgtttaaatggaggatttgtctgagaggttttctggtatctgaatttcatctctctagttcaaaatgcagccttgtaggaggactgtcagaggtcactctcatgaaaatgttttcactgtagttaagacttttaggccccagagtcatgcaattatggatcttgtcttgcaataactgtatatattatatcaacccaattattgctgtcatctagaaatggatcaaatcctgtggaaacccaaagataataaaaagtcatactccaaatagacattttaggtttatatcccagtctctggttctgtggcatgatgcctttgatacctgaggaagatatcttgagacattatgtccttctctaagctggtgttggggaggtgtcctacttccacaaggtgcctgcactggggaagtaggaggtgaagcagaggagtggccaggacctcattttcatcacttgattttcaatatgcccctttggaataaatagtgccttttagtgaactgcttgcggtaccatttaattaatgactcttctatcacaactactgcatcctttcttaaaagactctgacatattgcatctccttatgtagttcctattcccaggaatccctttaagacctgcagaaataaagtcaggggacattttcagttagttatttaaggagatttattgagtattatctgtgcaaagaactttgtatgacatctgggagtctacagtcttattagggaacttttaggagatatagctagaagagtatatggtttaattacagggccgaccctagacaaaaaccttgtctccaatcaataattactttacttagcagcagtctattgagcctttcataggtaatgtaggatatacacgacaaagcaaaacaccaaacagtttgggttaaatgttcaactcttgtaaagcaaactgatcagtgaggactggcctagtggaggtaggtgttacggagatgagactagaagtggctctgaaagaagaggaggaagagatgggcagaaaagaatggaaaggagctgcagaaaagaaagaaggaagaataagtgaagccagtgtgctcacaggccaatgagggcatcagcaggacttgggtgagggtgtggaggcaaactactaaaggccctcaaaaccaagccagggtgctgaggctggatgatggtaattgagagctattgaaagttttgagcagaaaagtgttatgattaaagccatgcaaaagaaagattagtctgatatggaaaacagatgaaataatgtccgcaaagaagttattaaaataatctagccataggtctccaagggcttggataggatgcggccagggggaatggaaaggaaacgagataatatgcaagacactttattatatttttggaattgcgaggccatagtcttacagtttagtggtagctgagatctggaaagaccgttcagatataaggggctcctcaactgttatgtcaggttaaatgaattacaaaggaagggtaggaaatgtgagggagagtcgtctgtgtaacaatggggacatgtttgtaatttaataaaataaacaaaacgttatattgcttcctcagaacttggcttgagacagaaagaaggcaagagaagccttacatttatttgtagttatgaaaagagtatccaactttcatggagaaagaactttgttttgcctttaatattgatgacaccaccattctcttgatgtcgcatccagtgtccaaactgcaaacccactttttacttgactctttcccttaatctccatatccagttacccaaagctaaatacttatgtttaactatacgcttcctgttctcagcattcccaatgcctctatcccaagcccacttgctcttacgtttctttcattggatattaataactgaccatcttacaagggcttgtgtgggaggggtggtagaatttaacatatcaaagtactgtaaaaagtagagacttgaaactgcatttatgaattcaaaaaaagtttagcaactatctaattaaaacagtgtctgactctgttgcattctgaacagaggccactcatcaggagctttaatagctgactctgttgaagatatagtactagtggggaatcaacatattttataaaggaagcacagaggtgtctcaacttgagccaaagggtggtgaaagtgaaaagttaaacccaaaccttggacggcaaacagagcactgcctgagcctcgtatctttcaagaggtgtgtccctttctggagcaagagccagcttggcttctaaaaattgattcttggagacttctggaaggaatgaccccagagtcctttccattattagaatgaagcacagaacacagagagctcttgaccatgaggaaaacctggacaagaaatcactttttttcccatatatgttttctacccattttctaaatgggactgctgtttccgtagaaccaaaaaaataagccaaaaacatcttaagtattgtaagattgatcagctatattatgagcttccaatataatttacctaaagcaatgtagtgactagaatcttgagatgatcaaatgtggtataacacaaacatagtataatgaaaataataaaattctgacaccatttccaaagaataaggccaggttataatattaagtgtgactttcttgatatgattcatatcctgatatttatggtttaacacagtccatctgaatatttatgacattattatcagccagtaagaatgcccattctgtttttcagcttctcccgttggcaacggttacatcaagcctccggttccacctgcttctggcacgcacagggagaaagggccgccaaccatgctacccatcaatgtggacccagacagtaaaccaggagaatatgtcctcaaaagtttatttgtcaacttcaccactcaggctgaacgcaagattcgtatcattatggcagagcccctggtgagtacatgccgtggaaactgcctctttgaaaattcatctgtatgctgaatatactagatttaaacactataacaaaagatggattgcttttcctctggtttgtaaaggttctttaatatcataggtaatgttttaaagataatagttaggttccctgatctaagagaaacaatttgagtgttgaggattttaaaacgatcttcagcaaatactattcagtagcatgcttcactgctgcattttggactaataagcttaatttaacaagaagaagtatcaaagaagtgtcaatcacagaaaaattgtgttcagagtctctgtgatatatatatatctcatatatatatatggcaaaatcttttgtccagtttttaaagtagatgacaagaaaaatcattttgttcaggtggctgtgtggacttcgagtttgagaagttaaggccttggtaccatattgtcagagaaagtgttttgatgagtcgttcagaaataccacttccatttctaaaacttggaaggctataaattcttgactgacttacctttagttccctcattagacacatgatgcccttggatgtgagtgtcttcagttgcagatgcttctgctagaaaataaggcaggcatgagtctgccttacattgattgctctaataggactctaaagagcactgaatctctccaaaggacagtcaggaaggaaggaagcgcaattggtagattcagattacttgttttctaaccttggcagggccacacaccataaaagaaaaggaaaggaattcagagtgacgcagctgtttctgtgaagggcgactttgtacctcctgtgaggttactggggcaataagaagataatcagaggtttgctttgcagaataataacttaaaataattaaatacaatattcttaagcctgtaatacacatctctgaaaatatgtaatagatgatgcacatcatcagttaaaaatgacccttacaagaattacaacataaggtttgggaatcagaattcaataatgtttgttaagtgtgtttacctgaaagttacaaactttgcacattaaaatttttattgtatcagtggatgttatatttatccattctgttcataaagttctcttcatttattgaatttccataattatgggaaatgtttcttgcttttacagtttaaatcatctaaactcatccttactacaggacctttatttccattcactcatgtttttatgtttctgctcctcttactactaataatagctgatatctgtggtgtacttactatgtactaggcattgtgcacaacttattacctcctttaatcttcacaatgaccttaggtagatagcatttatttcctgcttacagatggggaaagttggcacagagaaagttaagtaaatactcaaggtcacacagtgttgatttaaactcaaactaggtggcttcagaacccacatctgaacccctctatactttattgtcagtctttgcacggtcctcttcatgtagaggcactgttgcagatactgttgctaacttcttaaaccaacacaggactctcctgtaacttgagtcagccacctcaagtatccaaagtcccattgcccagaacagggctgacccttggagcctccaaccccttgagagacactgaggcaacccagactcctcccctggtggagggagggaagctacctccatttcagaggatgtgggtcagtttaaagagagagtggtgaggcacaataaagattcatttcaccctgtagccctagaaaagtgcaaaaatgacaggtctagtctctttgaaattgtgtatcctaatgcattttcctgaggagctgtgaagttgtacaaaagttcaaagagatgcttacacagctaggtcctgacaccttttcaaccatccatgtttccaaaataatagtttactgttttttaagaatttgtgaagtaaaatagtttggatttaacattttccctcttaactcaggttggaatttgtttgcgtggagtttgttttttcttcttggaataaggattagatctgaaaaatgtacatgtgccatagcattcttttaatagaagtagacatttttgttcctctctatgaaacaactaaaatgtccccaaacaagaaaaaaatttttaagtgtaagttcttgtcataaggaaatcttccttatgtgcttagagtgagggattcttctgggtgtcgatggccaacaagacacacttgatgtttttagctgaagagatgaatctaatcagtttttagtattattgttttttataaaaagagacttttttgctctatcacccagacctcagtgcaatggcgcaattttggctcaccacaacctcggcttcccgggttcaattaattcttgtgcctcagcttccttagtagctaggactataagcgtgcaccaccacacccagctaatttttatatttttagtagagacggagtttcaccatgttggccagcctggtctcgaactcatgacctcaggtgatcctcccgtcttggcctcccaaagtgctgggattacaggcgtgagccactacctctggcctttttattcccctttgattttttggcagaaatgtaagcttctgtgtcatattcttttcttgtctgctgaaaaatgcttagtaattttctgtccttatttttgcctacttgtaggccagcaaatgtgaatggattcagaggcttgtcagctgattctagaagtgtgaatgggcatttggcattttgtcctgtagctgcaacaagaggtgttatttttgatgtatgtagagtacacttaaggtgaattctattaaatgtcctctactatttctcttgttgagttagcttcttttacaaagacattgaatgctttaaaaccctgaatttatgcgggtttgtatcaaatcacaaaattgtattctattattcttaactaaatacgacttgtatggggatggcaaaggtaattttcaaaaacttggaagtatagatttactatttgggggactactcaggaatctgtatttttcagttttatttttaaaagactaactcggaatttcacacccattagcttgtgtggagcagattatgtacaactttaaattaaagcttaaggttttatttatgactttgcaatatccagatagccaactttaaaaaaaaaaaaaaaaacaggaaataaaaatgttccacaaaacaaattttagatttgtttctttgtaaatatctttctcttgttctgcagaatggctctttgtacccaaaagatgctcaggtcatattcatgaatatttatggataagtcaataattttattctatttttattgcttcatggagacatttaatagcatttgttcttgtccagtcttatcattatttcacctttcccaagcaaagtgttctaaacaagctaatggggtcatctgtgtctcttttatatttttatttcaaaagataaaaactgcagaaaataaataatggatacaattccttcttgcatcctcctccttccctctgaactcagttttcttcttcccaaagtgaatctttttcagttctttaagtaagaatcagtgggtggtaaattactcagtcttgttcatctgaatgtctttatttctccctcatttatcagtgatggttcagctgggaatagaattctaagttgaaattcattctccctctgacatttgaatctttatttcactgtgttgccttatcattgctgttgaaaagtctgtagtgaatttgttatttctttgtgggttctttacttttttccctgtttacttttatagtttttttctttgtctttggtattctgaagtttcactacactgtgtttggatgtgcatttatttttattttcttgttggagactcttgtgcttcttaaattgaggatttatatcttttcatcaattctggaaaactcttaactattaattatatgaatgtcatcatttttccattttccctcttctctttttctggtacttctatttgatgtaaattggactttcttatgctacattgcgtatctttttacccatcttttattattccacctctttgtctcttctgcattctgagtagttttttcagatctgtcttccaattcattaatgttctcttaggctatataacctgttttacctacctattgagaattttaattttgatgactatattttttattcctggaagtgctatttagttctctttgaaagtctacttaggcttcttattttcattgtattttgtttcttttttaagattacaactttgcttttatgtcttcaatcaccttgaatgtgtctttattgttctgttataacactacttcttgtgtctgctaactcttctgtttgttgtgcctgctaattcttgcccatgatggatttctttttatgtactttgaaattttttgttgtgaattctttcattgagcctctttttctgtgagttttccttgcatccacggttgtgggagtgtttctccagcacggttttgcttttgccccttctgttgcccagggttattgctgtccggggccaaatatctggttactttctgcacctagaaggtgacacaactgtatatctcaaacttgtaagactttggcctgtggtttcaaattcttggatgtgaatttttttttcttgttattttacatagaactcaaccagagaccactgggaacatcgtttcatcttcttttaatggtgcatagatttttctctagtccattgtttaggaccagactttatgtaaggcatcttattttctatgtcccacctctcagggcccacatcactgtttcctatcccccagtggacaataaagaaagcctctaggataatgaaacaaacagtcctctccctggatagctactatgctacctcactccctcctgtttttcctttcccttttcctttcttgtgaactcatttctataccttttttaaaaacaaaaatgttatatttcattcaatatttccaagcacttactccgtgtgagcttttgggttatctgagcccatcgtcctgcctgtgtcctctgcagaattctcagtttgctttccaagcagatagagccagagttggcctttgctccgtgaagctcatggtgaggtggggtgtcctcaaggtgaataaaaggaagaataaggggcctgtcaccaatttttcctcctctgatctcatctgtgaatcttctctaaatacaaccctgtccattacatttcttgcacaaaactttcatttcattctttttcactccttgatttggcccaaactgatcttactcccaccacatacctttatgaacccaggtttcttgtctgccaccatgcgtttatgcatgctgacccctcttcctggaatgccactcagcttctcattctgcctaccctttaaggcccaatccaaaatctcatcatctgaaaagcttggcttgatttcttccctgctatctccacacaatcatgcttatgataaaacaacttatacgtatctgcaattctttactttatctaagctactgtatcattctgtcttgcaaactattctgtcctcattgaattacagtaattagtatagactaaactagtaaataccagaatatattacaggttttaagggtaaacattttatgatactttcagttgtgcatgtgcataccagaccatagtgtattttttatggtggtggggtaggggcagagattttctcttaagttgaagaagcaatgtgttagcctataagttccttggaggcaatatctgtgtgggatgcatcttgacacatacacacatgcaaacacacacacacacacacacacacatatcccatgtccccatgtttaggacagtgtttgcgtatcatggacagtacatgttttttgaatgaatgaatgaaacattaatataatagcttgaaaagaatgtctttattggaacctgtgtgtttccagaggtcatcttgccaactctaaactaataaactaataataatagattatgttctgttctttgcacagatgaatgccctaaaatgtgctgagtacaagaggcattgattctcagcctcctactttcaggcatctaaggatacctctttattcattgatatggtcaccttctcctcacactgactccagcaacaggtgactcttagtgatcagacacagtatcagaatatatgctctcattctctatgagtctgtctatatagcatctattactgtagtcacaggcaattaccttctcagtaagctctttccaaaaacaagactctccagtttttctgaattcaagtgctgctatcaattttgactttgtagatcaaatggacaaaagagataaagttaaagacaaaacagcttttcattctgactgatccggatttgactcctgcttccacctctttagtgttgtgtgaccttggaccagccagtcaacctcctttttttctcatttgcaaaatggaagtaacagtacccagctcacagggtggttgagaggattagagggagtgtgtggagcccctgatacactcctgagcatgtaggagatgctcatttgtcctcatcaccaccctcctcattatcctcattggagggctgagatgaatttctggtatatttcctcagaagtcagcctggtgcttcctctctttgtgttcacgcaaacataatggaggcttgagcaggggacttgactgtctcctgttgccatttatcaatactgtcaggtgcctgtcctgagctctgccatggcattgacagagacacaaccacagctcctttcagcagacctggtcttagccctccaggtgctcatgctttgggagatgacagaggcaaacaaagtacttaagagaagacaacacccccaacgatctcactgtatttccagcaaaatacttgaggcctacccaggtgtgaattgtgaagacctaggcggtaaaaccagagatttgaggtaagtccgcctctgagggttttcaaaggctttcaaagaggaaatttcattggttcttgagagtaggggtctcagaaaaaaataagaaccgcataatggccaggcagcccaaaatatgaaaggctggattactcagctaagtaaaccaagtttagaaaatttcaagaattttcaatcacacttcttaggcttttgtccacgcccctccctataacttgaccaatacacaagaaaattggttttttattatagccctgccactaacctgtgcttctggcaaagtcacctacgtgtgatctgtcattgttttctcgtctatgaaaggatagcagccaggccattttcactctagtgtataaaacaaatgaaataaaagcagcattcactctcaaacccctgggtttaaactcttaaattccctgggtttaaatccctgggtttaaactcacttattagtgagtctgtccaggtttaatctcccattgtcccttccaggagctgcagtggaagctaaattggggattgggccaggaattccatctggatctagtctatcagcataaaatgtcatcgggaagaagaaaaagaaattctaacttgcctgacaaagaattactcagaaagaaagtaatttactgtgttttgattttgaaacctggaaaaacgaaaagttttttttaagtctacttgacttaaaaaaaaaatctaactttaatcttgtccttcagcagagactaagaatgagagctgtgcttatcttcatccaacaccctggaattcaaaaacactttttatgacgaaagatgagtgaaaatggggattttcattattgaggttgcttgagccttagtagccttgttcacaaaatagttaacggacaagatgcaggcaggatattttagacattgcccctgtgctgagttaggagcacaggtgtgggctgacagagtgataattcataaaggtgctaactgtgtcatgctggaatggaggcttaaaaataatagaacatgatctagctggtttgctaacatgaaagaagtaaactcaaagtaacacaaactattttcttggggtacacagtctgaagaatccaggatgccaaactctattgcatcacacatcatgaatctgtaatgaaatatgtcatgcttaagaacaaacctgtaggaacatcagtcatggccagccggcacaaacactgaaaggccaggcaattagctaatgacagcattactgcttgctagtgttgttccaggttcaggcagtaacgttgttgacatacctttgttccttggcccagagtctgaggcttccaactcctcctgtgtgttgatgttacaaagctggcatcaggacaactctcctgttacccctaaagttaagtaggacgctgtgctgtaataaggacactggtggcccaccaccaacagatggtatatgatgaatggttctagtcattttgatgaacgggactgtgggtctaagtaagcaagtcctttggcaagtgacatacatactcgtcccagcttcctcttgtgattttagaccatatctgatgagaagtaagagactgaatttaggatacaccctatttttaggtgtaaaagaggttttttcacctctgggccatctagagattgaacattcatccatagtcttgtatttcattcattcacatgagtgatgtgtgtgcagacttctagatatcagaaaatatcagatcctttcatccggaaccctttttagtattttagtaatttgtgaattggaaattctgctgtgctaaaggacagaatgactacctctaattaagtttggatctttatatggcagatcttcataaaactgattgtaatttactaatcatcttcataggcttatcaccatttactaacctcagccatatgatatttcataatattttatcatgcccatttgcaagttggttgtttttctgcactgctctacatgccaatcttcctatactaagcaaaggttacatgtctgttgactaaggatgtgtaaatagcagaaatgccagccttaatgtctttctgcactgtggattccagtcagcttcccagaaggataatcagctagtcttgttggtcaaactcctctttaaatagaggctgctgttgcttcaacagaccaaataagggaaatatagagtaaaagtaatttcatgtagctccctgttgagtgtagtgatagaatcaaagcaatgctgtcctgaaaagagactaaaacattgctggtcagatagggaatatttatatcacacttgacaacatactggctagttttcaaattataaataaataacttttaaaatagctgtttcttagcaaaacagcttagcctggaacgtcccttaaataatctataaagacattcaccaaaaacttgaaaattcaccctaacccagaaacatagcattgttagtagctaaaaagattcaatttaactgctgaatgaggtgatctttcagatgagctcataagtttgttttctttatcatgagtatgcttggagacatgtagatgaaacacatttcttctgtggctcctaaatggaactttttcagatgtgaaatgaaatttaatacaccaccatagtttgattgaaccttatagcaaataaatgatgtgaaaatatcaccaggtaataaaaaatatcagagggctttttacttcaatttaatagtatccaattcaattcattcatggataaggccataatttttatttttatttctggtgactttatgaagagattatcgaagtttcctttttttgagaatacaaaaccagacaaaggtaattcctcatttcggtctagtttttctgatgatatgttctttgtactatttacaaagacatcctttttaatacaaacaaaagatcatctggaagtatatgttttagagtgacagaaaataccaataaaaatacgttcaataataatggcataataccaggtaacaatggctcattccttaaggtcactgtgatgtaatattgctgtgtttccacacaacattttgcattttgacattcctgaaaatcatcagtacagttttcagcaatagcaagttttactatagcattgtagcaattttaaccggcacaaattttgatttctacggtcatgctaacaataagacttgttttattaggtatttttactgttgcttacatacatatctagtatattctgacttttaaaatttcttaaaacacaatattctatttgataatatttcctgatgcttttgggaatttctactcaattcctaagttgtaatcacataggttgaaggcaggggggttggaatattcctgtaggctttcccaagatgattcagccatgaagaatgtgaacattcaaggaaaagactatgcaggccacagagaaggaatgtctggtgggcacagtggctcacacctgtaatcccagcaccttgggaggctgaggtgggaaaattgtttgagtccaggagtttgagaccagcctgtgcaacgtggtgagaccccccatctctatctacaaaaaataaaaacaaaaaaattagccaggcgtggtggcacatgcctgtgcttccagaggctgaggtgggaggaccatttgaatgaggctgcagtaagccgtgttaacaccactgctctccactccagcctaagtgacagagtgagaccttgtctccaaaaaaagaaaaaaagaagaaggaatgtctaagaagtaggaggagaacagatgggaggtggagggcaattcaagtggaaagaagggagtgaacattgcagctaaaagatccagcatgaaaaatggccaccagatttgccatttggaaagttactggggtccctagggagactaattttagtggtgaaagaaaggccagattgcaagtagttgaagacattttgaataggagaggaaagaaagacaggaagtgtagaccacccattggagaactgaatatgagaagagggttagaaaggaaaccacagccgggcgctgtggctcatgcctgtaatcccagcactttgggaggccgaggcgggtggatcacgaggtcaggagctcaagaccatcctggctaacacggtggaaccccgtctctactaaaaatattaaaaattagccaggcgtggtggtgggcgcctgtagtcccagctactcgggaggctgaggcgggagaatggcgtgaacccggaagtcggaggttgcagtgagccgaggtggcaccactgcactctagcagcctgggcgacagagctggactccatctcaaaaaaaaaaaaaaaaaaaaaaggaaaccacagccagaggtggatgtgtggtcaaggaaggcactacgatgaaaaggtttaagcatgttgatagctgagagaaagaccgaagagaagggaagggtggaagacaggggtcactgaggagctggctgatggagccatgtcctgaaggagataggaaaagatccatccacacacactgtagtagacactgaaagtctactgagtgaacataacatgcacagttagaggggtatattgggacaaataaaattgaaaagaccaacaaaatagaaagttacccagaaacaaacaaatgaaggttgtatcttacatttcttagtagctgctgtagttcttttttttttcttttttaaagaatgcctatgagagctgctcttttgttcaattaaaatgaagattaactttgtagctgaatttaagtgaagtttctcttccactgttcaaataatggatttgtacttagggttgttaaatgtggcagagaaataggctccactgaaatgagcaaaaccactgcaaataggacagattatctcaagagattttgcttaaaaaaaaagtgccaacatattcttccagatttacatctgccttcagttttcatagcatagggtactgggcagcatcttacctgatagtaccttggatttatttgtgctgtgtcttctgtatcattctcttttgtttctttttccccagtattttaggtgaaaggcagcatttattatttcgcttaagaaaattcattttaataactaaatggaataaaaggggagaagttttgtcagggttttgactatttctcattagttattagaaacctactcaggatgtcatagggtgatgtccatttttacaaactgaggcaggttatcaagggggctaagtcttccaccagaagtccagtgatccatgcagtcagtcaattgacatgaccagagtacatcttcaagattaatcacaccagtggggtgccgattacccctcatgatggggaagtcatttggggagtaatggtcagtattcagaactgtgagtcttcaggctcactctttagatgtttttccaaacttgagtcaaagttggcacaaatgagatctgatgagaaaaagatgtcagacatgaaaacatttgggaccccgttattctttggttcatacgaagtagagtgcctgcggctgggtgtagatagttctgaacaaaacgctttggtgcattttcacagttgggtccacagctctctactgtgaagggtgccaccacatggggtgaggaagctcaccactaggcatcttcccgtgttctggtgaagaagagagatcctaatggtggtagttccattctgaaattctttattaaccactaagaccagacatttatattataaaatttcactgctgctgatatcaaaaccctcaactgattatgtgtatcctcattttttctaaaagatagctgaagcttagagaagttaagaaagggccataagttgagaggacctaggattcaaactcaggtctctcagatttcaaagcccacacccttaactgctacatccactgttgtaataattaaaagactttaaaatagcatcttaagcaaggttagtgatatatttaactaattgaataatctcatattaactccaatagcattgctgggttaaacacattcattgaaatctctctaaatgcccagatgtcaccacaacgcagtatatccatgtaacaaaactgcacttctaccccttaaatgtaaacacatttttaaaaaagaaatatctctgagggcagtaatactttggatctttctagattagtgaaatcttacctgtgtggagcacacttgaaattttggaaggccactaaaaagttagaagtagaaagttatttgtattaaatgaccccttgtataatacctcaaataaaacacgtcttgatatatcagactccctctagacttctaagtgactgtggcctgtctgtctggccatctttctttcctcctaaagattacagagatgtatgatatgaaaagattgtgaagtgaagatgtaattcgtgtacaccaaaattgtttgaaaattaaggtagagggcgatggctttcctcggcccttcttagttagatgtggacacaaggagtgtttaaagtctgtatttttttaagctgagagtagggaagattggaactcctcagggtgtgagaagcacaaacagctgtattcctatggaaatactgaaactcctgcagaattcttcagcgcaggagaaaattccccttgcgtgggttgggacagcagtagtctctgattcagagggagaaaactcaaagagaaacccagagtgcgaactgaggactacatcttacttctcacgcagcaggtgaggtatctctgagatttggccacccaaatccagtctgcaaatggggagaaatgaacagtggtccgttttatagctccaccaggaaaagatcaaaaaaattggagaattgctattagaataagttttgagagtatcttatgtcatctttaaaaacgagacattgtaagattttaacagtgatgataagtgatgcatcacgacctcctgtttttagtttttgtttgtttgttttttctaaagaatttaaaacgtaaacatatgcaaacagaatagcacaatgaacctaatggtcatcttcaacaattatcaactcatagccaattcgttacacactccctgaaccttcccctgatattacttgaagtgaatactagaaacaaaatcatctcatctctaagcatttccatatgtatctctaaaaaaattcttctctaaacaaaactgcaatactattactacatctaaaaaacttacaacaatcccttaacatcatcaaatctcccatgtgttcaaactgccaattgtatcatgaatgtcatattttcttttaacaaaatatttgagtcaggatccaaataaggtccacacattgcagtagacttttaaagaaatcaacagactccccctccatttctcttttttttaccctctcaaaacttatttattgaggaaacgtctttctttcccgctctttccttcagtctggatgtggctgattacatctttttggcgtaacgtaatatattcctctaacccctgtatttcctaaaaattggaaattagatagaaaggcctggttagattcaggtttgagcttgttgtttgtttagtcaagactatttcatactgctttcttccatcagaagggacgtaatgtctgggtttcactttttttgtgctgtgagcagccactgatgttcagcgccaagtctcagtattttgggttttcccagggccccaggtcctcatttgttcactgtcactcagtgagctggggcatctggtcagacctaaggtcttcagctttagccagctaagaactttcagggacccatcaccccaaagttatgctttttcagaatgattttgtgaaaataaacatattcaattcaattcatgaaacttcagtacataaataaaattgtaccaaaatatagaacaaagacaaatttttaaagtatacgaagtctttctattcttacttgaagtatactgttcttacttgatgaatggcatcattattttgagcttcctttgccataatcagtttccacttgttggttaaatacccattgtgtattctgtgctaattttgctttactacttatttaatgctctttaaaaaccaggatatctgaatgtgtagatcttggatttcatgcaactggtgtgctgcagtagaactgcaagcagaagcatacctttacagttctcttttcttttctttattttttatttttattttttgtgggtacatagtaggtgtatatatttatagggtacatgagatgttttgatataggcatgcaatgcataataatcacatcatggagaatgggtgtccatcctctgaagcattatcctttgtgttacagacagttcagttacgctcttttagttactttaaagtgcacaattaaattattattcgctatcatcaccctgttgtgttatcaaatactaggtcttattcattctttctaacttttttttttacccattaactatccccacctccccactaaccccccactatccttcccagcctctaataaacatccttctactctgtgtctatgagttcaattgttttaatctttagatcccacaaataagtgagaacatgcaatgtttatctttctgtgcttggcttacttcacttaatgacctccagttccatccatgttgttgcaaatgacaggatctcatttcttttttatggctgaatagtacttcatcgtgtatatgtgtcacattttctttatccattcatctcttgatggacacttaggttgcttctaaatcttggctattgtgcacagagctgcaacaaatgtgggagtgcagatatcttttccaaatactgatttcctctcagtatttggaaaagattgctggatcatatggtagctctatttctagttttttgagaaacctccgaactgttctccatagtggttgtactaatttacattcccaccaaccagtgtatgaaggttcccttttctccatatgcttgccagcatttgttgttgcctgtcttttggatataagccattttaactggggtgtgatggtttctcactgtagttttgacttgcatttctctgatgatcagtgatgttgagcacctttcatattcatgtttgccatttgtattcttttaagaaatgtctagtcaagtcttttgcccattttttgatcggatgattagatttttttcccatagggttgtttgaactccgtgtatattttggttcttaatccatgtcagatgcatagtttgcaaatattttctcctgttctgtggattgtctcttcactttgttgattgtttcctttgctgtatggaagctttttttttttttttttttttttttgagacggagtctcactctgtcacccaggctggagtgcagtggcgcagtcttggctcactgcaacctctgcctcctgggttccagcaattcactgcctcagcctcccaagtggctgggattacaggcgtgcgcccccagcccagctaattttgtatttttggtagagacgggatttcaccatgttggtcagcctggtctcgaactcctgacctcgtgatccacccaccttggtctcccaaagtgctgagattataggcgtgagccaccctgcctggccactgtgtggaagctttttaacttgatgtgatcccatttgttaatttttgcttgggttgcctgtgcttgtggggtactactcaagaaaatttgcccagaccaatgtcctggagattttccccaatgttttcttgtactaatttcatattttgaggtcttagatttacaggtctcttttctgaagcaggcctgagacttacggatctttcccttgtattcagatggctctcttctgagctggagcaagtttgcctctaacctttcctctctttttatctctctatccttcctcccctcttttctttcttcctccatccttcctttcttcccttttattccctctttccttccttccatctttcttccttccttttttcctcccttccctccttcctgtctttatttcttcactcatcctttctttcttccctctttcttatattctttccctttctccctttcttcctttcatcttttgttctctttattttttagctactatggtattctgtcccctaggtgtactctcaagtctcatctcactgataaaatctatgttgatgcaaagataatcttggtaatgttaaaatgtgaacctgattctctgttcgcaaagctatctttccaaatgcatacagttatagtcagccatttaacacaccctgataacttccaactgtgtactaggggtatggaggagacagacaagttacaacatggtgggaatgctaacaagaataggtgcaaataatgtactgtgtgacaactaacaggtgactctgctagggaaaactgcgggggggggcttcatctgggaaatgacatttaagctgagtcttcaaagaatatgattaagacagtatatttgtgtgcaggtgcagtggcacgcctgtaatcctagcagtttgggaggcccaggtgggcggatcacctgaggtcaggggttcgagaccagccaggccaacatggtaaaaccccatctctactaaaaatacaaaaattagccaggcatggtggcacgtgcctgtaatcccacctactccagagcctgaggctgaggctgaggcaggagaatctcttgaatgcaggaggcagaggcggcagtgagctgagatcatgccactgccattcagcctgggtgacagagcaagactctgtctcaaaaaaaaaaaaaaaaaaaaaaaaagatagtatatttgtgtaaaaatagttaaggaaaacttagcaacttagcatgttattttattgcagcattgaccccaagttcttagctaatggacttgacttttatgtatagcaacaacttatatatatatatatcaactttgcttattggagaaagtgagcctgacaatatgttgtttccttcatatgtatgcaaaaatgtgtaagtgtaaaataccatgtttatcagcttcccatctaatttgtagtgggacaaaaataacttttaggtaggtatggggagctttgggatgtgggtggacacagtcacctttctttccccgctgtggcaggatcttcttttaggtagtagtgaaagaggattgccttctgtgctcccactatgtgaactcctgagttgttgtaggggtctacagacccacaggtgtgctgagttatcatttgtctgagttttaaggtctcccatatagatgtattcccatgtttctagtatgtataaaagaagtatttttgctactctagtacagaacctttttttccttttttttttttttttttgagatggagtcttgctctgtggccccaggctgagtgcagtggcatgatcttggctcactgcaacctccacctcctggttcaagcgattctcccacctcagcctccctagtagctgggattacaggtgcccgccaccacactcagctaatttttgtgtttttagtagagacagggtttcaccatgttggccaggctggtctcaaactcccaacatcaggtgatctgcccacctcggcctcccaaagtcctgggattatagccataagccaccgtgcccggcccagaaccatttaaaagtatcattggagctgtagtattagctctctgtcattatgtatagttttaaacaatagattctaaaataaaattactatcttatatgtttggagtgtgtgtgtgtgttggttaagaagtttttgaacatttctggaactaaaaggaatcttcataaaatagataatgatgatgtttgaacaacatttgaatgtacttagtgccactgatttctacactttaaagtgctaaatcttctgctatgtatattttaccacaataaaaagtattttttaaaaaatttaaaacttaaaacaagacatatacacagaaaataaagggattttcatatttgaaaaaactggacactactgtcctagaacttctattaatctggcaaatgcgtagccagcaccaagcgaaatgcacatggtggtctcacctacaagcctgaggtttcatcaagagccttacaaattccaactactctgtctccattgcaaaatatacaggttcaaaatgtgtattcatctaaaatacagagaatactgtgtttttatgggtaaacaaacattttctgttcaaagtatactatttagatataatgaataaatactatatgtattcatcaatcaacagtgtctgaaggttcacagcatgtcacatgctacatgtcaggtggaatgctgcatgtcaggcgagccatgctctgtcctgtgactttaagtgttgaaagaaacagaggtcgctgcatttctggggcctgccacctagcagggatggtgctcggtgcctcactcatgaatgtgtaattgcacaagatgatgactgtgatgtgactttactctatggtaaggtcagtgaaaggacaaatacatgaggctttgcaggcatgtacagggagagacaccaggtgttaggggatggctcagagaagggcttccctgaagaagtgatagttcagctgaggtttgaataatgaacaagtagagacaacactcataagaggaaattaaccacatttcccctctcagactcgactcttctccccagtagtgtgtatcgtgtgttcttcagtgttccaccccggcatgtagcatttgacgcattgtgaaccctcagtcactgttgagtgatgaataaacatatagtatctattcattatatctagatagtatactctgaacagaaaatgttacccataagaacacagtattctttgtattttacatgaatacacattttgaacctgcatattttgcaatggagacagagtagttgatttgtaaggctcttggtgaaacctcagacttgcaggataagaccaccatgtgcgtttcttcaagaacaaagacagttggggcaggggtggggcttgtatatgccttaggtaagatcatctttgtgagtggaggagaggattggagaaatgattagacccacagtgagagggtctatgtgagcaggtacatataaatggagtcttgctagggaacctgcattggccaaagtaaaacttaatattttttgatatataacttttgcattgtttctaatcctcaaccaaattttggatcagaatgaacttccataacaaagacatatatatatgtgtatatacgtatatatatacaggttcaaaatgtgtattcatctaaaatacagagatatatatatatacacacacacatacatacacacacactaacacatacacacacacaaataagggtaagtaacataaaatgctctgctggaggcttaaaaagcaataccgcgtgagttgagtcattttggaaagggtgaattagcaatatatattattctataattaaaaattcaagttgtccgagttttaaaaagctctctgaaagagcacaaagaaatacgattttgaaaacgtataatacagtcagcataaaagctctatttcctttgtgtgaatgaacatttcccatgtaattaatttacttacaatagatacttcaaatccttctaccagatatgtaaaaatttctttctgaaatgcattgaaaacagaaaactattcatgatgaatattttcctcagaaatttcagtttggaaaactgaggtcttgctttgagttacattttctggagttctcaaaatgtcaataatgtctgaattaaactctttgaattgaaaaaaaaatgctctgctggaagatcagttaaggcttcctaatgtaaacaaagatgtaataattaaggtgaattgtttctgtagtagactcttgttactactgatattatttttgcagagaactagatgtggtgcaagaaaaatcacatgccccaaattcaccagttacacctagtaaatgtatgattggtaggttctccctcagtaccagtctaataaataaaccttactttgcttctaaatctagggacttggaatagtgaattgctttcaactttttattttattttatttatttttattttttaagatggagtcttgctctgtcaccaggctggagtgccgtggagcaatcttgggttcaagtaattctcctgcctcagcctcccgagtagctgggattacgggcacacaccaccttgcccagctaatttttgtatttttagtagagacaggatttcactgtgttgaccaggatggtctccatctcttgacctcgtgttctgcccgcctcggcctcccaaagtgctgggattacagacgtgagccaatgcgcctggccgtgactttttattatctgtcaaatcccaagataaatattaaatttttcaaataaattttacggtttttattatgttgttgccattgaagacataggaccacttatagcatcagattctttttataaaattggcaaataagtttatttatggtgttacaacatgatgttttgatatatgtataatgagtaaatcaagctaattaacatttctatcacattacgtaaattttttttgtgatgagaacatttaaaaatctactttctcagcagttttcaagtatacaatgtatcttagtccattcaggctgctataacaaattactataaaataaatggcttatcaacaatagacatctactgctcagagttttggatacccagaagtccaagatcaaagcacggggatatttggttgctggtgagttccccctttctttatagatggtgccttcccgctgcatcttcacatggcagaaggggagaacaagctccttaggacctcttactgatcccactcaggagggttctgccctcgtgatttaatctcctcccaaaggccccacctcttaacaccatcaccttgaaggtttcagcgtatgaatttttgggggatacattgaggccatagcacaatacattattaactgcagtcaccatgctatacagtagctctccagaacttattcttcctatctaaatgaaactctgtactctttgatcaacatcttccatttcctctcattcctctctcgccagcccctggtaactaccattctagtctctgcttccatgaatttgacttttgttgatttcaggtttatgtgagattgtgcagtatttgtctttctgtgcctggcttatacactcagcataataataatactccaggttcgtccatgttgtcaaaaataacaggatttccttcttttttaaggctaaatcgtcttccattgtatctatatgtagcacattttctttatccattcatccactgatggatacttagactgactctatattttggttattgtgaataatgctgcagttaacatgagcatgcagatatctttcaagatactgatttcattttctttggatacatacccagaagctgaattgctggatcatatggtagttctatttttaattttttgaaaatcctccatacttttttccacagtggctccactaatttacattcccactaacaatatacaagagttctcttttctctacatgtttgccaacatttattatcttttgtctttttgataaaagtccttatgacaggtatgaggtgatatctcattgtagttttgagtttccctaagtatcagattcttaatgttttggtcaaagagacatgtattaagatgaatagcaagagtcgtggcagtaatgatcaaacataactactatggttacaatacctaagggagaatacctcactcatttaaaaattggtgcctcctgattccataatgagagaaatgagtgagaaaaaatggaacaataatggcatttcttttatactatttaagagactctaataattattcttgcatatattctttttctttctaggaaaagccattgacaaaatctctgcaacgtggagaagacccccaatttgatcaggtatgtgatatatatgttatatactagttttcctttatttcagcattcacgcaaggcaaggtctgcatgctcactattgttgtatggatgaacatcctcaaaaagtatatgggtatgtggtcttaagaactgtaccctgcagttttcatggttgtggtttatagctgttcagtaaatgtctattggttagaatcaaaaagaactggaaagtattgggataatatgagtaggtcttcaattgattatttcctaaatctttacatatcagaattaaagaaaccaagaaaagagagtttaaaggaaattccattcgtttaaaaacttgagattcttctaaatgaatgatactaggtgatgatcagatctctgcactagagcttattcttgttttcatgcaacatttttttgaaggcctactatttgcttgacgctgtgctaggtactggtgatacaaaatctaagataacttttaggtcttcaagaattcagagtcttgtgagaaagatactacctcaaaataagtataaaacagtataggatcttagattctaatagagaaaataatacatgaacaaaatgatttaagacagaataaatacaaggtaagtcctttgaaaataggttaggactagtaaagaacattcaactctaaacagtaggtaataaacatatgaaatcaggatctgatagattctggttcagtaaccaggaaggccctaggcatgtttaaaaatgatggataacaggacatccaaggaggctggaggtatgtttgtgaagtttcctaaacttttgcagttaatgacaaaaaggacattatgttcttcaaaaacctcagttggtgccaacgtcagacacaaaatactgctagatattccctggcttgtggtagtacggtgtttttatggtctaatgaaaaccacacagggtgtacactttctgtcgggctttgaaactgcctttaatatgaaatccagaggaagtctccctggctgtacaaatttagacttgtatgatccagaaacaccatgactgtacagacaaaatcctttgttttctattttatgagctgttctgtgaaggagacctcacaggtttatgctcacagccagccctgcaagggtggcgtggctctgggctagctctgttgccagccaagctagccattttccagaaggctggtgaaatggaagatgggcctcatctctttgtgccatggcactatcttcttttgtcacattgtccattgttgttgtcacctggcaggtgctgaggtggtcagagacccttggtgaatacggtatatgatgtttggggttaccattttggaaatgtggcaagttgtggctttttaagaataaatatcattctcagcaaactatcacaaggacaaaaaaccaaacaccgcatgttctcactcataggtaggaattgaacaatgagaacacatggacacaggaaggggaacatcacacaccagggcctgtcgtcgggtggagggaagcgggagggatagcattaggagatatacctaatgttaaatgacgagttaatgggtgcagcacaccaacatggcacatgtgtatgtatatatgtaacaaacctgcacgttgtgcacatgtaccctaaaacttaaagtataataagaaaaaaaaagaataaatagtgctgggcgcagtggctcacatctgtaattccagcactttgagaggccgaggcaggtggatctcctgagcccaagagttcgagaccagactgggaaacatggcgaaaccttgctgctatcaaaaatacaaaagaattagccaggcatagtggcacatgtctgtggtcccagctattcaggatgctgaggtgggaggatcacttgaggaggtggaggttacaattgagccgagttcacgccactgcactcaaacctgggtaacagtgagaccgcatctcgaaaaaaaaaaatgtacatacttatcacctgtcttttattagctttccactctattttatattctttgtctctttatcttattaaattatcactgtcctttcttcaaaaacatttttctccagcttaatgtacctctctttatcctctgagaaaatcgttctaaattttaactttgcagataatagtaatcccaaataactaggcttaaacacaatttcttatttgttactcagctttctatttctgaatctcagtattgtggaaaagacatgacctttggaattagacaaacctgggtttaaatcccacctttgtcacttaattagctatatcacttttaactttgcgtctccaagtgttgtccatggatctgtgtcatcagcatcacctgggagcttgctagaaatgcagactgttagcctggccccagaactgctgcatccgccacctaacaaaactcccaggtgactcacatgcacattaacgcttgagaagccctgccctgtaacatatctctatgtattaaagacactttaagtgtgaaccaatagtaagatggtcactaagaactttcaaataggtcacataggattgtcctctgatcattacatcataaactcacaaatgaactgtgagagaggacaagccacaaaatctagtccagttttaaagtgatagcaagactttcaggcctgatatggtttggctgtgtccccacccaaatctctcctcgaattgtagctcccataattcccacatgtcatgggagggacccagtgagaggtaatcaaatcatggggggccagtcttccccatgctattctcatgatagtgaataaatctcatgagatttgatggttttataaagaagagttcccctgcatatgctctctcttgcctgctgccattgtaagacgtgactttgctcctcattcacccctgtgccatgattgtgcagcctcccagccatgcagaaccgtgagccaattaaacttctttcctttataaattacccagtttctggtatgtctttattagcagcgtgagaacagactaatataaagccatagagaaacttgactaaggttggtccacctgtagattcagtggggaaaaagttggcaaagcataatagcttttgaaggtgcttactgtggttcaaatgtgtaccctccaaaattcagctgctgttaatgtgatagtatcaagaggtagggcctttaagtggtaattttcccatgagggcccctcccttgtgaatggggttaggtgctcttataaaaggtcttgacagagggagctcctctcttttggtcctttctccatgtgaggacacagtgttcaaggagccatcttggaagtagagaccgaaccttcaccagacagtgaacctgctggtgacttgatcttggacttcccagcctccagaactgtgatgagtacatttttgttctttatcaattaccaatctcagcagcactaaaacagtgctcatctgctgtttcaaccaacaaactataagaatttcagttccattggtaaggccatgaatatagcaaggtctcttagtcctttggcattaaacattcaaattatatagttttattccaaacagtaggattttaatctgggttgccacagaagtctgtctatgggaaaagaatatgctggagatgccaccttgagtggttcagactccattgctataattgtaggagtagttgtaatagtagagatagcatttatttagtacttatatgtgataggtactatgctaagtgcatcctttgaacaacatacagttggttcctgtttaaatgatatttgtatcaagttctttcttctaaatgtcactggcatgaacaacagggtatatagagctaggtatctactgtttcactgactaatcctgaatggccctttttactcctctacctaaccagcccatgattcattttcttcttgctagaaatagaagcaaaaaaaaattcatgtaatactttatagtttacccagccccttctcatattatctcacctgacatcactcagtccttccagcaactccaagaaggtattatctctatattaaatataatataataatattaaatataatattaaattatactaacattaaatataatatattaatattaagttaaattatattaacattaaatatactattgtattaatattaatacactattatgttaatattaaatatatctataggatatataacattatatttactatgatattatatttaatatagagatgataataatggtgagtctcagaagtttcccaatattatatgactaaaacctgaaggagccaagactgtaatttattgtttctgacaatacagcctgtgctttttactccataatctttgtttctaaaaactaggttgatgagagttcagagggaagttttcagcaggtaaaggatctaaaatcttttatcagttatgattagctttggctacaaatggcaaataaagtaaaatcttcttgagcaagattattttttctttcttatgtatggcttacattctcaaagtccagtatggctgctagagcttggccattgcatctgtattccaggcagccagaaggagaaatggaaaaagaattatagaaaaacaaaaaacaaaactttccaacatagcatataccatttctacttatatccaattagccagatgtcaatcacatggccacatctagctataagaaaggtggagaaattttactttgggtgactatgtgtccgtctaaaaatggggtattttatacctaaggaagaagaaaagaaaaagaagaaaacctgttattgggtaacagctagatgtatccactagatatttagccaaaatgcccaaagtagaactatttacagttctgtacctctttctttcccactgtgggtttctcctcaaatttgccagttttccagtttgaacttaaatatacatatatatttagaagctaaaacttcatgttttcttttatattttatatttttacactcataattttattggtttagtatttctaaatttaacctaattacactccaactctgtaagaataaacctggaagggcctggcgtaatggctcacgcctataatcccaacactttgggaggccgaggcgggtggatcacccgagctcaagagttggagaccagcctggccaacatggcaaaaccccatctctactaaaaatacaaaaattagccagacgtggtggcacgtgcctgtaatcccagctacttgggaggctgaggcaggagaatcgcttgaacctgggaggcagaggttgcagtgagctgagattgcaccactgcactccagagtgggactctgtctcaaaaataaaaaataaaaataaagaagaaacctggaataaagattttataaatgacaagatgtctaaacaggatttttaaagctcagtgttagtaggagaaatatactagtgaatgctttacacattggagaactaggaatttgtgccctcatttccagaatttcacttttcacaaacttcaggaatatgagtttttttccattgttatacagcacctacctcctggcaaccatgtgccaagcattatgccaactcatggaaacaaacaggaaggaagcatagtgcctgccctagaggccccaccactggagtctcgttggagagaaaaatagaactacaatcagataaatgataaccgcagactagtaagtaagctaaagcgggtgtgagcctcaggagagcaaacttcgccctgccctgaggagccagggaggccttcatggagcaggcagcagaggttcagagcagtatgggctatcccttctggtccatgctagtgataaagtcataccagtaacaagaatcaataaaggcagaagagaattccaacagcatttgaagatgtatatactatcactatttattttaaattactatagtaactgtcagggcttagcgagtaaaaggaactaaaaatcgttctggtaataaagtaatttagcaaacacttactgtgcatgtgtatatgtatatacatacacacaaagttttatatgagacaaagagatgtaagaatgtggtccccaggcatgtgtttcacattccaggagctccagatctggaagagggtcaggcagtgcacaaccagccttgacataggcctgcatgtgtaagaagtgccacatgaatggtgtggacagtaaatatgctgagacttcagggacagaagacacatgcctcaggaccagttgcctagctagaaaatgccttctagatgagaacaagatttatcaggtgcctaaagcagtagaatcgataggatttgctgagtgttgatgatgaggaagataggaaatttcagaagaaaggaacattttatgcaaaggtcctgaacagaaaaatgacactatcagttatctttgaggaacctagaaattgatcaatttagttgatgcagaaggcatgtattgttaaaggataatcttcaaaaacaggcaaaaatatgactcacatagagatataaaatgaacctgtattaaacattttatttaacttgttattagtgcaggatgttacaaccagttaaattccaaaaaacagacacatttataaatcatcattgaaatgaatgcaatcagaggcaaaactggcttctttcatgtgggggagggaagtccactgaaccttcactggacagtttttcatgtctatagacaagaattattttgcattgctatcaggtatctaccatttatacaattttaaaatagctcaaaggcattgacaggtatagagcccccatagactcagaatcagataaccccttgagaggtatgctttagttttccattgtaaacaaacatttcctacagtctggcagaagttaaaaaagagatcaggcggcagaggtagaaagggatcagattgtggaagatcttaatgccagtgggatggggctgtatgcataccagtatcaagttgtcaacttgatgttagccttaaggagacaatggtcatgaaggcagtaatgaagagacctaaggcatttggggaacatggcattgataaagattctaagctaaaggggcctaaactaaaatggaggcagtgagactataagaaaggacgattataagcaaaattatataagaaggataaacattggttgagaaaaggagaaacaaaggataactgtagttttaagcatgatttggagcgatttccattcaattaaacaaacaatgagtgcctgacacatactaggatctgtgcaaggtgctgaagtcacaaaaatgaataagacagagccctgtcctccaggaattctcaatcccagaaggaagacagttatctacacaaataaagtggcaatgtaaacgctataatagaggttgtatcaagtgctctaggaactcagataaaggaggagttaatgatgctaggaaggtacacaagtgtgtgctacaagaagcaaccaaggagcagtgacatttaaaataagccttttatccagatgaacaaattgggccagggtatgccaggcagcaggggtctcacagacaaaggagaagttgaaggtgaaaagagcagagtgctgggaatgagggtagaaaggtggactgagcccattgcagtgggtagtaggagccgtgctgaggggtctagattattttctatgggctatgagctcttcaagcagaggaaactatacttgggggcagaagacaagagaaggctgtaaatccgttatgcatactgagttttcagggaaggtgaaatatctcaagaaaaataacgggttcagtttattatgtggtcactcaacaaacactgatagagactagagcacataagtaaagaacgtcataaagagtttagtatcaggaggtgggatctacaaaagaatggctagaaaaagggtagtttggaaagtgggagaagtctagagatagtgctctctagggcagggatggcccatcacagcagctgatgcagggacatcacggaagatgcagaccaggaagaactggaggttagcagctaggagctcactggaagtggctttgaggaaggcttttgctgcaatggctattcatggatgtgtagagtgcattttcatagtcgatggactaatgttaaatactttgaagcttactttcacaagctaagttatagtggctgattatgattggtagcacctaaataacaaagcagcgtgctagaacataatcatggaaccagtgatgagttccttatctggcatctgtggagagcatctatgaatgaaaggcatgtgagctcaccattttaccttcaagtggttttcttcgttgtacagacatctttttacaataaaagtccacagcattttatttcagattctccaaagaaacaatagccaacaacaaagaactactcatccaaccgtgatgagcgtgggcctgggtgggtgatgatcaaattagcccatttttaaaagtgaaaaagcaacactccaaaataactcttacttgagggagtttgtgacccttacctgttggagattgtattaatgacagccactagatacagttactctcagaaatgaaaattctagctgatgaatgaagtcagaaacgaatattctttcacataccttccagctacatgcaaatgcttgcttgttgatttgctctgcccttggcttttagacctttgcttatgtagtatttaatgatgatataaacatacaatgtgttaaataataccaaaaattgtatgctgtacaatgtttttctgtttgaagtattatttcaacttttaaaacagtctcatacagtaagtggaagttattttctctttgcataataaagtctgattactctgcaaaggagcatgtgtcagagcaatcagaattcagatccttattgtcacagatgaattgtcctactatgctttggcatttcatgaggaacagcatagaagataagagaaagtacaggaagctaattaagacagggcaacatcataggattctggggaagaaatcctttccaggagaacctggtgaatactgtcatttgctcaggagacttcaagggaaattattgcaaaaaaggccattggttggccattgaattgtccctgctgatttttcaaataaaggtgccaataatgtggcaaggacagaaatcagatttcagggatcaagaagagagttgggggcagatgcagtggttcactcctataatcccagcactttaggaggctgaggcaggtggctcatttgaggtcagaagtttgagaccagcctgaccaacatggtgaaaccccatctctactaaaaataccaaaaaaaaaaaattagctgggcgtggtggtgtgtgcctgtagtcccacctactcgggaggctgagacaggagaatcacttgaacctgggaggcagaggttgcggtgagccgagattgtgctgctgcactccagtctgggcaacagagtgagactccatctcaaaaaaagaagaaggagaaagagaagaagagagttggcagtgaagcaggaagaggaagcatcagcattgcatgggtgattgagaatctgtcaggaagaaggacagataattgagaattagatgagaaaggggagagcaggatcatatgagggctacatgtgttttacagaacgctcttataccaaatgaagtacaggagcttcacactgtgccttcttgcagagggttgtgtccatttgtcacaacccacttatatttggactcaacacttttctcagagtggttgaggatcctgagttaattggttttattcaattgattgattctgattccagaatagtcatgagttactatcctcagtgtcctttctcattggctttgaagtgagctgttgcctgcagcaaactcagggagccagatgtttgctacctttctctcaagggtctaatgcaggacagacattgctcagtgacctctaatgcaagcatttgcaaggcgccaggcaaaaggctttgtatttacatctgctggagtcagaaaagaatgggaacacaaactaagttgcaagggttctaatgaagaccctgggagtttgtgcttggacacgggataggtggggcttttcaggttcccacaatatacttagaaagtgacatttcttcagctctggtgaataaaatcctgacagcaaattctgttacttattctgttattaacttagcctgtgatctcatcacagtcattttttgtcttttttttttaatgctcctctttctatatttggaaatgaaagaaggaaacacattttggaaggtttattatgtgccccacgttttatagcatctcatttgtcctcttaaaatcccaatgaggtaagtatttagtcccattttacagctgagaacacaaagcatcagagaaatggtggcatgccaagcttatacagctataagaggcagagttgtaacttgaacccaagaccatttgatcatcccatacactagagaaactatgaaaacatggcacgtgagtggtcagtctcacatgttgggttctgagaacattaagctgtaactatttgcaattgaatgtgacttatattcttaactagtgtcatatccgtgaattgcagatcatttgcccaaacattctaagtaacttcagttaaggttttcttccagatgttatgtcttacatacttttgtgtacttgtgtacttatgtaccgtttactttatttcttaatatgttaaaatactatctgtaaacaggaaacacatggttaaacatattcacacctctataactgagctaaaatcactttctaccatcttggtagtagtaattttccggaaaaggaagcagatgaagaatgtaagcaattaagagtgaaaacaatttaactggcattggatttatattagtgttagtcagcattgctttaattattctctagtggaacactgttctatgaaatgaactaagatgttaaaatcaaagaatcttttcctaacttgaatgaaaaaaaatatttaatgtatagatttttatgatattgtttttctatgaaactattcttaaatctttgtcgttactcatcaaatactataatctagcaatagtatgatatgtgatcaagtataaataaattgcatttgaaattaagatatcagcattttatggtattacacagtgagtatcgtggccctcagagttgcttgaccacttgaatttgttagagaaattaaaccatcagtgcagttactttaaagttattcattaaatgttccatttatgagaagccagtcttattactataaaatatggaatgactccactgagtaattattcaaacacttatatgtaaagtttccttctttgcgtttaacaagtataatgaaatgcttatgaaaaatcaatgtcttagctgcagcataacagtctcttttggcctatttatacataaactgccaaagtaaacattaaaacatttacaaagtacatttagttttcttctgtatccccccaaaaaagaaaacacaagtatgaaatagtcctgtgattctgtgcacttcatctcttcatgctgcccagtacctagctcactagctcatctgtggtggaagaatatgatcatttaaatgcaacaagaacatctttgtaaatgggcctgccctctttcatcaggagcacagagctagaattcatcttaccattggctctgcttcccgtaaatgaaggagttgagtaaccaagaagccagctagaccttcctcccttcctgagctttgagggccaggtctttgcaaattccacccttccttcctgaaagcctgggctcagaagggcagtaacagaaagatggaaaaacacacacatccaccccatgctgacctttcatcccttctaagatggtttcagtgttttgccatggaaagtatgcccagtagatctaacaccaagaatggattcagggtgactttttaatgggggagaaaaaaatattttaagaaattattatagatgaagtctgatgaacactgtggaagttctctatggagaatgggggttccacatacatgaggtagcggaacattgcatgcattgcccagagatgtttaggagtcaaacgtaagtttccatctcttttatgggtctgtagtgagtattggaacttataaatatcccacacaagtattttttgaataaactttttattttgaaatagttttggatttgcagaaaagttgcaaagataattcaggcagttgccagtttcccctgctgctatagcatcttacactgccatggtacttttgtcacaactaagaaaccagcataggtacattattgttttatgtgttgggcttttttagtggtttactataaaggagattgcaaaggatatagatgaagagatgtgtagggcaagctgttggggagggggtgcagtttccatgcacattattgttaactaaactctactgtgctttatttgtatttcctttctttttctctgatatcttttttccgttccaagataccattcagcataccacatgaacgtttagtcatcatgtctccttagattcggcagatttacacaagtatttttaaattattgaaatataactgtaatgctttgaaatttcgttacctatgtaataattaagatagtcatcctatagtcagaaactctgaattctgatccctttttcttcaatgggaggaatgtccttcatttctcaattcaaaacattttagatgttggtgacttcggaaagtaaatatcctttctcatgttgggataactttagaaagaattagtgaattactaccttgccacatcatgattagctttcttctgaaaagttactgctgttacattcatgaccacagcaggaaaaatatgtcttggctgtggatttcactagagtcaagggaagggtgactctttaaataattagattgctcttcagttttaaaaagtttatgctgactaggttaacagggcaggctgaatgcaatagcctatttatttttaccttatattaactcataactaaagataatgtacaattttgtatgtgtacatataaccatcattatgggagagacagcatgaagtaggctatgaagtggtagaatgtgagaaagaaagcaataaatattttgttcaatcttaaggtttcttttaaaggtgacagtggaaaatcctattgacacaaagcactttagctccctttgctctcatttcctgctttataaaaggaagtgaagcccggcctgcttaactgcagaaatattgtgagttaactaaggatttccatttcttctgccatctctgcttctcaggccgagatcacagaatgcctggaatcactgccatcacctcatgcagttcaagcatgtgtgtgaatttgcctccacatcaccccactgtttgggggattcagcctccccatacacagtttgtatgggcttatgtccctattcaaaaatctttagagtcttctcattttctagagaagaaaaattttcagcattatgttccttcactctggcaaaataaagtcttcataccagtcagatatttcttctttcatttcactcaaaaccttcgtcacatcaattgtgataatcatcaacagttactttataccttcattactaaaggctttttctaccttgagtctttgcttttttttttcttgggtctcatctcaaatttctaccctttctaaaatagtcccaggtaaactctcatcttcatttctcttaaattcccagcctccttctccctctagtgatctgacctaagaacccctggttttcacatgcactctatatgttagtatgtttccttctggtcctgttttctgcatatgtatacttacatagtatctctaacaaattggaatcataccaattaaatgattcttcatttttttcatttaccatatcatgaacattttcatgtcatatttttatatttatattaaaatatgattttaatggtttcaaaaatagtccacaccaaattccacatcttattaagcatttacatgtagttggacatttatgttgtttccatccttttgctataataaataatgctgtcctgcaccttcttacttatctttaattatggacttgagataaattctaagagtggccttcttgggaatgatttttattaggttcttgatatgtatttccagagatgttatgcctgtttttttctatcagcggtatatgaatatatccactttatcactgctcatcaactctgggcgttataatttgcttatacagtttgttgattagctagttaaaacccatttcattgtagttttacatattctggagacaaggccttagtcagacatgtgtttcgcaaatattttctcccactctgtggtttgtcccttatcacgatcttaactgaattcttctaaaagcagaagtttttggttttgaagagtttcattatatgaaattttatcatagactttgcttatggggccgtacctaagaaatccttgcctaatacaaagtcacaaaggttttatcctatgttttcttggagttttatatttttaggttttatacttaaatttatgaggcattttgtggaaacttttgcatagagtaatgagatatggattgaagtgtttttttatagtaatcagttaaaaaatcaggactctttccagataaggaaattagaataacaattctaccaaaggcacatttgttctttaaagaaaaagggagaagtttgcctttaatgtaacagggggtaaattattgctgcccatttatattttgagtctaatttggagcatacttcaaattaatgaatgaataattattgtccaaaaccatacattattattaccacttaggttatttggtgatgggggcagatttgtttatatcatgtaaattattaatgtaactgtattcatatatttatacaacaaacatttttaggacggaagaagcattcatctactttaggcagatgaacgtgggaacataatatctttgcagttccatgaataacctgtatgcaattaacatctgatttctagaatgaaagggagtcaaagtaattaactttcttgaactacaaaattattcttatatggggaacatttgtcaccattaagagacaggctcttgggaatgtactaataaagattatgaaagaaaggactgtgatacggaagaaaatattttagtgagtagtgcttggggttacttgtgaaataaaaagtttctcagtaattggcagtgctaccagtgttctaatcacctgcattttcctccataggtcatcagctcaatgagctccctttctgagtactgcctgccttccattctacgtacattatttgactggtataaaaggcaaaatggcattgaggatgaatcacatgaatacagaccaagaacaagcaataaatcaaaaaggtacatttcttttgtgtaaggatcatggttttattttgttttgttttcaggaaacataaatcaaaattagagttacaaggcaattgggtcttcctgactcttcacaaggatgcctagcaggtgctgcaggggccctgtgtctgtagcaggtaacccatttggagcaccgagtcactgccagccgtcacgggttgaaaattcatacacagctttatttcaactttggtggagacaggtgtgaagggccacaggtcactttcttgccagcttctttcctctgccctctcccactgagtctacacccaaagcagaatgctgacttcaggccttgcgtgacatgccaagatattttagtcctcgttccagtaaccttgagtgctcagtgtactgtagtgggaaggacgctggactggacgttagtggtagtcctggcgctgccactatttagccatgtgactttgggcagctccccgcctctctgtacctcagcctccttgtgagcaaaacaaggaagttaggtgacaccatctccaactcctccttccagctgagtattttgtttatttattctctgttcccttcttcctgtgggtttgaaaaatggaacttgctgctccaggagcatatcagcatctgtaaaacttaagattctcattaatgtgtgtcctccccaaattttaggtaagcacatataatttcatatgtttagtcaacctatagcaaggcagtgaatataagaaagattaatacacttaccttttttaaaaaaaataaaagattattttaaaaagtagttagatttctccacatgaatggattattccaattaaaaaaatacttttaaagtctgtaaactgaaattaatcaaccagaaaatcagacattaactactttttgtgaatgatttatttctctcatttttcttgaaagtcctaatactgtttcaaaagacttcttttgaaatagaagaattgtaacattaccatgttacacttcaacaaaatttgtaatctgcttttataatgtgcttgaatttatgcaagatttaatcatataattttgtttgggagagagattaataactttttcgtattgaattttttttagtgaagaaggaaatttttagaatttttagatataactcagatgccataaaattcacccttttaaagtatataattcaatgtttttagtatatttacagggttgtacaaccattaccactctaatttcagaacatttttatcacccccaaatcctgtacccattagcagcctctcctcatgaatatttttttaatttatcaggttttaaaaatagaatttaaattgtttatctgaaaaatggttcagaccatgtgattaagaaattaaaaggatcattttattattttttccatattacatgttgtcttatgaacagatattaaaccttcccaggggcagggagtgggacagtttttagtgagttgaattgagttttagttttgttcctctgttttgtcagaatttagttgctgaaattagatttttcatgaattgatttctttatggattaaaaattatagtttttaaaattgtgttactgattattttcaggagatcagagtaagtactgagatcagataaagaatcaggacagtaaaatttgacttagtagcattttagttaatgcttgaatttttaaaataagagagaaaatgtgcttagaaaacagccaaatgaatgaagctctctagggtatggtgtagctaaatgtgagtttctgctactaggaaaaaaaggttggggggactttaaggaggagcataaactactgaaaatagatgtcagggatgcacattgggttgtgatttctgagattagtacagtatcagcatttggactgccaaataaatctgtcaaatgtctctggctcctggcagttagactgcaaaccagcaataaagttgaattcattattagaaatgtatatgtcttactttgatttgaaaacataatttggcttattaaataaaatagaatcaaaggtctacatttttttttctgccaagaactgctactttctcaggttcctctggccacttgtaaagacccttagcatccagcacaaaaatactctctctactgctgctggccatctctgggagttctccttccttttggtctttccaacttcctgtctccttattctataatataatggatataaagcctgatttctgagtgccctcctttttaatgcagctgcatagattttcctttcccccagctcgcagtgccgcttactagttccagtgggtcttgaaggactttagatagatggttttgttcacagctctttctcctggcagggctgttcataaatgatcctgaaagaatgagttcctactctgttgatacatttactccttgaaagataaacatgcaagttccttcttaacgcgttctgtcatccaccagccttaatttgacttgctcaaagttacagagcactccagaaggtcttctttatatcttaaatatcacattattttcttcttattcccttttgactaaagagaaaaacattccagatttaaaatagtcttgatttattttgaaaagatcttcctggcaagtctaaatcctgtcatccctcctcattggttttatttaatatatactattgagcatttatgtgtttgggaaattatgctaaatactttacatgttttatcttctcaaactattatgtaagtactattattcacattttgtagatggagaaattgccgataaatagaagaggcataattttatgccagactgttccacaccagagtcagtgctctaggccacttcttgtgccaaggagcccagcagtaatttcatctgtctttgttcaattccaaatgagccctcaatcagtgtgttagtcaagcagaaaatggggtagagggactgccttcctgttcttctgacagtgctgattctgcttctaacttttttaaacatttatttatttttccgtacgttattggggtacaggtggtatttgattacatgagtaggttctttagtggttatttgtgagattttggtgcacccatcacccaagcagtacacattgtaccatatttgtagtcttttatccctcgccccactcccactcttccccccaagtccccgaagtccattgtatcattcttttttgtttgtttgtttgagacggagtctcactctgtcaccaaggctggagtgcaatggcatgatctcagctcactgcaacctccacctcccaggttcaagtgattctcctgcctcagcctcccaagtagctggaactacaggcatgcaccactgtgcctggctaatttttgtatttttagtagagacggggtttcactatgttggccaagctggtcttgaactcgtgacctcatgatccgcccaccttggcctcccaaagtgctgggattacaggcgtgagccaccatgcccagcccacattgtatcattctgatgcctttgcatactcacagcttagctcccacatatcaatagaatgtttggttttccattcctgagttacttaacttagaataatagtctccaatctcatccaggtcactgcaaatgctgttaattcattcctttttatggctgcatagtattcgatcatatatatataccacagtttctttatccactcattgattgatgggcgtttaggttggtttacgattttgctatcatgatttgtgccactataaacatgcatgtgcaagtatctttttcgaataatgacttcttttcctctgggtagatacccagtagtgggattgctggatcaaatggtaattctacttttagttctttatggaatctccacactgttttccatagcagctatactagtttatattcccaccagcattgcagaagtgttccctgttcactgcatccacgccaacatctacgggtttttttgttttttgttttttgtttttatggccgttcttgcaggagtaagttggtatcacatgtggttttgatttgcatttccctgatcattagtcatgttgagatattttttcatatgtttgttggccatttgtatgtcttcttctgagaattgtctactcatgaccttagcccactttttggtggggtggtttttttcttactgatttgttggcattcattttagattctagatattagtcctttgtcagatgtatagattgtgaagattttctcccactctgtgggttgtctgtttactctgctgactgttccttttgccgtgcaaaagctctttagtttaattaggtcccagctatttatctttgtttttattgcatttgcttttgggttttgggtcatgaaatccttgcctaagtcagtgtctagaagggtttttccaatgttatcttctagaatttttatagtttcaggtcttaggtttaagtccttaatccatcttgagttgatttttgtataaggtgagagatgaagatctagtttcattctcctacatgtggctagccaattatcccagcaccatttgttgaaaagggtgccctctccctactttatgtttttgtatgttttgtcgaagatcagttagctgtaaacaccacataaacagaattaaaaacaaaaatcacatgttcatcccaatagatgcagaaaaagcattagacaggccgggcgcagtggctcacacctgtaatcccagcactttgggaggccgaggtgggtggatcacaaggtcagaagatcgagaccatcctggctaacacagtgaaaccctgtctctactaaaaatacaaaaaattagctgggcatggtggtaggcgcctatagtcccagctactcgggaggctgaggtgggataatggtgtgaacccgggaggcggagcttgcagtgagcaagatggcaccactgcactccagcctggacgacagagtgagactccgcctcagaaaaaaaaaaagaaaaaaaaaagcattagacaaaatccggcatctctttatgattaaaactctcagcaaaatcggcatacaagggacataacttaatgtaataaaagccatctacgacaaacccacagccaacataatactgaatggggaaaagttgaaagcattccctctgagaactggaacaagacaaggatacctactgtcagcactcttctttaacatagtactagaaggcctagccaaagcaatcagacaagagaaagaaataaagggcatccatataagtaaagaagaagtcaaactgtcactgtttgctgacaatatgatcatttcccttgaaaaccctaaggactcctccagaaagctcctaggactgataaaagaattcagcaaagtttccagatacaagattaatgtacacaaatcagtagctcttctatatactaacaacgactaagcggagaatcaaatcaataactcaaccccttttacaatagctgcaaaaaataaaatacttacgaatatacctaaccaaggagtcgaaagacctctacaaggaaaactacaaaacactgctgaaagaaatcacagacaacacaaacaaatggaaacatatcccatgctcaaggataggtagaatcaatattgtgaaaatgaccacactgccaaaagcaatctactaattcaatgcaatccccatcaaaataccactatcattcttcacagaattaggaaaagcaattctaaaattcatatggaaccaaaaaagagcccacatagccaaagcacgactaagcaaaaagaacaaatctggaggcatcacactacctgatttcaaattatactataaggccatagtcaccacaaccacgtgcttctaacttttaaatgagcacaaatgactgctttgcttctcctacctcttcttccttctgccttttactcttctctctcaccaccccttcacttcttcattcctcctttcactaagtctcaagtggcaaaaaatgtaagagaaaagggacagggaaagaaaagaaaagtggtaatgccgatcctcttcacccctgcagtcctgctcaaattggtgatcatattatttccttcttgtttccttacattgtttagctcctttcacgagatctttcaatgtccacctctggtatggtagcctgtctcaagttgttatcacattttacagatggtagaattgcagagttgaaagctaccttagaaaagaccacaaggtgaggtgatagactcacaaataactactcaagttaacatcattgaaaattttaaatttgaagtcaaatattccgacttcaaatccaatgtttgtccactgcagcacacagagaattagcatgttttgttgttgttgttgttgttgttgttttgagatggagtctcgctctgcctcccaggctggagtgcagtggcatgatctcagcttactgcaacctccgtccgcctcccgggttcagacgattctcctgcttcagcctctcaagtagctgggattacaggcatgggctaccatgccacctggctaatttttgtatttttagcagggacggggtttcaccatgtgggccaagctgttctcaaactcctgacctcaggtaatctgcccgcctcggcctcccaaagtgctgggattacaggcatgagccactccgcccggccaacgttagcatgtatctaccagtgcaattatataattttaaaaatgggttttgcagtctattagggaggagtcctagattttttatgaattgtattactctgagaataccttcagtgtgctttaatgtaaatattttaaattttacagcgatgaacaacagcgagattatttaatggaaagacgggacctcgccattgattttattttttctttagtattaatagaagttttgaaacaggtaggtgattaatttattgttacttttagacaatatttattgatctaaaaactacttaggttgtaaaagtctaagtttttaaaattatttctgaattccaaatactgggttatatgacttatgtttattgattgctattgattgtcatatatagttattggaagtactgtaccgatttgttctttaatattcccttctgagttaagaaccacctttttttttcagattccacttcatcctgtaatagacagtttaatacatgatgttattaacttggctttcaagcactttaaatacaaagaagggtaagatgatttctcaccttagaatgttgaagttggtgtttaaaactaaatcagtggtttgcttttttccgatgaccagggatccctaacttgtctaattataccctacttaggtaccttggtcccaacactggcaatatgcatattgtggcagacctgtatgcagaagtcattggagtgttggcacaagccaagtaagtgaatgccagaaccctttaccatgagaacgtgcgtgctttcactgtccttccagccctaatttagggaagttggggttgagcttacaaggaactaggtagggctctttgccatgtgtgccccatctctgaaactgaatagaaagctcttccaagacaggtatcaattatcttttttacttggcacttgggccagatcctacctagagtccatgggtttcatactgttgcatcaaagaaatggggtgaccagattacatttctctctgcctaaatattccaaggaagtttatcacttttgaaagttctgttttctctagcccatgagtgggtggttacaatatatcatctatcagtgggaaaattccattctagaatgtcccctttactatagaccttacttaattcagctgagctaaaaatgtcccagactctgtcatggaaacaagtcaggggggaaattctcattgctaaatttatctggccccatagcactacttagcaggcaagaacaaaattgcgttagactattagcaacaatatacctcttccaaaagtgatgtcacaccctacttacccagcttcattttgtccaaccctgaggcaaatcaggcaagatcccgaatgcctaagttaggcaaaatgaaccagagacataatgtgaattcatgccaggaggtcagcttaaagcaacagtgatgctccaatccttgtgaaatgcaatccttcctcagaaagagatttttatcttcaagggattgaatttcgtaacgtagtagcatggaaattacacaatttatcaaaaaaacaaaaattttaaaaagcacttagcaatcttacctggccaaaacatagaccagaatgcaggaaatagaaccccttaactccttggcataatttatttaatctaatccagtttatctactcatcctgactatatttttttaaatatataacacatcagtgttcgaaggaggaacgggaacttccagaggatgataaactgatgccattgagaaataaagctcaaccgctggtggcaacagaaaggaaagaaactggccaaagcatacataagaattaaacaatagagtgatctgggccattttgcatgaggctatattgtagttttatagcctattaaaataattgtggttcatgaatcattaagaaaaaagtgtaatgcattttggagatatttccattgcaattgagtaatgaaagcattagcattttaaatggacaagctgtagttatccagcaaatcgtgtatctacctcatttctagaaaagattgggaaaaatgaggtattaacatgtatacttgctgatttgtcaaaccctgaaaatctcaacataaactttcagctgtcatttggaaacttcagtatgccaaaaatgactttgtgttttccttagtttttgtgaattatgcataacaataatattggttactgtcaaatgaccttccttagctctgtgattctgagttggttgtgaataagttgagaaacactgtcataactgagcaatattctaagcttgtaggaatttccattttaggtaagatttatggtccaccaagtcagtgtttgcttgccaatggtggctttttttattttcgtgatgtcagtatttgtccctattctgcggtagtagggtgtaagaaatgcctccatttggacagtgctccagtactttccagtctctagtgaaccgtttggccagtctgctcttgcagtaaacacagactccaatagcccttgatgtgttctcaactagtctatatgtagttaaccttgatggatagatggtataaacttaaactagtatcataccatgaattatgacattacttctttctcataagtacaccaggaccattactttattgttaccttagaaaagtactgtttccttcattcccagggtgggagaaagaatgtttgcttatctggtatagtgtgattatcttttttaaaaaagttgagtaatgtaataattctaattttagattatatgtctcattcccaatgataatgcttattaaatattttcctgattatgactttagctattagtacttactttggaatttgagttttagcagaatcactatttttagtcttactagtgatgatgctgtttagttcttgtcatttagggaaaagaattttgataataagtgttattcacccataatattgactttttgaaagtcagttaaaacaaatttaactactttggccaaaatctggtagattcatttaaatagtaataatacttcatttaagaatcatagatttttaaactactttctctttatgcgatattatctttatatgttcatttactcatttttgtaatatgtactatacattttaaagcagaagtttatattcatgtgaattttatagtataccaaagactaagtaatcattgagttacagtatttactaaataaaatactaaacaggaaatactaaaggaaaggtcattgaaatttttttttcttaaagtcactttaagagaaaatagattttaaatgcaaatagattttttgatggcttttgtgctaagtaacatgtttatatcatttgggacttttaaaaataaaagtctgggtgcggtggctcacacctgtaattccatcactttgggaggccaaggtgggcggatcacaaggccaggagatcgagaccatcctggctaacatgttgaaaccccgtctctactaaaaatacaaaaaatattagctgggagtggtggcacgcacctgtagtcccagctactcaggagactgaggcaggagaatcgcttgaacccgggaggcggaggttgtagtgagccgagatcgtgccactacactccagcctgggtgacagagcaagaatccatctcaaaaaaaaaagtaaaagatagacgtatttatttttaaatgagaaataaataaacttttagccactaactcatgagaatattgaaatagtgaattatgcaaataacttccctttttctctctctccttattttagtcatggattcaaactggaaaacaaactttccttagtatcgtgtcatctttaaaactatataactctaactataatatttttctctctaaactcatacatttaaaaattaaaaccatagttattttggtatctggaaataatttgaaaagaaatacaattttttaaaattcagtttggggttattgcatttttataatcttgatttaaagtatcacttccattgcttgacagtcatggtcatttctgcttcctaccttttatccatctctaccgaatgtcctctgctcacctgtaccccagctcaaatctcctctgaaatcctctctaattaattacgcagatgagaatagccccttcattctctgatgccctgaagccactatttaatagtgaatagtgattgactattcaccaaatagtcagtgtgaaatataagaaagtgatggaacctggtgcatctgaactccctgaagatcagaaaggtctggacagtgtccagcaggtgctaacacatagtaggcccccggtaaattattactattgtgattcacatggctcatggtcagtgctaccttgttttatcttcctaattaaactataaactattctagagagggcagagactacatgttaccattaccactgtctaagacagctgcggtgtaatggaaattcctggaatttatatcagaagctctgggtttgagtctcttctttgccactgtggtcttccaatctgtttctttatttgttaattggaaatgcattcactgcctaattcactggattgttaaggatcaaaatgtgaaatggtataatcgcttaaaatgtaaaaccacttacagatatttcttgttattgttattctgagtctacaccagtgtttctcaaattttttcacatcagaaacacctgtagagcttattaaacacaaattattattcatccctggaattacggattcagtaggtgtattattctgcttaagctgccataacaaagtactgcagactaattggtttaaacaacagaaatttatttcccacagttctggagttgaagtccaagctcaaggtgttagcagggttgattccttctgaggcctctctccttggcttgtatgtggccattttctccctgtgtcttcatatggtcttctctgtgtgtgtgtctctactcatctcccagtcatgttggagtccttataagaaggggagacgagtacagagacacacacagagatataacttcattttaacttaataacttagctggagaggttacatggtgtccattttatgataataactttgttttaagttaattacctttttataagctgtatgcccaaatacagtcacatttcgatctcagaagggtcaggcttcaacatatgaatttgaggggcacacaattcagccctaacagtaggtctgcggtaggaccagagaatgtgctgataccaaatagatttttgtaaatttaataaagtttctattttaatttttgctaatttcctaatctgaaaaattaatataccattttgtagttaatctccatgaaattttacttataaagtaaacacagctaatattttctaccatattctaatagtattatttaaatgtcagaaggggccagtttggggtgctgtcttgaaattgggtattctgtagaagtccaccaaatgccaccgaagattaggaaaataccctgaaatattcttagcgatgctaataacccattagggaatatctcattcataagttgtctaaatcttcttgaagctatttatattttctgctctattgccttttaaaaatcttttttattaagaaatacatgtagcaaacatagaggaaaatccataaggcagttaaacaaagtattataaaatggacaccatgttacctccccacctaagccaagaactagaaaattgccagcacttgagaatcccctcacgccccacttgccaaccaccagcccctgtactgcctttggttaaacaatgtctctatgtttactgcctactttatttgtcctgaaatttctgctttaaggtctcaagaattgttccaaacttccgggactctattagttcacctttcatttctataatcacaattacctcccccagcctttttttttttttttttttccggtgagacagagtcttactctatcacccaggctagagtgctgtggcgtgatcttggctaactgcaagctctgcctcccaggttcaagcgattttccagcctcagcctcacgcacaccaccacgcccggctaatttttgtgtttttggtagagaccgggtttcaccatgttggtcaggctggtctcgaactcctgacctcaggtaatccacccacttcggcctcccaaagtgctgggattacaggcttgagccacagcacccagcaacaattaccatttttaatcaaggcttgcttctaatttttcatggaacctcaggctaatagtctcagaaaacaaaatacaataaatcttagactgttttctttggaaagtgtttgtgtgtgtgtgtgtgtgtgtgtgtgtgtgtgtgtgtgtgtattttttggtgaatagacaaaccagctgtgtcagacttagtggtatggacaatttctatgtgtacatttctctactcttaggtacttgaagatctgcttctgctttctcttagctttaagatctgttctttttacaaacatggatgataatattgttgtaattagtattattttactttcgaatacaaatactttgaggacagggactggactgtgtctttttgtttgttttgcacttatcagataaaactgtaaaattccatgaatataatagacagcccattcatctttaccttttagatataatttaaattttcccattactagattttttttttttttgagacagagtttcgctgttgttgcccaggctggagtgcaatggcatgatctcggctcattgcaacctctgcctcccgggttcaagtgattctcctgtctcagcctctcaagtagctgggattacaggtgcgtgccaccacacctggctaatttttgtattttttgtagagatggggcttcatcatattggtcaggctggtctcgaactcctgacctcaggtgatctgcccgcatcggcctcccaaagtgctgggattacaggcgagcgccactgcgcccggcctcccattactagattttttaacccaaaaatatatttttcaataatcattatcctacaactataaaggaaatgataacagaaaactttagaattacaagaatacttggcattatttggaatacaaatccttatatcatttgctgtccctgtcagaaatcactaacctagtatgttattgctcatagactcactatttgatacttcaggctctggggtctgcaactgtgttgaaaatggccaagcctgaggaaatggggttttttgtgatgctcaatttaagagctagaccattttgagaaggtctaaataaaccgggatctgccccctcgcctgatgaagatgttgagcatcttacagtataagaagggtaaaggagaagaaaattggatcctttgccaaatcccaaacaccaaatccttacaaaatcatggctgttgtacttgaactgatttaaaggattccattgctctgctcaatcactcccagatgctggaggcccccattacagggactttcctacccaatatttgataaaccacttatgttatcttcttagattccctgctgtaaagaagaaatttatggcggagctaaaagaattacggcacaaagagcagaacccatatgtggttcaaagcattatcagcttaataatgggcatgaaattctttcgaattaagatgtatccagtggaggattttgaggcctctcttcagtttatgcaggtaatgtcttaggcaggagagctaaggtgctctcaacttgagcacttcccttcctcaaaatgatgaacctggaacatgaaaagccaattacttgtcaatacggagaaacattctactgtctaaataattcatgaagtcctttgtaaccaaatagtacagttgcgggcacataatttcatttctcaactttcatatatctttggaggagagtatacagtgggattgcttgtttgctgacttttttctctttcacccactggtacatattgttctatgaataaaatataactgatttttactttttaaaattgatagcattgggttggctacattgacattcacaggcatgaggacttgaaataataaagaaatctgttttattcttactataaaaaggaatcttaatttttaaaaactcagctaaacaatacaggtttgatatttattgcccagtgcccatcatggtacataacaaaagaattgctgctaaggagaatttaacagaatactcagctcttagagtttacaaaactttggtatttgaaggaatttttaaaatgctgctgtgaattaaatttggtgatgaccttactagagggtttagatgtatggattatgaatataggctgtaccattttacacccacaaggatggctatagtcaaaaatataacaattctgggtgaagatgtggaaaaattagaaccttacacactgctggtatgagtgcaaaatggcacagccactttggcacagcctgtgccacaaatggtacagcttggccctggcagttcctcaaatagcaaaacctagaattaccgtatgatccagcaattccactcctaggtatatgcacaagagaaatgaaaatatatgtccacacaaaaacttgaacacaaatgttcatagcagcattattcatagttgccaaaaagtggaaacaacccaaatgtctataaaatgatgaatggatagataaaatgtgatatatccctataatggaatattatttggccataaaaagtagtgaagctgatacatgccacaacatgggtgaactttgaaaatgttacactaagtgaatgaaaccatacacaaaaggccatgtattatattattctgtttatatggaatgtccagaataggcaaatccatagagacagaaagtagactaacagttatctagggctggggatggggagtggatagggaggttgcagatggctgctgaggggtagagtttcctttgggtgtcattaaaaggttctaaatttgacagtagtgacagatgcacaactgtgattatactaaaagtcaatgaattgtatatgttaaatgggtgaattgcatactacataaattatgtcacaataaaactattatatattggggggactatgtatcaaacttctcgggtttgaattcaagctctggcatttaccagctctgtgacctgaccagtcacacttaacccctcccatcctcacttcccttatctgcaaggtgatgataatgacactaaccttagagagtggttctgaggattcttagcacatgacaaacactcagtaactgttaaatattttattatttatcccactctcatattaataattcctttatctatatacatgaattaagacttgagagagtattacatacttatgcaaaataatgtagcaaaagaatgactattctgggaactatagagctcatctgtataggaaagctgtttcagtgacttcccgtactggtgttgcctatcttgagctgaggtcttaatatgatattgatagaatgaggactttagggattgtttttggcaatcttcccaatggcaacagaaaataaagggaaatagccagtgtagatattaacatgttattatatttagccttggactctttcttttctttctttctttctttctttttttttttttttttttttgaatttgagacaggggtctcactctgtcacccaggctggagtgcagtggcatgatcttgattcactgcaacctctgcctcccaggcacaagtgatcctcccacctcagcctcccaagtagctgggactacgggtgccgccatcatgcccaactaatttttgtatttttttgtagagacagggtttggccatgtcacccaggctggtctggaattctgggctcaaacgatctgcctgccttggcctcccaaagtgtcaggattacaggcatgagccatggcatctggctgccctggactcttgaatgaaaacaatacctgatatagaccacaataagttactaccaataaggccaggaaggagagagaggtgggcagaattctgccaactttccttttaaaaaagttgacattttgtttaaaaaaaaaatgttggcaggccaactttcctacagaatgagtcattgagcaaccaagaacacccttacatatgacaacagtccactggcagtagtgtcctttcttaaggaacccttctaaaggtttccttgttgaggtgggagagggaaacgttcctgacttgcttatgaaactaggtgaataataaacacacctaaaatgtcagagcgaacaagtaaacagctctgtgcccgaggctgtcaggcatagggcctaaaataagttcgatgtcttctgcctctcttcccatgtttaccttccctggggatctgtgtttgtgggctaactaggagcccagggcctaacacacacactaagtaataaatagaaatgtattggaagtgaatgactgaatgaatcaaccagtgactcagtggatacacgtgtgcttgctggttagagatgctttgtccttttagaatagtgaattgaaatataagagtgaaaaaaccagccttgcagaatgtcattgaggccattgcaaacatacaaatttcaatacaaatgtttgaatccagtgatttttaatagactatggaatatgctctgttgatacatgattgaattaagagctacttactgaaacttgtttaaatacattctatgtgtacatttcaacctactctccctccctatactctttttctgcttcccaggaatgtgcacattacttcctcgaggtcaaagacaaagatatcaagcatgccttggctgggctttttgttgaaatacttgttccagttgctgctgtgagtttcatttctaaaaactccttcaaattgtatcacaaaatcaacaattttattaatataatattcacatgcatctctatttcaggctgttaaaaatgaagtaaatgttccctgccttagaaattttgtggaaagcctgtatgacaccacgctggaactttcttctcgaaagaagcattccttggttagtaactatgagaaaatcgaaaacacaaacaaaactgcacagactaaaattcctagacaggaatctgtttgaggatcctaaggactccacagataggaaaagtacctaaagctccctcaaaaagaggcagcatttgaaactgaagctggctttttgtattgaccatgattgaatgatattcatgtagggggattagaccgcatcacctcagatgaccctctggtcctaaggagtctgttatttactttcaagattggcttaacttgatttttattttaatttctgagaacttttttccaatctgaaggctaaagtttataataacagtttctcttctcaatccccaggagcctgccctggcaaatttctatctggatgctaggatcaaaatggaaacaggcaggaaaaggagttgggaaatagacagttgcccataggaaggattatctgaaggctgggaaaataattcttgggaaggtttcggtactgaagagcagtatagaaaatcttttaggttaccaccaccttttacccgctatggtgaataaagctttggtttatgaatcggcgagtgatgtaacagctgtaatgtgaaagtcaggaggaagcaagttgtttagggatctggttactggcatggtttatgctagtctccaaaggatgagcatccctaccatgatttgagcaggtacttagggttgctttgctggtagtggtgacaaatttgctcattcgtctacattctgtggtcattgtgactaactgcatgcatattttttagattactgactagcattagagctgcactcaatggtagcagtagttccaagtccctttaaaactaagttaatttaaaaaaaaacgactaatgaactgttaagcattgtgggcagttgtttcttgttaattcaagttaacagatgagccagttacatttttatttcatggcccttgattaagagggaatcataaaggtctattacatctggcttagcaaaatggtgatgggttctgcatgtatgatttttttcggtggctgttcattacctttgctgtcttctcaagttgctgcgggaagctggcccagttaggcaggaaaagcacagtagcacctctgtttatttggtcataagcaaattcctcctgtggttaaatttgtcttggtagagtttaccaatgcaataacacttcttttaggaatcttccttaattaccagaaggttgcatgcaaaagaaaatatagacaactacctctaagatagggacaaattattagatgtctatgagcaaaaaagccaataacattttcaaaatctgtgtgccttcctgcttttttttctggagattaagagagtgatctaagatggtaagtttgtttttaaattttataagtaaagtctaaatcattgaatcagatttctgcattattatacatgaaacttctttcattttattacacgctatccataattcttggttattccatccccagcattatcagaaagcgtttgtgaaatgcgcgccagtgccctgcatccactgggcactgttgtgctacacagtgtcctgtttcttgcccacagggcccccgagggagatggcaaggtagtgggtacagagaatgtatgttacctggtttgttgaaatataaatgatcctgtgacctcctctcctttctcctcaggccttgtaccccctggtgacctgtttgctctgtgtcagtcagaagcagctgttcctgaacaggtggcacattttcctcaacaactgcttgtccaaccttaaagttagtatttgtcagctcaaaaacgatctctttaaaaaatttacagtagtttttaggctggctgatgtgcttctggaagtgactcctgatgtttgccaggggaattgtcctatactggtggaataatgaaaaaatattaataagagttcttattaaatatagtcaattttagaaagtgactaggaataagataaatcacttcagatttgggaaaaataaatctgttctaacaaggatcactttaaaagtagaattaaatgttcctttatatgcatccattgtcacattttatctaaatgatttaaaaatagaataagggccacattcagctaatagaagcatgtgaattgatctcagaagctcacttataccttcccatcctttctctatcccctccagtctagaagaatgtctctggggcaaaatctgagcaaaattctaaatattttgctcagatagctccagtctgtggaaggactgacctagcaacagagagcacttctttcttgtcactgtcatttgtgattcttgaaggtatcctgttcaagccacatggcagtcagtcctaagcattcactgtttccagcaatacacctgctacacaggtgctgggtctttaaaatggactttataacttaaaagtggtgaacatgttttaagttttagtaacctattgataaaagacagtgaaatgaaaactatccctaacataagtgcaaataggatgtatttttgacagttgttcttggttgtgtccaaagatgtgattaaatttcttttaccagtttgatattagctgcttttgaattttaagaatatagttagttacaaaattttgtatgtgcttatacacgttacctttttttttctatgatgctttaatttggtgaagtagttaagattaattatattattttggcatttaccataattacacaataatctgcattagagctgttttaagcaccaactaggagctggctctaaaagctgattgtgaaatccaagattagaatcattcattttcttcaaattggcagtgaaatataatagcagtggatagaaaattaagcttttaagtactctgaaaaaatgaaatgcttttcagggttatcaagtgttacataaaggccactttcaggtttgttttttttgttttgttttgtttttttgttttttttttgaggatctgccatatagctctaacatgtagcctagtgtcatttgttaactggtccactttcaagttatccagctgttagttcattaaattttttttctattacattttacacagataggaaatagtcactttattgaaaacagagaggggaattattgagagtgcttatagtgcagttttctgtatattctatgtttaatgtgtatgggtttttgcttggaattaaaataatatttttcatgacaatctattgctgtggccacagagaccccaattttttgtctgaacttgtttttgaaacatagcagatcatcttactttggaacttaattacttcaaagttagaatattgcttacagctctagtcaaaccccaccagaaagatttaatatgagggttatatacaaccccagagaggagcaggcctgggcactgacagtatatccctgtgcaaacttttcaagcactaagatttctaagaggcagtaaggccagaaagaggatgtagagtgaatgctatagagactgaaccacattccagaattcagttcagcagggacttatgtagtgtccactatgtgaggtgttagggaaggtgctgaaagtgggaaggagtggggaaggcaattctataaaaactagattattctagagtccctgtgcttgacaagcttagaatttcattggaggatatgtaatgaagtttcaaaatgcgtgatgcagacagtgaaggatgtaaaaggtaggagcagggagatacctctgagagttataaaggtcacataccccacgaatcacgaaagaaataattaggcaaagtaaggcagaaaggcaatgatgtcttattttatgggtaataatctatttgaattcactacgtcaaggctaaaagatataaaaatatccttgataagataaaaatgaaataaaattgtattgcatatatttagaactaaacctagtagggatttgaatggaccgtttaaaaaatgttattaatattcagaaaaccttccaaacctcttgagtccttagtaaggaagaaatacctgagaaaaaactaacacagcttcaaagatatactttgtcttgaattgctgcagtattttatgggatttagagccaattctaccatttcataagtgaccaccaaaccaacccttccccgacgcacctttctgcacccttccctgccttccttacccctccccagccacagatgcttcaggatagtgaacttcgcacctgaatcccacatgctgacctttggtagccacctttgatgtattctgtagaggtgagccatcaaggggcagtgtggcagagcagagcagaagtgtgcgtgagcgtgaaaacctgcccactttcaatgtaaacaagctctcagggtcaacactcacttaatgtcagtgccctggtttattcccagcattagtcagtcagaagcaggttgctttgggagcacagacttgaaatctttaatttttctacttaattaacttaagcatctattagtaatattccattataaattgatgagaaatgtatagcaccttttcactgagacattcacatctttcaggaactcttggtccgtggtgaccaatacttttttcttctatgtattttatgtcagaatctgaacatattgtgctataaaaaaatgcattcccttcacatctgccatacaacacctaattctgacaaaaggaaatatgctttgtgaacttgatttaatagtacttttaaaatgttgagtcaccatttgcagatgagaaaaaaattaaaaatttaaaaattaaatgaaatgatgttcataatactatgtgctagtttcttatccttcaaaataaaatgaattgggagaatttaaaaatttcttatattttataaaaatgaatataatataccagtgaggcccagattattaaaaaaaaaacaaaaacagaaaagaaacctcaaaggttaagaaacacatgaattatttgattaataataataatagctctcattcactggagatacattatgagcaggtgagtggtagaggcttcctatacattgttgtgggtatcatggcaatgccacgggctacactgagtttccttatgctttcatgaatgttgtttatgcatttccaaatatttgctcagatagcaatactgcatctgaaggttagacatgattcagtttagtttcaaagttggagaaaccaaagtacagaatgagaaagaatactccttttttctcagggagtacttatgctaggacttaaatccattccgtcagttgccaacaattctttataagtagtctaccaggcacagttctaggtactgggaataagtgatgagtaagacagtagcactccctggtctcttagaccttgtaatttagtggaggagacagaccaacaagcaaataaataaatacatgagaagaaaaaaaaacagataatgataactactctaaagaaaacctaatagatattaggattgagaatgacgcattcagggaaggcaggcaagggaggtacaagcagggtatttgatttccagaaaaatctcaaaacaagtgtggttgccataaatatatttgatgaagcttgtgtatagcacttcaatatttgtatgtaataattgcaatgaagtttgaatgcttttttcaacttttcacataatagtaagtttattaatgttatctttatcttgtaaatggagacattgagtaatatattaaggattccacaatcattgcctgaattaattaaaatatatggcatttattttaaaatgactacttttctcttttaaataccaaatttaaatggtatagtatagctattttaattattaattttcaagatgtagttattccgctttactattaatctcatttctataatcttgagaaaatctgtttcagatctacaaaaataaaggcacatttcaaagattccaataatgcacataaactggacgtaaaaattaataataagatgacaagcacgttattttccatgaatgccttatttatccaaccattcaatagaaaaataattgccataaaaatgttgttatgataattttagagattatcctaaactgtagcaataggttatttggataatatacagtcatcaaacccggtgaatcataatcaaagtaagttgattcaagtatcaaaaagaaatgtcaaaaagatgtaaagtattgctgtgatatgcaaaatataacaaagaaatagatttacttagatggctttctctttgaaatggaagagaaaactggaaggtattttaagtataacaaaattagtagatgactaaaattatctgtctcactaggtctttaccttaacatacataagaattcctacagaagcctgttataaatgcaacttcttgaagcccactttctgaggttctggttcagaatatctaaggtgcaacccaggaatctgcatatttataagcagcacaggtgacttggtgcaaatagtcagctgacggaccttgagtaacattggtctataccactgattgcatcaccagccaagttatcagtgaattcacttgtccccacttgttcccattaactctgaattgttttaactaaattaattaaaagcaaaatttaaaggaggtaggcatgttattagataggctgacacattccatgaagtcagtgactggcagtgaggtgagatgcagagggtccagggaagatctactctgaagcccactagtttcttgaacaattgtatcaatgaacctcagagccataataaatgcatactattaattaattattggttaattaattaagggagatgcagattccaacagaagaatggttttttttgatcttgaagcaagtatctttgacacagaaatcagtggtttgagacatatgctgaaatgtctgcatcctgaaaatatacatcaagcacctattctgttagctgctaaggaaatacaaagacagaagaagaagaagtgctgtcttcaagtagagtaggcaccaatagcatatgtgtgcagcctccacatactattaaagtgaagtggaaaatttaatgctttaaagccactgaggccagattgcctaggttcagattctagcactgtcatttattagctgtgtgaccttgggtaagttatttgacctctctgtgcctagaatctactccatacattgctgtgaaaattaaaatgagttaatataagtgcagcattgattaaaataaaatacctgccctggcaagcaccatgtaatacatacattccaatttctgagaaaacaatacttattagagcctaagtcaattcctatcccagctgtcgtttactaacctggtttactgtcgtttactttgagcaatttattgggccttccctcatttataaaatccttcaattgacatcttgttatgtgaaagcacatctgaaataccaaaattccatacaagtgcaagatatttattactgtcattataatatgaaaattagcttcacctacatggcaaagtttgtctttcatataggtcctgtacaaatgaatctagtttatgcatcaagttgttcagctactactcagattgtttttgattttgaatactttctggttttgtttttaatatataacctgctgtatggtagtcactgaggacacaaaaatgaacaaatcagaatgcctggaactcactgtctggtaggaaacattcaagtaaaggatgtctgtttcctagaaaacagagagcaggggtgcttggtagcctctccagaggattgggacaggagtagaggggcaggggaatgtagtaagaggagatgtaacctaattgaagttatccaagtagacaaggataggaaggcattccaggcatgcagggaattgcaaaagggatgttgcagtgcaaggttcacctaccacaaggcagaggcaggaagtggtacaagggagccaggtcacaaaaggcccctcatgtgctatattatgaaatttggacattgtccagtaggtgattagaagcctcttaaggactttaaatgcaggaaagtaaaaaaacatgtttgtattttcaagaatatcatttgtgcaagaatggaagagaggccagaaaatccatttaggaggcagttgcaatgatctgatatcatcttgaaatgctaaaaaccaattaacagtacataatccacagacaaaacaaactaaaacctaagtttgctactttgcttttcagtgcatatggaagcaaaaataatctcaaaaatgttcttaagagtgaaagaatattagtcacaataagatgctagaaaaatggtagacaggagggacaggacaaatattttaaagaagttgaagttgaaacagaagacactaatgtcaatcagttaaactagagatctcggttatggtctacagtgaaattgagatgatacttgccttcctcatcatgatacacaatgagagattatgaatatgaaagaatttcaaatgatatgctatgcaaatataaactgttatatatatcttaaaaaaggaaattcacaaaggaaaagatgtttctactagaagagaagctccttaaaggcaggggctacatttcccttgtttgctgcttgatggcaggtgtcttctacataataatactacaggcaggtacagtgttaagtaccctatgtgcattaactcacttaactctcatacattcctgtgatggaggtaggattatcatctgcatttcacagacagggaaaatcagacccagaaagattaaaatgctttctctaggtggccacacagctaataaattataaggcaaggatggattcaaacccaggcagtctgtgtgtggagtctgcttttaaccaccatgtaagtacaccataggcatttgctgatttggaccaattggaagacgagtagtcagaatttctgaaatttttaaatgagcgagtattttaaatgcagctttactagtttcaagtcccctttaagtaactaaaacatttgacaaattttacctgttatattaacaggcaaaaaaaaaccaaaacaaacaaaaaaaaaaacttctacataaatgtgtgcttctaaaaagccaggtttttttttctccatgaagctaaacaaatagctataaagttcatctagaataaacacgcaagaacatcttggaaaccgctaaaaattaaaaaaagaagcaatggactatatgaagtaggccatactagatattaacacattataaaacctgaataattaaaatgatgttgtattagtacttgaatagacagactagtagaacaaaaggaaatgtagaacagacctaaatgtacatggaaatttagacttttagaataatgaccacacatctttattcagtaacagtttaaagataaactttatcccagatcatttctaaacaattacgaattctataaaaatcagtacctaaattatctacactaagaagaaaagagaatcatatgactaaataaatggagacagacaagtaacataaaggcaaaagacctatcagaaagttaagacactgaaagactggttagcaaacattcattgaccccgtgcagaacagcagaaattttaatagatcttaggggtaaataatgtccccttttttcagagaacctatcatttatgtgggaactgatgtttaaacaagatctccccataggtaaggagtggaagggctatgctagatgtatgtgtgagagtcaggggacactcaggaggaaataattagttttaacgggctggaattgaaggcatcagggaggaacagagaaggcttcacaaaggagaggacatccaagcccactataaaaaatgaacagggttcacttgggagaaaagaaagattcaggaatgggggtggaaggacacttctatcatggaaatagaatgaacgtggcctagctagggtttacaaagcttgcgggagagtaacaggatgggaggcagaagagataggttagagccagctactgactagtcttgtatgccaggccaagaaatgttagcttgatcccacaggcaccagagaaactaccgattctgtgatttctatatagaaaggattataatcggtgtaagatagacatcggggcagggattgacttagggagactgttaggagggtactacagcagtccagatgacagtgttgggagcctgagctatagcaaaggaaatgagaatggataagatgtcaaattcaagagaaattttgtggacaaaatctataaaattgtttgaaaggatggagtgagagtcagaagtaaggaatggaggaatgaagtgtccacagatgatgaaacccacactctcctctctgactgatttgttttttttttttgtttttttttttttttttgagacggagtctcgctctgtcgcccaggccggactgcggactgcagtggtgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggcctctgactgatttgttaatgcctgggtgcccacagctggtctccctgcctctgctccattccccatgctgcagacattggacttcctctgtggtctctctgatctcattggctgcctgtcaccatcatgagaagcctattctcctcatgaaaggtgcctcatgtagcccctgctttcctctcaagcctcaccacctactgctccttcacctggccttgcactggcccttcaccagcatacaaaggattcccaggctccaaaacaggagccctctgctcctccatttctctcagattccatgtgctcttgcctctgcctacaaacctctccctcccaccattttttttttttttacacctttcgaagtatctagggccacaaactgtggcaggctcagcatagtagctcaaatgtgtgtgcattatgaatgagtacaacaaaaatggatttaaggttcatctgagtttttttgttgttgttgtttgtttttgtttttgtttctgttttttttgagacagagtctcgctctgtcgcccaggctggagcgcagtggcgccatctcagctcactgcaacctctgcttgctgggttcaagcagttctctgcctcagcctcccaagtagctgggattacaggcacccgccaccacgcccagctaatttttgtatttttagtagagacgggatttcaccatcttggccaggctggtattgaactcctgacctcgtaatccacctgcctctgcctcccaaagtgctgggattacaggcatgagtcatctgagtttttatctgcacctggaatcctttcctgaccccattccttgagtttgccatatgttgcccttcttcctatcctcttgcttctgtccctaccagtttttcatactgttgtagagttgactcccatcccccatagattgtgaacatcttaagggaaaggattatcttttatctctgcatctcaggttctagcacagtacctagtacacattagtctcaataaatattggagggtaatcagatgggatggggatggggcagaggtgttggagaatcaaaacagtaaggatttaaaaggacataatcaacaataaaaagaacagactgattctcatattggtgctaaagaatttgggttccctagggttggagggagaagataacctcttgagtactcatcttggcaaaggagaaaatgacatggcttcccccagaattaatctgtcccaccgtttatatgcctcctcatggatgatttatcctatgagcattgagaggccaatactctgtaagtcccaggtgatgcaatgtgtctcataagtacccagccatccacctggagcttgccttttccaggcctgcagataagagccatctctagaacctcagacctcactatttacatctgcagtcttacatcttggtttctgttatagaacaaagatcccaagatggctcgagttgcactggaatctctctacagattactttgggtttacatgattcgaattaaatgtgaaagcaacacagctactcagaggtaagatttggcttgtgtcaatggtaaccatatcactcagccactgcagagggtgtttcttttattactacctatgctaactcaactagaagctattcaaagctgacagtttctaaaagatctaagtcctaaggaacattttcaggctttccatagtcattggctcaacacccattacaaaagctccagcctctaccaggatcaacaggttccacttccagagttgcatttgccactttaacaaaaaagcagctgtaattttccaactgctcttagttttccagaaaaacttttcatagagtaattatgctaatggaaagaggtgaggtggtttgttttctttttctgaattctctctgattcttagataagatgaaatatctgccattttcccttaaagaactggagctcagccaatcttgcttgttttctcttttcccccttatctttcagccgacttataaccatcatcacaacacttttccccaaagggtcccgcggtgtggtaccaagggacatgcctctgaacatctttgtgaaaatcatccagttcattgcccaggtaatggagaagattccggtggtgggaatcttctgatggtttttcagcagccagcctccttcttatgaagtactaaaagacggaaagtctaaattagcatcttacgtgtttagacttctgtgaaagatttaaagtgttttcacacacagcctattcttttgcttcaaaacaaattgtgagttgagtatgtcaagtgttttcagcatctgataaatgaagaaacagagacagagtttaagtggctcatctgagtcacaaagtctgtgaattagtacgattgtcttgactcttcacctctgtttttttcctgtttctctgctctggattctacaagtaaagaggaagcaaagggtctggcgttcagagaaaaccaaaagagaacaatttagcaaaatttgaggaataaataataatgttctttcaacctatgaaaaagaatttaataggaatattagcatttatcaagcactcttttgccaagaactgttctaagtgctttgtgtatattaatgacttaaaaacaggtccagtaatattaaacatagtttttaatatgtaatttactatttgagcccaggagttttacttttcaaaacactttgtgagtaaatgggtttaccccaactttgacctccttgtgcagaggaacaggaaaagactattattccagtccagcctctgccatgagccatctctataaccttaaacaagtcagaggacatcttttttctgtgtctttatctgtaaaatggggataaaaatgcttgcttcagaatattgtgtgcttaaaaggaaataatgggcatgaaagtactgttgaagtacagttgatactgatataaagtgtaaggttcagttgctacttcacagatgatttgacagtgatagctctctttgagtttggtgcaatgaaatagttctgtaatatttgtacttagggaaaggacattacctgctctgcaggtgaaagaattaatgtaatttttctgcatgtagttatcatgtgactgagaatgtgctttgtttattctggaatatgttgtataaaatgaacctgttttatttatatatataaataaatatgtacatatacacacatatatacacacagatacctgatatatttatatataaaaattatatatattaattatttatatatacctgatatatatatttctgttatatattcctgatatatttttacatatattaattatacatattaactattgttatatatatacctggcatattatacctgttatactatatatatatatacacccctgatatattaagtaaccttaatatatcttatgtgttgattacatgtctcacatgcagaattacttgttatactatgagccaaaggatttttaatgttagagaatagaaaaaaatgatcattttgcagtgatctctttaaaaatacattttaaagaggtacagtacaagtaggaagagttcacattctttataagcccagataccccaagtgtttggttatttgatttgtggggggggtcttttgtcattagtcatactgtggtttagaggccaattacatattttgtataatgaaggcctccttgcacaccacacaaaacagaagcagccctaccctcggttcagatgggcatggtcttcctccaggttctctgcaagccacaaaactgagcagtgcccctcctcttttagccaccacctgtttgcttggtgcatattgatgaaaatagccattttctgttgagtttatattttaacactttcattttgtgttcttgtttttactacaggaacgtttagattttgcaatgaaagaaatcattttcgattttctttgtgtgggaaaaccagcaaaagcattcagtctcaacccagaggtatgaatgatccttttatgtacttctaacagagcatgtcttccggagccatacctttgctttgcggctttggagaatgggatgagggatgtcttctcacaaagtcttctatttgtttctgtcaatgtccaaattcagatgatggtggaatttcagaagtaaaattttggatgaatagacttagaatgaaacggttagttgaaaggttgatgtgctaccatattctgttcttgtataacaaagtaattcttgcccaaaaagataattcatcactaaaagttaggttgttttattttagaaaagtcagtgcttttacttgtaactgttcaacaaatttagcatcgggaagtgatgaaatagagaagaacaaatatgtgtaataataaaaatagtaaaacaatgaaattaaataaataatgtatgcacatctgtttctgtgacagcatcccaactccagggcaggcagattgtggagatgagtatacagtgggcatcatacacaacatggagcagtggaggctgtgcacatgaacagcacatataattttaaacttttaaaaacactgtcagccaacagaagtatgcctggcacactgcctctttttctatgaggttgtagaaagaacactggaccagaagtcagcagagccaaatttgccacttgccacaggctctgctgcttttcctagctgtgtgacatttacctctatgaactccagctttttcaccagtaaaaaggacaaaatgcctttctacctcaactcgcagaagaattgtgatattaggaagagtacattacaaactcttaagataaaaaaagggaaggaagaaagagagagagaggagactgcacaccataaaaatcaaatacatagagagttcctgtcatctctgtattatcacctggctccttcattctgtcagtgaggaagggggcctggaggctggagactggcagcttgttagtagcagaggggacccaggtccctgttagtcccatgctccttcccaccacaccccatattctcttcttgatactaaggttgccacatatctgggaacagcacaaaaagtccaaaaatgggagtttctgtctggtgtccagtgacctcacaggcttctggaatggctgcagccagggtctctgggccaatgggagggggcagggccagtgccaaaccagaggctttgggctggaaggaggcccagagctgtacagtgaagagccttctcttgctgggaaggttctcaagacattattcatttcttagcagtcatggctttactgtctttagcagtcatttctcagaattactggattacttgtctaaaaaggacatgttaaaagctactaccatcattatcactgtctataaaatgtattcttggttcttttctcaaactcctcattcagtcagtgcgtaattagttaacctctctgtgtagagcagttggaactgtgatttaaaaaaaatatataccaataggagtaaatatttggttatcttcttccatttctcgtgatcttgtagatttatggaataattcatttatcagtagttggtaattataagcccaaaggcatacccataaccccactcaaaagcagacgggaggacagcatagtctgcgaagcagatgtcatacacttgatgaaacatgctgtagggcattgtttctcgggaaacaagttcagattgggtcttaaataatattttggaagtagcttgtggaacaaggcctggagatctaaaggattatcttactgtaaactttatgctgcaccaccactcaactcttcaaaatttccaggtaattgtcttgttttagtgcacacctgaatgaccttctatatccatcctcatcgtcgtgaagacttgctggtctgtgagaagagtttcttggtcatcaatttctctgtttttccttgacctaaaataacctgaagtcggaggtcttatgtagtgctagcggcaagaagaagaaataaaagcgtatagattggaaaggaagaaataaaattgtcttaattcacagagaacatgattatttatgtatgaagaacctaaagaaaacctactgggactaataaatgattttaagaagtctgtaggatacaagagaaataaaatcagtatattctagttatgaacaattagaaattgaacaatttacagtaacactgaaaaacaaaatacttagcactaaagctgacaaaatatgtgcaatattttaatactgaaaattactaaatcctgagagaaatcaaagaagacccaaatagtgaagagaaataactgtagattgaatgactcgctgttaacaacaagaggtcagttgtccccaaattgatctatgtagattaaactgtaatctcaataataataaacccaattaaaatctctgtaccttttctgtagaaatcaacaagctgattccaaaatttatatggaaaatcaaaggaactagaataaccaacataattttgtaaaagaagaataaaattagaagagtagcatggcctgatttcaggacttactataaagttgtatagtgatcaaggcagtgtagtattggcagaaggatgaatataaaaaccagttgaacagaatagagaatctagaaatctagaaatagactaacacatatagggtcaattgattttcaacaatgattctaagttaattcaatggatagaagataatgtttccaataaatggtgctgaacaattggatatccacctgcaaaatactgaacctcagcctataatttgcactataaacaaaaattaactcaaaatggatcataaacctaaaggtaaaatctgatactataaatcttccagaagaaaagaatattttcatgaccttcaggtgggaaaaaatttctaggacataaaagtcataaactatacaagaaaaaagttgataaattgaacatcatcaaaattaaaaatgtctgtacttcaaaaaacagttaaagtggagagccacagactgggagaaaatatttacaaaactcatatctgacaaatgacttccatctgaatatatagagaattcccacatttcaataataagaaaataacccaattttttaaatgggcagaaggatcagcatcttcaccaaagaagagacacaaatggctaataatctcatgaaaagacattcaacctcattagtcattaaggaaattcaatttaaaaccgaaacgagatgtactggggaagataaagagcaactagaacctcatactattctagtgagattacaaaaaggtacaaccactttagaaaaatttggcaatttcttttaagattaaacgtatacttaaccatatgactcagcaattccatcccaagatatttttcctagagaaatcaaaacacatgctcacaaacgtttgtgcaaacatttatagcagcctcattcaaagtcactaaaaataaaaaagcaactcatgtccaaaccccggtgaatgactaaacaaattgtgaatcatcaatacaatgggtactatttagcaataaaaatgcacaaactgctgatacttgcaataacatctcaaaagcattgtgctcagtgaaaaaagcaagatataaagtctatgtactatttgattcaatttatatcacatacttgaaaaggtggaatgtggaaattaaacaatgtctgtcaggtgctagggttaggagagaagactaaccgcaaaaacgcacaggggactttctggacatggtggaaatattttggatcttgattctgttgatggttacctgactatgtatgtttctctaaactcaaacaactgtacaactaaaaggagagacatttagtacatgtaatttatatctcaataaacctgatttttaaaaaaatagagtggggattctggcttacaagagatatttgccagcagcagcttttcagacattttctttcattctcacaatagccctatatgattgataggtattactgtcctcattttacagaaaggaagcagatacctggacatggaaaagttaagtaattttccaaggccagacaaataaaagggagagttgtgatgaactatatgaaacttaaaaaaacataaattatttttgaagttaacttcaaaatgtgtgtaccaaactatcccatcttatttctgcccttactgttgtcccgggaaaaggaaaacttagagaactgacaaggatgattgctaaattggataatccactggcaaataattgaggcttgaccacatatgtcatcccacagttattatattagtactacatctgctgaattgaccattttattttcttatccacaacattgctgtgtcttgagagacacacacaagcctagaaacatctcataaaagaactatcaaaagagggaactaatgggcttcgatacacggattattttttaaagtaatattctttcattctagaaaatggagaaagcatataatttaaggccaaaaaatcataaagtacacattgaattgcttataaatgagccagagaaatatttagcaaatcctggttgaattatgataactccttaaagcttgaataaataattttaaaataaatagaagtctatgttactttatgttataaaatgtaatcgtgttctactaaataggtgattcaggcaaaccagatttagatgcaaagcttcccactatacctcagtttcctcacctgaaaaaatgagaatactttaccctgtaaagtgggaataccttccttatatgactgtgttaaggatgaaagttaatgagcagtgctggatatattttagggactcaatacattgtaactaaattattttcatcagtcctagtaatcgtcattattttcttccataggtagtagtatacttggggaacttactacttcatgagttttaaaaatattggtgtaaatgtttcacacatggctgcttaatggagtacagatgtttaggtaacttctgacctttgaagacgagcactagggagagctgctgtcttactaagccatctttcagggccaaagttgtgccatacctgagcctaaggaagatcaatctggcccacaatcacatttcttcttacacacccatgtgttttcatcagtaacaggttctgtggcattgaatttttaaaatttcttctcaaacttgctggcctttgtaaatcagaagtcaggacgtgcagttgagagcgggtgatgttcattttatggttcccatttggaaccctgggtgtttccattcaatctttgtgagctaacacatgtggtgcctcccttcttccaggagacgtatgagcccttgtttacctcagtttaccttagttgcatccagaggatgaggcatatcttttagagatacactcagcattcccctcaacagaatatagtacatgaccatctcaaacatgccctccacagtcggtgaaatctcccctgttgttttcttataatgcaacaagaaaaaacagtgacagaaacttaattttcataagattgctctacactcttgtggcttttaaattattttctcatactcatctacatgcaattcagtcttaactatctgaaagacttatggatgtattccactacaataattgggcctttccttttgtcatgacaatattgtctcttacagagaatgaacattggtttacgggcattcttggtcatagctgatagcttgcagcagaaagatggggaacctcccatgccggttacaggagccgttcttccttcaggaaacacgttaagagtaaagaaaacatatttgagtaaaacactaactgaagaggaagccaaaatgataggtgagtttcagaagtgcataagaactaagccttattaagcccttaaaatgaccagtagatatttatctttagtgagatgcagtttttaaaaatctttatagaagtagatgataagacattccaacattaattgttttgattgattcatgctgtgttttgttttactgctctttaaactttttagaacttcctggtaaatattttggcatttaaatgttagacttttatctatggtctttttaaagcctctaataatgattactacgtttttcagtaagtctccaagacatctgtgtgctttgctaaataatcctgttcatcaattcattcattcatctccttcttttttctttagttaaatttaaacatgttaaatttagtttaacatgttttaaacatgccaaatctcacaacacacatcaggttattttgtggatttagactacatgagatgattttctaatttaactatcttatctaaagagatgtttttggcatttgttcatttcttaccaagtatccaaatgtagacacctactacaaactttattaagatagttactggattctacagacctgagagaaacacacaaggaaattttttgctttgaaatatttctctttagttaggcaatgtttaaatgacttttaaaagatgtaataggttgggcgcagtggctcacgcctgtaatcccagcattttgggaggccgaaactccacctgaggttgggagttcgagaccaacctgaccaacatggagaaaccctgtctctactaaaaatacaagattagctgggcatggtggtgtatgcctgtaatcccagcaacttgggaggctaagataggaaaatcacttgaacccaggagacggaggttgcagtcagccaagatcgcgccattccactccagcctgggcaacaagagtgaagctccatctcaaaaaaaaaaaaaaaacagatgtaatgcatgagaaataatcatgaataattatttcactaaggtacaaattttaaatacaaaggtatttacttttcatttgtataattcgtatacacattcgtcttccagtgtgggacatcaacactgtagttaatgagaacaataaaaataatatagctaaaatatgtttttcttcatttttaaatttataatatgaagttattttattttactaaaaaaattcacatatatatttcagagggccatatggagttattaaagtcctaacccccaatgagaattattctttatttacataatcactaatgatggtgaattttcttatgctaactagaaactttaaaattcaaattgctttaatttgaattttgtattttcttattattttaactcttctggaaaatacttccaattgagtattagaattcctatacattgaattaaaatgattatctggtgaacacttactaagtgcaaggcactatgctaaaagctgtgcagatgagattgaatcagacagcccttttgctcaaggaagtcattgactcataaggtcttcagtaaaaaatattatagaggatgaataaatcaggatatcctttgatagattcagttgaaggtataactataatgcatgtttttcaggcatgtccttatattactctcaagtacgaaaagctgtagacaacattttaaggcaccttgataaagaagtaggaaggtgtatgatgctgactaatgtacagatgttaaacaaagaaccggaagacatgatcacgtgagtacagtaaagactaagttatcagtgaaagattaaccagaaaacacaagtagagagtattctcatttattctgtattttgttttcatcttcttagggttctaaaaagtagtaaagatagttaaaaaaaaaaccttcacagtatttgattaactataaaaataaggtcatatctgtgattgatctattttatttatatctcaagtatcactaggtcagtaagttagaaaatgaggaccatgacccactagtccatgtttttcagaaatggcattttgttcccaggcaccatcacaactcatgtgacatagtgacatcccaaatttacagacattccatctttatacatctcatgacagttcctacttcattgtttctgtgtgattgtatcacagactgcatcatagaaagcattttaagaaagcatgcgtagcttcaaatgtattcaaatcaagtattcttattcaaaatctgaagatctagattgacaattagaacttgcatttgctgtttttgtttaactatggcaggaactaggattaagttataattctatattttaagaaagtttagactgtgttgttgggctatgaattaaattacatttgatagctgtggcataatttccaaaaatataattaggtaaatttcttctgtcatccatcattttcaactgcaaatataagaattaatctgaagattgttacctatatagagagattcatattgtggtgtgcatttttttttgtgatagtaacatgtgctcgtgattaaagcaaaggcaaaaatgcagaattatttaaaatatgtatttggtagaatctaaagttaaaataaaagcctcctcagagcctcacatgaaatctgcagccgtttcttggatcaatgtgattccttccagacctttccttatgtcaatacaaatgtatgtgtatacatacctccttttccccacaaaagtgggataatacaatgcatattatcctgcagctcgccaattactcgatttaaatagtatgagatgatgttgctttagacttttcaaccgaaataatagcagaatttatattgaccaagattaataacgttaaaaatattatctacagttctagttcttacctcacaaattgccagattatcaataaactttcaacctcatttttccatacttcttgcatatattaaagccattttcaatttataatgtagaagatataaaaaatgcattacgccaggcatggtggctcacacctgtaatcccagcactttgggaggccaaggcggtcagaccacttgaggtcaagagttcaagaccagcctggccaacatggcgaaaccccatctttactaataatacaaaaattagccgggcatggtggcgtgcacctgtaatcccagctactcgggaggctgaggcaggagaattgcttgaacccgggaggcagagattgcagtgagccaagattgcaccactgcattccagcctgggcgacagtgaaactgttccaaaaacaaacaaaaagaaatgcatatagctgtttcctcaaaaaaaaaaaaaaaaaaaaaaaaagagctttaaaggacaaccatattcgtaatcaataggcatcataagataggttcaggacaaaaacaatatattcaaaatcataaaaaggtacatgtttaaatgtaaacattttatttatgttttaatcaatgttcaaactttttctagggttcttctttactttttcctattcaaacatcttaagacctccagatagggctagaaatatttttcgtgctagaattcaaggcagattcctaaataactcattgcatcatttcttaaaaaaaaaaaataaggaagaagagaaatgttagggaatcatataagcatttaggagaagagggtggaggcccacacaacactaatggaacagtcattggagttgatatttgaagctgggccaccactttcccaggccctacgcagggtaagaacttgaacattgaacattctgtgttgctcagtctttattccatatcccttttgtggttcatgctagtacaaaaaaagaaagaaaggaagaaagaaaataacaagtaaagaataataaataataattttaacatctgttaatatattttcttaattatataattttggggatttatatgcttcccataaaaggccagacagcaaagactgcagtagtaagaggaaatcatgcagcaattagtttctaatctaggcttgttttatcatcttggaagtctggcagagttcgcccttacacttcaggccaggcaaggtcatccattttccgacagatataaaaataatcccagctgttaaagacatctggtgagcaaactagtagaactgtttaaactactcactgtgttacaaatgaacaattagaagagatctctaggctctaacactgtacagctattgaggatatctgaaaacatttctttccttggctgattggaaagccctgtgcaactgcttcctcttctccagggtcctcaacagctcgtgcaaaagctctatggatgacaaaagtcataagattattaagaaaataatcttatgactgcccacaaaagcagattattttggaagacaacatattatgtgttttatttttcatataaacaattttttattaattcttaacaaacttgtaaaagcacaataaaaggtaatgtcacagagcaaaattgctgcttgattatgatctttagattacacagaggattgattctgctagttgcatttctattctgactacagttactgttccaaaaaggaattatttttatgctattttgcattttcattattgtgcttgtgtccttggatcacattaatttggtactgattctatatttatgctcagaagactaagtcatcagactttagatatgctgttatatattatcacttgggtcatttgaaagattttggtgggtagtttattccataaaggttacagataaaataagtggttaaaaatctaacagttacctattaaaacaactaaaaattgaaataacacaaaatatatatttctccttcacattttccaacagaatgcagaaggcattaattatcattaaacattcatattctcaagaaattaattaaaaatagagaaggaaatctccatagaggtgaggcccatcagtatcactttaaaagtcagaaatgggtgcacaactatatacatttcagaattttacttattttgaaagatttattttggaagcacttaaatttttaaaaacaggacaaagggctctaggggagaagcataactcatcagggagagaagctgctagatatcacaattacaaaaggcaccattccatatatatatactccatttttaaatgctgaatgaaatacatttttaaatgctgaatgaaatacatttcttcatgtggatgtacttagccatttctgtgattctggtattttaaatgcaactggactagacccaactaaagggcaaattcaaggcaaaatactattgatatcagcatttttcttttcagatatatacctctgtcttacacttaaattacttaaagttttattagaactggtcaagctacaaagggcataaacatttgagagtaatatggagctaacaccaggctgtgactcagaaggcatggattctagtctttgttcatgcacttaattcattttgtttttattttcacagctttttgacctattttaaaattttgtcttctaattctaggggtgagagaaagccaaaaatagatcttttcaggacctgtgttgctgctattcctcgactgcttcctgatgggatgtcaaaacttgaacttattgacttactggctaggtaggtgagaatattatttggccaaaattaatttcgatcctttgttgtgactcctgaaaaaaaaatagaatggtagtttacaattaacaaatatttaccaaatgaggtactgggtatgggcaggaaaaaacaaatttttaaaaattatttttcccatattcaaggggtttaaaatccaacttagaagcaaatacgtaagcacgtaaggtcgctaacaacccaaagcctgtgttgtgcaaactaatggcacaaaaatatacaatacatgattcgtgggtaagagattactatggactggggaaggcaacaaataactcctgagagaaggtggaacttgaacttcctctcgaagggaaggtagagttcagaaaggtaaaggcagagacatgagcaaaggcacagaggtagaaccaggaaatgagatgggtctggccaaaaaagagttcattcggagtctgatacccaatctgaggcccacagacccccatggggacaagaatgcaggtcgtggatatccttaactagttttagtatagtgcttcagaaagctgccccaaatcatatttatcaccttcccaatgcacaatccaatgagaacctaaaatttattttctttgagtgaaattatcttattataatttagtaagcttagttatctcatgttgatctggagctccagttgacagttatgcatgtctttaatttaaaaatcaaaagtgacataacctaactgcaatttggaaagcaaaattattagacacttgggatgtgtggaatgaggaagaacaaaagtcattggtttggagggaaaaaagagaaaatagtttacaaacccaatgatgaaaggaaattgaaataagactgaagaggtagattttcagctaatcttaagtacttgttgaggcatttggactgatgaaattttaagctggcgaataagatgacaaaaaatgtcaatttaggctctataatctgattatggtataatttttaaaaagcctggagaaggataacaaatagtcatgctgactgaatgaatgatgcattacacatagcctggtttactcacatcctctcaccttctgagagcacctttcccatcaatattcaaataaataacccaaacttccaccccacatggctgcacataatctggtggcctcctgaggctctgagtgtccctgtggagccccgcacctcctggttattgtggtcatggtcctctcttacgtgggcagccagcttgggtccctctgttgattacctcttgctatctagtaatagcttttagaaactactgccctttcccattctttaatttgcatttggacacagccactcccttcctccttcctgacaccactagcacaagaacagtgctgaatgtgaaggtttcctgaaggtctgttaccttcaaaaccatgatttcaagccgttgtgctctctaaccacagccttccaccttctggctgccaatgtcacccagccctgtagtctctttctgctgtcatcagcagccttccagccgtggatccttcttccttccagtccacacttagggtgtaacttttgagacctagcaaccacaatatgagtgaagagtacattccctggaagcaggaaagcagagagaaatgggaaaaaataatcctggatcaaaaagggctttccacttcagggcaaggggaagacctgtggaggaacaaagagtgggtttccaaagaataatgaacacgatgatttaggggctgggggaagctgagggaaagagagactaagactgtaagggtcatccatgctaatattgagtcacccgggatgagggcagagactgagaataaagaaaagctgtgagacaagggctagagctactgaaaacataaaggagagcctgtcagtttgctgtggacagcattggagagggtggcatgaccaggagacgtgtatttccccagagcacaggtggctgagcgaaaagcccctctccaaggcctcatgactgtctggacaaagacggccaccatctaacagacatggaggaagcaggacacgagaatgggaagaaaacaatcctctaaaagcctgaacttcatttccttcattcctttgccattttactacctgcatgatccggacaaattatttaaccctcaagcctatccttttcccttggtaaaattttggtgaaattggaatgagactgcctacctcaggactgttgcgagggctagatgacaagacatgtggttagagagaggaggcgtctgcagggaaaaagttttcagttaaattgaagtagaaggaaagttcactttattcaatagaagtctaattggtgattatatacactgaggcctttgaagtaccaagttttttgaatggcatgcagtgttctctttctggtaaagtctctaatgctattttgctataagtctgagtgggaggctcctacctctggaatcaccttgacagcccaatccagtgacgcccaaacccccagaccatggtgccaggcgtgttgggagggaattctgtcagatgtggttggaatgctagtgctatttatagtgcgtcctgtttattataagttacattcttaccaagcccaaagcaatggatgctgttttttgttttttcttttttcttttttttctgagggaacagaacaaataaatattcctgagagtctaagtcttagggagaaatcaaggaaatgactggacttatatgggaaacccatgaagggacctttttaataagcttcaaaagaagccagaggctgttctcctcagggggaaggataactagagtaagcgacctgcacatagagtcctattaacctgtgagaaaatgaccctcttcagatctccttgagagggtcagaggacaaaagtgaagtaattcaatagcaataaatgtgggtttcaagtgccacacaagaagtcttcagttactttatacccccacagtccagttgccttcggattcaattgacctgagataatatatggtctagtcagagaggagtgagacctgttatttctgacacttcacagtctcatccgtggtacactttttatttaaaaccttgttttttttcataattggtaaaataagggcagtgttcatgcaggttgtccatccctcccagctcagttccctgtaaggagtttcaactgtgtgtcccacacagctgctcccaggcccttcctgcactttgagtaatggctgaataccacagacacttacacctcagacacatattagtatgttgcacatgacaacagtgtatacaacgaagctggaaaactgccttcttcaagctactagatttttgactttacatgtattgctcagccagctcataatatggccaagtgtgagaacctttccatgtggctccatggaagcttcacaggccctcctgacattgtggtgagatccatgggggtgcttccttcccattctctgcagagcctggcctgctcagctgtctggatccctgaggattctccagatagaaagggcagctgtctccccttggcagccgccatctttttctctcgttctcctctcctagatagttcctgctctgtcatttgaccacaagagggagctttcactaggagtccacaggctcctttccttgtcacttcctgcagtgctttgcatgcacaaagggcttgctgttgagtattcaccctcctctttcaaagctctcagcaaatgttagtttattatttttagatatcttcacattcaaagaacatacaccatgctatacaatgcatttcatatacattatgttaggtaagctgggcacattgttcattcttatttttagataaggacattgaatttcagaagggtaaatctgattgcccaaatttatagaattttccaaatgtcattggttttatgcaaaataataaacacgttttatgtggtgtttccttattatttgtagaaacttctaagataatgcatacacagattccacagtcttctagggtatctaaaaatcattaaacatttattctgctttcccttttccacatatgcctgtgttgtggaaagtggttagttgtttggagtagctgaaagagaacttgtctcaattgtatatattgcctcaataattcacttagtcatatttctgtattttaattgagatatagttcgaaccactgtagatagatgggggttcattctttaatagcctccaaggagaaatttccaccccttctggtgaactaccctggtggtgaacagtccacctctctcaagctccttcttttggaaatccttgtctgctgggcttcactttcagtgtttcttcctccacggcccttgttgacattgtggggcacttctttctaataagcttttgcttatcttgcctagttcaaaggaggatgtttctcctaatttatcttttcttctggatatggtttgtgaatttgaaatcaccccttttctttcatgtatctctgtacaagaacattattaaaagctactaagctgattccatcagaatctgaagcttaccttacacaagtgttttccattaaaagtcatatttctgatctgaccaaccaagaaggcagctttgtccaagttctatttcctcattttatgacatgtcctgacttgtccagtagcacccttgtctgagcagcacgtgcccttgtgatcacaccactcacttgttctccatcaccgcagacagggcccaggaccattggcagtggcacacgtggcctgtgcagaatacagctatgcattcgctttctgacgtgagcagtgagaatcatgccaggcctgcttagtgctcctgatcccagctcctgggaggggcagctgcaactggtattggcaacactggtttcttttattttaggcttctgagagccaaatcagcttttcagaaatttagccttagttccccaagctagccagacatcttctcaagttgctttctcttaaagtctttctgttccctcttaattgttgccaccaaactctctcaaaggacagtttttaaaattataactgcgtctgtttaatttgcagctgagacctgttctttctttcctggtctagtttctctatgaagatggcccagttgggggaactgctgtcccccaccctcatccttgctagagaaggagatctaataggatttgtaaatctgtaggccagctctacgctactttcctgagtagtcagaatggctggacatctttctcatttaactccaaggcttcctttcccttttagatagctatttttttcccgctttataatgtaaaatcccatgtgtttcacaagatcttgattatctggtcaaaatctaacaaaagtaaaaatgaggaagaactgagtggaagagatggcaactgtatctgacaggcagccctctgcttatatgcttcgagggacagacacagggagggagctttgtcctcttcacagcttcttccccttacccctcacctactacccacagactcgtcttgataggtgatttccattcagtctcagttctgtggcagctgggcctttttcttctacaaacattccacttttataaccagctgagccttctatcccagaagccctttcccctccctggtcttcttcctccaggaatatttttgagcctttcagtggtagagcatgtaaacactgtcattttaagagacatggccaccaagaatagcaaggactacactgccctggggctccaagagtcctgaaaatgatcctgcattgtgggtttgaagttaaaacagattctagattgcaaattgtgcgtgagagcaaagttagatgacgagtagaatcaatctcatttggaaagctgaaagtattggcccttacttaaaggcttcatgaaaatagaccatgacatggctttcgtccttggtgcttgtctggtttcatgattatattggtttgctagggctgctgtaacaaagtgtcacaaaatgagtggcctaaacaccaaaaatttattctctcacacttctggaggctagaggtccaagatcaaggtgtcagcagggttgtgtcctgctcaagactatgagagagaatctgctccaagcctctcacatggcttctggtagtttgctggcactctggcatcccttggcttgtagaagcatcaccctgatgtctgcctttatcttcatatggcattatccacgtgtgttgtctgtctacaaaagtgcccttcttataaggacaccagtcatattggattaggggcccacaacctctccttaatttagctaattacatctgcaatgacctcatttccaaataaggtcacattctgaggtactgggagttaggacttaaacatatgaattttgtgggagacacaaaattatgaacactgtcattactatcagttaacatttatgtagtgtctgcaattcctggttactaaactattacctgtcctaaaaacggtggcttgttatctgtggaagcttattttctaagaccttcaggtccatagacaggtataaatatagtaaattagaataataaacataagatggggaaatgacttcaagtgcttttcataaactagtgttttcaaaccatggactgcagagatgactcagctgcttggcgagtgaaggagtgttttctccccagatgggtgggcttcaggccttttaccccagctttaaccagagtggctcaggctttatgtatctatatattgcagtttgtattagagttctccagagagaaacagaaacaataagatgtatatagagagaaagagatttattgtaaggaattggctcatgtagttatggagactggcaggtccaaaaccttcatggggggccagcaagctggagatgcaggagagccagtgctgccattcttgtctgaaggccggcatgctagagattcagaagagccaagtttccagtttgaatccaaacacagtctgctgtagaaccaggaagaaccagtgttgcagatgaagtctaaaggctgttgaattctctcttgctcaggggagtccaatcttttgttctagtcagtcctgcagctggtcaaatgaggcccacccacatgagggagggaaaactgctttcctcaaagtccactgatttaaatgttaatctcatccacaaacatccagaataatgtcagtcaaatatctgggcactgaggcccagccaagttgacacataaaattcaccaccacagagctctatataaacttttgttggaaaaaaagatagatatgctgctgaatgaaatataaagaaagtttgaaaacttctgttttagacaattctagattggaagcccaggttaaagccttctcattcttctttcagcaactactgaagaactgtagatttaattgtataagacgtccctgaaaaattagcttagatcttccttctcagtgtctgtgtagaactttacatgcttttgagacagtaaatatattccctggctcagtgtaaatctgtgaactaaagagctttttacctgatttatattgtcaaactggaccaattggtgtactttatgctttataaaataagacaagagtttgcttatcttatcaaacttttgaaatactatctgagagtgataactggggtgacttgtgtcaggcttgttttgtgagaagtattttggattaaagattagaagtcctaaattgaattcctggctcttccctttgttaactttgagcaaattccttaaccactctgggcgacaatgttgtcttgtatttgttggtgataatatctgtcctgggtatgggagcccccattgactctgccatgttccgccactgaacacctccaggctactgagttctaaatatctttggcctctgtctgcccttgccccaccacacttctatgctttgggtcaggccctcaccacttgttgcttaagtcattgcagtgacctcttagatggtctgtgccttgtttcttctccaagacattctccctattcctgcctgactctcttttctcaagcgtgaatctaatcatgtttctttccctataactttcaggatacaattcattttcttctaataatagctaacgttactgagtgcttactctgtgctctgtgaagtgctaaatattgcacatggatcattcagtgaccctcacgacaggtttatggaatgcagttacagttagtatccccattttaccaatctgaggcttagagattaagtgactagcctgaagtcacgtagctaataagtgacagaggcaagaccctgatccaggcattctgactccagagtacacactctgaatcccttccctgctgtgttgtctccctgagtggcccaaagacccttcagttgagctgcctctgcttcctctccagcactgtctcacacctcactcttgcaggcacctcacccaatagacacagccacaccgaactccatatcctaagtgctgtacatagggcatgtgatgactgaatcttaggagggtctctcttaaaagcctttgcttattaaataaatgaatgaatatgtaaagcagtatgttagcagtaatccatcctaccaatgtcaagatttaatattattgtgttgttctagattaaaccacagatacactagaattctgttaacttactcaaaatgtctcaaccttggcactattgacattttgggccagaaaattctttgtcacagggacctgtcctgtagggtgtcttaggattctggggtgttgagcagcatccctagcttctacccactagagaaatgcctgtaccacaccccaaggtgcacagccagaaatgtgtccagacattgccagatatcccaaggagcaaaaccgatttaggaccacaggcctgactctgattgttcatttatactgagcttctggatgagtcctttagcttctccagtactcaggttcctcatccttaagaataggattcgatactaatttattattctgtagccagtgatgtattaaaaagtgttcatatacagtacagctaaatgcagtgtggtatcttggattgcattctgaaacagaaaaaggacatcattggaaaaccggtgaaatctgagtaaagtagttaatagcttcatctcaatattaagttcttagttttgatcagtgtaccgtagttatataagatgttaacattaggggaggcccgaagaacgctatatcggaaaactctgtattatctttgcagcacttcagtaattctaaaattagaagtttgttttgttttgttttgttttgtttttctgagatggagtttaactctgttgcccaggctagagtgcagtggcacgatcttggctcactgcaacctcagcctcccaggttcatgccattctcctacctcagcctcccaagtacctgggactacaggcatgtgccaccacacctggctaatttttgtatttttagtagagacggggtttcaccgtgttagccaagctgtcctcgaactcctgaactcgggcaatccacctgcctcagcctcccaaagtgctgggattacaggcgtgagccaccatgcctggccaaattagaagttttttaaaggtatttatgtaagtcatttactaagcaaaaaataagggagacccattttcagactcaagtagaagagatatacattaatatctattaatccttgttagctctagaagaccagttaataaagtaaatgattttattttcctttattcgtttcacaggctctctattcatatggatgatgaattgcgacatattgcacaaaattctcttcagggtttacttgttgacttctcagattggagggaagatgtactatttggctttaccaacttcctgctccgggaagtaaatgatatgcatcacacactccttgattcgtccctgaagttgctgctgcagctgctcacccagtggaaactagtcatccagacacaaggaaaagtctatgaacaagccaacaaaatcagaaattcagaggtgattttcacaccttacccatgaatttatattctttttttttttttttttttttttttgagacagtcttactctgttgcccaggctggagtgcagtggcgcgatcttgactcactgcaacctccacctcctggttcaagtgattttcatgcctcagcctcccgagtagctgggattacaggtgcacaacatcacacctggctaatttttgtagttttagcagagattggggttttgccgtcttggccaggctggtctcgaactcccaacctcaagtgatcctcccgtctcagcctcccagagtagtgggattacaggtgtgagccaccatgcccggctgaatttatattcttttattcatatatgtgaatgagtggcagtctagaacctttagaattcttacttccagccacctaagaacttcctccctggtggtgggccttagttcttccactggcataaattgtgaccaagaaactcagagcatgatattccacatcaggttagacttgtgaacattcacaaggctatttagggaatagaaattggttttttcagagaagtatgattgcaaatctatttgtaagaacaaatgactacaggccagggacttagagctggatgtgggtgtggatgtggatgtaggtgtggatgtagatgcagatgtagatgtggatgtggatttgggtgtggatgtggatgtaggtgtggatgtagatgcagatgtagatgtggatgtggatatgggtgtggatgtggatgtagataggatgtggatgtggatatacatgtggatgtgatatggatgtggatatagataaggatgtagatgtggatatggatgtggatgtaggtgtgggtgtggatgtagataggatatggatgtggatataaatggatgtgatggatgtggatgtagatgtggatatagatgtggatgtggatattgatgtggacgtggatgtgggtgtgggtgtggatgtagatatggatttggatgtaaatgtggatgtgatagggatgtggatagggttgtggatgtagatgtggatattgatgtggatgtagatgtggatatggatgtgaatattgatgtggatgtgggtttaggtgcaggtgtggatgtagatatggatgtacatattgatatggatatggatgtggatataggtatataaaagtcagctgtccactagttatttttagccagaaacatatgggctgctttgttcaatatccacggagaggacagtgcagtcttgtggtttctttatcctttcatgtctcagtcctaaatggttaaggtagtgataacattttgcagagcgcattgaggaggagtgttgtcagaggagaaccagggtggtgggaacttggcattggcaatgagcagatggagaaaggggtctggctggagaagagtgtaactgagagtctaaagactgtggaggctcatggcagtatagtagcatctggggaacagctgggattccttagaggctaaccccagagatgacattcagctccttctcccttccctgtgttgtagacatgccaacacgataggtagaaaagcaagggttatatatgcttgtaaggggaaaacaaaaatgaaggtggaaacttccctgttgactggcttgcttttactttagattcacttggttggggattgggaactttcagaatccatcacagagctgtgcaaaacctagattagaatctaacaaacaagtaagcaaggagaaatagaaagtaaatgtttgaaaatttgattcaatagtatccaaaagtctatggagaatttaaataacaactttggccactttgattgtatatacagtgtaataccaagtggtatacatgaaaggagttgtgtttttatcaacattaatagcctttgaagagttatttttcatcagaagtaacagatggttgatggtattccgcagcagcaattgatctgaaagacagaaggggatctaggatatttcatgaataataataaattcatagacatgtctggttctaaaccatggtcatttattttaatatttacaaggtcaaatgtgcaaaaaatatgtaaaacatgagtgtattcttcttcctttgttatttcgctgaatacagaatgttgttcttattgcataacagctcatcgcaaatggctccagtcacagaattcagtcggaacgaggtccccactgcagtgtactccacgctgtagaaggttttgctctggttttactctgcagtttccaggtggccacacgcaaactgtccgttttaatactcaaggaaattcgagcgttgtttattgccctggggcagcctgaggtatggattagtcttctgaatttttccatttcttactttcaactcttctgaaatttagattaaaaactacaaatgatgcattactatttcaggtacttttatgttacatgtagtgtttcattcattgttaggttttaaactattgtaataacattcttgatctactagatgtaagtcatattttctaaaagcaatagaaaagacaaatcccagttctccagggacattactttgctaagaagtgaagaattttaagattaatttaggctatgaatcatttccttcacagtgttcagcacatatctaattaagaagatattattactttatattagagaataaacttgaaaaatcatatatctcatttgaaatgatcaaggtaccaaagagtttggcaaattgaaagatgtttaatcttgatgatggtagaaaatggcatcacaaaaaacacgtcctcttgaaatgggagaaggaagccagttattaagcatgatcaatgcctgctaacaccccacatttggctaaatgccatacaccttgttcagagaaaacacttattgctatcttgcaagctggcatgggtggccaaaccaaatgcataatttgatgaaagagggaccagcttttcatgtcatatatttctttagaaaattaccactttctgttttcttcttttaaaaataactactttggttttgtaacacttgacatagtcactgtctttataaaatattttcaacttcacagtcttttctgttcatatttcttcagatagctttctgatgtatttcagggccacatctctggcatctggtaaatgaatctctaagacatattatattttagcaaaccttcatcaagtttgtaattatgaaagtaatgataataataattaccatgtatgtgtcaggtagtgtgctaagtgctttataaataatatctcatttgaccctcataataacctaaggattggtttggttattatcccattgtacagatactgagactgaggcttagagaggttaactgcctcctgcaaaatcaacagctagaatgtaacagagccaaaattcaacaacagatatatacacatgcctctaacgccccacttcttaagtgctaatccactagactgcatcaaagatgttcctcatatgttgctttctttgaccagccataattttttttaaaccattgtcattcacacagaaatagagacatcccaaggcttttctataaggcttttgagtaaataattttatattttccaatttctccataagggatggtgaatgaatatataatatataaataaatgaatattcatttatacattcattacatatattttgttcataatatataaatgaatggatgaattaatttataaatttatgatatataaatgaatccattcatttatgtattattcacatagaattttcactaagatactctctcgtgccctttccaatttgcatcttgtatcaaatagttacatactatgtagatactacaaagagtgtgtggtcagtctagtttctttgggactaaaattcagtcacagtaaacaatttatcagttattttaacagatcaatgacttaaaataagtagcattttagttagcagtctaacaaagcatattcttgcagaatttctactcctcgaaattaataacatgaacactgtagtgaataatgtatggcactggtagattctcatgtacatgtatgagtctgaaattcaggtatatgtcttttcagtacaatgtgaaattggagctctaattatcttccactaaaacttgaaagatgaagctcagaaacacaggagttttactcactgccttccaccctctgggcactcacttttctgtgagaaaacccttatcactatctcacaagctgttctgcttcatgtatcagacgaaggcggtggggtgggtggggaggattcattttcccatagagagtaatcgcctcccctttgtacaggatgacgacaggccgatgattgatgtcatggatcagctaagttcttccattctagaaagttttattcatgtagcagtttcggattcagtaagtacacatttgattccaattaatggctcttaaaagctctggacctatctaaaatagtcagtgaaaaattatgtggaataatttgggtgtttatgtcagattaataaactgacccaaaggtacttatgaagataagactagtttttcagatgttaatttaagagacattcagataaatttcacacaaaatctggatcttaggaatatagataatatttttaaacaacagttttaagaattgctcaggattcttaaggaaaattactttgcctttttcattgtacttatcacttaatactatatgtaacacttaatattgtacttaatatgtaacttctatttatgtggtactttatagtttacagagtgctttcacatttattattcgatttgattctcacagttactgaaactcaaaaatgttaaggggtaagtccacagtcacacaaaaggagagttttaaagcccagggtcaagtctgggctctcgaactctcctccccaggtttggactctgaacctaggagagctttatctgctacacaaatacattcttcctttttaaaagcacattggcaactttcaatttcctgaacaagtgtagaagggaaatttaaactgattttagttatctgacttttaaaaaataaaagtataataacaggacctggattaatttgggctaaatagctgaagggaggcagggcagagctgagactccttgcagaatccatgttactgatgttgctgatgcctgatgtgcagatacttgtcagataattataaatgtatacaaaacctgaagacatttcagagctcttcatggccttttctaacttgattgaaaacagattcctatttttagtggccctgttcttgcttatgatcataataataatacactaaaactataagccaggtactgcagaccttaacagtaatagtgaaatagtcctacttcttttagaatttcaaattgttctgacatggaatggaatactaagctttgtttaatgtacgtatcctacttgcctacagataacactttatattttgttcatgtgcttttgttctgtgtgtaccaaaatcaaaatcttaacctgggtaaccagctcagcaatactgcagttaggaagatatacagaaacggggagagagtaatgggagaagcagtgactgctttgtgccaggtgtttttacagctgttacttcatgtaattcactgaaagatttggtgagatcagcattataattcccaagtcataaattcaatacacagagattctgggatgttcagtacttttctcaggtcacaggctttgggcagagcctatgttgccatctcatctctcaggctctgtagctccagctctgccccttacagcctattgaccattgaggccacaattataacactcttacccatgggaactcataaacccaacagttaattcatcattttacatgcctaacaaacataaaggcagtgtcctctcttggcacaatagctagattatttgaaaattgatgtcccctgaactttggtatctagacttaaaagagaacaaaatggaatataagaacttactaatatagatatttatctttcaagagatttcaagagatttttatttttgcttgctatcatagggcaagaatatgtgggtatcttggccaggtgtggtggttcacgactataatcccagcactttgggaggccaaagaaggcagatcatttagagttcaggaattcgagaccagcctgaccaacatggtgaaaccctgtttcttctaaaaaataatacaaaaattagcgaggtgtggtggcgattgcctgtaatcccagctactggggaggctgaggtacaagaatcgcttgaacctgggaggcggaggtggcagtgagccaagatcacaccactgcactccagtctgtgtgacagagcaagactctgtctcgataaataaataaataaataaataaataaataaataagaatacgtagatatcttatctcaaaaactgtcagtagaatgtccttcataaaagggattgtgcttagccatctctctaaatcaaagggaagatatttcagtgtaaggaaagatagagaagatcatagctttaagaacgtgttaattacaatgataaaaacacatttgtgaatctcagagatgaataacttttcagaattttaaaatactgaatccatgtttcagtttaaatttactgtcatatattcattcaacaaataattagtgaacagtttctgtgtattgatgcacagtgctctgtggcaataaacctgtcaaaatgtgacccaggttcttaaattttgcacttaagctgcttatcatctagcataggaagactgatgaccacacaccaaggtcaaatgtggtaggtgcaggattggtgtttcagattcaaagccagcccagtgcactcagcaaaagcactgtgcaagaatgagtagtcaggctgagccttgatgaggatggataacttcagttcgggtttaacttacaacctacctcttatacctacaggcaacattaccactcacccacaatgtggatctgcagtggttggtggaatggaacgcagtcctggtcaatagccattatgatgtgaaaagcccttcccatgtctggatatttgcacagtctgtcaaagacccctgggtcctctgcctcttcagcttcctccggcaggagaacttacccaagcactgccccacagccctcagctatgcctggccttatgccttcactcggctccagtcggtgatgcctctggtggacccaaagtaagggattcttgtgttttcctctgccctcttgtttttccatttgccctcttaaattttcattttgtgtaagagattgggatgttatcatcccaatttctgaacttcctactagagaattcttaacattgagtaaaaacattaaaaaaattttgtctaaagctagtggttttttgccttaataatcagtatgattgtctaagtctataatttcagacttttaatggtaaaagatactttaaagttcttctgtttgacttttcatccaatgcagatactctttgaataacattcttaatcgacagttgttcaactctatttgagtacttcctatgatctttatttaataagtgatatttaaaatccagaacttagtttcactcttgttttcgactccatatttctagtagcccaattaatgccaagaaaaccagcactgccggcagcggagacaactatgttactttgtggagaaattacctaattctttgttttggagttgcaaaacccagtattatgagcccaggacacttaagagcttccactccagaaataatggcgaccacacctgatggtacagtgagctacgataacaaggtgacatgacatgcttcagaagaattattctgtaaggtttttttttagcttgtttgtctagagttcacagtgcaaattgcactgtgcctgccatctggagtattatgggatcagattttcatcctacacatttctaaattccattgagtgtttatatgaataatttattactcctccctgacaagcagggaaccaaagataaagaaaagttgagaaacctgcttaagaccatagagtgacttgtatttattcgtgccctgaggtttggtttgtgtcctacaacaccacactacatttctttcactcctcactgagtattcacctttaaatcatgccttgattaaataaattatcttgttaaagatagctttatagacttaaatggttttaaaaagaagaccgttataaaaaaaatttctttagaatttgtgttccaggtgagaattgcattcattttgctgtattaaatttgtgtgtgtgtgtgtgtgtgtgtgtgtgtgtgtgtgtgtgtttcctgaaatgatggcagtgccttgggatatggttcagtactttgaaactgttataatgggatcatcctttgattaaaggaaccatcagttaccatgttacctctttttcacttgtattcaacttatttcaggccataggcaccccatcggtgggagttctgttaaagcagttggtgcctttgatgagactagagagcattgagatcacagagtccttagttttaggatttggaagaacaaattcccttgttttcaggtacagtagtcttaatgagttgttctaaattcatacatgctgctgctattgtagttcctttattaactcagatttgagtctgtgtgttggcgtgtgcccagagagtttataggctttgtgtgacttcccactacatcgtcttggttgatgtgcatgtaacaagcattccttgcaactgcctctcctgtcacttttagtcattgcaactttgattttacctctcagattttatttcactggcaagctttgttttagacaactaaaaatgaagatagttcagtatcaatcccagttggccagactgttcagaggttatcacatcaaaataataacagtctgctcatcagccatttacccaacagattctcaaaggttaagcattgataaaaccctttccaatgtgttcagttccattggttgatctttctatttttttttctttttttttttcttgagacggagtctcgctctgtcacgcaggctggagtgcagtggcgcaatctcagctcactgcaacctctgcctcctggattcaagcgattctcctgcctcagcctcctgagtagctggggctacagacccgcgccaccacatccagctaatgtttgtatttatagtagagacggggtttcaccatgttgacaaggctgttctcgaacttctgacctcaagtgatccacccgcctcagccccccaaagtgctgggattacaggcgtgagccaccatgcccggcttcattgatctttctatagggcactttctttgccttaatgtaaccatatacctgctttctggattccttatttattcacatttgcaatcaaataatcattccatctgaagtactgtcaaagcctttgaaagaaacattgtaaaatgttagtttggtttgcctctgatgactttagataagcaacaaaaccctataaagacaaataaaatcgcaaacaaaattttccatgtagatagaaatgagaaacctccaagcatttatgagaaaccctacttgaaaaataaagattaataagatgttttagaggctattgaaaaagatctaagttacttatggttagagtcagattttattcttttgtttgtttatttttttgagatggagtctcgctctgtcacccaagctggagttcagtggcgtgatcttggctcactgcaacctccgccttccaggttcaagcaattctcctgcctcagcctcctgagtagctgggattacaggcacgcaccaccactcctggctaatattttgtatttttagtagagacagggtttcaccatattggccaggatggtctcgaactcctgacctcgtgatctgcccaccccggcctcccaaagtgctaggattacaggcgtgagccaccacgcccagcccagattttattcttaaaagaagtaattgtgggttctgactgcgtaggttaccagttaaccagagttttactagttattggttaattaattaagacaaaatatcatatagaaatacaaggagatggacgggtgcagtggctcatgcttgtaatcccagcactttgggaggctgaggtgggtggatcacctgaggtcaggagtttaagaccagcctgggcaacatggtgaaatcccgtctctattaaagtacaaaaattagccaggcgtgatggtgtgcacctgtagtcccagctactcgggaggctgaggcaggagaatagcttgaacccgggaggcagaggttgcagtgcactccagcctgggcaactgagtgatactccgtcaccaaaaaaaaaaaaaaaaaaaaaggaaagaaatacaaggagataacaataacaatccctgaaattacccaacattcttacctgaagaatctaagattgttttgcatatatagacctctaaatacttctggaggcaggtaagattatgcaaccaactagcctcatgagtctagaaaacttaatgtctctgggcctcagttttctcaactgtaaaattggcataataaataaaaatatataagtgtatctgtctaattttttaaatgttagtatagagaatccatctcataaatttattgagaaggcatattaaatgtaaatattcacaatgtaaatatttgttaaatggtagctgtaaagtggaggaaattatcgatgttattcccatttcttcgatgaagaaattctaatgtctgcattggagaaatcaggaatagaacccaggctttctgtctctcgatatggaatgtcatagagtttatcttcctgtctttggattttcctggctagtgatgtttaatagaacaaaatatcctaccagaaagtacaaggttttcaaacttgggcatactacagacaaaatacctacatactagtctgacaacaagctacatcttatctttttgtctgttttttgacctagcaattcagaagttatttcttgaagaagagaactaattagattagaaagtgtaatgttgagaactggagataatcagaacaaagatatatactgtgatcaagacttacatttttactacataaaagaaaaggttttgatgggaatctcacaattttagtacttgccatacagaattttttatttattatatagtggaaataaaggaatttagttctgaaatccaaaaaaggctttgttttaaagtcaactgtaagtcagtttgcggagcacagatcccaaatgcagcactgtggtaattgcacccatctcttttccactaattagactgaaaatttcttgtgtacaggggctcaattttatttatcttgagctccatagcttgcagtaaagtgcttgaatttagcaaatacttggaaaatattgtttgtttaattgttcacatagggttttgtttttttgtttgtttgtttgttttttgccatagagatctccagaacattaaatcaaaatcaagtcaacaaatagattttaagccagaattatatgcatagcactggaattaagaccagtaatacaaagtataggccaatacctgtttccagcttagcacgtgattgggaaatggagagatcagggagattgtgatgtcagaagcaaagtgtaaaaagcaagtgatttgggattaaatggatatagagtatttagtgacaagtttggtgtcaaaaacaatgaatttcaaatttgacctttttcctccacagagaattggtagaagaacttcatccattaatgaaagaagctctggaaagaagaccagaggtaagaatttgaatttaaaaaattaaggcttggttttttggacaatcatctgaatttaaatcaaacctagtgatttcccctaaagaatacaaacccctaacaccttttaacaaatgaatctttatattttaacttttgttgtttttattatttttcagttttcattatttagtataaaatggttctatagattttatgtcctaaacatacaaatgcaaaacaacttaaaatactcatgtttgtcaactattacattcttttgcaggaggtttgagttaaaattgaattttgggtttttgtgtgtttgcttgttttttcacaaggagttgaatggccaagaatgtaatttgtttcatctggcatacgaggcattttccctagcatcaccttccctgaagtgaattctgaaaaggatgaacttataatgtaccaggataaaaataataataagactagaaaagggccaggcgcgatggcgcacgcctgtaatcccagcattttgggaggccaaagcgggcagatcaagaggtcaagagatcgagaccatcctggccaatatggtgaaaccccatctctactaaaaacacaaaaattagctgggcgtggtggcacgcgcctgtagtcccagctactctggaggctgaggctggagaatcacttgaacctgggaggtggaggttgcagtgagccgagatcacgccactgcactccagcctgggtgacagagcaagactctgtctccaaaaaaaaaaaaaaaaaaaaacctagaaaaggaggcttctcatatagtagcaatgatacaagaaatagcagaaattaggtcaggtgcagtagctcatgcctgtaatcccagcactttgggaggccaatgtagaaggattacttgaggctaagagtttgagaccaggctgggcacatagcaagacctaggtctacaaaaatgttttaaattagccgggtgtggtggtgcatgcctgtagtcccagctactagagtagccaggtgtggtggtgcacgcctgtagtcccagctactcgagaggctgaggcagaagaatcacttgagcccaggagttcgaggttatagtaagccaagatcacaccactgcactccagcctgggtgacatggtgaaatcctatctcaaaaataaataaataaaatgtaaaaataaagaaataacagaaattcagcagtgtgaataagaacaaacagtgttacttccatgaccagaactgggattatttcatgtcccctgcccctttcactggtttgagatgcttctgcctttcagcagacactgggagcatctgggaaatgaggcttgttggttctcaacattgccacctaatatttactgacccacttatgatgtttttttttcttacagcctgtagatagcaagcatttcctctgaggattaggaagaaagaaaaatgtatgctgacttttatgcttagaaaattgaaaatgactagattatgccttttgttaataccattttctaaaacaaagttaatattgttttgcctgtgtctgtaagtgatactacctctttctacacagaacaagaaacgccgagaacggcgagacttgttaaggctacaactacttcgaatttttgaacttttggctgatgctggtgtaataagtgacaggtagggtcagaattctaccgagttgctctcttctcaccagactgatctttttgttttctttctgtctctctcttttgtcttttctttgtttttaaatataatacccttaacttagaaaaatccaaaaactcgctttttcttttttcatattttctttacactgcatataggttaggaacaactttagtgtgtgagttgtgacagtgaatcttagttttcatgaagcctgtattactttgacataaagactgatcatctaaaagtttcattttcctttattccagcacaaatggagccctagagcgggatactttagccctgggagctttgttcttagaatatgtggacttgacccgcatgctcctagaagctgaaaatgacaaagaagttgaaattcttaaagatatccgggcacattttagtgcaatggtggccaacttgattcagtgtgttccaggtacggtgatccgttacaagaaattaccattcatgcttggaagcccattcgtgttctttattacggtgctttcgtctttaaccctactggcctttatgcaggtctgggatggtgaagtttatttacttcgagatactaggacatatatatgagaacagattgtcattactcagcacagagttggaaggggaatgataagtattaaatttggctttgtgtgtgtcatttctattctttgttttggtttccatctgaaaatgaactgatgtgatttccataggaaggaagtaattcagaaggaacattcacacaggcttcatttttttcacattgtctctgtactaatctgtgaacaggtaatttcagcaatatttcttctctctgactctaccctaccaacacattaaatgtaattctataaagcttaatatattttacatttgattaaatattacattatggagaaaattatctttcacagagcaaatgggtatgaaacatcttcattctaatagaacatagaaaataaaatatctggttagtttgctataaaaaattattctaattaaattttttgatattattacaaaaagccccttatcaactaatatttccgcttttcgctattttgatgttaataaccttctttaccaatccttctcatcttcagcgaccctaaattaagatttcagtttacctcttcagttaaagcgaagtacctatgtgagtttgaaatagacagtctatgctatttccgagttctcttaaagatgggcagcagtcaaaaaacatttaatatgtaagcagcagctgagtgggaagtgttgcagttttcccaggtattgattagaaaaaaatctctgcaggtcctatttttgatctttctttcccactctgagtcaaggtgctgctggctgcaacgtgaggacaggaagagtgcacacttagaaaagaaaatgtggcttgactttttaagtgcatgtttcattgcctaaagaaaactgtagttaaaaaatgaagtggttcctttcctcaaaatgtaagaaatatatataatagcgatatacagtatgtccagtcttataacctctaagtgtgtttttctccctagttcaccaccgaagatttctcttcccccagcaaagtctgaggcaccaccttttcatcttattcagccagtgggcaggacccttcagcattatgttcactcctctggatcgttacagtgacagaaatcatcagattacaagatatcagtattgtgcattaaaagtaggtgatattgtactcacgaatgactgagtcagatggatggtctctctcgttaaactaataaccatgccttaaaaataagcttaaaataaataatacaatatcatagaataaaatctaagcgcacatacaaaaaaatcacatggacacacacgtacatagcttttctaagctcccattttcttctcatatttctcctgtatgggaaccatatatttttgctcatttacccattatatagctgtcttgtcaattaactttcaacctaaaaaagaaaaaaatagacatcacctcaggttcaaaatctacccagagcaacattccctttttaatctccttctatcctagaagactgccagaaataaatttccccccaactaggactattcaaaatcttcagaagcatgactcctttacagcctaatttccttcagaaaactaactgtatatcagctctgtcatacagaacataagttgctgactctcagattacctttgcctcggtggaactaatttaaactatggccctgatagtcagttggacctgccaattgcaaagttattcaagatctcctcttctcctactttcccttgatttatccctccacccacccctttagaggaactaaagtttttatttttcattttatttacctttgattaaggattataattatttactttcatacttttcatatattttatactgtctcagttcaatacgttagtccaatatttgtcgtaaaagcaaaattcgaaaagctatatttatcttataagcagaattcacttgaaacattgaaggaaagcttattttaaatattgcaaaatagttttttggttttgaatacttactctgatcataaagagttgttataattataaaattaaatgtccacaaaggtaaacttatgggtttttaattcttatgaaaagagccaaatttggaatctggtattttttattaaagctactaaagaatgctttaaaaatcatggggaaataagtgtctttagagggcccttatcatttataattctgacaattatggtttataaagtcagttggataccattagatcattccaagtttcatttccatgtcttgttgtgtttttatcatcaggcaatgtcagcagtactgtgctgtggccctgtctttgacaatgtgggcctttccccagatggctacctatataaatggcttgacaacattctggcttgtcaagatttacgagtaagtataggcaaaaatacattgtttttgaatgtcttctgtgttctgcctcagttgagttactgagatgtgtaagcattgttcacaatacctcttcacacatcagccacacaagtatagatttatgtgttgtttgctttacgctatgatacatcaagataaaaaagatagtaacatttatcaaaactgaccataagctgggtcataaagcaaatctcaacaaaggtcacattagtgaaatgatagagactatgttctctaatcagagtagcattaagttggtattcaattcaataacaaaaagataattttaaaaaatacttcctgataaccagtgagttgaagaataaattactatggaaactggaaaatatttttaactgaagaataatgaaagtactatatcctaaacttgtgggctgtaagtaaagcctttcttagaatgaaatgcatagccttaaacacatatacaagaggacttcaaaaagttttgtgggagaatagaattaaaagataaaaattttaaaaatataaactttatttcttaataatctccatcaaggttaagacatttttcgaagtctttgcttactccatgcctaaagaatccatcccagacctaagtcctggaaacttaaccatgtcaatgccacgttctctacattattacctgaagaaaattcgtgacttttagagatttttttaagatgaggaaaccaaaagaagtcagaaggagccaaatcagaactgtaagatggatgcctaatgattccccatcaaaactcttgcaaaattgccctcatttgatgagaagaattagcaggagcattgtcatggtgaaaaaggactttctggtaaagttctcccaggtatttttctgctaatgctttggctaactttctcaaaacactcttataatagcagatgtcattgctctttagccttctggaaagtcaacaagcgaaattccttgagaaccccaaaaatctattgccatgacctttgctcttgaatagtccacttttgctttgactggaccacttccatctcttggtagccattgtttttattgtgctttgtttttaggatagcactggtaaagccatgttatatctcctgttacaattctttgaagatctatagaatcttaattccatttgttgaaaattttcattgaaaactctacttgtctactgctgatgagttttggtgcccgtcacatggaacatttgctaaagtttaatttttcagtcagaattgtataagctgaacagattgagatgtctgtagtgttggttattgtgtctgctgttaatcgtcagtcctctttaattagggcacaaactaagtgaattttttcctcacaaattggtatggatggtctaccactgtgggcttcatcttcaacatcatcttaaaacaggttttctatttgtaaactgctaatttctttggaagaattgccccatacatttttttaaagcagcaatgatttcactattcttccacccaagcttcactataaatttgatatttgtacttgcttcaatttcagcaggattcatgttactctgatagcggctcttttcaaactgatgtcttctccttcttagtgcctcaaactaaattctgttcagacatgttataacaagttagcacaagtttattttggtgcaaaaaatttttaatccatgcataattttttcataatatacattttccatgagctttctgaagactctcatattaaagagagaaaaggtggataatcaatgacctaaacatccatcacaagaagttagaaaaagaatagactatcaaactcaaaaacagtaccatgaaggaaataatagaaataagagtagaaattaatgaaagagaaacaaattaatggtagtgatcactaaaccaaaagttgaatttgttacaatactaaaaaaaatcataaatccatggcaagttcaatcaagaaagagagagtgactttctttaaagtgttaaaaaaaagaagactataaaaccagatggctttgctgatgaattccactgaacatttaaagaaaaaattgcatggattcaatgcaaattcttgaagagaaaacagatgaagaggaaatacatcccagtacattttgtgaaaccagaataaccttgataataaaacaagaaaaggttgtagcaagaaagaaaattaaaaggcagtctcattcatgagattgtctctaatacatagatacaaaactttaaataaaatattagaaaattgaatttaatgatatagaaaaaagatgatttaccatggtcaaattgggtttattgaagaactgtaaggttggttaatattcaaatgtctgtcagttcattcacatattaactatattcacagaatctcaaaaacatgatctcagatgtacgaaaagcatttgttaaagttctacatttattcatgagaaaaactcctggcaaaactacaaatagaaaagaacatccttagtttgacaaaaggcaccttgaaaaaaaaaacaccctatgagcaccatatttaatataaaatatgtaaacatcatatttaatagttaatttgaaagtgttctctctgagattaaaatggccaaggaagcttactgtcaccacctctatcaacatcatactggagatcctagccaatgcagtaggaaagaagggattataaagaataataaaacataaataaaactcattgctcacaggtgacacaattgtgtgtgtaggaaattccaacaagtctttagataaagtgttggaattaatcagtgaatttagcctggttgccatatgaaaggtcaaaattaaaaatcaattatatttcagtacagcaacgatggggagctggaaaaataaatttttaattatgccacttataatggcattttaaaattaggaattaacattggaattaacattaaacactcaggaataaacctaacaaaaatgtgcaaggcctcatacatagaaatatataaggcattagtgagaaaaattaaacatctaataaatggaagaatataccatgctattgaataggaagattcactattgtaaagaagtcagttctcctccagaatgatttatggagacaatgcaattccagtcaaaatccgggcaggatatttgtgacaactgaaagttcctttcaagaccagaaatagctaagataactttgaacactataatcaaagtgagaggattgacttcagcagaaaccaatacttactataaacgtatggtcattaaaacactgaactactgaccaagaataagtatatataccaatggagtagaatagggaggccagaaaattacccatgtattatgtatatgcatacatggtttatttcaaagatggcactgcagagctatgagaaaaatggtttttttccaataagtaatttggggtcaattggatagccttactaaaggaaagaaagaaaaagaaatttgatcctttcctcacactttacaaaaattcattgcagatggattgtagatctaaatgtaacagctaaaataatagtctctagaaaagaatccagaagaatatcttcatccctggggttacagtaagatttcttgagcagaatgcaaaaattactaaccctgaggaagagctgttaacttttattcaccaaaagacaccattaagagtgtgaacaggctagccataaagtgagagatgtctataacacacagtcagcagagggttcttatctagaatatataaaggacccctacaaataaataagataaatacagactgaatagaaaaatgagcaagaaacttaagcagttcaccgaagaggttatctaactgaccagtaaacataagaaaacattctcaagctcattaataatcatgtatcttagtccattcaggcagctataacaaaatatcatagactagtggcttatcaacaacagaaatttatttctcacagttttggaggccaagaattccaaggttaaggtgctggcagatttatgtctggtgagggcctttttcctggttcacaggcagcagtctttttgctgtgtcctcacttgacataagagacaagggaactctctggggtctttcttatgagagcactaatctcattcacagggctccccacctcatgacctaatcacctcctaaaggccccacctccaaataccaccaccttgggggttaagatttaaatatgaattggaggttgcggggatacaaacattcagtctatagcatgagggaaatgcaaataaaagccacaggagacaaaattatataccatataattccatttatatagacctcaaaaactgcccatactaacaagtagtgctagaagtcaagatagtggtttctcctgggtaggaaagacaggctggtgtttaagagagtgcccaggggagggttcagtggtgctggtaatattctggtttttgacctggtggtgatcataggagggtgttaaaatgactcatgatatacataggaactgtatactatttctgtgtattttatacctcaatataagtttctaaagtacaataaaagcttgattcttctctcaagtctaactttttaatgactttttttgttttgtttgtttgtttatttgttttgttttgttttgtttttgagacggagtctcgctctgtccccccggctggagtgcagtggctggagtgcagtggcgcgatctcggctcactgcaacctccacctcccgggttcatgccattctcccgcctcagcctcctgagtagctgggactacaggcgcccgccaccacgcctggctaattttttgtatttttagtagagacatgttattttaagtcatttgcaataatatcgtcagcttttatctgctgctaattacttaaagcgagttgggggaaactaggttgaagatgtttgaccatccagttagaatatcactcccacctaggcccaaaccctgtaagtaaaaaaacatgaagaagccagaatcttgccttttccacctggtttcaactgacaagaagagtgaacaactttaagaagaggcaccagaatgttacttttttttttttttttttttttgagacagagcctcactccattgccccagctggagtgcagtagcgccatctcagctcactgcaacctctgcctcccgggttcaagtgattctcgtgcctcagcctccccagtagctgggattacaggcgcacaccaccatgtccagctaattttgtatttttaatggaaatagggtttcaccacattggccaggctggtctcaaactcctgacctcaagtgatgcgcctgcctgggcctctcaaagtgctgggattacaggtgtgagccaccactctgggccagaatgttactttctgagaagaaagtaacatatgtaacctctaggcaccaggcttctcctggacaaatgtgcatattcactgaccatctagtatttgagagtagcttcaggcatcatcgattcagcatcctattaattctatctagtatgattttttaattaaaaaactttgattaaaaagagtctactgagactgtatttctttttgaaagataggccactaagcttcacaaagtatatttagtaaccaatcctcataatcatatttcctctgattttttccttaagagactttgtagtaggaatagacgttgatacacaagtatacttcacatctgccactataattatcactattcctactggcatcaaaatgtttaggtgagtggccactctgcatgcacggtggtaacatcaaatgatcccccacaatactctgagctaatacatagaggatacccttttgtatattggattttttaaaccaaatacgtgtatttttcagaaatattttaaatgcaaaaaaaattgccaataaagtcttcgtccttttttttttttgagacctagtctcactctgtcacccagcctggagtgcaatggcacgatctcagctcactgcaacctctgcctcccaggtttaagtgattctcctacctcagcctcctgagtagctgggactacaggcacccaccaccacgcccagctaattttttctattttttagtagagacagggtttcaccatgttggccaggctggtctcgaactcctgacctcaggtaatccacccacctcagcctcccaaagtgctgggattccaggcgtgagccaccacgcccagccactcctttccagaggtaaaaattgagaatagatggaccctatgtaacagacttacatgatcaaatttaatgtatacatttcagttttcagttacgacattatactcttgaagaatatatgacataaaaaccaaaatgaaagctcggtcttccctttcattttactcagtttatattgactaagctttatctgtatctttctctagaacattctttcatcaaatgggaataatattgatttgctccatgtattcaggttcatcaacttggctgcgaagttgttgtcttgctactggaacttaatcctgaccaaataaatctttttaactgggcaattgaccgatgctacacaggttcctaccaacttgcatctggctgcttcaaagccatagcaactgtgtgtggaagcaggtacgaatttttataagcagtgatgagtggcaagtatgtttagggttactttttgtgatatgaatgacggagagctgttttgcaactatatgagcaaagtaagttctatgagaatataaaatgttctgtatgtccccagcaggtaaactactccctgtaaggttgcagttccattggtttttctcattttatcaggaaatgatttgttgttatagtacctttctttttaattgcctggaaattcacagtcaggtattacagcaggatttgaaaatgacaaagaagatacattataggaattaaaggaatgtctagaaatgtttataacgagggtgaactatagcccatcagccatctttacaaaagaccaaacccaggaagtggcctaaaatttttaaactcactttatccaaaacttcagaaaggaaaaaaagaaaagaaaatgtgataccaaaggttctatagattacacttttaaaaccattgcctttgttatataaattagttattcagtgtagccattcagcatgatttatgtgctgaaataagttcatagctaccaagaaagggttaataaagattctccaagttgcataagctattcccaagaaagagcttatgtatcagaaaaattgagggaaaccagctcgtttatttttgaaaatattcatatagagtgtcaattttcctttttaattaaatgttgcactttaaatagctatcttgagctaccagatcaagagaataaaagtgaattagttttaaattccaatctcttagaggtctaagttagtaaaagcggtattttggaagacgtctactttcaataaacctaaaatgaacatgctatttagagagacaagtttctccttaaaatttttatctttcttttataaagatagtagataacatttcatatctaaaggtttcagcagtagagtttttattatagattttaatatgcataaaagagcaaatgaatataacctaaactgcctgattttccatcaagttttatttcctgttataagcattactaaaaaatatactttaggacattaccaaaggaacattgttacaaaaatctctttgtccagagtgcttttttttaaattttcagatatttcaacattctaaaaataaagttttgttcacatgaccctttgattttaaaaaatatatttagaatctatggcttgggcttctttctttgacaaaaataagtttcacctcttcgctgcccttctcccagtgaacttggcttgagctatcctaatcaaatttattgcattgcatggacatctcacaaaacattacactgcatttctctgaataaatctaggtatttttccttagggagcacaaataagtgcttaataaatttaacaacatagtctcaatttcaataatatctctagtcacaaaaatattaggtcataaaacctgctatgttccaagtatttttttaaggcatcattgtacactatcttggtttcttagacaaatattgcatatctgtttgcattcatgacactcatctattctgaaggaagggcagagggcaggagaatacaatagcttgaacccaactgtccagatagtgaccagcatttctgccatttctcaacacagggcatgttcagaatttaaaatttcagctgttgcctaaatttgctctttccacataaattctcagcctgtgtagtctagacaggcctccagagaggcttgagcagtcattgtgcttgagtttgcagtacttttttacaaaaccaattgtgatattttcagctcttgcttgatttgtcttctgtaagtttgcttctaaaaagcaactgaagaccttatgaaatatgtttctgaaaagtcatatgcaaactgaattttattttaagtttctcaaacaagttatctacacagtaactcctacaagtcattttctaaagcaaagaattcttgtaagataaataatgatctcctccttttcaaataggaatgattatatcctggatttatttgtagaggaatatgacagtttataagtacatttatttattaagaaaccactcataattgactttaaaatacctaaaggattaaatttttttaaatgttcttgttgatttaaattttctactttagctttagaaaagaggatttgccatttttgcataattaatgtatcagtgttcattagctgtggcaatggggaaaatggttctctacatccttctttttggttacttttccagcagtaaaggactgtgtgtgagtgtgagagtgtgtgtgtgtgtgtgcatgtgttgtgaacttactgttctctagtcaaaactctacagctatgccatgctatgactctggtgatattaggagatagaaagtcagaacagaacttgaataggaccaaaggaaatgaggataaagatagaaagtgatggtagaactggcagtattaattttgcaaaatttttcataaaacatgttaatatatttgattaaatgctattagatacagctcactactataatttagtacaaaaaattgcttacttgttaggcagctttagttcaaataactatttggcttctgtgtgtgtcctaattaattttcccccactccaaatgagattagaataagatagataaggaaattgagaaagaaactaaatgactttccaaggttataaatcaaggtaaattgtgtattaagaatataggccatttccaatcactagcttaacgcaccagaattctcctcacattttaattaaatacttaagaatttcattatttttacttttaccttccaacacacttttaaaacgtgtttaatagatattttagaattgtatgtaagaacaaagtgcaaagtgttgatttttaaataattttgttggatttattttcggtggtggtttttgttggcattgtttgtatgtttgtttttctttaagttaacattctgtaaatcttcctaatttaagtcaggcctagcaaacttgaattcttaaaagtgaatgcctatttcttcagggaatattatccatctatcaacaaggaagacaggcaaagcttatgattcataaatcccaatcacactccctaactgatgataaatagccctatttggttatgtcagccatccatctggagtatttcaggagagcagagttgggaatctgggctccagaaacataccatcttgggttcaaatcctcactccacctctaatcaagcagctgtgtgttcttgaacaagttactgcagatgcctacccactagtaaaatagggctgatgatagggttagagtaatgattaaacaaaaacaacctcttggcctaaggcctaacaaatggtaaataccccataaataatgttattcaatagttgctggaggagaacagctgtgaagtaatcccctcaattaaccagtaaaatctttctcttcagaatacctcagagccatcttgagctttgtcacatagtactaggtaagccagagtagcggacatttcccaaattcttcaacatctcctctcttctagatagttttatttcttgtttactttttgagtctcaactacctcccatatttattttatcatttgatttttatttggtatgatcacagctgtctttatcttttacccttgctctgcctatgctgaataattaaatattgaaaggtataagattccatttctcagcctgttttcaacatctaagtacagatactttatttgtactcttttgcttatttgaaatctctctcattgtttcctcctctgggtttctttcattttctggatctgttattcctttcagtgttgttgcttatgaatttaatagctcattcttcaacaacaaaataaatgctctgattacaaggtcaagtgcatggccctgcctagtaagagggaggctttgtctgcccctttcctgcctttaaatctccagcgatccagcaatatatttggctcatatatatgtatatttgtatatatataaatgtattagtgttagattccagtgtcagaagacagagacataggtaaagcatctctgctactataacactcagaagggagtttcctttctacttttataggcagaaaggtctgttccaagatacagcaatttgtaacaattccaaacttcactggctatgaaatgcactatcgtgggctgtctaggagactgagagcattgtaggtaagagcttgaattctttgaagtcagacttatctagaagtctgggctccaccacttctacatgacctgaagcaagtacttttctctaggctttgcatgcttgttgtgaagattaaataacaaatctaagtaaaggtcttggcacagtacctggcacaaagtaagcacataataacatcagtgtcacccatcattcaacatcattcttgcactcatcatcatcaccaccatcatctggcggtagttccccagtttttcatcagacccaccaaacttagactgtgtttatttaaaaatacaagttacagaaaaataaacattttggagtaaaaattaataaacctattttggatggcaatatatcagtatgtaccaaaattttaagtgtgccctttgaccctgcatgacctctctatgaattttttctaaagaaaggccagcacatttggtgtttgtggcactataataatgaaaaagtgaaaacagtctaaatatctatcaatgcgtgtcaaaagttggatttcccaggaaatagactgagatggatatttgaacgcaggacatttattagggtgggcccttggggtcaacatctatggagaaatgaaggaattaggactgggaagagaaaagaaacctcagtcattcccactggggctgctgctggggaacagatatgaccttgacctaggcaaacctctggctgaaggcagttcccagagaaggcttcagatcaaggattcagctggaggattgagtgcctccatcctgaaagaaggatctaggtggcacaccacagtacgcattacaagagtagttgtttatgatatgttcctagaatggaatatgtggcagctattaggaagactgaagtgagccttatagttcagtgaaaaagcagatcatcaagcagtacagacaggtggtgtaatcacatttatgtttaaaaccctgtgcattgaaggagtattttgatgcaaatgtctgtatatagacttggaagacagctgaaatatcaaaatgttgacagtaattgcctcttggataagattaacaattgggagaatgaaaggacatgagatacttctacattttattctattcacctacctgcaagcaacaccaacttgcagccctgtgagtgaaccatcttcagggcggaccctgtagccctatgtgttgcttgaatcttttagaagaaaaatatattcatgtcataaaaattaatatttgagtaatgttaaaagtagaaaaactttttcatgtgtataatttctcactgaacttaatgtaaaatgggatgtattcatagtaggacatgcctttctagaaaggtgattgtctcattctgttttctgttgcctataacagaatgcctggaactggataatttatagagaaagcaatttattccttgcagttatagagactaagtccacagtcaaggggcctcatctggtgagggccttcttgctgatggggactctctacagagtcctgagatggctcagggcttcacatggcaggagagttgaacatgctagcttctcttcctcctcttataaagctactggccccactcctatgatatgtatcaatccattaatccatgaatagattaatccattcatgagggcagtctcatgacccagtcactacttaaaggcccccgttctcaatactgccacaatggggattaaatttcagcatgagttctggtggggcaaacattcaaaccaaagcagtgattgttctaaaacagaacttcttagataatgtaattatgtagaatcaaaaaaaagattcccaaggaaaaacaactaatatgttttttcaccttcaaactatctttttcttcctgaagtttgtttgaaaataaatagcagtaactcaccttctacatataaaccgtttaatagttcaactcaaccaggtgcagttgttcacacctgtaatcccaacactttggaaggcccagttgggaggatcacctgagcccaggaggtgaagacagcagtgagccatgatcatgccactgcactccagcctgggcaacagtgagaccttgtctcaaaaataaaaaagagagagaagaaaaagttcaactcaccaggagttttctacttacgacttcttttccactataatctaagaaaatacatatggtgaaaagataacatctttaaatagaattacatagcaagaaaaaaatggatttaatctctctattctatatggttatactgccaattgccacataatctattctgtgttcctctccccccatcccacacatgctgtcagttaccaaatcctgatgattttatctccttagtgttcctcagatctctcccttccttctgtctctactgtttctgccctaattccagccctcatcagttcccatttgcattcttgtaatagcttccactcttggccccatacaatccattctccacacagcagccagagtgattcttcaaaagtgaatgccgtggcccccctccccagggcaaatcctgtagtgcttctctgaaactttagggtgaagtccataggctggtcatcttctgaacccacctactggcctagcctcgcttccttctgttcctctacttattttattcagtctactacacaaagattcttcccttttacaatagatatcttgctgtttcattcttgtaatctttcaaaatgctgtcctctctatctggaacactcctgtactaccccttccgtgacctggctaatgtcacctggtgcttcaagacccattttacttgtttcctcttcagaaaagacttctctaccccccatctaatgtaggtgtccctcatcaggattctcgtagcatgctgtggatgttccaacaacactcatcagaactagactgtacaggttgtctccatgactaaactgtaagccctccttaaggactgggaccagccttgctatctttgtatcattggtactttgtatgttgttcctgatagttgtttggcacttaataaatttagaagaatcaaatgaaaatattgatttggtgagctattgagaaatttagtacatgtatccttttctgtctttttcacttgttggtttgcattaaagtcattaaagtccgtttgcatcagatagacttttgtgttcttttatcctggtgtcccagtatttatgcatcagatagacttttgtgttcttttatcctggtgtcccagtatttaattttaaaccaaaataaagtcattttcctttatctactgataaatagcaaaagaaggaagcaaaaaatggccagacgggggtaagaatgtcactaataagtgaccgaggtcagcatgccagctagaattttaagaggtaacaatctagccactctgtcttataaaccatgctttttttgttttgttctgttgtgtttttaggaactatcccttcgacatagtgacattgttaaaccttgttctattcaaggcctctgacaccaacagagagatttatgaaatctccatgcagctcatgcaggcacgtatcatttactggcatagaaaatatccatccttgagtacagaaaatagaaatggtagttgattacctaatagctgtttattgataggcctttgtttatttctgcatatcatttgtggctatgaagagtgagaaagtaactatataatcttttgtaaacatactaattaaactgatgttttacctttaattctatttttaaatgggaattaattaattttgttacttctaacctttgttaaatacaaatgctcatgagatatccagctaatgcttttcatactacttttttactttcctacatctttatagatccttgaagcaaagctttttgtatactcaaagaaagtcgctgagcaaagaccgggaagtattctctatggaacacacggcccgctgccacccctctacagcgtgtcacttgccctcttgtcatgtgagctggccaggatgtaccctgagctcacactccccctcttctcaggtaccaggcaatagtcaataatgacatatgtgatcatttctaataatgacgtatgtgatcatttctaataatgacatgtgatcatttctttgctctaagtaatttttctttttaaattctagtttaattttagagttatgaccaggcacgatgccacgcattcctgtaatcccagcactttgggaggccaaggcaggcagatcacttgaatcaggagtttgagaccagcctggccaacatggtgaaaccctgtcactactaaaaatacaaaaattagccaggtctggtggtgtgtgcctgtaatcccagctacttaggaggctaggcaggagaatcgcttgaacccaggaggcagagtttgcagtgagccgagattgcgccaccgtaccccaacctgggcaacagagtgagacagtctcaaaaaaaaaaaaaaatcttagagtgataattagtgatgctaagtttgtaggtcagaattactgtgggctagatccagttacatatgaaagtaaattctataattgttaaatgaaaaaaatttctttatctaaagcagtgtaggcataaacatacatatgacaaatgcaaggtgcttagattaataatactaacttctgcatacattatatatataaatttcccaaagaaactaatatcccacaaaagctaaatatgaacagtgtaatttataacacatataattgctgcaagttgtttggtggttgtgatagtggtggtgttttgtagcttgtattttgctacatatgtaagttgttgaaagtttgaatttttgcatattctttacaatcttcataaatagtttttgtgaatttggctttgcatagtggatggactgccacatggaggataaactgcagttaggtaatgcagaattgctaaagaattgcatttgtcaggccgggcgtggtggctcacacccgtaatcccaacactggagaccgaggagggctaatcacctgaggtcaggagtttgagaccagcctggctaacatggtgaaaccccatctctacaaaaaagacaaaaattagctgggcatggtggcccgcgcctctagtcccagctactcaggaggctgaggtaggagaatcacttgaacccgggaggcagcgattgcagtgagccgagatcatgccattccactccagcctaggcaacagagtgagactctgtctcaaaaaaaaaaaatgcatttgtcacctaacttcttgcctaagcttacgtagcactttgccaagagacagactttggcctcttgaattcatcctgtttttccatctctatcaccacctcaccactgctttgtccagatcttcctcagtccttccctgcctctgcattacctaactacagtttatcttccatgtggcagtccatccactatgcaaagccaaatatgtccagcacttcttaactcaaacttctctgcccagttgtcctaaaaatagctgataacagcctacatttagtgagtggatagtaggtaccagcctccatgctaggtactttatgtgcattgcatttatcacttaatatttatataccctggtatagtacagtggttagaacagaggctttggagtcaggcaacctttcactagttgtttgactgtgggcaagtcatagaacctctaaattacattccttatctgtaatagtaatgactaccccataggatgtgaagattaaagtgatctaatgaaaaccaagcagctggcccagtcctggcatggaattatcacaactaccaccaccaccatcatcattgttttacagatgagaaactaaggtttagagatgttaaataatttgctcaagaccatatagctaggaagcaaccaagtcagaattaaatctagatctgtcttcctccaaagccattgctataaaattagaactcagccaaggggcagggaaaaaaaagctccttttctaaacttgctttctaccttttcattcaagaatcctctactccagtcctactgaatctttgaccaacattccaggtcctcttgtaaatctttgcttctgtacatgctgttgaatggccctcaccccttcttcctaacttcaactttccagaagatctaacttaacatccacctcaactgtgcagacctctccatatacctgaggcagagttagtcacttctttgtgtaataccagaaacagtggagagacccaataaaagcctttttagtaaattaattctcttcttgcaaaactaaaatttatttttatgcacttcacccaagatttgagtgctgcctacatgctaggcactgtgcttgggtttcagaaatacagagggaaataaaagtctctcccatcaaacgttcatagtctagcagaaaagatagatatgcaatcaagccaagcacagtggcttatgcctgtatcccagcaccctgggaggctgaggcaggtggaccacttgaggccaggagttcgagaccagcctggccaacatggcgaaaccctgtctctactaaaaatacaaaaattagctgggcatggtggcacatgcctgtagtcccagctactcaggaggctgaggcacaaaaattacttgaacccaagaagcagaggttgcagttagccgagattgtgctactgcactccagcctgagcgacagagcgagactctgtctcaaaaaaaaaaaaaaaaaaaaaggtgtgcgatcaaatgattttgatacagtatagcaaatgcaattttttaaaaaagaaaaatgctcaatgtattagacagtagctgaaggactaatcaattattgggccaggaatatcagaaaagaattcccagagagaagttgatgtctaagctgtagtttgaaaggagtagaaatttgcatagcagacaagtagttgatagacattacagagcaagagaccattgcatatgcatcagcttagagttataaactagcatgatgtaattgggggattatatagaggtcagtttaggtaacataacgtgcaggaacaggaaaagctagagatggtcgtgggcagatgcagaggccaaaatcattatcttggaaggccttgtgtacactacaaggtttgtaggccagcaatcttccatatgtgctttttgaatcccccttcagagctctgtaaacagagagagcatccaagcaagctgctggggttttgaaagccactgatgagttgcaaacgagaagagggagtatcaagattagaatgcatttttaaaagcctggttgcagtgtggagggtggattagtgaacatccagtctggagagaggaggatagttaagaaacaatggcaatagtccaaggaggaaataataaatgataagggcctgaacaaagacagcccaatgagactggaggggagaaaccagagcgaaaagctgccaagcagaggcacagaagagaatgcctactgtgatatcagggaggtcagtgatgataaccctcctagaaacccaatacagggagaggggaaggtttggtgcaaggcagagatcaggagcccagcccaggatgttgagtgtatgcctctgctggacttcctcctgtatggatgagcctgaactgagggaggtcagtgctagcaactcacagaaggatggaagggattagagccacgggcatggatgagatcaggaatggagagagcacagagtggaagaaagggcctggacacccccacttttgcagactggtccgaggaagagcagaagggtgagaaggaatggagggagaacactcaggagaagggtttcatggaaacataaaggaaaaagagatttagaaggagagagtgagcagtgcacagcctccgatgcagtagagagatcccagaagagaagacctgaacatgactctcttgagtttcgagattcattggtaactgtcagtagtttctgcagggaggtagtggcagaagccagatcacagtggcctggctgagaaagaatgtagaaagagaggctggccctccagtggggtgcagagtcagaggaggagttttaaggatgagcgatattggagcatgtttattagctgagagggagatgctagtaaagtgggagtggttcacagttcaggagagaagagagaaacagtccagcaagtttaaccagatcagaggctcctatgagttgcaagcaggttcaacctacatttccttgaagaattaccttttggctgttttagcttaggggaaattactttttaaaaataacacagaaaaattaggaggttataatagattccaaacacttgtttttaatataaaccctgtggtgaaatttttattgcctgtaatttcaagtgacctaattattgtaaacggccagacaaattgttcaggtccactgaacaagagcatcccactgatgtggtctcacattttatttaaaatatttctggagcagtgaatagagggctatttgcatgtctatggcatttttcttttcttgttcccttttaaaaagggaactacccttgactgtccaggagctacctgggtgcttgggatacctcaggcatacatccctaccctcttggtgctattatctgtcagacaaaatgcaattaacataataaacaagcaaattatgtaatgcataagtctttgctccaaaaagtctatagatttttataccattgtcaaaagataggtcttttgaataactgctctctcttttatttgtttttgggattttttcccccatcttaaagtccagatccttctagtggagtttaaatagttctcccaccataaaactattctgagtctttgcacccagaagtcattttccaccaccgaacccccaaagcactctgtttgtgcctttctgatttcatttgtcactgtttcccttgccccagagtgatttgtcaacataatttgtctgagtctctttcttaggggcaggaactgcatcatttgtcagtctttgctgtctttgtcatgtctagcacagtggcttgcacctagaaaatgccccgtaccttgggacaaatgaatgttctgactttataaggatttgagtatgtgacataacagtcacatacatcagtcacatccataaatgtagaaatcaagtaaattttgaaattttgacctatatgaaacataatagcttagcactgtctgattattgtgatataacattatggtctccaaaataaaaaattataattttaattttaggaaaagggccaaattgattaaagctgctgtttcagaagatcccgtggattatcttggtataattcctggcatctgtgttctattatttagcagccatgagccctctaagcgagattgcattgccacactggatcataacacctgtatgagaccaagctttctaatttccctgaggataaaataccttcttctctagatatgagagataggagattacatcggagcctactgcatatacataatgctgtgcttctctatcttagaaagtttatttggattataaaattaaatgctgctggcagtgaaacaatgccaaaatgctctgagagaaagtaatggtgaaataactggaccagacctagggcttcactgtttggactcacgtgtctcacaggggacacacagcccttggcaggcaccttccacatgcttagcagttttcaagacgactctgcaaagtgggtttattcttcctagagatccgcatgtcactttttaacagccaatgtttcatggaagacactttgtaagacactgggtcagtggaaaggtaatcattggtgttagcctgatcctaaccacaatttataaaagcctgatggatgataggcactgtgctgagcacattgcattcattatgattatatcttttagtcattacagtagcctgatgtggggccctatcagtcccattttaccgacaagggaactgaggagcagagatgttaagtaactagcccagagtcacatgccactagtatgtggtggatctggaatctgaacacatgcccttctaactccaagtcccttattttgtccaccctctgatatacatcttccgctagcagtggatttgaactcactccacttttaccaagcctgtgcttgccccacagtgctatacactttcctgcacagcgcaccagatgtggagcaacaagcttgcagacaagccttggttttatcattctgtggccttggggagctcctgtatgtgaaaatgttttgtaaacgtaggacactgttcagtctgcaagttggcatttgaatttccatttattttggtggaataaggtatggatgactctctgtcactgcaattctctttagaggtaagccagcgattccccacaacacaccccaacgggcgccagatcatgcttacctacctgctgccctggctgcacaacatcgagctggtggacagcaggctcctcctcccggggtcgagccccagcagcccagaggacgaagtcaaggaccgggaaggtgacgtgactgcttctcacgggctgagaggaaatggctggggctctccagaagccacgtcactggtcctgaacaacctcatgtacatgacggccaaggtaaactcagaggaattgtgcttcaaatagcatggctccatcatcagaaaaaaaccctgggttagtcaaaccccggggaaaatgggattcctttaaaaatcacatgactggggataaatagtggtgatggttgcacagaaatatgaatggacttaatgccacaggctgtacacttacaaatagtggtgatggtaaactttatgttatgcgtattttacagcaattttaagaatgataataaaaataaaaataagcctaatatttaaaaaactcacatgaataggtattatgcatgattgatttgtgcattattaactactgtttactgaaagatggcatctttctgataaatggtcatgtttaccccttcttatgattttgagacggtcatgaccctcaaaactactttcagtcaaaccttttgcgtccttacagttttcacacatctcttgggccggtttttattttgttatagtatggagatgaagttcctgggccagaaatggaaaatgcttggaatgctttagccaacaatgagaaatggagcaacaacctgaggatcaccttgcagttcctgattagcctctgtggggtcagcagcgacacagttctcctaccctatgtaagtgtctctcagcccttcaagagtgattattcctgcagggactcccatgtgcaatttgcaagtcagaatgtgctctttgctccagctaaaatagaaatgtccagttagtcacatgaatctcctgtgagctcatccagatattacataaaagttcccttctgccccctagacacaggctatgtgtgctagtgatgcctctgtcatctccttactctgagccttgggacgcagaaacctattgatatagcaggtggatatttttctagcagttactgaaagctgccttctataaacattggacctactatgtaagagacactaagtaaagtgttgtattattactaataagaatgtttcatgtttacatcttgatgctcttgaaacagaataagaaagcagagtatgcaggtttttctcttcaaattcaagtggtagaagagagaagtaagcatggagaaatccttctgaaatgtctgatatttacagttggtatttaaaagtgataggatcaacagaatgacagcatttttaaaacccaaactcaattggcatttctgtgctggttgtttttgtgacaggtttatgtcttcctgctgccttgagtccacataagcctcactgcagcttgcagggctcaggttggactatgaggcctgcaataatgtggagctttaatccagagttatttttaaaatttaaaaccataaaaacagctaaaactcatttgtttcttggggagaagagaatagcaggggactggattcctttttaaacaaaaataactagcagtttttccccagggtttgtataaataaaattatttctgaagatgagaactttgatggcaagttttcagtttagatagaattcacgtacctcaaaagtaacttttaaaaacttagccattagaaaaggtaagggctttaagaacacactgttatcagacgtgccgatgaagagaggtgaattttaatccaagtccttggtccatcctaggatagcacaaagattagctatcacggtgacagctcctgcatgatgacaacttatctaaatgagaggtttactggcctagtgttcctgtggactaggctctgtgaaacatcccttgttttcttttttccttctcagattaaaaaagtggcaatatacttgtgccgtaacaacaccattcaaaccatggaagagcttctctttgagctgcagcagacagagcccgtgaaccccatcgtccagcattgtgacaacccgcccttctaccgcttcacggccagtagcaaggcttccgcagcagcctcaggtaagaagagcaaccgggcagacacctggtcacagatccctggggtttccttcatgtagattcctgaaaggatatgagaatgtgtttgttacttttttcttattcctgtgtgtgcattcagttaagagatggcttaagaataactgagacatgggctgggcgtggtgactcacgcctgtaatcccagcactttgggaggctgaggctgaagtcaggagttcaagaccagcctggccaacgtgacaaaaccccgtctctactaaaaatacaaaaacttagccggatgtggtggcacgcgccagtactcccagctcctcaggaggctgcaggaggagaatcacttgaacccacgaggcagaggtggcagtgagccaagattgcaccactatactccagcttgggcgacagagcaagactgtgtctcaaaaaaaagagaataactgagtttcttagggatcatagggttaatgaaatgatcttgtaaagatgactgagaatctgtggctcaagcatcctccatcacagaactttgtatttcagccgatcccagccaggacattgcagtcactcaggaatctcatttctggatcccccttcttgtatctggaccctcccttggctatattccttcagcgttgattaaaattccccccaaaagtattatcacttttggttaattggtgtctcagcaacctttcatgaaatatatgccatcctcctcaaattccttgaagtctgcctcccttctgctgacctcatgcagtaactgccttccaattcctctcctccctgagtctactgtctcctctgttcgccctacaccctgccaccagagcagtgttcttacagggaagcagtagcacagcaatcagaagtgctaggtgcttggccttacttcactagcattagtttagtaactcctggacccagaaatactaaagcagccaacagcagggccagccactataaataagctcattgcctaagtggccaggaagaagaggtttcaagaatgtaggcttgctttacgagagttaaggaatttggtttgaccataacagatgtctacgattctctcatttcagtggtgtgggcttggaagattgtttagaatgtctgagattgtgcagaagatgtaaaaaatcttccaaacataagaatttacaggaaatctttccctggaattacttgagacttgagcttgacccctcagcttgcatctttttataagtgtttttcttccattcccatctacaggaaccacctctagcagcaatacagtggttgctggccaggaaaatttcccagatgctgaggagaacaagatattgaaagaatctgatgaaaggttggtacacaaatttgacttaatatccagtgtaatgttctgcaataatctatacatagacatcaatacaggtttgtggagtttcataaattttacacgtacataaaaatccttctttgtttttagaaactcagacttactttccaactctactcagtatatccctaaagataacagttatttctgtgcaaagtcagagaagagaaagattaagaagggtgttgttctggtggtggtggaatttcgcatacctcagggcttagtaaaaaccatgagttgttctgctaatggacacagaccatctggaattagaattgccatgtgaaattttcgaatctgatagttgaataatttcttagggatagagtagtcatcttgagatgagttctatgaaacatgattattattattttacttttgctttgtgctgtcttggttaaccaaaacactatcttttcctgctaaaaaagtctccgttccctccacattagctctttaataataatatttcccctatatctcagccttcttattgccttgcctatgaactactcatcagtagtcaaatcagagtcactctttcctgcagttgattgtgaagagcagggagacaaaccaggagagaaaaacaaaactcaatttaaaaaaaatgaaaattaggatgatcctcacggtgcttcagctgagcattttatagtgaaaggtaatgagggagcccttttacttaagaaattagtaaaaaggatgagatgctcatgaattcatattaaaggtaatttaggggatccagtggtgaaaataactcacttagcccaaaatgccccagtaagcccacagtgcttcctgagcatcctgaggatttcatcatgtgtattggggcacagtaggggctggcgtggagatgacctggcacagggctgcctgcccttggggctctgaaggctccttccctaattcaggcaccagccagattcctcactgcatcactgggcagctgtgttaccttcaggcagatgctcatccatacgggcttcccttcagactaaaagcccaaacccagcagatcacgaattatagaccttgtcctttgaagttctctaataaagccttttatttctttctcaggaatgaataaaggtttttatattccacatattagtgaaggtacaagattattaattagcatgttactttttaaaatctatatttgctattaatattaccttctttggaaaactacctcatgataaaagtcacagtatttctctaaagatatttttactttctcactagactataacattcttgatcatttattgttttgtctgagtttcctgtctgaattttatttgaggtagaaagatgatagatctccatgtattaccatctcattacaaaggcctgtttagggccagagttctgagtgtcctgcctagaggttttagtggtgcctttgaacttaagaagccagtaatctctctaatatcaagatcacagaacatcttcaagagagattttcttgtttagctcttactcctgctctgtcaccatatctctgctggtcattggaaagcctgatgcaattatctacccatatatatcacacatattcatacatgtcagattcttttatactgatatttatctacctataacattgattgatcatattcacatatatgtgcaaacatatgtctatgaatatactctcccaatggacaccactattccgttgatcccatatagcacctacactatttgtctactgtattcttttttttctatgaaagtaggctgtgccctcagcctaaaatccttttttctcctcagtctacttatcacccttccttccttgtaatccctgtcatgttgatatatgggtgcttacagacacacttaaccaccagattttaattcctagagaacacagagagactgcgtatctcttacaccaagcttgtccaacctgcggcccacaggccacatgcggcccaggacagctttgaatgtggcccaacacaaattcataaattttcttaaaagattatgagattttgagtgtgtgtgattttatttattttttttagctcatcagctattgtgttagtgtagacagttcttcttccagtgtggcccagggaagccaaaagattggacacccgcgtcttacacatatttctatcctcagtgattagtctactgtgctgtgcatagtaggcattttaaagtgtttatttggtaagtgaatggaaataggagaaatgtcatatccccagaggtggataagctgtccaaccaccaccagtccgctttcccttaccctttcagtaacccatcttggaggacagcaatttactcctttctttacagtccttataggcaaagagcctacagagacagtgttgttcagaaacaccaccccaggctgctgtgttaacacacctcaggagtgaggcatctcttccaccatatccattgtgagggaagcaccatatccatgggctgagggaagcaccatggagttggacaaaatgaccgccttggcaccatgttctttacaactagattaatggttctttgatgtgactcagtaatatttaataatgccgttcctactgacaaaagcacaaacaaaccttatagcttaagtgaaagaacattaaaacaagagtaaaagaatatgtgccaagctaatgggagggtaagacagttggtgtcttaattcctgactaaggaaaactacaacttaacattaacctaaccttgaggccccagtagccaaagtaagaaaagaaaaataaagcaaattttataacattcaatttttttaaaaaaaagctattcaagttaacagtaatctatgaaacatttcaaaatagctagaagaaaataatttgaatgttcctagcataaagaaaaaataaatatttaagatgatggatatcccaattaccctgatttgatatttacacattaaatgcctgtatcaaatgatcacatctaccctgaaaaatgtacatctattgtgtattaataaaaatttttaaaaactatcagaaaatgtaacagaaagtacacctaagtctaagatttttcatatagtttattttactaggcatcaaaatcaacatatatttattaaaagagtagtttatagcaatttttaaagtatgcagaaaaaatcttcataagtttttgtttttgtttttcagacagggtctcattctgtcacctaggctgaagtgcacaaaatcacagcttactgcgggctcagcctcccaggctcaagcagtcctcctgcctcagcctcccaggtgactaggaatacagacatgtgtcaccacacctagctcatttttttatttcttgtagagacggagtttcactatgttgcccaggctggtctcaaactcctgggctcaactgatcctcccacctcagcctcccaaagtgctgggattacaggtatgagtgactgcatccagccataagtattttcaatatatcaatcttaataaaagatttttataaatttatatgcccacaaagggatttttcatagaaagctaaagtagtaaacctcacctgtataaattttgaacggtctatgttgaaacagagataatttctatctaaattgatagtgttgatatacacaaatatatattaactatcagttatctaagtattattaatttgagctaaatcaacaaggtaaaactgaggggaacatttcatccttctaatttttctcttatcagagctattttcatgaggtatttcttaaggtatgtacctttgatgttaaaagacatcaaagattctacttaatccttgaaattctttgagggaccagacccaaaataagcttcttcaacccagaaaagcaaaggaaaataacagattttacagttgggagtcagttttttactttttccttgccagacatacactttgctacactgtggcttcagtcttctccagaacaaggagaacagtctggaagggacttgctcctcccctttattccagcctcataaactccacccagcacccctttaaatccaactcaaaagggaaaagagatgagttgtcatccatcctgtagttcttccgggtgcaggccctccagggcacaatttaaaacccgacatagagcacagttcatggtagctggaagtgctgtggcgctctccacccgacggaaacctgcagatgtgccattttttcatcaccctgcttttgttcctttctgaatgatgtctgggcctagcagatgctgtttatcactttgcatttatcagcataaatatgattaaagaacttcttcagaaggtaataagtttgtcctttttccagtttattttcataaataccagtctgatttagttggccgatttgtatgaaactaagccaatgtcttagatattctgttcttatagattcacaaatgcccaaaagatataacagtgaagaaggtttgaggtatgaagttactggggaaaagatagctgtcaggatgggggaaatgttgttgcaaatatctaaaaagtgaatgaaaccaagctcattacagtacatttctgtaattcagcaaatccaaatcactgatgcagtgccctaaggttgtacacctgggacaagatgggcatcttaatggtacatccaggagtttttgctgaaacgttactctttctccacacattagtaaggacagcaatagccctgcaccttccagtgtccccaaaagaaatagagtattgatctgttatgagttaagtcagaatacccggtgagtaatgtagagggacacacctattttggcttgagttttccaggtatttctagatagccttagttctttgttttggctacatatatattaagttgataaaacctgctgtgtatcattttatataaaataaatatagacataccattttgcccacactgcccctgaaccacacccttgccctaccttgtagtcctctgtttgagaaatatgctattgatttctttctagaaatcctagatagaagcataataactaataccttatagtccgacagtgtcttgcagttttggaaacactctcaaacatcctttcttttgttcccccaaataaccctaattaaataaaagacagagtattattatgatgccctttttgcaattgtggaaataagttccccagggaggtagaggccttggccatggttacagagccagtgagagagagctcagccttaaagctccacgcagggagttggcatggcactgaaggcctcctgcactgccacctccctgcggtcaacactagacaaggtgtataacttcgcctcccctcagtttcctcattgtagaataaataatgcttatctcaaagatgagtgagcaagattaaataagatgatgtctatgaattaactatacttcaacatttttattttctttgttgttgttgttttgtttttgtttttgttttgtttgtttttggtgggggttacttcttaacaagccacaagagaggccagaccagagagtctttctggtgacattactccccaactaggacctttccctgaacactctcaaactattttaagagaaactttaattctgggtaaagtccaagatttattataaagctatttttgtgtatttcccattctatgtactttgagttgtttaatcattcaggaaatatttattgaccacctactgtgtgtcaggctatgtaaataagggaatcatgttattcagtatcatgcccattttctttccaaagcaaatgttaccattttctagttcagttgaaatattaggcttaaaatttttatcttttcaaggtttggacttgtgcttatgagcaagagtgaccactgaccctctcaaggaaacaagaaatgtttggggtacaatttttacagcattcctttaagaaaagcaccattggcaactagcagctgaaaaaccaactgctaaatcatagtgtcagtttatgagtaagagcgtaggctgggcacagttgctcacgcctgtaatctcagcactctgggaggccgaagcgggcggatcacgaggtcaggagatcgagaccagcctggctaacatggtgaaaccctgtctctactaaaaatacaaaaattagctgggtgtggtggtgcacacctgtaatcccagctacttgggaggccaaggcaggagaattgcttgaacctggaaggcggagattgcagtgagccaagatcgcaccacggtagtgcagcctggtgacagagtgagactccaactcaaaaaaaaaaaaaaaaaaagcgcatatgcacacatgttaatatttcattctggttgttcttgtatttgaaggtttagtaatgtcatcagagcccacactcgcctcgagtcaagatacagcaatagctctggaggatcctacgatgaagataaaagtaagtaccaacaggctgtgggctttcagacggaacgcaagtggtcagaggatggaaaatgagtgttctgattgttcttggtctgattactaaaagggcctatagatattaagtaaccatttaatccacctatgcagatgagcatagagtcagcatcctcaaaagttaaaaaaaaaagaaaaaaccatggacaaatcaaaattataaaaattcaaactaccatccactcctgtgtttctatatatatacatatatatatacttttttttttttttgagacggagtctcgctttgtcgcccaggctggagtgcagtggcaccatctcagctcactgcaagctccgccttctgggttcaagtcatgttcctgcctcagcctcgtgagtagctgggactacaggcacccaccaccacgcccagctaattttttgtattttttagtagagacgggatttcaccgtgttaaccaggatggtctcgatctcctgacctcatgatccgcccgcctgggcctcccaaagtgctgggattacaggcgtgagccaccgcgcccggccgtgtttttatattcttgacattttttcttggtgatgcagctggggaaaatacactaagtcatagtcccattagaaaacacatgttgttggctgggcgcggtggctcacgcctgtaatcccagcactttgggaggccgaggcgggtggatcacgaggtcaggagattgagaccatcctggctaacacggtgaaaccccatctctactaaaaaatacaaaaaattagccgggcatggtggcgggcgcctgtagtcccagctactcgggaggctgaggcaggagaatggcgtgaacccaggaggcagagcttgcagtgagccgagatcgcgccactgcactgtagcctgggcgaaaacaaatgttggcggttcaacatttccacctatcttgcgagtgggtttaaccttgaagctttgaaatgctgctcactcaggataggatctgttcctatgttgaatttctcaatggcatagtctccatagcctattgaaagccttgctaacctgggagttagctttgtgacaggaatttcttctggtagttgggaaaaccaaaaaggtcagtgcatttactgattttgtttaagccctggacagcttctgtagatattgagcagatacagagtattaattggtcacaagttacagaaattctgaaaccaaagaacgctcccagtgacatttcagatttgctaagggaatcagtatcttgtgggatttattcttttttgtcagaaattgtaaatatactgacatttcatgagttaagttcatttcgtaagttggtgctttgaattgttgttttgaattgttttgtttttacagaaatgtgcaatgtcaggtaagaactaggtagttccaataaggccacatttcagctacccttgttctacttctgaatgcacagacaggcagttctctaccattaaaatactaatggaaggcgtgtctagaatccatatgtaattatcatgctctaatgtaggttaagtttcagctatgtccctataaaaccttcactagagctgtcaataggaagtaaaataaagctgtttgtgttttccttcctttgtgtgtcccctcaggggattgtaccatccaaacactgaatagtcaaatctcagtaccataggccgttacttctagaaggcaccagattttagagatgaggaaagtagtacttgagaaatggagagttggttcaagaaaagtctggttactgtggcaatatctggtaacccaaagtttgaggacagaaaaatttaagtttaggccaccttaattcctctcagcacattttggctgattggatatatatctgaaaacatcactgaaacaaagaataacatatcccttcctaacagaaatctcacaatttactttttaattcttcaatattctccctttttgtttccctttcaagttttattgaagagtagctagttacctagcagtacatttggcaactgacttatcctggatgattatctgagaagttaatttgttgcaagtaagttacttgtaggtaatttgctgagagttagaactgagatgagttactagtgcatctgctttaaattttttccaggctaaaattgttgtggccaagcttcatggcatagaattatagggttctggctgctcacttgtcagtgtattagaaaaagccagtagtcactcttcctgagggaagtcctgaccttttccactgaaaccctcttagccacatcccatgaaaagtgggatgttcttggttctggttttctgatgcctgtcctccttcagagcctcagttgtcacaacaggaagacacccctccaccagctctgtaaatgttaaggccagcattctacactggaccagcagcatcaaaccaatgacttcacactaccttgcagaagtgaaggaaagaaaaattatgttattataaaattgcctaaagacgacatagtatgttcttcctcttaatacataaactgatcccaagaataaaccagctggtctgcagccaaatacctgggttaaatcctgtgcccacctgtattgctcttcttaaatgctgctggcctgctttgggagcatgataagaaataaacatggaaagtgttgctgtacttattttattttatttttattattgtttttgagacagggtctcacccatagcccaggctatagtgcaatgtcacgatcttggctcactgcagcctctacctctggggtgcaagcaattctgctgcgtcagccaccctagtagctaggactacaggtgtgtgccaccacacctagctaatttttgtatttttagtagagacagggtttcaccatgctggccacactggtcttgaactcctgccttcaagtgatccacccgcctgggccttccaaaatgctgggattacaggcatgagccactgcgcctggcctgtacttactttaaagataatattgtgacgttcattcattcaacaaatatttattgatgctttaccatgtgccaggcaccattgtaggtagtagggagaaaacaatgaacagaacagaagaagtccccactctcctggagcttacattagagttggggagggaggtggtgctggtgaattggtgatccatgggtggagggggagggactaaagcagagcgagcagggtagaaagtgattggggttgggggtcaatttacatagagtagtcaaggaaagctgctgtaataaggtgatattagggcagagacttgaatgaagcaaagaagtgagccatgcaactgtctgcagatgagcatcctagccatagggagcagcagatacaagggccctgaggctgtatggggcccagcctgatcacagaacagcaaggaagctaggagtggggtgagcaagggtgcgctggtaggagataagccaggagaggaacatggagggggaagaccttgtaaggccttaaaggccacgggtgtggatttgtggagagccgctggagggtgttgagcagagaaagagacactactgaacttgttttacaagaattggtctgtctgctctgtggaacacagacctcaagtgatctacccgccatggcctcccaaagtgctgggattacagaggtgagctaccgcgaccagccaaaactgtgctttattgagatgaggaagactgcaggacaaggatggaagcagtgagacagttaaggaggccattgcagtggcccatgcaagagaggatggtggcttagtctagaagtagtggtgaagatggagaacagtgctcagattctggagatgttttgagggcagagctctctgaatatgtggatgacaagttactgaacctcactttcttctctacaaaatggggataaaatagatacctatcattgggccattaatatgtgaaatgcataggccagtgcctggcatcaagtaagccctctgtgctagttcctaatgttatgatttttattattgttgttatcgtcatcatcactgtgattattatttgggtatgggatatgaggggaaagtcggggatgactttaagtctcttgtcctgagcaaactggaaatatgaaattgtgctttttttttgagacagagtcttgctctgtcagccaggctggagtgcagtggcatgatctcggctcactgcaacctccacatcctgggttcaaacgattatcctgcctcagcctcctgtgtagctgggattattacaggcgtgtaccaccacccctagctaattttttgtatttttagtagagatggggtttcaccatattggccaggctggtctcgaactcctgacctcaagtgatctacccgccttggccttccaaagtgctaggattacaggggtgagctaccgcgaccaggccaaactgtgctttattgagatgaggaagactggaggaaaagcaaattttcatagagatgggaattcaacacgatttaatgtttttcttttcgtatatctgtattctgctttgctttataatgaataattataaattagttaccaagtaataactatgcaagtagttacccaaacaagtaattctcacccatttgatcatgtaattcatactcaccaaatgaaatcattagaaagttatttctggccaggcactcacacctgtaatcccaaaactttgggaggccaaggtgggaggatcacttgagtccaggagttcgagaccagcatgaacaacatgttgagaccccatctatttaaaataataataataattttttaattagccagctgtggtggcacatgcctatagtcctagctacttgggaggctaagacaggaggatctcttgagccccagaatttgaagctgcagtgacttgtttttgtttttcaaacagagtctcactctgtcgcccagactggagtgcagtggcatgatctcggtccactgcagcctccacctcccagattcaagcgattctcctgcctcatcctcccaagtagctgggattacaggcacgtgccatcatgcctggctattttgtgtgtgtgtgtatttttagtagaggtggggttttgccatgttggccaggctggttttgaactcctgacctcaggtgatccacccacctcagcctcccaaagtgctgggattacaggcatgagccactgtaaccagccctgcagtgagttttgatcaatccaatgcactccagcctgggtgccagcgagaccctgtccctaaaaaaaaatttaaaaatgaaaaataaagttatttttacaagcatacatttttaaaatttattctgaaaacatcaagtagagaaaacaagtctcctctccctgaaaataaagcacagttgtctttctcaccctccagatgatccaatttctccctacacgggctggttgctgactattacagagaccaagcagccgcagcccttaccgatgccttgtactggaggatgctgggcccccctggttgactatctcccggagaccatcactccccgggggccactccacaggtgagcagcatgtgtggggagaaggaaatcttagctttgactggacttttctacctatgacaagagaaaaacctagtccaggtcccaccacattaaattatcttatcaatcagtgggatcctgcctgatttgactgtcagcttccagcatattagcagagtttggtcaaatgttaatcaacattcaaagctgcctgtgacctttgaatttctccttgatgtaatctggatatgggcatgcattctgtgatgctttttagactgtaagcaacttgatgagagggaccttgtctttgatttctcttcatcccttagctcttattgcctagtggctagtagactctcctttatgtgattagctcaaccaatgtttcttattgttgtggagctctatgctgtgttacaagttaaactctatttcccccgaataagagccttatataatgttttaaaaacacttaagagttatattgtactgtaacttaatgatctactagtatttccatccccttcagaagttgcattaatttcattatttcattgattaggtgcaatattgctgtaatttttatgactgaaatggtggtggatcacagtgtacgagaagactgggcgcttcatctaccattattacttcatgctgtcttcttaggtaagactggatctaaaaggcattctagccaatcgggttaaaaatatacagaagtaatccgtagagatttcctttcacattgacatcctgtttgactcatttcgggaatattctatctccaccatttttcattgcccttttgtgacatctgctctgaaatgtcagctacttggtcactgtttgaaattgctctatttctaccatgtaaatacagtggtttctcactagtgccacatctacaaatatatccaaaataagttgggcctttttgagagtcttcggctgaaatggtaaattttaagctatgaggcatagtcagcgtataaaaagaaaggatataggacggagtgggccaagccctgagctttgtagagcaaaaatgggaaggggaaccagccagggaaactcagaaattcagttagaaagagactaataaaattagaatctttcagtaacagggatatccaaggaggagaacatctcaagaagaaggaatgctaaccacatcaaatgctacagagaggtcaagaaaagttcatctatcagcattttatgagaacattttacttaagaaataaagcattttatttttcctaagcccaactcctgtatgttggtaacccaaacaataacaaagaaaactaaacattcttttaacatgttcctcctgagtatcctggaatctttactatccctggaatctaaacgagcttaacgtttgtttatacttagattctactgttttgttccaggtttagaccactaccggcctgaagtctttgaacacagcaaaaaactgcttcttcacctcttgattgccctctcttgcaacagcaatttccattccattgcttccgtgctcctgcagacccgagagatgggtgaagctaagactctaaccgtgcagccagcctaccaacctgaatatctctatacaggtaacagagaaggactggtagagagcctaggacagttacaaatgcagagataactaactgcgggtgccagtggagcccaagttaacttctctcatgctatgacctccaactttccacgtggtaaatcaacagtacaataaatacacaccatttcacttgatgtgaacttgcctctcaaaagctttctttattattgaatatttaaaatatatttttcctggttatatatatgattgctgccccattgaatatgttcctcctgatgcattggaaatgtaagtgcccattggccaggagcagcagtctagaacaccgaaggatgagaacacacaaaatagtgacccttgctactgcctgagagcaggtcacagccaaggtgccggatgtatcacttgtgtgccttctagtgcccatgaaggaattttcacttttgaatgattgaccttttccttgaagacaccattagtgggagcctgttaaaagccattgctgttttgaaaccaaaaaaaattcttagaaataggaacagatggcattaactgagacaaagaaattactctgccatgtcacgccattcatgaaaacgggtaatagtggttttcatttagaaccagaacgtttaaaatatcttaaaatgatgatgaagattaccaactaacagagttcagggactaattttttttttacctattcattttacacattgcattggcgccagctgtggtgcgacatttcacatgtcactgtgtgctttctgcattactgtgaaaagggtgcaccttttatttatcacttgtacccaccactgtattggcttctaacagatgttaacatagttgtttggaaaacaaatatgaaatcatcattatctctaagacctaaggcctactgacctcaatttaagcacttcactttgaaccaagctacacttaattgaaaataacctatcaatagcctcttagaaacacaaaactccctttgctgtagatgtttaaactgaagagttctagctgctctaagtcctgaggataagaatgtactttcttaaatgttaggcagagaaaactgtaatatctgataagttgggtatctctgtgtaatcagttttgcatttattataccactgatatggtataaatgatttaaagtgaagatttaccaaaaacgcatacaatattcataggcaagacaaacagtagatagctaaagtgactggctctacaggacacagggaataggtgtacaaagattatgggaaatgttctttttttataaatatttattaagcacctagtttcaactatagttgctttaaatacacactaaaaatgtgtgtgacagaaattattgtcttgactttattataatagaacactgagatacagagaattccataaattccctgaggctacactataagtggcagaaatgttattcaaacccaggactcctcacttctaattcagtatatctatcagacacacaccagcactacatactttttatgattattaaataggggaaaagggatagttgcatatatacattttcaaacccacagcctacccagaggtatagaatgtcaaccaagtatataatgaagaaacagtatttgcttatgccatatttctttgaataccataaaacatattctattaaaatatatcaatatacacataatactaaagcttctgggcacatttactcaaaaatattatgtaaaagtaaccagccattaagtgactggtatcctcaaacagggtatcatttcacatggttttttttttttttttttgagacagagtctcactctgtctcccaggctggagcgcagcggcgcgatctcagctcactgcaaactccacccaccgggttcacgccattctcctgcctcagcctcccgagtagctgggactacaggtgccgaccaccacgctcggctaatttttgtatttttggtagagacagggtttcaccatgctagccaggatggtctcgatctcctgaccttgtgatccacccgcctcagcctcccaaagtgctgggattacaggcgtgagccaccgcgcccagcccgtttcacatgtttaagaagactaatacccaggaataatttattaagagcacagttagtagatgaactgttacagttgaactggttgtttgcctggtccatgcatgcatacaaacacgcatacataccttccttttatagaaagtatcaactaaaatagcagagtagaaagcagcagatcacctcctattcccaaatacacactcatttacacagcagtgcaactgatttcctaaacaaagaaaaactgtcagtctcatttaatcatagccacagccgaaagcaaccattttctccccagaatttaaataactccacacttccctgccctcctctgtggacctcattaagcatgctgacaagcacactgcctagtacatccctccttgaccttcttctcccaccaggtggctttgacttcctgagagaggaccagtcatccccggtgcctgactcagggcttagttcaagctccacctcctctagcatcagtctgggaggcagcagtggaaacctcccacagatgacccaggaggtagaagatgtggacacagctgctgaaacagatgagaaggcaaacaagctcattgagtttctcacgaccaggtaataaggggttaggagtccgctgctgtttgcaggttggtctttcggaaaattgccaacgctttaaaccacacagatggaaaagtgatcctggggttctaacaaagtcctgtttctcttctcaattgcaactgctggagtctgtgtgaacagacactgagatacagagaattacaatttgtgaaaggcagacatcaatagcagtttctaggatcccactgatgtgacagttgatgggcaaggggattttgtggataatgatgatgcagcagatggaggcaggagatggtagtgccccacagtgagcatgcctttagccatctatcagagctgccaggggttagtagttctgagacttggcagagaacttcactctggaaatcaaggatattagccatgatcaacccagaagcagctgccaaggggaccattgtctgttcatctggtccaaagagtcatttgtaaaaggcagtcagaaaccagaaacaataggaagcataataggaaaggaatcaaactaataaatcaaaaccaagaaaaactgcaagtggtactggttaggtcttctggttcttcttattaaccatttagcttgtaaggcttcaggatttctaacaccctgcggtctggtagttgtgtaaaacatgcttacttgtgactgggtggcatgctcccctttctcagtgagttaagtcctggaaatctactctgtgtatgtgttatctaatatctcatgtgatcttgctttcttcagctaatgcatcaattaatgcaaacaataaaaaaagagtattttctttccacaattcatgattcaggttattttgtgcagctctcaacttaatgtgggatttaatgtgcaggaagcttaggacaggagctgatggtgcctacatacagtatgcctgcacatacagggtacttcagagacccgcatgatttgtggaaaggaaaagtattgtcaccactcaccatctgtcagtaccacgtgtttggaataactctcctctgaagttctcccacctggctccattccattcttactgttgaaaaccaagtagatgacagaggctgtgtattcagtttgattgtacggtatttgcagcttgatgtgatcctgataaaagccttatctctgcaaatgctaaaatgtgaaaattgagtccatgtctaaatctttatttcacttaacatttgatatcattttacttaacaaacaaacatgtagcacttatgatatgccaagcactgttctggtgaattgggaggttttaattttgtaaatgaatttaatttaaaacattttaaaatgactctataaattagatgtgttttgagtatgctgataaggtttataagactgaaatgtacttccaaaataattcataaaattgtttaaaatatttttttaactcacattttaagttcaagggtgcatgtgcagggtatgcaggtttgttacataggtaaacgtgtgtcaagggggtttgttgtacaggctatttcaccagccagatgttaagcccagtatccattagttgtttttcctgatcctctctctcttctaccctccgccctccagtaggccccagtgtgtgttattctccccaatgtgtccatgtgttctcacaattcagctcccacttataagtgagaacatgcggtatttggttgtctgttcctgcgttagtttgctaaggtgatagcctccagctccatccgtgtcactgcaaaggatataatcttgtacctttttatggtggcacactattccatggtgtatatatagtttgctaaggtgatagcctctagctccatccatgtccctccaaaggatataatcttgtacatttttatggtggcacagtattccgtggtgtatatttctttatccagtctgtcactgatgggcatttgggttgattccgtgtctttgctattgggaatagtgttacagtgaacatatgcatgcatgtgtctttataatagaacaatgtatattcctttgggtatatactcggtaatggaattgctgggtcgaatggtatttctgtctctgggtctttgaggaatcgccacactgtcttccacaatggttgaactaatttatactcacaccaacagtgtaaaagccttcctttttctccacaaccttgccagcgtctattattttttgactttttaataatcaccattctgactggtgtgagatggtatctcactgtggttttgatttgcatttctctaatagtcagtgatgttgagctttttttatataattgttggctgcatgtatgtcttcttttgagaagtgtctgttcatgtcctttgcccactttttaatgggttttttttcttgtaaatttgtttaagttccttatagatgctgggattagatctttgtcagatgcatagattgcaaaaaatttaaatatgttatatgtttggagtcaggactgtatgtgtagttttaaaaatgcaaaatgacagttatatttttgacattttgtgtgttttgtttaagggcatttggtccactttggtgccatgaagacatcacacctaaaaatcaaaattcaaagagtgctgaacagctcactaattttctacgtcacgttgtatctgtatttaaagattccaaatcaggtacttcatcttatttgcacagatccctctttcagcattgttctgtaatggacactgtctctatatgatgattacagcgccttaaaacggtcctgcactccacatccatagcacgagcatattcacaggggagttctgaagcttgttcagatgctgcctaactgcatggtatttaatgccgtgtatatttgcattatgctatatcaaataattttcccaacatacttgttctacttctttcatttaccttactagaattaaactgtgcctataacattttctttaaagaaggctatgaggaataaatctcattgactctcatcagtctcaacaatgaaaaatagtctggttaaatggctggttgaatggtcaaacaatttttttttaattgtgataaaatgtttttggctttaaaagtttttgctaacaattcctgtgcagatgactattcaatattctaaatacagtgtgactcctttagcattatgatacttaagtgtttgccttctgctgaattccttcaggtccaagttggcctgggctgatttgtgtgtgaaacttaaatccggtttctcaacatgttgtaaaaccatctctacctttttttcctcacaccaggctggcaatattaaatccagctccctggcttttccagctgctctggtaattagcacatttcccagtttgaaacattttggattagccacatatcttttcattatcagaggacacttactaaaaaacaaaagatactgacagaccgaaatgggagagtcatttctaggaatagacttccgtttctagttttgagtttcccctttggaatttgtttaaaatatgaggacctcaaaagccaattaataattgaacacagactgaaggaagcagtttactatttgtatgtaaaccattaattaatctaaaatcttggattgaatgaaaataataaacatgagaaaatgtataaatgccttatgctgaattcttggagggtacttcaggctgcataaagtctaagtctttttgcaccttgaccaatttttactgattctgatttccttgtacatccctgcttttggcctgttttctctatacatacacaatgtattcctggaaacacgtgttagtcagggcggcatagctgctgtaacaaacagcccccagagctcagaggcttaacacaacagaaggttattcctgggtcctgtaacagttcagtgcaggtgtttggcaggtggccttccgctaggtgcttcaggaccctccagcctgaggctgtgccaccccctaggctgaggcctctgctgggccctctgcatccagccagcaggtggaagaagagagagtgagaagaggattcctcaggatgagttgacaccccaggcttaaatggggtatccagtgggtttttttccacatcccatgggccagaactcgggcacctgggcacacctaactgcaaggaagactgggaagtatagattcactgtgtggctggaaagaaaaagaaaccttttccttttctcaaaggacactgttgtgatggtggagtctgaggtcctactagtacagttctagccttcaggttcattgtgatttaaatgagcatttgctcatttgaatcacatttatcatttgccagggtacctaatctccacacataaaatcacaaaatcatttgccagggtacctaacttccacatataaaaaaaaataggttaagtaaacaaacctttattttgataaacaaaataaagacataaaaagcttttttgaagcatcattcataagatacgagcagcctacatgggtttaatcctacgtttactaccctgaatgtgtctgaagtcaattttccaggaccctctgttttctctgcaggaacattttcttgtataatctatttgtccctagggtcaagtagccaagctgcaactaagagcaatgacattgaattatcccttctggcccactttcatgtagcagccaaatgtgctgcagagcctctgtgtcatagagacagcctaagtctctgttttcattcagtcctcctacccttgtagtctgcttttctccctacagagaggcacagcaagtatataatttaatgacctagaattcagtcatgagctttatcttacattttcattcccatctgatcaaatggttttctgattactgagattacctttgtacaattggaaaaacaaatattcaggcaaaagtttaaattatggctgccttcttcacagtatctacacttcaatatctgcatatcaataaagcaaagactttggcacaggccttagttgtgttttgagttgaatagatccactaacagctttcctctcttctgaaatttcctctactctaacaaacttacaaaaaaaggagagtattctatgtaaaaaaagtagtacagaagaataatatgtgaaaatagcagagtaataaataagaatacatttgtgaacctatgttatgtttcagacactatactaggcactttgtaagttgtttaattttcacaacaactgtacgagacaagttaaagataaggaaacaggctcatggagaacaaattcctttcccagagttagaaagcctctgattcaataccaggaccatcttgttccaaagcctttttctactacactatacctccctaagatttattcagaatttgtttttattttaaaatgaggtgggtgcagtggcacactcctgtaatcccagcaactcagtaggctgaggcaggaggatttcttgggcccaggagttcatgaccagcctgggcaacaaagaaagaccctgtttccaaaaaaaaaaaaaaaaaaaaagcttgatgtggtggctcatgcttgtaatctgagcactttaggaaggcagagcaggcagatcacttgagcccaggagttcaagaccagccttggcaacatagtgagaccccatctctacaaaaaacacaaaaaagtatccaggcatggtggcacatgcctgtagtcccagctacttgggagactgaggtgggaggatcacttgagcccaggaggtagaggctgcagtgagccgtgatcatgccactgcactccagcctgggcagcagagtgagaccctgtctcaaaaagagaaaaaaaaaatggttgacttgtaaataagtaccactacaaggtagccctgtgccgttagcctgttttaaacttagaggtaactttgatgccccagagcatgtagagtagagactgacctattctgtggctcttgttaccctaggcttccatctggagcaccagttgagtgaagttgcattgcagacagccctcgcaagctcttcaaggcactatgctggtcggtccttccagatattccgggccctcaagcaacctctgtcagcacatgccttatctgaccttctctcaagattggtggaggtgataggagaacatggagatgagattcaggtatggaagggaagaccactgagctcgtgaaggatgagctctctcatctcaatgaggtgtaaactatttttgagcctttcttctgtcaacaattattccagccatctggacatgtacaatatattttttcaattttagaggttgacttttatatttacaaaaattattccaaggagccttgttctagaaattcagtggatattatctcttttatataagccaacaactggaaatcctctggtggcttcttctttgttgtttttgtggttggttttatttggcaggcggccaggggattattttgtatagtttggggtttctggctgccaacctaggatgcagttatacagtctccctacccagagcagggacctccactgtatctgtccaaagcactacctctctctctatggttagtctccagtagactgagaagagctgaagaaggaatggagagtgactgccacaaggaggccctcaagatagagcccagagattgggaagctgaacaggttgagagctgctggcattacaagctctctggctccggccaagtccttctttcccttcagaaatgttcctggctgggcagtggctcaagcctataatcctagcactttgagaggccatggcgggcagatcacttgaggccaggagttcaagatcaggctggccaacacggtgaaaccccttctccactaaaaatacgaaaattagctaggcgtggtagcacacgcctataatccgagctactcaggaggctgaggcaggagaatcacttgaacccaggaggcagaggttgcagtaacccaaatcgtgccattgtactcaagcctgggcaacggaagtgagactccatctcagaaaaaaagaaatgttcctgcatctgaggaagcctgcacacctacagacactacctgcttccttctttcagccatcagaggtgctgtttaaaacaccacggaggcagctcttcctgtacctctcctcttgatctgtggctttcagacattgccactctgtatttcaaatgcccaccctcccctcagcagagggtcatgcttacccctcgctgttgaatttcaaatgaaagtgatctgttgaggctcttagacataggaaaataaatttgtatgattatctgctaactcctaagccatctgaatttcctaagtggcccttaaagcttattttagacttcataaattaaagcagcaataacattattggaatacagtttacattaattaaatttatcttaggaaattaacaatggttacaagcaatacaaaatgctatctttgcatgtttggcagggttatgtaatggaagcgctcctaaccttggaggcggctgtggataacttgtctgactgcttgaagaacagtgacctcctaactgtattgtcccggtgagaatcagcttaatgatactttgacatcaagtatactgcacaggagtatttgggagatgctggactttaggaaaagtacaaagaaaaaatctagtttttgaagtatatttatgacctgaaaaagtatgtgtaatactttcttaagttaaaaaagaagtcataatacacacaaacacacacacacacacacacattatataagtattttaaaacatcaggaagatagatactaagtgttatctctgaatgataaaatattaataatttttcatttctttttttgtctgagtatttttccaaattttatgtaataattatcctatttattacattggtaaagagaagcaaaagctaaatattatttttaaatgaatatatacaaagcttctgaactgttgccataaaaacagttggaataaatgttgacttcattcaaagaaattcctacctcagtatctttttttttgctcctgccaatgtttaataattcatttcaaattattcacgactctatattctgtttgtgttattgagctcatcttgcttgaaattgagtcggtaatgttatcttgtatccgattgggccttgttttatttttaagttgagcattttttatggataattttggtatgattacaaacatcacacatatttatctatattaacataaagatttatctaaatcagtaaaaatatagcaagaatgttgacaaagagttttaccttttcagcatagacttagaaataatttttcttaaattttggtaagtaccaaaaatttcctttgacatgaacatttaccagcttctttctggatagcataattcccatttctgttctccttatcagtcagttaacagaatattgaagcttatacctatcaggtacattttatttcataattactcctacccaaattcaagcaaaacataaatgaaatatcagtaaactttaaggccaattattgattcctctacattttcaagaagtagcagtcagtattgggctttttgttttgttgatgagggtttctcttgttttgttttttatagctttaaagataaggaaaaataaatgaatagaaagtggcatttctaaagaatgatttccctcctgcagtgtttctcagtggacttgaaaggactggcttttggtgacacatgttggcatcctattaaacttatttatttttatacccagctcttcctcaccagatttaagctccagcagtaaactaacagcaagcagaaagagcacaggacaactaaacatgaacccgggaaccaccagcggcaacaccgcaactgccgaacggagccggcatcaacgaagcttctctgtgcccaagaagtttggtgtcatcgaccgatcctctgacccacctcgaagtgccacactggacagaattcaggcttgtacccaacaaggcctctcctcaaaaaccagaagctcatcctccttgaaggacagtctcacggacccatcccacataaaccatcccaccaacctgctggccaccatattctgggtcacagtggccttgatggagtctgattttgagtttgaatacttaatggccttaaggctgttgagcagactactggcacatatgccactcgataaggctgagaaccgagaaaagcttgagaaactccaggcacagctgaagtgggccgacttctccgggctgcagcagctgctgctgaaaggattcacatccctcaccaccacagacctgaccctgcagctcttcagtctgctgacaccagtgtccaaaatatccatggtggatgcatcccacgctattggtaaagccagcctcgttcaccctgtctcaattctgatggtgactgtgttcatcatttggtacaataagataatatgaacttactgcttttaacaattctgcttaaaaatggttccttgggagtagtttattttttctcataaaattctatataatgtaaatctcaatgatctgtattatagaaaatatttttaaggcagtagcataaaaggggccaaaattatttttaagatattagcgatttctttttagctttccagatcaaactgcaggtgctgttagtttattccattgctctcgtacagaaaaaaaaaatttttttttcttaactcctaaatcttttatttttttctttgcttttctgctttttgttcttcttggaaattctgttggtttcctcttgttttgaattaacccaaatcaacaaaccagatttttcatttatgtctttttgttttgttttgttttgttttgtttttgttttttgagacagagtcttgctctgtcgccaggctggagttcagtggcgtgatctcggctcactgcaacctctcctcccaggttcaagcaattctcctgcctcagcctccggagtagctgggattacaggtgtacgccaccacgcccagctaagttttgtatttttagtagagacggggtttcaccatgtcggccaggatggtctcgatatcttgaccttgtgatccacccgcctcagactctcaaagtccttggattacaggtgtgagccaccatgcccagccaacaaaccagatttttaatgccatggcatgtgacccagaattcatttcatgaagctatcgcttaacagagagggactaagccattccttattttaaagagtcttttcaattacatgactaagacttaaattggttggcctatgtcctctcacaccagtttttcttaaaatatgtttttttgataaaaatttcaaactagtactcagtttggctcagttcaatctgcgccaaaaacatctgggccagccatccttattcacaatagtccagtgcaagataatcactgcatcttaaaatcgcagatctactttactgtcttctttgtaactggtgcaattgtggttgtgcatttttcatagattttgtgttagatcatgtttaagctgattcaaaaaactgcttttgcatcacctcagtataaaaatctgtaacatgccttcccactgttaacagctaaaatataccatattcagctatctccattgtatcttctctaatccagggtttccactgaatgtcttgtgtctcctgcctcagctgattcagcattttgaaaatcccaatcagttctgtaaggatatagccgaaaggattgctcaggtatgagttacagttccacactcaggcagatccatagaggccttcaggacgccctagtgtcaggcaaattacaaggcccagagatggcagtgattttctcaaaaactggaaataataactaatatcacagtaatggaaatataggggtggctgatgcaaattgtcttgcttgctttcattcttgagaatgcaggtgggaagaatttgtgaaaattatattagccaagctaagtatttcctgtaattaccaaaaagtgtatcaatctactttccagatggccagagcttatagtaaaattgctaacatttcttcctattcattgggctattttattcctaattgatttttttattttaaaaggtttgtttagaagagaagaaccccaaactttcaaatcttgcacatgtcatgactctttataaaacgcacagctacacgagggactgtgccacgtgggtcaatgtggtctgtcgataccttcatgaagcatatgctgacattaccttgaatatggttacctacctggcagaggtaagctttttttttttgttttttgagacagggtctcattatgttgcccaggctgatctcaactcttgggctcaagcagtcctcctgccttcgcctcccagagtgctaggattacaggcgtgggccaccattccctgccagaggtaagctttgaaatgaaggataaaatctattatagcttccaagggtaaattatttgcataaaattgataatacactcagtatactcttaacttccatatagtgtgtgcctattaaatattataatacatgctaatggaatcattttaaaatctcacaacagcacagtgatgtagataatatcatacagatctgaggctcagccaggttaaataatttttcacaagtttaaagcagcagagtcagcctttaaacctagatatagctgcctccaaagcttaaactccttctgtttattatggtaacacctgtcagtacacggcacagatcagaaatttttatcctaattacgctgggtgttcaaatcttatttaaggagttaccttgtggcttgatatgtttaatggttgtttgatctaattatcaaagcatacattctgaaataaactttattctcgccttttatgtttgtttttaaaactggaatggtactttgtcatcataccaacgtgtttctagtatattcattacaaaccctacactgacctctgtgtacgttggtgctagaaatacatagaatattgttgggcaagagatgaaatgtattccgtttagcatcttcagtctccaacaagtttattacacaaggtcatgaaatctataaggcaaatgactggtaatcgctacgttgttttagcattttcagtgttgctttttcctttgtgatacgcattcatagctatcactagcacctttcagaagagatgaggacaatctatcctagtttttcttttatttatatcatcaatccagatgccagataggttaaaaatcagccattttctcaaaggctccacaagcctgaaagcatctacctagcagaggagagatgccccatccatcaacatttatagttgatcgtgcaggattttgacttgcaatacagatcagtaatgtgtgacctgtgttcagactgtcagcagcccaggattcacttgctatttccacatccacatctctgacattttaaggaacctctcataagtaccaccttgctggttttaatagtcatctggtcatacctgtccctgcaagagttaactaagcaagcacacacacacctcagcacagaagtagtactgagagaactgatttgttctgcttgcaaaggcagaccttgcctcctttaaaataaggtgaagtgtagatagcaaggaggtaacatttgtctggctcagtaaccataagaagtttcaaaaatgcaaattgtacgtagcatatatatacaagggagtattattcaggaagaaattctgatgtgtgcttccacgtgggtgaaccttgaagacattatgctaagtgaaataggccagaggacaaaaggacaaatatgacaagattctgcttatatgaggtacagagattaagcacatttatagagaaaatgtagaatagtagttaccaggaactcagggcagttcgtagtggagaattattattttgtgggtacagaatttcagtttgggatgatgaacaagttctggaggtagatagtggtgatagttgcataataatgtgaatgtacttgagaaaacaggtggaaagaatttgtgaagattttattagccaagctaagtacttctgtaacaaccaaaaagtgtatcagtgtactctggcagtctggaaagtagattgatacactttttaaaaaaatggttaaaaaggtaaattttatgttatgtgttttttactacccataaaaaaattggttatctaatttgttctgttcagcccttatcacaaaattgtcaccaaaaaatttattatgaacttaaccaaggtcccactgtatataatatatattaacttctgtttcaattacacattctttcaggtcttggctatgcacatacatataattttgtgtcactgtggtattccctggaaccttctttgctcacttattattaactgtgtgtgtatatttctatgtgttggggtagcgcacagagtgctgttttaaataactctggaagtctatcaggttaaggtaacacagtttgcttaaccatctcccttttgttgctaatgttcataattttttccattacaaatggtcttgttatgtagatctttatcaaatgatatttgaaatttgatcaagtaataatagattttatcaaaatccttttatcacataatatcaaatgactctacatttcctgaagtcgaattattcagtcctgtggcatggattgtgggtatgttatttagttcttcaacatattcgagaagttggtcttcataaagatccccccatttgtaatactataaacagtgtataaatattcttgttttcctgtatccccactaaattttgtcattccatttattttttaatttaacactttttattaataattttgaactattttatgtattttctttctagtaaagatattcatttttccacattatagatttacataattatttactcatgttttttgttttgttttgttttgttttgagacagagtcttgctcttgtcacctaggctggagtgcagcaacatgacgttggctcactgcaacttccacttcctgggttcacacagttctcctgcctcaccctcccgagtagctgggattacaggcacccaccactacgcccagctaatttttgtatttttagtagagactgggtttcactatgttggtcaggctggtcttgtactcctgacctcaggtgatccacccacctcagcctcccaaagtgctgggattacaggcatgagccaccgcgccctgctctttcctcatgttttaaccactccgtaaatattgtgtaatttcaacatttagttggatcatctctatcaactttttatcttaaacagtaaacttttatcatgatgtctgtcacatatatgttttccttattttgctttccttttggtcaatatcattgattttttatgattataaaagcagtatatattcataacaaaatttggaagttgcaggaaagtttttaaaaagaaaagaaaaattacccagaattgtagagaaacaatactaacattttaaaatttatttccaatgttatttctatgtaacacacacattcatgtcaatattggcatcatctattaaaaagacaattgtgtatccttcatttcccacttaatattatctgatatcctccactgcctttaaaaatgtcattctattaactgcatgacgtttcattatacagtttgctgttaacttatatatccatttccctagcgttcaatacttgaattgcttacaaagctttcttgttttgtgtatgttttttgccattataaataatgctatggtgaaatcttatacataaatcttaatgtctatctctggtttgagaaacattcctaaaagtataattactgtgtcaaaagattatggacctcttcattgctcttgatcttatttgccaaactatccaatttacatttccactgatatgtaagaatactcatttctttatctccccatcaatactgagtattatcaatttctaatctttgccagtttgataactgacagattttatcttttgtttgaatttgtaatttttgataattggtgtctgatgctttccttttaggtgtttttaaatatttcctcatgtgaattttatacttacatatttacacctccacacatgatatagtctattttgataatatcttcagttcttcatagttaggattttatttcccctcctaaggaaatgtgcaatcaagccaggcatggtagctcttgcctataatcccagatactttcgagctgaggcaggaggatctcttgaggccaggagttcgagactaggctgggcaacatagcaagaccccatctcctaaaaaaataaaaaataaaaaggaaatgtgcaatcctaaatgtgttggaaaacacgggtccttccatacggagatctggtgtgtgactgactccagccgcactttgcccccacagctgctggagaagggcctccctagtgtgcagcagcccctgctccaggtgatctacagtcttctcagctacatggacctttctgtcgttcctgtcaaacagttcaatgtggaagttctgaagacaattgaaaaatatgtgcaagtgagtacttggataacttcactaagcaaccagtcgttctaaaaagatggaggcttttcctgtagcttggctacaaaaccatctgggtgccaggccactcattcattccttgacatccatggcacagccagggcagttaagagtgggagttggccacaccctgagtagtattctgaagagaatgagagcacaagaccccggcacactccggtgcctttaaaaggcacatttccgcctcttggggccacaggctgagtattgaaagcacacgcctgacttggagggcagaggcagagtcttggtttttttatcccgtttcagagaaggagaggggacaaggaactgtaggaactttcacatgtgccgggttctaggcccggtgtttcaacatgtgaaggattattcaaaggctaaaactgtcactttagagttgaagagtggttaagaaacttgcagaaatatacttgaaaatactgcaacaaacaaacaaaaaacatttgtttgaggggataaataaaacaagatgacaaaatgtgaatagttgatgaatagtacaaagggattcattagactagtctctcggtttctgtgtatattttaatatttccataataaacagtctttatgtatatttttaaaaccaagagactggctccaagatttcagttagtaaaggctggagctggtatttggatccaaagccagtgtctttgttttattgtaccaggcagcctccctggcaggatacttggacatctccaaacagctacagattgattttttttttcaaaactgagtctcgctctgtccaggctggagtgcagtggcacaatctcggctcactgcaacctccacctcccgggttcaagcgatccttctgcctcaacctcccaagtagctgggactacaggcgtgtgccaccacgcccggctaatttttgtatttttagtagagacagggtttcaccatattggccaggctggtctcgaactcctgacctcgtgatccaccgcctcggcctcccaaagtgctgggattacaggcatgagccaccacgtccagcccagattgattcttaaagccgtactctgagaagaccagaaacacaatttattttaatgaaaataaaaataaatatcaaggccaggtgcagtggcttatcctgtaatcccagcactttgggaggctgaggcaagaggatcgcttgaggccaggagttcaagaccagcctgggcaacaaagtgacaccccatctctacaaaaataaaaaaaattttaaaaatcagcaaggtgtggtggtgcacacctatagtcccagctacttaggaggctggggagagagtttcccttgagcccaggaggttgaggttacagtgaactgtgatcacaccactgcactccaacccggccaacagtgataaataggaagataggaatatagatagatggaaagatagctcaaacacaccaggacgagtttctagagcctggaagttaatctaaaacacatgaccacagactaaagcagggaggctccaggccatgggagtagtgcagggccacgatggggttaagtagagagcgcctagctcaagagcatagacatccttttctctatattgtatttgtctatttcttctctggaatgtactttgtaacttgtaggattcaagggcaaatgctaggttctctctggaagctcattgatgaagatataccgtataaattttagacattcctttccatctttacttcaccaaattacttacagaaattatttgatgctgaaagtgacttccaagcatttttcaagtggcgttgctgcatcatacttacaccacatagggtaggcagtcagttaacagtttctcacttcactcacaggagacaggtggtcagttgacacctttctacgaatgtgtgccccattttgttgtttaatgaggctgtccattttgtcttaggcctgcgggcgacatctgatactttttatcttaactcaaatagtagcttatttcacatttaaaccatggcttcccttgcgcagaatttaatagatgttttatttcatgtgctttgactgcaaagtccaggcaaaaaataataacaactttcatcaaatttgtttatctgtgtttctaatatttttatgggagcggcacacagtctgattggaggttgtcagagaaacgaagatggtaaaactgagtcttaaatgaagagtaggaatttgacatgccaataaggaggggaaatgtattcaaggatgagggcatagcatgagtaaaggcacagaggctgagagggcttgccaagtttggggaactccagcagcagcctgggggagatgacccttgcaggccatgctcaaagagtgtggactccaccctgtccaccagagggagtctgtgaaggagtttagtcagggaagtggcttggtctgaagagttctaggaagatcactctagctggatctgatgcacttaagggctgcaagccaagacaccagtaaggggccattgagatagtccaggcaaggcccaagagggtgccgctgagccagtgccagcaggaatgccgtggagggaacagattaccaggagggagggaaagaaagggttaagaagggcttccagattcctgagttaagtaatgaggaagacaagaagtgagaagaaaagagggctgaagacagagatcaaggtacccaggaagcaaatggagcaggaggagccagagaactagaaggaggaccaagaagactggaaaccggaggtggggagaactttaagaaagagtgaactgaacagtcagtgtcataaaatgcattgggagcttttttttttccctcaaattaaggaggtgcctcattaccataatggtacctcattaataagaatttaatttagctgaaatggacaaaattggtcttttttgtttgtctcctaaacatagctccttttatatatacattgtctttttatgtcatttgccttttacttctcatggaacctgctgcgctgttttaagtcagtgaattctgactggtcactagcttctcactggtcattctgacatacattagctttaaaaaaattaaattatttttaacccttgaatgttttatttcctgcagagtgttcactggagagaagctctgaatatcttgaagctggtagtttctcggtcagccagccttgttttaccttcataccagcacagtgacctctcaaaaatagaaatacatcgagtgtggactagtgcttccaaggaattacctgggaaaaccctggacttccacttcgatatttcggaggtacttagctatgttaactatttctgtgaactttagcatgaatttgtagtagcaaagatcaaaagtagttgcctggaaaaaagaagacttatttgacagttatttcaaatgaagatttctaagggctaaattaggttttgctttttaaagaacccattgagtgtcatattcactgggactctcagttggcagcttttaaaaatagaaactagcctcagttatgtaaaaaatgattttaaaaagaggtatttaaaaatggaacgatcataagcattttaaaccatgaccttcactcattctttatctgacaatggtcatgtctttatatccacaatgtttctccctgaatgacagccagttcagcagatgaccgaaatttacaggaatatagactccacttttatagttgcttccccagtccacactattttttaaagaagtaaaactaaattcttgccttgaagggggcaggggagagagagggaggagcaaaagactagggacccaagctaaggagtcaggaagaaaagaaaggacaggaagtagtcatgtttacctgatagtccatgaacaaatatttgggaggcttatattgaagtctaaggtataaaataactttgctttcacatctcttaccccatgactcatgaacccccaaagcagaaactgtactctgttcctgtttataaccagggctcagtacaacatctggtgcattagtagatcactagtaaatatttccaaaactctgctgaatgaataaattcactaagaaataaacctggtgtcaaatactgcatgttctcactcataagtaggagttgaacaaagagaatacatggacacagggaggggaacatcacacaccgaggcctatcacggggtggggaacaaggggagggatagcattaggagaaatacctaatgtagatgacaggttgatgggtgcagcagaccaccatggcacatgtctacctatgtaagaaacctgcacattctgcacatgtaccccagaacttaaagtatattaaaaaaaaaagaaataaacctggtgtgcttatatggaacttacttgcactattatgtaggtcatatccaagttgggttttttatacaatggtcctcactgacctttcatcatttcagtattcaggatgagatactatttgctaccattgtgacacctgcatctatatttaatatgtaaataatattaaggtttcaatttaatcttggtccattttcacattttttttaacctggctagggggaaaagctattttttctctgcaatttgagtttgttgtgttctaaagaggtacaaaaaaacatgcagctggttagcagcatgctccagagacccagaactgccccagaatgatgggtctcaggagccaggtgtaaaattgacagtttctgccactgccgaggtcaagcccatgagctggtgtctgcagaggaggcctgctcggagcttgagtttgcgaattgctgcctatgcagccaccacactctggagctctcaggaagtgaaatttctcaagtgctgcccaagtacctggccctgacctcagtcatttgaataattgaaaagatataaataagttaaatacatttttaaataattgagagtatataaagattaatgattaaaagttgggagagggaaaggaattttggtctcttgttctaactatatgaaatttttttcaagtttaaacaatcaaaaactgactatttggtttcctgcatgttttgcttccctttgtcagtggtttctaaagcatattaaagaacaagcagttgcatttttctgccgctaaagaggggaggaaatgttgaagatgaaaaacgactcataatgtgtacttgcatgttgagaaaatgagcccacttgtaacactgaacttctctaatctgatttttaatcaaataagcagctcttggttgcttctggggagaagggtttcatatatcacaaaaccattgagacagaataatgtgcgtttgtcttcttctcaagactccaatcatcgggaggcggtatgatgagctgcagaattcttctgggcgtgatgggaagcccagggccatggccgtcacccggagcacatcttccacttcctcaggctccaactccaacgtccttgttccagtgagctggaaaaggccccagtattctcaggtatgcaatcctagacccacagtcctgggagggagtttagggacctgttgagtccatatggctgggtcataagggattccctctcaccatcccaaggttgcccatataggtctcagcacttccagggatggggtcttgtggcattccaaggaacccatttgctctttgaacagttcatcaccttgagttgaagtctgactctttgctgcttctatccattggttccagttctctcaaggcttagaaaataaaatctggtctctctttcacatggcagcccttcagaaattctgcccctctgccactctcctaatgaggccaaacaacacatccttagttctcccaaccaattctatagcacttggactcccaaagggttgatagggctgcacacccaaagaccaccctgtctgctgcccacggaacaggcacctcaaccatggtgtccatgcacgggctgagccatgcagatggcaaggggcgggggtactgctgccagattctctgtagttctgtcatcacagcatagcagagatgccattgggcttcctgtcaagtaaaacttctgcattattcaggggtcttctgttgacttgttacagaaacccactgaaaaattaccttctgtggtaaagaaacttactaacttactcatcttggcttcaagcacagttggctcctagttcacagatgtcagaaactggattcttaggctgtctcctcactgtccccaccttcccttcccaacatcttggcccttgttttcccctccagtgacttcattctcaggcagggtttttctatgggaggcccagatgacctctggcagctccaggtttacatggtctttggctctgatgacttcagagcgacagaggcctttcctcttttgacatccatagcaattctgaaagatcttgcaggacatgcgagggaggcatagcctcacttagtgggaatggagcctttccgagataaaaagagggacagtgttaccagaagaaggtgaagtgggtgctgggaaggacaaagtgggtgcccaggaggactcaccttctctctcaaaggttaggggaatggaacatgtagcatagtgccggctgcaacagagcaggttctcagtgagtgttcagctgaaaacttcattggaagagagaagaaaatacagcccaatgtgttcctctacattgattccttcccagaattgtaaaatgaccactaagacttaggaaaatcgtttagcgagtcttctgccattcctcaacctcaaagtcctcctgtctctgaccttgagcagacaccatattgagtgtctgtcccctctataatttggaaagaaggatgcagtgaattgagttccgttaagaagaaaaatctaagagtggcattggcctcctagcagtttccacataacaaaccgtaaatcagattaaaggggggagaatcattttaaagagattaggaagattgctttaaaaattctcaactcaccaatcattctgagacctgggttatctgccactggaaaaatgtaatggtttatagaagaatccctatggtcaaggggctggaaaataggtttatgaaggaaaggaactgaatctgtttaactttaggaagaagaaactaagaaagatttaatatggcttaaaacgaatgaattttttcattctacagaaagtattcttctatttgagaaaaagagactcatgctgtaacttaataaagtgtaaggaaagccttgctaatactgaaagtttaacatataagaaaagattatcaaaggaagtgatagatctccttaaagaacctagggatttattttcacatacacacatatatacaccccttgggataacttagatcaccactgtccagcagaaacataatgtgagcttcattttacattgtctaatagttacccttaaaaaaaaaggaaaaacaggcaaaattaattttaataatacatgttacctaacctactatatttaaaatattatttcaacatgttttcaatatttaacaatttttaattgctatttgtgttcttttttcatacttttgtgtattttacatttcattctgtctgtacgttaagtgctattgccctgtatggatagtggctagaaaattagagcagatttgctcacaggaacccataatgaaacctgccttgtgtttcttttccagaagagaacaaaagagaagttggtacatgtcctttctctgtgtggccaagaagtaggattgagcaaaaatccatcagtaagttctgtcatgtgtcatagttattttggtgtcatatctcctttttcattggtctgtttttgcctttggtcatataatttagaggattcaactatgaatgacaagtatgatagccaccgtcttgagcaaacccctggactatttctccccacaccatgatttttaatcacactgagttcagaaacaatgaaagatcttgctggctgtttgctcgtttgtctgtgaatactgtttcttttcatttttttaatttattggattttttttttataaatatgcccagaatgtcttacaacgtaaatgataatctccactgaccaccatgtatgacatatatgctcatatctcttggatataattttactctctgtacacacgcttcttactctcatgtccttatcttacccacatacaataaagatgaaaataatgtttctttgcatataaacttccactgatgttacaataaaaaactaagaataaaacaaaaatcataccatcaagcttttgaatgaatggacgattgaataattataagtaaactttggaagcttttataaaatttagaaaaaattgaattaggtatgggagtataacaaaaacaatagaagtgtctgctagtttcaccaggtatttttgtttcacctgtatcacagaatatttattatttatgaaaaagaaataacaaactaatttctcaactgaagtaagaattagcaaacacatttctcggtggagctatttttaaatttcaaaatggatccactaacacatagttcatgagcaggtgaaatattagaggctcataaatacttgctaaagtacaaagtgatatttcttatcgtctgggaaagcaccccagccagccatcagctaagctgggcctccatttaagtcacttttttggtgttattgatcagtgggttttctgcggctcctgtgacaatatttaggacagaggggacagtggcagaggcagatagagactcctagcccacagtgaagagacacaagtatgtttttcctctgcattgcagcactgccaacaaggcctacttcttatcgtcattgtggttggcactttctccttcagactcatcctgtctgccctgtgctaaggccttttcagctaaaatatttacctggagtacattacaaataagagaagcagcactaactaggaaagacagccttcagctgaggaaatcagaaatctcatgtctcgtctctcactgactagttgactagccctcagggctctttatctcatgtacccatttgcaatccctatgtaaaactgtgtgtcaggtgctataatgagaggctatcatatgcatcatatactattcttaaacactagaggaaaaaagtacacttgaaatccattcattctttctacttttgagagatgtttatcgtatttaaattcttataaatgattttgcctacttttcaaggacaactaagacattataatggttatacaaagaatactattaattttctttaatatctatctatgttcagtagaggctggatagcaaaacatttactctcatttacagtttattatataccaagttctaccaaaatgggtcagtgaaaagaacctaaacatagaagttaatcttaaaacattaacatactaaagattttaatagtaaaaaaatgttttattttgtttaaacctacaggagaggaatttaagtataagttatgggcctggttactcacctactcttctatggacaagtattgtaatttttggcttctgtttttttatttcttatcaattgcttgtttatctctaaaagagttaaatcctttgttcccacattcattctacaataatatatcttggtatcagtccttaaaatattatttatgtgtatttgatatatgtgtgtaaacatgtataatttctaactctaatcagttcagaaacagtggaacattttcctggctgctccagtttacacacacacacacatacacacacacacacaggtagtatacagtcttcatccattaaaaagcagcgacgtgattcttgaacattttcctggtgcatgaacttgcgtctttgccacgagtttaatctgaaggcacctgtccaacataaataataaaagaacattctaaaaatacccactgaaggaattaggtgtgtactggaaatacggtgctatgaagagccaattacaatttttcgtagcacaaacaaccaaagggagaacggtttctcaggagaggactcttgattcgcaggtgattttttcatcgtgtggggatctggatctgcttgagcaccagacaagcttggtatcttctgaggacggtgcccgagagcaggagaacatggatgacacaaacagcgagcagcagtttagagtcttcagagacttcgacttcctagatgtggagctggaggatggagaggtacggtgtattctctgtaaagataatccccgcacccttttccttgactaatgaaactattctttttacctgctaaataatgagtttttgtaacaagatctttaattggaaagttgtaaactttattttgaatcaacttattcaaagtacagcagctaaactttggcaaaagttaccacacccttcctgtctgagcccacggcaaaagctgccaagttatttctaaacggcaaagacctgagttttaatgaccacacaaagactgtatgtgtgtgtgtagtcccaagctggacttaaaaaaaaaatcacaaaaaacatttcagttcttagcctgttcactggtacctgggtaaaatatgctaagcatttaatcatttctaatgtgaagtttctctaattcaattccttcaaagcttgcctgctacaacatgagaccagagcctgagggatcaaacatttttgtgcttgatgaaatcgttagaactggaaacaaaatgcaatgcacacaagagagctctttgctctgcttagctcggtggctggtgttctagacactggagcagccaaattcaagtctcagtgggcaaatgcagattcatttattttggatgataatcatggtaataagatactttcagctatgaatcatgtttgcaaaaacaggtattgagaggaggagcatcacctgtcagtcaccttcatttcagtagcttagaggcatgttccacctgagaggccgtcttttgcctcatgggatcaaaactcagttcacttaagtgagactggatgatgcaaaggtgcctcgttcggaaccgggctcatggtgttgtcaagctcatgtttaactgcaccagatttcccaaacgactctctgctagtcctacaattgaagaggcaggcctagatcccaagtttaggatttcctgcagtaggtaggcacctccttacttaactacaggcttgtgggaaatgatgcttcaagtagctgcttaccttccctaaaaggattttattattgaccaacccgcctatgtctaattgaagccaaagagccctttgcttttgtccttcctggcccactgatgaccctggatgtctgccccagcaggagagaatcatgtcctcggaataaagaaggtgttcttcaccaattctttccctggaaaacaagttgagcagatccggtccgtaagcagtataaaggcactgctatcatgtatccttaaaataactgccagcttaattttcaccttgaattgcttaagaaccaataaaaagtattgcaggtttctgtgatccataataaatgatagagaaagcattcactgaatgcagtgaagattgttttaagtctaaagcaaaatacaactgttttgaatactttcaaaaatgtctctgagacagagctcagagttcagctagtgtcaaaagaccagctccctgatctgacaactgacctaatgtttgctcttcagttaaaattcaagcttggacacctgtttccctctggaagttatacaagggagggaaaaaacggatgaagcaagagaggcatcatttcctgtctcggccagagaaaaatgttatgtgaaacgacctagcaggaatgatgtaaagcgaagtaatccgacacaatttcagaacagctcacaaatttagtttctatcaaaataaaggaaggaaaaatctgggatgcccgttacttaaaaataaatattatactaatgtttttcagggacaagaaataaggaatactacacctttttttctggtcttctctttattgtcctagccagcaataactaaaaaatcacagtgattattttatctttcattgttaagattttataagaaactggctgggcacagtggctcacacctgtaatcccagcactcttggaggctgaggcatcctagaggatcacttgtgtccaggggtttaagaccagcctgggcaacagagcaagaccctgtctctacaaaatttaaaattagccaggtgtgatagcacatgcctgtggtcccagctactcgggaggctgaggtgggaatatcgcttaagcccaggaggtcaaggctgcagtgagccgtgattgcaccactgcactcagactggatgacagagtgagaccctgtgtccaaaaaaaaaaaaaaatttagaagaagaaactcacggggctgagagtgtacattttatccaaataaaataaggcatttgagaatgttttgctacttcccaataaaatcacaataagggattctagcattcttggagtagaagagtgaagatgcctgaacttcagagtccaacagctccaggtttgaatttcatctctgccactgaccttagctatatgaccttaagcatggatgcaattcctcttgctttccacttctttgtctattaagtgggtataagaatacaggttgagcattcctcatctgaaaattcaaaatctgaaatgctccaaaatcctaaactttttgaacactaacatgacatcacaactgaaagattccacatctgacctcatgttacaggtcatagtcaaaatgcagtcaaaactttgtttcatgcacaaaattattttaaaattgtataaaattatcttcaggctgtgtatttaaggtgtatgtgaaacataaacaaatttcatgtttagacttaggtcccatccccaagatatctcattatgtatatgcaaatatttcaaaaatttttaaaaatctgaaatccaaaacacttctggtcccaagcattttgaataaggcatactcaacctctacctgcctgtagagctgacatgaggattaaataaaataaccaatgtatagtgtctagcaaagtgtcaggcatatagttggcattgtaaatgtgagtctccttgtactgtcattggtgaataattttagtatatcttcatctgataaagttaggcatacttggcgtttagatcaaagcacagttgtcaaaaaaagaaagacaagtcattttgtcatatctattccttttcattggtctcagaatttactgagtgatatctgcaagagtttgcccttgaactttttagaatctttaaaaggtgttgtgtctttgctattaattgcataagaacagtaagcatcatgatcacaaacacttttagctttgtgaacaggctcaggtgatgccacctttatttccagttgatgaccctcattcatgtttccataacatttaacagttttctcacgaatacatatttaggattccaaaaaagtgttgaggagaccaaagttgtcacagaggtagaaagctatttcagaaattgtaataatgatttgttatcccagctctatcatccacagccaaaggatttggaatttctgatgtttaatgttgatttttctctttggagttagtgtatatttaccttttcttttaaggtgcacctactgaagtgtatattgttagcactgttggttaatgttgtgttaacactaagagaaatgttcttgagtatctttaatataatcattgtaaatagaccttttgtttgtttttctgctcattcaatctgctacccaggaacttcaggtaagatgatgctgtttttaattcaaatatgctagtagacgttttgcatctttgcagatttataacaacataattgcttttttcctcccttccagaatatatatgcttatttgcgtgcatatttccatttaggtgtgtgatataagaggtatttttcttggctgctctagtatggaaatgttttctaaaatgtaaatacatttttaaaacctttatatgcctagttctgaaagttgcatggttatatctcagagaagtggagttttcaaatctgatctatggcaatcctatcatttctcatcaagtggttgcacaactggatgggttttattgttaaattcttgtattaaaactgaaatcaccgggtaccatggctcccacctgtaatcccagcattttgggaggctgaggtgccagatcacttgaggccaggagttcaagaccagcctagccaacatggcgaaaccctgtctctactaaaaatataaaaattagccatgcctggaggtgcacgcctgtaatcccagctacctgggaggctgaggcaggagaatcccttgaacccaagaggcagaggttgcagtgagccaagatcatgccactgcactccagcctgggtaacagagcaagactctgtctcaaaaaaaaaaaaagtgaaattaacaatttgcatctaactatataccatacatactttcagttgaatctttttttcccccaggaattaaaggctatctctatctctgtgtagtgactagataacttttcatccaaaccagggcccttttaaaagtaaaagggggtactaataatatttatacccaaaccacaggcattaaaaccgggatcatcctgggcaaagtgacctatgatcagtctctatctacgtatatcagacttactctaagtagaacatttgggggagtatattttgaccacaatgcacccaaatttcttcaacaataattcttgtttgacagagttccaatatgaaaaaaagtgtcaaaaaatagtatttctaacatttatagaatgtttaatcattaatactttcccatctcagtgtaaaccctcagtggtttttaagtttgaactgacatatacagagtgttcatctggactagccatcctctgcattttctcacatgtaggaaactgctttgacttttcactttgtatgtaacataaaatacaaatctgacatttgggggagaggaaggatggagggtgggtctcccactagggccatgctgagaaagcctggttgagttttaatcaccatggactttacctgggtccagactgcaatgttgttccatcatctcaacctctcagccaccaccaggggaaccatttcaacacccttgcttctaatggagatattacaccttccagcaagacagccaaaccttattcctccaagaacagctttccctgcctccctattttcacacctgattgattcaggtcttcaccagagctgccgccaaatcagcactagcagtgacctgtgcctggtatagccttctcccacctggatgtctgtattcctctgcaagctcatggttctgtctcaagtgcagcgtgggagtcctccagaatcgctgcctaagatagttcatccaacccttccagtcatttggcacaagagagtcagttttttgaatttgtgtttgtatatttgtccctataattttcacattcttctctttttactctgcatagttagtattctgatttttctgtattttcttcctttctttacacgttggattttccttttcttcccagaacttttgcctctttcatatattgttttattttctcactgctgtggctatttttaaaatcccagtacaacagttagccattttctaccaaaaaaaaagaaaaaaacatatggtggtaatttatcatagcagatactggatgttagaaacaatattctgagtctgcattcttttttataatcaaacacccctaagagcaatcataaatatcatatgtgaggatgaataatgatgatttctatatcttatccagattgtgcttaggatttgtgcctgttgccttctaccatgaatagcccaagcagactttgaaaaagctatgcctctgttatatgacagatctgtgagaatggcaagcttgtttcactaggagacagacacgaccctctgctttaaaacagagggaaattaataaatgataatgctcataagtttaacagtaactcacatctctcatattatgttgttcactgagctctcatcagaaaaagttgttttattttattccaatgaaccatcaggcagtgtttcaaattaccagtaaatgaaaagattctgtactagattttgtcagatcatttgtttaggttaaaatttgcatatcagtcagctgagtaatatttttcttcctttattcctatcttaacagaaagaaaaataaaacccaaatccatttctagaaaaaaaaagttatgttagtcaaatacacttatttattaactgatggtttgtagagaaagtctgaatgcaactaaaagctttctttaacacttacatggccacttaagctagttctcggtaattcaaaatatacaaatcaacaataatatttggggccgggtgcagtggctcacgcctgtaatctcagcactttgggaggccgaggcgggtggatcacttgaggtcaagagttcaagaccagcctggcaacatggcaaaatcctgtctctactaaaaatacaaaaaattagcctgacatggaacccagaaggtggaggttgccgcaagctgagatggcgccactgcaccactccagcctgggcaacagcaagactctgtctcaaaagaaaaaaacaaaaaaacagtaataggctggatgtggtggctcacgcctgtaatcccagcactttgggaggccgaggcaggtggatcatgaggtcaggtgatcaaggccagtctggccaacatagtgaaattaacaattttctacaccgggacaattatttaaagatgagcctaaagcaaaagttaaggtgttgctgctctggcctctgcatagtgcatgatccatcagactttgcccagctgctctgatagtctttaactctgcattgtatctgtgaaaattgctgtggcagaaataggctggaatgtttacctaatgctcttccactaaatacccaaaggattctggaatgtgctacaagcagcatagctcctacttttttctccttctgaaaacagtactaaacaggggccgacctcagggtggtgggagtgggtgacacctcttttgaagttttcatactaatggtctctttgttacagatttttgaaaacacagatcattggtagtgtttaccaaaatcaactttttaaaaaatgtaattattacccaccatgccaaagaaaagtatgtaatcatttctgcctatgacttcacatgagtttacatgaaaatagtgtgcttttactacttttcacattgggtaaacaaaagttttgataccaaagtcgatgagggcctaagagttaataatgacaatatttgttcccaagctatgactaattgaatgtgtgaacatgtgagtgcaagaggattttggcataaaaaaccggctgatggtgtgatttcagggtgagagtatggacaatttcaactggggagtgcgcagacgttctctggacagcctggataagtgtgatatgcagattctggaggagcgccaactgtcaggaagcactcctagcctgaataaaatgcaccatgaggactccgatgaatcatccgaggaggaggacctcacagccagccagatcctggagcactcagacctagtaagtagcggctctcccactctaagaattgggaggcttattttttgtaactaatgcaggaggacagtttccagttgcagctaaggaaactttccacagctgctgaactaaaatcggaactgtcaggtggtgtcatacgggttctagctggcagagtcttctctgtaggttgcagatggaaacaaagactggggtccatgtgattcaccctgaaagccaccagatctgttaaggcctagatttttcccaaataccttttatgattctggaatctttttaaaaattccccagatctctaaagtgtggagatatgacagacattttgatgtgattttctgaaaatacctggattactagctgctatgtttaaggcccaataatggtgaaatgtggaagttaaaaaattaagacgtattaaccaacaactagagaataaatggagcttttaaagaatgggaacttcatactatgtttaatttcctttgctttttaaacagatcatgactctctccccctctgaagagacgaatcccatggagctgctcaccacagcctgtgactcgacccctgcagaacctcattcctttaacaccagaatgtccagctttgatgcttccttgcctgatatgaataatctgcagatttctgagggttcaaaggtgaagagattttaacaatgatgatttgtacttcccttaaaacccttaaaaaaaaacacttccaattttctgagaattcttaaggggtctcaagtagaaagactatctttatctttttctttctctcttttttaaaataatagaagtttgtgcacctgagcctatgttttgaagttgttttacccccacaaacttgagcagccatcttcttggctgaaagacttgatttgaggtctttttaaaatgagacattttgcatgaacactgctggtggatggcaaaaccagtggtgtatgtctgagatggctgtgactgggaaactgctgatctttgtcatgaattttataaaacaatatgctaagtgaggtgtgggtgtatgcacatatttggggaattttttcctttgtaggaaacaattatacaatttgtacattgattcagtgcttgccttttggcatactatcagaatttttaatgtcaatcacagtcttatgccagattcgcacaaaactcttcttgccagagtctgtgaggagaaaagtaactaatggatgtaattttcttaattagaaaaaatctaacagtgtatatttcatttaaagtttattttattaaaatgtcctgaaaaccatccacttgcatgctatgcccacatctatgcccatcagtatagaattgtatttccttatagtagaaataccaaaataatctattaccattaagatagagtcaagcactgtctatcatgagtttggttatggttgtgcaagttcaaaagaaaaaataaaatcgaaaaaatttcataaaagtatattccttctgacatttctaatggaaaaatataatattggctattctatattctctgatagcatagtaaaaatagatcagaaatctaggaaaatctatgtgctttaaaccaagggcaatcaccaaattacaattacctaaaaatattgaagcttaaatagtaattatttctaagattgcctcattgcaaaggtactacaatcaggattcttggaattagcagagttcttttttagccaaaagaaaaaaacaaaaaacaaaaagcccagaaagaaaagttgtctaagttaaaattctaagattatgaaattaaatttcatagaaaaaaatcacaaaatatatgtgcatttgatatttctcaatgtcaatatggtcattttctccatttttctattttgaatgctaaaaacatatagatttctcatagaaagtgctacctaaggccaggcgctttggctcacacctgtaatcccagcacttcgggaggccgaggcgggtggatcacgaggtcaggagttcaagaccagcctggccaagatggtgaaaccctgtctctactaaaaacacaaaaaaattaaccggtcatggtggcggtgcccgtaatcccagctactcaggaggctgaggcagagaattgcttgaacccgggaagcagaggttgcaggtagctgagatcgcaccactgcactccagcctgggcgacagagcgagactccatctcgaaaaaaaaaagtaatacctacgtaatagatctcatcctaccaaggaaaagtcgagtcccatttctgaagagctatccctgtttttcacttaagttgcatttctgcagtgtttgataaagctatgatattagagaaaataaaatgtattttaataaggactcatcccttctctaatggattaagtgtatgtacactaataacctagaccaggcaccagtggccagcctcattggcagcactgtagttttaaaaagcaaatatggataaacctctcaaactcagtatttaccagcaattcctccaaagacatgagatatcttatttccctaatatatttttaccattcctggtaattttccctattaattctagagtcaaagtataatatatatattttatatatatatttacacactgagtggacagatgttaacttgagataaagctctaattcatatacacttctattttgccttgcttttgtttttgttttaagaaaatgactcactgtaacatgtacatctttcttcctctcccttctgatctgtaatccagttgccttccttcctctcctaaagaacaatcagtcctccttttccccctggcccaggcccaaacccagcctctttttccattttacttgctgtgtctctttcctgcctctcactgatcctggttctgcctgccctagagccctttcattgtcctgctcattccacattttgtagtcaggtaagagcagatactcatatctgttatctgtggagggtattctcaagggtaaagcatacatgcaaatggatcttagaggatcccctatatggaaagaccgagcaacccagcaggctcagggaaggactctggatcactcgtgcataccacaggtatcctgggcatctactgcgccaggccctgatgattctacattcccttgctaaaggggttctatgttagagaattaactctggataggcttgctttagaaggctgggtttggacaatggaaggagttctgaatccaaaagaagtgtttcttgtcccagctccaattctaagtatggacctgatattagacaagtccctttcccacgtggagcattgtttccttatctgcaaaatgtggaggttggattggaggtcttgatggtcttttccaagtttagcgttcataccctataagcatgggccaagtacgaaaatctactgagagcccctttggggaccattatggaagagattgaaaagaagataaagaatgaacagtacttcagagaattcctgagtccagcctagaaacggactatactgtagctagaaaacaaatgtccccatttctatcaccatcagcatttcagtctctcttatttgttccttagttgaacaggttgtcctgtatgttttcttacacattgggggattcttttgtctttttattcttccaggctgaagctgttcgtgaggaggaggacaccaccgtgcatgaggatgatctttctagttccatcaatgaactcccagcagcttttgaatgcagcgacagctttagcctggacatgactgagggggaagaaaaaggcaatcgggcactggaccagtttaccctggcgaggtaatggagcccttggctgatgtgagtggtgtgaatgtgcatggtacattatatggcattcacactcaagttaagtgtcacagttgcactgctgggacatcctaataaaggactccaaagtgacatatatcatggcaggctctcagctgagttagagtcatccaatcccattatagggcctcgtgtggaacaaagaaagaacacttacatatgaattcataaggccagaaagcaacgtaaaaagcaaaggaagagcctggaaacatggtccagaccttgtaagctttgaagataagcaacacttggcaagccttggaaataagttctttccatttggagttaaaaccctggaacaagaggctctttatataggaaatacctactctttaagtgggtgtcttttggcctggtggctgatatttctgagactagtgagatatagaaacagaaaaaaaaaatgtgaagagaaatagataaacaccagaggttagattaatccagcatctagaataaatcacaaataataatgctacagatctacttcaggaaaagaaagttgagatcctaaaattactcttctgaaagttgaaaataagaactaagtaaaagcttctgatatgctagacaaaggccttctgttacagtgagcaatgtctgtccatcaaaggaaaaggttaaggtaacacctagagaagaatttgacctttcatttttattcattatctcttctttcttcctgcctctctgtctcactttccctgcgtatctctggtttccttgtctccctccacctttgtcttccaggcatttgtgcatatgcatttattaatactctccctccagaaaggaaaaattagaagattcaaaatttatataatttttcataatgaaaaatgaagaatgaaactgccaaagcataggactgtggtttactttggggcatagcctctgtgaaagtgagaggcattgctgaaggctaaaagaagtaccaagtctatagaaagggaatctgaaatggaggaatcccagaaattctagaggtgcaaattctctttcctcgaatcgtgaaagaatccgtgacctcttgccaggtgcggtggcacacacctgtaatcctgccactttgggaggccgaactgggtggatcacttgaggccaggaattcaagaccagcctggccaacatggtgaaatactgtctctactaaaaatgcaaatatttgctgggcatggtagcacacgcctgtagtcccagttactctggtgactgaggcacgagaattgcttgaacccacgaggcagaggttgcagtgagccgagatcatgccactgcactccagcctgggcgacagagcgagactcaaaacaaacaaacagaccaaaaagaatcacagtgactgctgaatgaaagccaagtccccaaagcaacttcaaaaggaagagtgggtagaatagctacctcattttgctgactctcagggtgagaatttataaaacccagtataggatgagaaggacatcacttcttgacatagtcgttttcattttttccagctttggagaaggtgacaggggagtctctccccctccctcgcccttcttctcagccatccttgccgcctttcagcccgcagcctgtgacgatgccgaggaggcctggcgcagccacatcaaccagcttatgtgtgactcagatggctcctgtgctgtgtatacatttcatgtgttctcctccttgtttaaggtatgtgtgctcactgaaagtgcagaggacttagtttctaaggggagccgggtaactttgaatttaaggagaggttgttcttctgttctggggttatactactgtattttctcctccagacacccctaaatttcctctgactttgaaatttcttctatttacccttaatcttgtcatccttctaaacatggtattgatgatttaggctgccatgaagtacctttcattcctgcatctcttggtgttactgacatcaccagtcctcagcagccatgacatcaggaccattaagggaatcttctgccaggcctatcctccatcccacccccctttacctctcttttgtttttattatttttatctttcctttccttgtcttttctcatttcccactctatgaattccttagcatgccagccatagctgtgaacacttgtttactcccttgagttgcttttgaacagatgaaaagtcattcttgctgttgtagcaggttgctgtgcactgcagatttcgttttatgaaatgggaacatgccgcctacttggtagcccttaagaatcaggccagtctaactactgcctctcccgtgtgaaccacagccccactgtccatagtgtctttgtgcaaactgtaatgaatgtccctgcctccagaggagtgcagtaccacacctggccagcagagtgcaggtgggattccaaccccacttccaatccctcagccagacaccctagcatcttgcacacagctctctgtggcagtctcatgtgtgggcacgcttaaatctcgcttgttacctcataacatacttacaatgactgcttcccattaactcctctatgcatctttctgtaaacttttgtcctccaaatttcatcaaataattggcagggggaggaggtggcaaaagagagaaacatgccttgctgtgaagaaacatcagagctctttgaaggccattgcagttaactagacctatgtctgagcttgaagcagatattgaccgtgaaaatggcagtgctgggaataatgaggcctggaagctacgaagatgaggttgtaggggaagatttgttgatgtggaactatggttaccatattatagttaaagagaaagctagtttaaaaaaaaaaaaaaaaaaaatatatatatatatatatatatatatatatatctagattagtattcctttttttaaaatgcctagaaaataatgaaaattatacaccagaatatcattgtatcttttcacggtaatgatatttggggtgttttttatttccttctttttactttttttcaatttcctattttttgggggggtggggagacagaatcttgttctgtcgcccatgctggagtgcagtagcatgatctcagctcactctgcctcccaggttcaagcgattctcctgcctcagcctcccgagtagctgggattacaggcatgagccaccatgcctggccaatttcctgtttttctataataaaaaatgcttttctttcagcattttcttaagcatatttttaataactcattagacagaactcccacggataatgcaaaggaaaaaaatggaaaggaactatctagttccaactttgaatagacttgaattttgaatgaatgaccagacagaacagttagaatctagttaaacttgtgtagctgttgagttctgttgagtagctcatggaagacggacaataatttagttggactgagggaaggagccctctaatcaccttcaggaagagccatggccgacgggaaaggcaggaaaataaggaatgatatatcaaaagtgcaaaactaaaattatgtccctcttaaatgggttgttaagaagtcttggggagtaggagactccataggtaaatctgccttaaaatatcatttcagcatttcagtagccagtgtcacttgacctcagttcagctctgaggtcaatggcattgcagcaggttgctgtacattgcaatttctttttatggtatgggaaggtgcctcctgcttagtaacccttaagaatcaggccaatcagccaggcacagtggctcacgcctgtaatcccaacactttgggaggccgaggtgggaggaccacctgaggtcagaaattcgagaccagcctggccaacatggtgaaaccccatctctactaagaatacaaaattagccaggcgtgatggggcacatacctgtaatcccagctactcgggaggctgaggcaggagaatcacttgaacctgggaggcagaggttgcagtgagctgagatcgcaccactgcattccagcctgggcaacaaagtgagactccatctccattttaaaaaaaaaaaaagataacttattaatctgttattctagtgagcagaaggttaggcaaaactgaaataatctaagttaaataatttcaaattcaggatgacatatgtttagttaacataaaagtgaactctgcttttgagcctggaggcccttcttataatccatttttggagaattatataccagtagtgcagatagctacttggactagctcacttggagtcttacttgtagtgctctttcaacttcttcaatttactctaactgaaaacctagtagaaacttgaatgggtaaattaatgtcatgtctgagattaacttggggctggaggagatgttaggcttaagacagaaaacaattggctgctaaaagataagaattctagaaatactttaaacattaaaccagattgaaattttaaggcaaactaccagaaagctactatttgaggtaaatttaatgttaaggattgagaggcaaagcaacttattagttatatttttctaaaagctttttttttttttttgagatggagtttcactcttgttgcccaggctagagtgtaatggcacgatctcagctcactgcaacttccacctcccaggttcaagcgattctcctgccgcagcctcccgagtagctgggattataggcatgcaccactacgcccagctaattttgtatttttagtaaagacaaggtttcaccatgttggtcaggctggtctcaaactcctgacctcaggtgatccacctgccttggcttcccaaagtgctgggattacaggcatgcgccacggcgcccgacctctaaaagctatttttaaagaatgattaataatatatatttaagtttggctgttatggtcatttttattagagttattggattattcatgcttaatttgacagtcctgcacaatactttctctctgcctagaacggtcatctccccttgtccctgggctacactcccagttacattcaaagccctgattgggtgtcacttcagttagtaaagccttctgttacttctttctcccttcccctggcatctcgggattttgtacttgcatccgttacacttgtgactctatatgataataacttgttttggtgtctgtctcccgtgaagagggcaggtaaacagtgccttgctcaccttgatttctgacagtttgcaacatacactaggtgctcagtaaatgtaggaagaataaatggaaaccttaaacacacagcttctaacttcatgtcagtagaccagcgggttcattaccaagaccgacaggtcagccatggcccacagctgcggccaccattcagcctgacttcctctcccacctacccagatatgcaggtagcatgaggaaggcagaagggaggctctttctccaccctctacctgcctggcacctggcaacccaccagttgagatgctggtgagacataaagagaaaagagttgtatgggatggtgatttccaggtggaaaaggagtacagtgaagtcagactagcctttgaacctacctgtgttcaaatcccagttctggccacttactagcctgctaggcctgcagacagtccttaagttctccaagcctcagtgtcctccatcatacaatggaagtgaaaacagtgtctatgagttttatctttcaaagactacttatgagagctcacatggagaaacacctcaagccatgcatctagcaagccgtcagcacaggctggctgctcccatttggctgctcttccctatggtcattggcatgttctttgtggccctggccccgccacagagactggatcctctggtgacagtccagaagtgactgactgcccaccacagagagttctgcagccctgcctgcacaccatgagccacctccactggggactctctagcaacttctgagagaatactcagattgcaggagagagacctaaagagaacaaagtggctataggagtgaaaggcctcagatatcccatccaatgtcctcgcagaagatgaccccttcccctgagaggggctgatgtgccatttgttgtctggtaacagttaactctctaggatctttcgccactccagcagcaaggcagtgggttcaggtttcacagcatccactgtccagagagcaaagtggttgtggaaagagggagaagaaagtactaaaaattaaaatgcaaatgagctggaaggtggggccaggcatgggccctggggggactcatttggatttgaatttctttttcatcaatatattaaatcaatcaccctatggagcttatctgcaataataataataatataataattttttaaaatgcatacctcctattttgctttttaatgttacatttatacttgagaactttctcaaccctgatcagatgctatatgaaagtaatacttgaagcaaaataggcattactaaaatatgctggaaatgaaatacatttcagacctgctttctgcctgttatgaatcatttgtcatttcctcacaatgtgtgtttactgtttcccaacatttccctgtaagtgtgaatacaatgtttccgtgttaggttggattttggaagaggtagggaggaggtaactgtgaaaataatttggttttaaaaacaaggaaatggtttctgtcggtacagtatggacatttttccaagtgtctcagtcattgtgttttcttcttgttactcatatgtgagaatgtcatcatcatgtgtcacataatgtcaccaaattatataatgtgtgatggaattcacaagaaaacaaaactgaatttacatcccctaaatgtcactgggtatggtggcacacgcctgtgataccagctacgtgagaggctgaggtgggcagattgcttgagcccaggactttaatgctacagtgagccatgtttgtgccactgtgctccagcctgagtgacagagcaagaccccatctcaaaaacaaaacaaaacaaaaaacattgtgcactagaagttcaggggggtaaaagtgtttttttgtttgtttgttttggtttttgttggttttttttgagacggagtctttctctgttgctcagcctggagtgcagtagcgcgatcttggctcactgcaacctccacctcccgggttcaagcaattctcctgcctcagcctcccaagtagctgggattacaggcacacaccaccgtgcccagctaattttttggtattttattttttttagcagagacggggtttcaccatgttggccaggcaggttttgaactcctgactttgtgatcctcctgcctcggcctcccaaaaaagtgttcttgttttggcactgacgcaggcacagtgaatcagattcttcttaattgtgttttttgttttttgtttttcccctcaggtagtgtaggaggagcagtaaccttaggaagcaatcgagattatggaaagattgtaaactttggagtcagacccgtccttactcattcacttactagttgcatgaccttaagcgagtcatttaactgttctttttttttttttttttttgagacggagtctcgctgtcgcccaggctggagtgcagtggcgcaatctcggctcactgcaggctccgccccctggggttcacgccattctcctgcctcagcctcccgagtagctgggactacaggcgcccaccacctcgcccggctaattttttgtatttttagtagagacggggtttcaccgtgttagccaggatggtctcgatctcctgacctcgtgatccacccgcctcggcctcccaaagtgctgggattacaggcgtgagccaccgcgcccggcctaactgttcttaacctcagattgttcatccggtgatgaggattaatgagtgatgtacattaagctctaagacagaattaggctcagttgagacacctgaccagacgtgccctcagagcaagagaggtcccattcagcatttactactttactcttcagaggctcaaatgcacagtttccgtgctgtctcaaggagctctgatcttgggaagcagaaaagagttacgccttttgacctttttcatcttgtccacattgaagtaatctcttttcaccagtctgacaaacacgcaaggaaaactcagactctgactggcactaaccacagcaaaaacaaaaacagtgttggtcaaaaagattatacaggctgagcatcccaaatccaaaaatccaaaatgctctaaaatctgaaactttttgagtgccaatgtgacactcaaaggaaatgcttaagtggttatgtatctgcaagtatttcatgtctgaaaaaatccaaaacccgaaacccttctggtcccaagcatttcagataagggatactcaacctgcacaagcatccacgcattgggaaatggtatttcaggaagaaatgtccacactgaatgattacttagttgatttaacataaacattcattctgctcccctcccccattaccctaaggacccattctcatgcgatatttttataaagatttaaaagtagggttttttccattaataatcgtgtatgatattcttgaaaattgctgagagtagattttaagtattctcaccaccaaaaaaaatgtgaggcaatgcatgttaattagcccaatttagccatttcacagcatacacatattttaaaacaacatgttgtacacagtaaacatatacaatttttatgtcaagtaaaaaaatcagggccagacgcagtggctcacacctgtaatcccagcactttgggaggccgaggcgggcggatcacaaggtcagatcgagaccatcctggctaacacagtgaaaccccgtctctactaaaaatacaaaaaattagccaggcgtggtggcaggcacctgtagtcccagctactcgggaggctgaggcaggagaatggcgtgaacctgggagggggagcttgcagtgagccgagatcgcgccactgcactccagcctgggcgacagagcgagattctgtctcaaaaaaaaaaaaaaaaaaaaaaaaaatcagttaatgtaattggaatataaaaaaagaagctacccctcccccaaaatatgttttatcatatataagtttaacttgacctttacaaatggtcactattttgccttgcagaatattcagaaaaggttctgcttcctaacctgtgatgcagccagttaccttggagataacctccggggaatcggatccaaatttgtcagctcttcccagatgctcacctcctgctctgaatgtcctacactttttgtggatgccgagactgtgagtatcccagtcctgctctgacagtgaagggcctacgcaacctacagtgcagaacttcagggtagcatgtttgcgctgtggtttgttttaaagataccttctggccgggtgcggtggctcaagcctgtaatcccagcactttgggaggccgaggtgggcggatcacaaggtcaggagatcgagaccatcctggctaacacggtgaaaccccgtatctattaaaaatacaaaaaaaaaaaaaaaattagccgggtgtagtggcaggcgcctgtaatcccagctactcgggaggctgaggcaggagaatggcatgaccccggggggcagagcttgcagtgagccgagatcacaccactgcactccagcctgggcgacagagcgagactctgtctcaaaaaataaaaaaataaagataccttcagtgttgtgagcagcactgtattgtgatatgactctcaaaggtctgcaatataaatactgcatatggccagtccaggccaaggcagggctatttcatagaataaggagaaaaatccaccacctctgctccgtctgcatcgttggcactgatctctgatgactctgactttgacagctgtgcatatatggtcagataacctcctggagctgacctagccggtgcccatgatgccaggttgcccagtcggatgggtcttcagaggcaacatgtcaatcagtttccccacccccaagtctctaacagagagttattgccctctggatttgcccagctcaaactgcaaatgatgagtttaagggataatcaaaacagtctctggctgacggtaattcatggctttacacatggaactctaaccatgcgagactgacgagctcctggagggtgggagttgtgtgatacctttttttttttttagcccccatgatatgacagaatcatcacatgctcagtaattactgaggtttagaaccagtgaggatgtgctttgattttaaaagtctctgaagagtcaagtccttccaagaatctgtttggtggctgtcttatagcaaagaatacaatatgaaaagtcattctgtcttaaatgacttaaggtatagattaaatacaaaataagtttgaaagtctttttggaggtttgtcttcacactgcttggagtattattgggtgatgacagtagaagtcgtgtataaaatggaaaacatatcttagtgtgggcctttatgaaatacttggtatgtcttatctgcctatactaatatgggaaagaatggacgttttcataggaggtgtgcattatcaagctcggattcaattgtaattgcagctgatagttgagcaaaattccaaatttcacagcttattaaaatggatgacacttgtaccccttaacagcacttctaaatatacttctgttttctgtgtagccatgcctttgtgttggtatctctctagttttaataccaattattttcctgtctttagctcctttcatgtggacttctggacaagctcaagttcagtgtgttagaactgcaagaatatttggatacctacaacaacaggaaagaggccacactctctgtaagcttttgtgtttctatgcatatgcagtcagttaaaaccaaatgaacccaaccactctgagttcttgggcggggttgtgattaacttaagactttcagacttcatcttttcctttgttaaggattacaattccaatttaatggtggtagaactgtatacaatattaattatattacaaatggtatctacaaaagagaaatttttcagcattcacttttagccctaccaagaaattggaaaaaaaaatgggtatgtacttgatatgttacttaccaaagttacaacttttctcagatatttgaaattggtgattatttccttccagtgttagcctcacccaaaactagttgtggcagatctcctccctgttctcttagccactcttggaggctgcgtctgccagtccccagggcttctcttggcctcagctcttgctctttacttttttctttcttcatagatctagatcacaaaatgttagagacagagtgatctagaaaccatccaagcaagccacctgttttctgacagatgcacaggtggaggcccagagaagtcagtggttcaataataagaataattaattgtatgtagtatgtattaagcccttcctatagtatgccaggtactatagaaaaagcaagggttttgaagtcagattgacttcagtttaaatcacagctcagttatttaacggttagtgaccttgaataagtgacttgccgtctctcatctcagatgcagcatctgtaagcccttggtaataataactaatttgcaggattgttgtgaagatataacaattataatagtcatggcagctatcatttcctgagtcctttttatgtgtccaacaatctgctaagagttaaatctcttaaattatatcgtttaatgctcacaactaccctgagagttgctattgttaccctcattagctagctaggaactggaagagtgggattgaaacccagagctgtgggattcaaaggcccacgctcttaaccacatcatgatattgccttgaaaacagaaataatatctgtaaactgaccagcacaatgccacatagaaagaaaatgttcattgtaaagttactggtttggggtttgtttattgctattgctgttattgatgttatcttgacctgcccaagggcaagagttcaaactctccaccgtaacaattagctttgtcttctgtttctgtggccttttacctgccactcttttcagcttctcagtcatcacccagtaaaagtaatctttttattctggttggtgaactaatctagcctttaatgtcaagtgtgaacttcagttcctcagtgctcattgttttctgctgaaaggttccctttcacacctgtgttagttactaccccagatgcttaagactagcaggatctctcagtagctgagctattaccataatagcctttcttatagtgaaggagatctgccccatagcagatgcagccaccgcagcatgacagaagtaggtgtgtccaagtcaggtcatgttgaccagaatcacccagcctgtgaggaagtattggtcctgtcttctaaccccaattgtatggaagatttctagccatatatattcatttacacataaattagaaacagtgtggtgaaaccattccctagggcaacacagtataatattgaaattgtgtttttagatgaccattactgaacccatataaacagatacttttaatttccaacagttcatctttaacccccaaatacgacccttttcaaaaagtcattacagcacaatttcattttactattattagaactttaatgaattttttcctaatggaattataccaaaaatgttctcagaacattgctgaatttacctatgtctttccctctctttctgacagtggcttgcaaattgtaaggcaacatttgcagggggatcaagagatggagtaattacctgtcaaccaggggactccgaagaaaaggtaataaaagcctgttagaatgggtctcttgtgtgctctaacattgtgtattagttttggtctacccaagaagcctggaacttgagaaaagaagaggcggaatgagtcaccccaaacatttacatgaaaccaacagagtaagacagaatgccttccagcatgactgtgtgttgatgggatttgtggggaggtttcttcgttttggaaaagtagaggtataaaataaccttttttgctggatactgtctaactatactaataatttcctaataaatttattcttaattcagattataaggccaaatttcattaattcttcactgaaccacttagtttctttaatgaaggaagtttctctcaacctttcagcagtcactctaaaacagattttctcatttagaattgctacacacctcagtccagtgtgccgtactataaaggaaattaaaggacagagtaagaatggatgaaaatcattcattctgcagttacatattgagtgcctcctgtatggccccatggaggacacaatcatgagcaacagacaaggcctctgctcttgtggagcttctgatcttgtcagcgagacagacattaatgaaacagtcatacagctattaactgcaacaaggaccatcaaggacaggaaagaacagaaagctgagagatcacagagcaaggctgcctgatccgatggggagggcggctctgggaagggttctccatggaagtagcatcttggcagagatctaaaatatgagatgaagaggagtgggcctgtagtctgcgtaagggcccggaggcaggggaaccaggcctttccaagaaccaaggagagcccatgtggctgaaagcaccgaaagccctgtggagaaaaggttgagaagagtctggagaagttggcagaagaagcccatgcagggctttggtgtttaacagcaataataagcaactgaaaaggattaacagtggggatgattagatcaaggctctcccactctgtctactgtggaaacagctcaaagtggcaagagtggttcagggaacttaggaggctgctgccccatctagggagagaaggttttacctcggaattatgtcattactactggaaaagtgttttacatggcacaccctctggaggatctgaaaacatcttcctgtgttagaaacagtactttattacgtaaaaagaatccagtaaagtctggtttctggtcagaggtttggagtgaacattttcaaccaaacaccagtggttccattccaatttggtatttgttattgagcaagtttgcagtcctgagagtaacattgtccatgccagcattgattgagtcccttggtaagccccttgataagttttagtgaagagatcagacattgaaaagcaaactataaagctgagaaatttctaaagagggcattgaagtagaggttgcatttccacattgctgcccttcttgaagacgcacatttatatctcactttatggtttacagagcactttcacaccccttaagtcatttgctctctctggatgggaagcagggccatagcagttgcccgttctatagctgaagacaccacagcttgacttatccaaggctccatggttgagaagtgacaggcagagatgcagcttggacacaaagtctgtcaacataggcaaataataactagtttgcatatatttttaaaataagtgtttaatgacttacataatgtctcccataagcaaacagaattgaatatacagttcaaaaatcacaataaactccagcatttccctcaatccctatatatgcatctgtgatgtcctgtctcagatgatttgtgacttagattttcactgaataacctgtgccgttagcatatcccagaagtaatatatttttaaaaaatgaagtattacctaggtttcagattttatggccacccagtagtactcatggcttgtctttccagcccagtcctcccttcactataatctgctgttaagacaaatgcagtccagagaacagttatatcaggttaggatttacattgagcacaaatcgaatccagctcatagtatagtttgtatagtagtatgtaaaaaacaacttgttatctgaaaacttgtcctcaatcatcaaattctgttatattctctgtaacagaacttcagacaggaaagcacattaatacattgcagacttttatgaacaagagttgaaaccaaatctattatttatttgtttgtttctttatagcttccgggttaaccctaaggataaccagaaattccagttaacttatcctatttcccaaacattccaactttaaaatacgtatttctgttgtgcttgtggtttatttctattaagttgttttacttggtattagttgctccctcctttcttcctggttcttctttaccttcctcaaacaaatgtttatcttatttttgcttattgtttttactcatttcctattcgtgcacctctttctttgcttctattttgtagtacttattcctctccctctcttttcttatgtttttactaaacccaaggactcaaaaaatagagttcacctatttattcatttgtttagatgtgacaactctgttagcattactataaaggcttgagagtacaaaagtagaaagaagaaactaatgttttcaagtactgtacacacgtaatctcatttgatcctttacaacagtcctttgaaataagggtttttccattttgcaactaagaaaactgaagctgagaggcaaagtctaaaggccatattctttccatttgtccacactttctctagcttaattttggaagcaaaacatacacatgggaaaacactcaagaataattcccagcatatgtctaaatgtctaatatggctttaggaatctgcatgaataaggagggaagatgcataaaacacccaagagggatgagagtgggatttactaggaacggaatgatggaagggcaaattctgagtctggtgtttccaatgtttttgcaaaaaccaaccaagctttggccccattgtcagtattagctcagtgtttcagaatatttccaaatggctcatggacacactggtaaccagagaactcaagcagtgaccagatgtcctgaggaagatgcttccaggcctacatgtgtaacaattctggagtctgtggttgatctggaaggcaaattatatgccacctaacaaaagaagttggcaatcctagtaagtcaggcaaggcggggagatttgtttaagtcgtctggatacttggttacagttattctctgttttaattggttagtagatcctggaaatagtctggccactgtgcatgcagctcaaacctcacactttctaatgccaccagccttgaggcatggctaggcaccatgcagagtacacaaatcaggcagcctcggttcccatcataggttaacactcgacaaggccggaaatgggctgtgagagaaaactgagtccttacacacaaaaggtaggccttgaggaggaatgatggtgtcattccacttaaatattaagatcttatatctagagatgtggagatataattttgctgactagagctaccatttggcctccaacccaaaacaaaacccaacaaatgtctggcctcagagcactgcttagcttacctctaagtgattctctccaacactcctgtgtaatcaggttctctgtcttctggaatgatttgatgttgccagttactctgagcacacccttgcctggggacaggtagaatggggataagtgaacttataacttgcagaatctatgtcaggatataaatagcaatatgaatataccaataattattactcatatctgttctatttcaaagaagtgtgcacttcatgaaaggattagtgcttacccgactaaacctagcaaagtaaattcttgaataaagatatcagtctgtcagagatggtgacagtgtacagacaggcatatgaaagcttctcaacccccaagccctacccagtctggtccggtctttgccagtagaaaattcctaatcattcttaacaggtgatttaagtgaggattgctatagaattgtttgtgaaagacaatatatatctttgttgggtgctgaatatttatttttctagtttttcttctattcttaacataaagttgtagacctaagtataacaaagaaagtttatgcactggtggcttgtgaactataaccaattcacagacatgttgtgttaagcttgcacaatattaactgaccctgcatttaaaaatttaaaactttcacacatacggccgagcgtggtggctcacgcctgtaatcccagcactttgggagcgtgaggcaggtggatcacgaggtcaggagtttgagaccttcctggacaacatggtgaaataccatctctactaaaaatacaaaaatgagccgggcacagtggtgggtgcctgtaatcccagctgctcagaaggctgaggcaggagaatctcttgaacctgggaggcagaagttgcagtgagctgagatcgcaccattgcactccagcctgggtgacagagcaagactccatctcaaaaaaaaaaaacaaaacaacaacaacgaaaaaaactttcacacatacacacacactcaaaacagaattcctggtgtctctgaataagaagatctagcaacactgggcctgccttcctcagtgacaataatgagcaagcactaagtgtagactgccctatatggactctccaccatccctgctgcccagtgagttcctaacactgaatgcaagagccaggcaccagtcatcatgatgtttggcctattgcttttcttataacagaaaaatatttctctgtacctaagtcctcaaaatgaagaataaagctagatagaaggggcttgagtttccaaaaagaaaacgggaaagagtattattctttgcatatgcaagaagcgtctctgcatatgcaagcacctgtttgctgaactcactttctgagggatatgttggaggaaaattctcagcgcatgttcaaaacaaaccatgtttctaagcaatttatttccaatatttgggaagtatattttggggctcttttttaaagacagccattataagtcaatgatttgggcttcttggtgatagtaataccagttctctgtgcagcatacactaaataggacataaatcaaggcatgtgatttgcttgtgtcataagaacactttactcatttgcggacactgctttagtagtgttttctcagcctgcacacatcaaaaggagaaaaatctcttcatgacttaaaatcagcatttccaactaatgattttggtttccaccaacctctccatctcttgtggaattcattctggagtgaccactagtcgaaggtttaagtgaacataaatggaggtcagggaacaaagtctgcagacctctcgactctgggttctgcaggcagtggctttagtccccttatagctaattaacataatttatcatccagttctgcagaggtggccccagaaaagctggagatgtttccatatgatgtattgttgattttagttaatgcattcataattcaacagatatttctgagcactacttgaacatttgactctttgaactcaagtacaataatttatatttagccctactacatttcatcttcttatattcaaatcatcattctgttagggtctttttggacactaaccttctcagttatatattttctatctacataatctatgaatgagaagcctacaacctctgttcttatacaaattgaacaagttaagtgttaaacaagacaagacttttctccaattaagttataatctattaaacatcatccttcagatatagtcaatcagtctttcctctgtaagccatattctttctcatattggctaaagaaatgtctgttgaagatagcttacagatttcttgaaaaaagtgaatgtctcaggatgtgtaatctgtatcataggtgtatttatctttcaaagctttgagggatatttatgaccaaggtccaaaaaactacttaacaaagataatgccatagccatcaatgtgccaggcccaagcattattagcaacaagtgggtacatactattcccaacttttaggagatttcatcattaggctaggttatttaaattttatctcattaatttaaacccaggacttttggagattaaatgtgatgaaaataatagctactatagtacactgtggttcatcttctctcatatcaaaagtttcttagatttttactgactggttatgtcataagcatagaatccacctgagaacagaagaaagaacccagatatggctatgctactgtcgatcagcaggagttcaattattctgggcttttaaaagctatgcattcctcaattgtttatgataaattcttaacatcttggcttcttgatcttttgtttcctcattttgagaaaacatacctctaaatccaattttataaatcaagccatatcaggagagcaggaagggggcttgaagaaaatcctcgtgactaaataaaacaaggacattcccacatgttcaaaagaacctaaagctgccaaaacacagataagtttataaagacttctcaagggattatttttagaatgtggatacagaaaaacattagaacgggacggtgggacaaggggaattttaataatttccataaaatggccccccagaaaggcttttttcactctttttggaactctaaatgcaaactaggtcccagcctgtggcctacaaaaagattctgagataataaatatcaaggaagcctgaactagcctacctaaaaaggaacgtttaggaagaatcctgagaactggcattcatcacagttggccatctcccaagaaaaacactgttttgtgccctgagagctgagtgggaggaattcattgacaatgaaattccttagcaccaagctggagtcgaaaagtttcctctgcctttattgaacagaaaagattttacttgaactgatttgatgacctccttggattataacctcgttttggaaagcaataaaaagccgttttcttcacacaagaccttgtaatttactcagcacttgcttcatttcacacttctgaaaagtaaatcccatagtagcaaatgtttacttcctaaactgcatactaaacgtttcagtcatatttgatgttgtccaaaaagtcttcgcactggaaattctgcggctatatagacttaagactctccctgtgtgactattttatatgacattgtatttcagaacagaaagtttggttttagaaacctttagatgtaaagttttcttgagaatagtaaacacctgaagctgtgtagtctccacatcagaggcttacaggtgtttgtcttccaaactttgaaagaaatttatggccagggtcccaaaaactacttagtaaacataatataatatgcatcaatgtgccaaccccacatgataagcaagtgataagtatgggaagaatagacccttggaggatagggtagggcttgttggtggcagtcctttaattacatttgtcgatactaattaataagttgatagtttcatttgttcttatttactgtaccttattttcaagtacaatacactaaaccgatgataactcagatactttttgaaagagctttaaaataagggggttttattggattagaaactgttaggtccttaaatattttgaaaattcagaaccagatatgttgatgcataattaggaatggtcaatttgatttaaaaaaaaatacattctgtcaagttttacttatctctttctgcatacccaaactttccataaaccaattctatgatatggtgacatcaaaaaatggtagctgctggctgggcgcggtggctcaggcgtgtaatcccagcactttgggagtccgaggcaggcggatcacaaggtcaggagatcaagaccatcctggctaacaaggtgaaaccctgtctctactaaatacaaaagcattagctgggcatggtggcgggtgcctatagtcccagctacattgggaggctgaggcaagagaatggtgtgaacccgggaggtggagcttgcagtgagccaagatcgcgccactgcactccagcctggggagacagagcaagactctgtctcaaaaaaaaaaaaaaaaaaaaaaaaaaaaaaaaaaaaagatggtagctgctgttgaacatggcccagttacaaatctcattattttagactaactattagttgtagattacttttagaaattgtctattgagtccaggcaaggtggctcattcctgtaatcccagaactttgggaggccaaggcgggcagatcaagaggtcaggagttcgagaccagcctgaccaacatggtgaaaccccatctctactaaaaaaaaaaaaatcaaaaattagccaggcgtggtggcacgcgcttgtaatcccagctactcaggaggctgaggcaggagaatcgcttgaacccaggaggcggaggttgcaatgagccaaaatcgtgccactgtactccagcctgggcgacagagtgagactccatctcaaaaaaaaaaaaaagaaagaaattgtctattggagaaaaaattgttataaaaagtaaaatgcaagaaaattacctgtcatatctcacacttgtttgagggcatacaatgtttagtcctttgaaattaaaaattatagcagtcctataaaatattctcaatgtgcaaggcaatccaactaaagaaaataccatgtagattgttcattatattcaatgttaattggaaggtcatagtttagcagacatgaaactgaacatattaaagactctgccttaatacaaagcaatagtctaatttgtttggggctataattcttcaaataactaagctggcttcctctcagttttactgtgttcacatattatgcacacttatacgctaaaatcttcaagcaataaaagctttgatttttggtctctaaaactgactgacaaaatctaaactgattaatcagagaacctaaaaacgtaaacattatgttttttcagtgatatgtttcccattagagcttgtttttaactggaacgctatgcatgttgaatgggtacgacatttgcaacatttatcaagtttgggtgagcaatgctaatactgctggtggttctgctcttggaaaagggccgtgctttctgttgcatgcagacactgaccctgtactttctttcctttcctttgtttcctgtgccatgcttgctgtgtagcaaatggaatctcttgcagtaagttaactttctttcatactctttgtccatttaggcatggacccataacaaagcctatttttaccgttactgttacatctcttagcatgttctccctttctcattttaatttattttatttggtagattaagacatggcagtttattagtagcattctgggctgctttcgccccaaagtagaaacttacattgctatgaattatcatattatcagtggaatattttgtgtaataattaccatgatttggcacttaggaaaggcagagttttcatagctaggtttcacccaaattgtgaaggtaatattgtttttaaacaatacttttttatttatttgcaagtctctggcagttatcttttataccagagttttaaaggtttctctaaagagaagcttaaaaaccacaaaatacaatgttttactaaaacaaccaaacatccagtttgagttaattagtcagtgtagctgcttctttaatcttaggcctgttaccagtattgagagatcaaagaatctaggcagaattggttttcccctaaagagcagggaagagctgggaagagaaaggaaaccattcagcatagtcttagcgtgaattttagtaacttttaagatttaggatcaaaagtctgttaataataccaatagaatattcttcctaaaacctaaattcttgtgatttctctccttaaacagatgggaggaaacagttttaagtcaccttagaagctctcgattctgagctgcattctttgtagtccttggtaaaagaaaggccgtatttatcctaccccatttgaaaactgaacagtgaaacatttagtttaaaccacatatttaatccactttcactggtgactgctggccatgaaattctattgagcaaaggctgttcctttcctttcacagaatcccatccactcactacctgggagcaaactcattcttggaataaaataggcaaagtgtagagggtacagctcaaagactagtcttgtcactggcattggaattgttatttttccctcatactatacataagctgtgtaatgaacaaattatagggtacagaggcacaaatgtgaccctgaaacattttaaattcgagaggtatttatgtggctcaagggccatcgtgtatgattactttttgatgtcctttccacagaaattttcaaatgtgttaataatttctttttttctaagcatttttggtccctttttatctctctttaattcaacaagtatttactgagcacagagtagacggatcatcagtaagcctgactgttaggtttacacaagcccaggcgtctacagaatttataagtttaacacctagaactacttaatgttttgcctttcaaatatacttttaataaaaggaaatttttctttttaaaaataatttatagcttataaaaatgaagacaaccactcagctataattggtaggtatttaactggcaaatataatggaaatttggttgttcactcagtccctttataggtgctactctctaattagtcatccattacacaaactataatggaaattataccgtggatttctcactggtatttatttaatgactgtatttcatttttctgttttatttggaataacagctggttatgttttcttaatttaaaaaaaaagtttgtctccattgagatttcactagttatatgtgaatgatctttaacaataactgtttcttcccatgcaatttctctctttagcaattggaactgtgtcagagattatataagctacacttccagctgctattgctttttcagtcctactgtaagctcatcggccaggtgcacgaagttagctccatgccagaggtgagtccacacgcttcccaaccccacgtcccaccacaaaaaccatttcttttgttcttcctcactccaccccttttataactgcccaagtgattttattcccgcataattattttgctcaaacacaattctgaaataaacatgtcttgtatgtatttctattctcatttttaaaagcaaagtcaggagtaggtatggaaagtgaggtgcctcaaaatttaagaacgcgtgtaggaaggaaccttctgtgggttacggcctaggtgccttgcttgcatctccctgatcctggccctgggtctgggcatccttatttgaaaactttccatgtgtgtgggttttcttctttacattagtttttcatacttgcctttgccttgaggtaagaaggaaatgtctgtatgatgtgtttggttctcttcagtttccctgccctgcttagcaccaggatattttaatattttaaaatatttaaaataaaataacttaaacatattactgctgagtgagccaaaatttttctacaaatgaagaaatactactgtaatgtagtcagtggaataatggtgctgtatagtggatactatagaagcaaagaggactaacggctcatttgcctaggggtaagaaaggttgaaactgaagagcttgctggaggaaaccacacctgaatggactctcagagggtgagttggagtgagggaggagcattccaataagaacaaagagcatggccataagcctgatgggaagaaagagaaaggaactacaagctacttagtattgctagaatagaaggtgcaccaaaaaagagctatgagataaggcagaagagagaggggtaaaggcgagatcataagacatgccgcacctaggagtatttcaggtagatctctctggcagctatgcggagggtgggtctgatgacagctagaacagagacatggagaccagtgatgaggctgctgaaatagttcaaacagaaggagagagtttgaactgggacagaagcgctaggtatggagaggaggaaggaaatgtgagacacgggacaaaaaaatcaatgaaactaatggggggatgaaggagaaagaagagttgaggagaggatgagactcaggttccatcttatagaaaccaggtgaccagtagcaccaaagctgaaacagggatataaaaagaaggactgaggcgatgctgtgtccagacagtcaagccttctgccggctagtcaatggctgcatactggaccaagacctggcttaaacggcgactgacctcttgcaggtggttagacgtgaggtcaggggagagatctgaacaaaaggacagatgtgattgtgaacaagcagaagtcgattaaaccatgccagtgacagcagagaagtgaggatgaagcctgggaaacctcaccgtctaagagcagaagaggaagagccacaagagacaaactacaaccattttaccatttttttattactcagtttgaaaaaaggaaaaaactatacgactttatactttcaaatgcttatttcaagaaagtaggccttcacaaccagttttcctctattcaattataagttgtcagataataggaatcaactcttttcttttttatttgccacatggtcaagataaactttactttttctttttcttttttttttttttctttttttgagatagaactttgctcttgttgcccaggctggagtgcaatggcacaatctcagcttaccgcaacctccgcctcccaggttcaagcgattctcctgcctcagtctcctgagtagctaggattacaggcatgtaccaccacacctggctaattttgtatttttagtagagatggggttttgccatgttggtcaggctggtctcaaactcctgagttcaggtgatccacctgcctcggcccccacaaagtgaactgtgagccaccgtgccccgccaggattcaccattcttgatgccattaagaacattcatgattcgtgaaaggaagtcaaaatatcaacattagcaggagtttagaagaaggtgattccaatggacgactttgagaggctcaagacttaagtaggggaagtaactgcagatgtggtaaaaatagcaagagaactagaattagaagtagaacctgaagatgtgactgaattgctgcagtcttatgataaaacctgaatggatgaggagttgcttcttatgcatgaacaaataaagtttttttgttgttgttgtttgtttatttgtttttgagatgtagttgcactctgttgcccaggctggagtgcaatggcacgatctcggctcactgcaactgccacctcccaggttcaagcgattctcctgcctcagcctcccgaatagctgggattacaggcccgcaccaccatgcccagctaatttttgtatttttagtggagacgatgtttcaccttgttagtcaggctggtctcgaactcctgacctcaagtgatccacccccgttggcctcccaaagtgctgggattacaggcatgaaccaccacacccggcccaaacaaagtttctttaggtgaaatttactcctggtgaagatgctgagaacattgtcaaaatgacaacaaaagttttacaatattacataaacttagtttatagagcagtgacagagtttaaggtgattgactgcagttttgaaagaagttccaaggtgtataaaatgctgtcacatgctacagagaaatatttcatgaaaggaagagtcaatcaataaagcaaactttggcagggtgcggtggctcacgcctgtaatcccagcactttgggaggccaaggtgggcagatcacaaggtcaggagattgagatcatcttggccaacatggtgaaaccccgcctctactaaaatacaaaaaactagccaggcatggtagcccgtgcccgtaatcccagctacttgagaggctgaggtaagggaatcacttgaacccgggaggaggaggttgcagtgagctgagatcatgtcactgcactccagcctggtgacagagcaagactccatctcaataaataaataaataaataaataaataaataaataaataaagcaaacttcattattgtcttatttaaagaaattgccccaatcaccccaaccttcagccaccaccatcctgatcagtcagcagccattaacattaaggcaagatcctctaccagcaaaaagataattactcactgaaggcacagatgattgttagcattttttagcactgaagtgtttgttaattaaggtatgtatatttttagacttagtgtatttagactacaatattgtgtaaacataatttttataggcatggggaaatcaaaaaattgacatgactcactttattgcagatgtctagaactgaatatttccaaggtatacctggtgtgtgtattcatatgggtaggtacacacacagtgtttaaatactacataagttttaaataatgtatatatacacacataatgtttaaaacttatctaggtttaaaataaggagaaatttgctttcaaatttaaaactacaaacaaaattaagatactctaatatcttgttttaaaagattatttcactaaattttaaacctacttctgtagtaggtagttgcatttaacaggcatgtgtgccaagaaaaaataatccttcaaggcttcagttttttattgtttgtaccgtgagtgagttgggaatgaagaggaaaagcaaagctgttgaataaataactttccaaagtaaacaggcatcatcaacttgcattacaaagaggaaaaaaaacctttaattttatgccaatttttttaatgctcttgagatcaaattgcaaaacaaccatcttccgtagtatattttgagacacttagaagtgacacaggttttcttaatctttactttttaacactctggatcctttggttccagtaacttcgagggaaaatatcttttactgctgtagcattaatacaaacattagtttaagattattctatctcctcaaaattgtgtcttcagctttttcccatggtgtggaaccaagagtgagaaaaacttattattaggacagagtccatggtcacaattacattaattgagcacttaggtgctggactgtactaagcattttgtatatattatttccacttaatctttaaaataaacctttaggatggctattatcttcagtctcacagatgagaaaaccgaggcacataaaagtcagttaacttgtccatcttcctacagtacactgcagagccggcatttgaacccagatctactcactcttgagcctgatctcttgtactctttccttctgtatttattccctatttaagtctaacttaaatagaacacattttaaatgaagtcttaaccttttctataaggagagcatctcagcagttgacacatactcaatgcatccaactccacaatcccctacacataccatggagtacaatgtcatctatcctatctgaatttaccaaggtattaagcttatgcttaaccacacccataagatcctttttttttccttttgggatgtaaaattcccccagcacctaaatatagtttaaaaaacatttttttttaaatagctgctgaatatgtccagggaactgagtgacctaaagaaacacctgaaggaagccagtgcagtcattgcagctgaccctctctattcagacggcgcgtggtccgagcccaccttcacgtccactgaagcagccatccagtccatgctggagtgcctgaagaacaacgaactcggcaaagctttgcggcagatcagggagtgcaggtgactctgctatttcttttagaggtggttgcaggaaatgcacacctggttgttactctgtcatggttggagtctagcccactacggaaggctagatattttacagatctcttctcagatctttactgctgccaaaccagaaacactcagctttcagaacactacatattgaaagtgttggtgttggttctggccatttgtcgtccctaaaatgacaaaatgctgaagcacttcaaaatatacctttatataatttttaactaacatttgaatatattctttttggttttgcccctacattctgatattgtattcacattcattgaaaccagaaggctatagcaaataaggtaaatgttttaggagtgtcagattccattctgatatttttatacttttgatattttaccaaaataatattctaaaattgattatggtgatgtttgcacaactctgaagatactaaaacccactgaattgtttaccttagatgagtgaattacctgatacaggaattccatctcaataaagcctttttaaaaagtaatactcttatattaatgaagactcataagctcccaactttgtgactaatagtgcctctaatctgtgctgttctttttgactgcagaagtctgtggcccaatgacatctttggaagcagttctgatgatgaggtccagacactactgaatatttatttccgtcaccaaactctgggacagacgggtacttatgccctggtggggtctaaccagagcctgaccgagatctgcaccaagctgatggagctgaacatggagatccgggacatgatccgcagggcccagagttaccgagtcctcactacttttcttccagactccagtgtttctggcactagtctctgacaggagcctcctgtccccactgggttccaaactggcagtgctgccatgctggggcaacgtcattcagtgtcttctcggccttcaaaaggcttggacagactgttctccctcttgttacctgtagggctttttctaaagaggatggcagaacttccaacgtgtagcaatactataagaaccaaggtagcttagaacgtcctggacagactccactcatcatgctgtgtggcacaaatgtgttacatttgaccgagcatatgcaactcgctactgaagaagtgacttccgttgcataccaaagccgactacactgaacagtaccttcctttctagaaacaattttagattggcaaaagtgcaatgttttcttcactcaaaaaattttatattctcaaacatgtatattctttccctgtcttgttccattttcttttcttttttcttttttctttttcctttctttcgtgggctgagaaaggggcaggcaaaatgaagctggccactgaaaactgtaagatggtcaaaagctgacagcctgtgtatgtgaaaagggaattgtaaatggactgcaatgtaatgtacactgtaatttgaatacaattactgtatctaaaaggagctgctatgaagtacctttcttatgttgctaggctactgtttctgaaagccctggatctctttgcaccaaaaatggtccagatagactctttttaaggatcttggctgctttttactagaaggttgcttttatgagcatatttatactgctgaaggatgagtgttaattttaattaactttgccgttttgtagagaaaactattcacaagataaattccaagtcttttcacctgtcaggcatgcatattttaatatctgtttggatagtcagaagtagaatcataaaggtaaaatatgagttgttactttgtttcttcgatgtcatattttatgtgtaatatatatgtaaagggccattcttaagttctctccttaaacttaatgctgtcaagtgttagatgtgtgcatgtgaacttgttgcactgcagaaacatattcagagtttatctatgtaacttattcactctgtaaatacatttaaagtttttgtgatgtaagcttaattgatattctgttcagaactttctttagactaaaaaaaaaaaaaaagacaaaatacacgttgaccatggactttatttctggttaatgaaaatgtttgtcctgggcacacatgaagttttgcatgtgggttgccaaagtaataaccccaaggggcacccctcacatgtatgatctgaatggcacccgtgggggtcatgccatgcatggccctgtgaagctggaggtaagtattatctctttggaagttggcatcaaaactgtgagcttcaaccaattctctgtaatcaaccaaagagaaaaatcagaaaaaagtgagagctctaattctccataacctataattaggttgtcatccttcaaatttggaaattaattctatagtgagcaggaaaaagtagtagagttgtaattctgtcaccaacacctatcccccaggaacacagggagaaacatgtaacaatctcatttatgccgtctttctactcatattttacatggaccaacaaatatagcttgctttactagcatatggctactgaatcattggcagtaatattctaggagtattctatagaagagagcctaacctaggattttttttaaatcctagtagttgctacagatgcaactactagattttaataattttctggactgctgaaaacatatttttctgatgatttatttttttcaacttgcctgaaagatgatttgctatgatttgtagaaacaactgaatcatgatctctctgaaaaatatcataaaataaaggtttctgtggctaaccacagtagacaactttcagagagttttgttgggagccacagtagaaagaacagattcgtcatgaactgagttttctaccatggcttcttacccagcagagaaccaccgtgatggtttactcttaaaaagggaaggaaaaaaaaaaaggatttcaacagtacattacaatccaagatattaacataggaagcagtggtctgtgtttttctcaattttatttttaaaaggagatgtattaatgtgaaaggtttcttctacttttcctctatctcttcacctcctctactttaagtggagatgggaaaaattgtgtaggatgcagccccacgccagcagagcccagcaataactttagatctaccagtcaaatcttgtcggctattgctctgtgcctctgttacagaagcattaatgttaattgccttccccagggatacaaagaagtagaagtaccaaaggaaagggtagatatttaacagatgcctcagtgataagaaagatgcctccttgtgtctcactgttttctagcactgaaacatgatacactttgtatccacctgcagaataaagcaatccagacaggcgctctgtaacttagacatcacttgattaaaattatagtctccaaatatagtgttttagaaaaggcactgcacatttttagaggcacgtgaatgtcattcccacctctaacccatctaacatcggtgagatgttaagaaaatgtgccgatgttactgtgaaataaagatgcctgtaattaattgtaggcatcacacacatgcgtgaacatccagagttaggtctcaaggctcttctggttctaagtcctaacaaacaatgatcttttcagtgaactgtagaattctggaaagaataagcgtacctccaggctgcttacatcaatagcttacacgtgcttcctgatgcctgccttaacaacaaaaaattcgtgtccataggtgagtattagggtatgttcattgtatctcaatgaaactagtttttaaagttttcaatgcatttgtttgagatcaattaatatttggatacctatcatgacccaggatatttctttgttcagcaaatatttattgcatgcccactctgggctaggcactgttttagaggacaccgcagctatcaaggcagatgtggtccctgttcccatgaggctcctacatttgagtggaggaagatgtacttgtctacgttgggtgatgattagtgccatgaagaacaaaacggatacagtgagtaatgtggacagggctatcttagctatcactctaataaggtgatatctgaggagagatctgaatgaagtgaggatacaatggatatccaaggaaaagagcattccagcaaaggaaaaaacacatgcagagaccctgaaggagaagcagggtcactttgtcaaagggacagcaaggaagccaatgaccgggtgaaatgagtgaagagagcgttcagagaggacagccaaaagctctgtgggccacggcaggactttgtcccttgctgagcaagatgggaagccactgaatgtttgcgggcagggtagtgacatgctgtgacttatgtttaaaaggattactccttcatagcgatgaagaaaagctctataacaaaagttccgttgtggtggttatacagcattgtgaatgtacttaatgccaatgaattgtgtactttaaaatggtaaattttatgttatatatgttttaccacaataaaaataatttttttaaaggatcattctggctgctatgtgcagaatagactgcagatgggcagaggtagaagcaggaagactagagagatggctgtggcaacagtgcagtcaccaggcgatgctggcttgggctagggtactagcaagggatatgattagttgtgggcatattctggaaatagttcagagctagagctgacagggcttaccaatgacacgtggaatgggagagagtttagcccaaacagctggaggaatggagtttccactaactgagatgcgggaatgcatgtttgggagatagaaaccaagatttattcttcagacatgttaactttgagatgtctgatatccaagacaagatggtgagtaaacaggtggatgtgtgagtctgttgttgaggagcaaagtctgggctaaagacacacatatggcatttaaagcccctgagaaaaaagtaggatactcccctgtcttgtccagccgggactgggatctctcataaaaattagagtgtaggtaatgggctcaaaatttcagatgcacattaaatcatgtcagggacttaaaaccccaacgctcagccttcgtcttaattgatttaattggtctgaagctgtgctcaaactccagtgctgtttaagtttccccagatgattctaatccactgccaagattggaacattgctttctcctttctagacctaagagtcaccccagggtatttgtcaaaaatgcagaatccctcaggttgacccctctggagaccagtttggtaaatccagcgcaggatccctcaaatcagcattgtaacagccactccactttgaaagacactgaactaggagaaacttcctatatagcgaagtgctctttcttctaaagcacacccccagttgtttttccacgtaggctgttggtgtagtaattctacccaaatctgtcattgatctttttgtaactttgtttcctatttgaggtcacagtgagtgagtgactagaatttactgcatccacttacagatcagtttcctggcagatgcctccttctctgtcaccatcttctgtaatccagatccttcttttaacagcaaacttgaatagatattgtattcgattttcagattccaagaacttgggccacctggtgcgaacttccaggagctcctcggccaggagaacaaagagattcctcccggtcccctttactatgtccaacccttctctcctcatctctatttcgaaaagcccagagactttgaaattcttgccacctggctgtactagccacttccttccccaactccatcactgtcatccacagcagtggctgtgaccctcagctgcattagaagcactggggaagctttttaaaaattctgaggcttgggcccccctccggatcccgtaaatcctttctaacgctcctctgatgattttgaattgcaaccgcgcttgggaactggtgacctaaagccctcctgcttcctgccccttattcatcggagagactagagcttcttgctcaccccagcttccgatgtcgtttccaggacttcaggagtcttgtgtataacctgtatgaaatcttttccctctcatcctgttaacattcttacctccaggcattttcactcttttctaccttagccacccaatttcctggctataccaaaacctgatccatagcagtaagtgaaccagctccagaatcccaccttcaggccccctactcaggaattttcccagttcccctttactccagcccccacccctctgacaattctcccatcatgaatatcagtctgtggccctcacaggtctttactcttctttggagcatgtttaaattccatgggtcattataatccctctcttgctgacattcacaagggatgccctacccctgtcttactcagctggttaaaccccaagcctggctgaacctaaaactgactcttcccacacctgcaccagaagtgtgacattagtaggatgaagatattactagaatgcaagtcacacatgtagtgtcgcactaacaatgacactggtaatgttacatttctagtcatatcttcactactagaagtgtcttcattactagaagtgtgacattactagtatgcaactacaaccaagaaaatctcaaatctcaacactatgagacaatcttgtaatacacttatgccttcctgatcatttcaatttcctaatgcctgagagagttatttctcatattttcctccctcctcagcatcctacctgtctcagctgatggctttgcttcataattcattgagtaaacaaatgagtctcaccttccccaccaaaaatataaagttatctttaactagccctatattctaggtgcttcatcctttataatcaaagggatatcactgctcccctcaggggccaattgctccactggcgctctggaccccatctctgctgcctattcaagggctttgctcccgcagacattcccctctctgctctgccatcagcttctctaaacgattccctttaatatgccaacatactctgcgcctccactttccccaaatgccattctagctatcaccagtttctctgctttcttacagcaaaacatctaagaagtactacttctgttcactgtttggactttaacgctgcttccgtccacaccactccaaggaaacttctctcttcaacctcccccatcacctccatgctgccaaatccaatggacctgtcgtcacctttctcgacctcccggcaggatttgactcagtcgactttcctaccttctggaaatactgtttaatcttcattttcatctcgtcatcctcttcctatccctcttaacttcatctttcatctaaccactaagttcctgctgctccaagtatagtctggggaaccagcagcattgatggcatctgggagcttcctagatttgcagtctcagaccccagacctactgaatcagaatcttcatttaacaagctcacccaatgactcctgggatgttaaggttttagaatcattactctaagtgttggtacgccccagagccctgtgttgtactcccttttttttcctgcttctatgaaactatattttttaatttttaaaatttttttatttccataggttattggggaacaggtgttatttggttatgtgagtcagttaattagtggtgatttgtgagattttggtgcaggtgattccatccaggcccatggctttaaaaactacttgttatctccaaatctatccctagccctgacttatctcctaaattccagacacatatacccaataggctacatgacatctaccatttggatgtctccaacacttcaaacttatgttgaaaacagaagcccatccccacatcactaaatagctccactaaaataagaggtaaatgtattgagccctcaaagtgacaggcactaattattctaagtgatgaacatgcctcaactcctttagttcgtctcttgatggtgtgaggactatcactatccccattttacagataggtaaactgagaggtagagagtaacttgcccaaaattatctcttaagtaagtacagcacccacgatttgcaattaggtaacctgactccagaacatgcttcctacctggtatagctctcaattccattcaccctacagctcaaagcacaatattgagtcattgtttatttcctccatcttccactgccagccctgcacattttcaaacattatcttaaacccatggatttctcttcgtctccctggccatcacccttgtccaagccatcaatttgctcatgtgttcattaacctcacaactggtctcccgctaaagggagctttttgaagtgagaatgtgtctgcactgttgaaagcccctcatgggctgtcatttgcttaaacatggccttgagaatcctttgtgatcagagccctgtcttctgcagcctcatgtcccacatcagccccagggggctcctattcctcagcccctcaatgcctttattcctgctgttcccttggatcaaaaccatcttctccctgctcccttcatcctgcgagtctcaatctcatgtcacctcttcccagccaacgtgtctaaaaggttactctatcatagcaccctatttccttcatggcatttatcacaatctgaacttgagaagtataaatgtaattgtgaaagcatggagcaagtcctactctacctggtttaaatcctggcactctgctctggcctctgtgtgcctctatctcctcatctatgagaaggtataatagctcctacttcatatgggtgctgtagtgagtaatagcaatgcatggcacatgctaaaggctgcttctgcatttgctatagttgtgtatacttggaggaaggaccttgccccttcatcatctctatatataatgcttagaaccagtgcttagaacgtccgacttataaaaatttgtcaaaagaatggctatttttcttcattgttccccttcatataagtgacagtatctaccatttcccaatgccatatattgatgtttttaccctaggatcaccaattaatgtggcttcatggtctagttcacatgcatttattttattctattcacattgtacaattgttacacaatctacaaaaagtacaaaagcctagccattttccgatgccaggtcagagccaagttgcaaaaaaggaagacagcacagtaagttacaagaagagctcaggggtccattacaagtcacactgtacaagtcacatcacatatttaaagctgtaaatattgccacaggagaatctcttgtctttgcagcgaccacacagttcctgtcgatgaggcctccttagatcaatgtgtctcttcttttgaggacaggaacaatgagactttgagcaggtctttaggaaacaaagaagagtttggacgctaaatgatcagtttagtgtttcaaatgtaaccctcaaatcacagtacttctccctattaccctatccctgaaaccttcatcctctgagtcctacgagaaggccaagaccaagttgtacaaaattacttgtatcacattaaatgtcagatattttttcaagatgaatgatcacagaagatattcaagagaatactgcagagccaatcaagacaacataatgtaaaaggaatttaagagttttgtagaatttcttccctatgtagatttttacatttgtagctgaaccagtcaaggcaacataatgtaagagaaaaaaataagtcaagagttttatagcgtttcttcactctgcagatgtttagatttgtaggcaggtcagggtgagtggcagtgggtaggaataaaatgaacatttaaaaaagactagagcagatgttctcaaccaggggtgattttactcccccatctccaaccccagtggacatctggcaatgtctgaatatattttgggttgttaaaactgggagagaagggtattctggaggaaactaaatgtttcttttcttcttcttttcgatgtgcccaatctttactaggatctaaaatagtttctttcaaccattatctcatttctgtcttccaataattaaaactaatatcctatggaaactggtacagtaccctggttccatccccccaaccctgccattctattttctacatgtcccatagccacatggaataagtcaagatttacctttttttttttttttttgaaatggagtctcgctctgtcgcccagtctggagtgcagtggtgagatcttggctcactgcaacctccgtctcctgggttcaagcaattgtctctgcctcagcttcctgagtagctggaattacaggcaatcgccactatgcccagctaatttttgtattttttagtagagatggggtttcaccatgttggccacactggtcttgaactcctgacctgaggtgatccgtccgccttggcctcccaaagcgctgggattacaagagtgagccaccatgcctggccaagatgtacctttctatattgtgaaaatagacatttttattctgctaaatgcagtcttaaacattatttaataaactgttctgttgaagaatatgcctccttatgagaaaattcctttttttttttctttttttgagacagagtctcgctcttttgcccaggctggactgcagtggcgctatcttggctcactgcaagctccgcctcccgggttcacgccattctcctgcctcagcctcctgagtagctgggactacaggcgcctgccactgcacccggctaattttttgtatttttagtagagatggggtttcaccatgttagccagggtggtatcgatctcctgacctcgtgatccacccgcctcggcctcccaaagtgctgggattacaggcgtgagccactgcacccagcccttgtaagaaaattctaacaagtaatactcacatggtgtttactatgtgcctagcactctcttaagcactttatatacatgaattcatttaattctcacaacacccttacaaagaaaggctcaataaaataaggatttaccctaaaggttgatttttgcttctggaaatgatggattaggtaattctaaccaagcctcctggatgactagaaaagctgagctaaaaataactgtttggatcactgagaaattatcagagcattagagatgaaaacccagaaataggtgtgagcttgatgtctgggactgtttactctcactatagtttttcacatgtgatagctagcactcaatcaaaaataaccaggtactgtatgtgaggaaacagaacaacatacttgaaagccaagaggacagcaatagactcacagggtattgagttaatggagttctctgacacagattttaaaatcactaagtgctaatatgttcaaggaaataaaactaatatttccagcaaaaaattgaagttttcttctaaagcaataaaaattctagaacagaaaaatacaacaaataaaatcaatagttcaatggatgttttaatcacagattaaaaagagctgagatgagaaatacaaatggaagatggtttagtagataatattcagcctaaagcaagaagagctaaaagcatggaaaatatagataagcacataagagacagaaagaaatatggtgcaaaggtctagtatgagtaattggaagaaagaaggaataggagcagaagtaacatttgaaaagataacagttgataatttcccaaaagtaatgaaaatctttaagctgcagtttcaagaaacactatgaagctcaagcaggataattacaaagaaactacaactaggcacatcattgtaaaactgctgaaaaaccaaggcagagagaagtaagcagatttacgaaggggaaagagaagagattacttcaaaagagatgcaataagagctatattgtttcatagaaacaatgaaattcagatccttaaagggcagaaagaagtatttccaacctagaaattctatatatacccagcgaaaatatctctt

SEQ ID NO: 251 - DNA, 10882 bp, Homo sapiens
agaccatccatatttccagggacagacacaaggggaagcagcagccagagcacacccgggccgctcacgggaagccttgctgaagagagaggatccgcagaagctgggaaattcctcccgcagcctaggcggagactgagccgcggctcaggttgagacagtgggcaggggcagggggcggcgctcccggcccatcccttagccccgcggcggccgtgtgggccggaggctgcctgcaccgcgtcagggaggccggcctagaaaccctccctcccagaagaaagccgatcccagttcaggtggggtcttcctcggttgcgtacctggctggagccgagctggtgggcggccggcagccggcgtttctggtgatgacagccccgaaatgaaagcagcgcggccgccgcctccgagggctgcagggagatcagcgtccagcaaataagaagcaagtcctggacccggaggaggaggagcggccgagcatctctctctgctccgccgtgtcctttagatgagcactcccggccggagccggaggtggatccgcagagctgcctctgggcgcctgaccccgcgctgacatcacaacctgtgacaggcgcatcacgcccggtacctgctcccggccgctgcccgtcctcccagcctctttgtatgccgcagacatggccagccagcaggattcgggcttctttgagatcagtatcaaatatttactgaaatcctggagtaatacttctcccgttggcaacggttacatcaagcctccggttccacctgcttctggcacgcacagggagaaagggccgccaaccatgctacccatcaatgtggacccagacagtaaaccaggagaatatgtcctcaaaagtttatttgtcaacttcaccactcaggctgaacgcaagattcgtatcattatggcagagcccctggaaaagccattgacaaaatctctgcaacgtggagaagacccccaatttgatcaggtcatcagctcaatgagctccctttctgagtactgcctgccttccattctacgtacattatttgactggtataaaaggcaaaatggcattgaggatgaatcacatgaatacagaccaagaacaagcaataaatcaaaaagcgatgaacaacagcgagattatttaatggaaagacgggacctcgccattgattttattttttctttagtattaatagaagttttgaaacagattccacttcatcctgtaatagacagtttaatacatgatgttattaacttggctttcaagcactttaaatacaaagaagggtaccttggtcccaacactggcaatatgcatattgtggcagacctgtatgcagaagtcattggagtgttggcacaagccaaattccctgctgtaaagaagaaatttatggcggagctaaaagaattacggcacaaagagcagaacccatatgtggttcaaagcattatcagcttaataatgggcatgaaattctttcgaattaagatgtatccagtggaggattttgaggcctctcttcagtttatgcaggaatgtgcacattacttcctcgaggtcaaagacaaagatatcaagcatgccttggctgggctttttgttgaaatacttgttccagttgctgctgctgttaaaaatgaagtaaatgttccctgccttagaaattttgtggaaagcctgtatgacaccacgctggaactttcttctcgaaagaagcattccttggccttgtaccccctggtgacctgtttgctctgtgtcagtcagaagcagctgttcctgaacaggtggcacattttcctcaacaactgcttgtccaaccttaaaaacaaagatcccaagatggctcgagttgcactggaatctctctacagattactttgggtttacatgattcgaattaaatgtgaaagcaacacagctactcagagccgacttataaccatcatcacaacacttttccccaaagggtcccgcggtgtggtaccaagggacatgcctctgaacatctttgtgaaaatcatccagttcattgcccaggaacgtttagattttgcaatgaaagaaatcattttcgattttctttgtgtgggaaaaccagcaaaagcattcagtctcaacccagagagaatgaacattggtttacgggcattcttggtcatagctgatagcttgcagcagaaagatggggaacctcccatgccggttacaggagccgttcttccttcaggaaacacgttaagagtaaagaaaacatatttgagtaaaacactaactgaagaggaagccaaaatgataggcatgtccttatattactctcaagtacgaaaagctgtagacaacattttaaggcaccttgataaagaagtaggaaggtgtatgatgctgactaatgtacagatgttaaacaaagaaccggaagacatgatcacgggtgagagaaagccaaaaatagatcttttcaggacctgtgttgctgctattcctcgactgcttcctgatgggatgtcaaaacttgaacttattgacttactggctaggctctctattcatatggatgatgaattgcgacatattgcacaaaattctcttcagggtttacttgttgacttctcagattggagggaagatgtactatttggctttaccaacttcctgctccgggaagtaaatgatatgcatcacacactccttgattcgtccctgaagttgctgctgcagctgctcacccagtggaaactagtcatccagacacaaggaaaagtctatgaacaagccaacaaaatcagaaattcagagctcatcgcaaatggctccagtcacagaattcagtcggaacgaggtccccactgcagtgtactccacgctgtagaaggttttgctctggttttactctgcagtttccaggtggccacacgcaaactgtccgttttaatactcaaggaaattcgagcgttgtttattgccctggggcagcctgaggatgacgacaggccgatgattgatgtcatggatcagctaagttcttccattctagaaagttttattcatgtagcagtttcggattcagcaacattaccactcacccacaatgtggatctgcagtggttggtggaatggaacgcagtcctggtcaatagccattatgatgtgaaaagcccttcccatgtctggatatttgcacagtctgtcaaagacccctgggtcctctgcctcttcagcttcctccggcaggagaacttacccaagcactgccccacagccctcagctatgcctggccttatgccttcactcggctccagtcggtgatgcctctggtggacccaaatagcccaattaatgccaagaaaaccagcactgccggcagcggagacaactatgttactttgtggagaaattacctaattctttgttttggagttgcaaaacccagtattatgagcccaggacacttaagagcttccactccagaaataatggcgaccacacctgatggtacagtgagctacgataacaaggccataggcaccccatcggtgggagttctgttaaagcagttggtgcctttgatgagactagagagcattgagatcacagagtccttagttttaggatttggaagaacaaattcccttgttttcagagaattggtagaagaacttcatccattaatgaaagaagctctggaaagaagaccagagaacaagaaacgccgagaacggcgagacttgttaaggctacaactacttcgaatttttgaacttttggctgatgctggtgtaataagtgacagcacaaatggagccctagagcgggatactttagccctgggagctttgttcttagaatatgtggacttgacccgcatgctcctagaagctgaaaatgacaaagaagttgaaattcttaaagatatccgggcacattttagtgcaatggtggccaacttgattcagtgtgttccagttcaccaccgaagatttctcttcccccagcaaagtctgaggcaccaccttttcatcttattcagccagtgggcaggacccttcagcattatgttcactcctctggatcgttacagtgacagaaatcatcagattacaagatatcagtattgtgcattaaaagcaatgtcagcagtactgtgctgtggccctgtctttgacaatgtgggcctttccccagatggctacctatataaatggcttgacaacattctggcttgtcaagatttacgagttcatcaacttggctgcgaagttgttgtcttgctactggaacttaatcctgaccaaataaatctttttaactgggcaattgaccgatgctacacaggttcctaccaacttgcatctggctgcttcaaagccatagcaactgtgtgtggaagcaggaactatcccttcgacatagtgacattgttaaaccttgttctattcaaggcctctgacaccaacagagagatttatgaaatctccatgcagctcatgcagatccttgaagcaaagctttttgtatactcaaagaaagtcgctgagcaaagaccgggaagtattctctatggaacacacggcccgctgccacccctctacagcgtgtcacttgccctcttgtcatgtgagctggccaggatgtaccctgagctcacactccccctcttctcaggtaagccagcgattccccacaacacaccccaacgggcgccagatcatgcttacctacctgctgccctggctgcacaacatcgagctggtggacagcaggctcctcctcccggggtcgagccccagcagcccagaggacgaagtcaaggaccgggaaggtgacgtgactgcttctcacgggctgagaggaaatggctggggctctccagaagccacgtcactggtcctgaacaacctcatgtacatgacggccaagtatggagatgaagttcctgggccagaaatggaaaatgcttggaatgctttagccaacaatgagaaatggagcaacaacctgaggatcaccttgcagttcctgattagcctctgtggggtcagcagcgacacagttctcctaccctatattaaaaaagtggcaatatacttgtgccgtaacaacaccattcaaaccatggaagagcttctctttgagctgcagcagacagagcccgtgaaccccatcgtccagcattgtgacaacccgcccttctaccgcttcacggccagtagcaaggcttccgcagcagcctcaggaaccacctctagcagcaatacagtggttgctggccaggaaaatttcccagatgctgaggagaacaagatattgaaagaatctgatgaaaggtttagtaatgtcatcagagcccacactcgcctcgagtcaagatacagcaatagctctggaggatcctacgatgaagataaaaatgatccaatttctccctacacgggctggttgctgactattacagagaccaagcagccgcagcccttaccgatgccttgtactggaggatgctgggcccccctggttgactatctcccggagaccatcactccccgggggccactccacaggtgcaatattgctgtaatttttatgactgaaatggtggtggatcacagtgtacgagaagactgggcgcttcatctaccattattacttcatgctgtcttcttaggtttagaccactaccggcctgaagtctttgaacacagcaaaaaactgcttcttcacctcttgattgccctctcttgcaacagcaatttccattccattgcttccgtgctcctgcagacccgagagatgggtgaagctaagactctaaccgtgcagccagcctaccaacctgaatatctctatacaggtggctttgacttcctgagagaggaccagtcatccccggtgcctgactcagggcttagttcaagctccacctcctctagcatcagtctgggaggcagcagtggaaacctcccacagatgacccaggaggtagaagatgtggacacagctgctgaaacagatgagaaggcaaacaagctcattgagtttctcacgaccagggcatttggtccactttggtgccatgaagacatcacacctaaaaatcaaaattcaaagagtgctgaacagctcactaattttctacgtcacgttgtatctgtatttaaagattccaaatcaggcttccatctggagcaccagttgagtgaagttgcattgcagacagccctcgcaagctcttcaaggcactatgctggtcggtccttccagatattccgggccctcaagcaacctctgtcagcacatgccttatctgaccttctctcaagattggtggaggtgataggagaacatggagatgagattcagggttatgtaatggaagcgctcctaaccttggaggcggctgtggataacttgtctgactgcttgaagaacagtgacctcctaactgtattgtcccgctcttcctcaccagatttaagctccagcagtaaactaacagcaagcagaaagagcacaggacaactaaacatgaacccgggaaccaccagcggcaacaccgcaactgccgaacggagccggcatcaacgaagcttctctgtgcccaagaagtttggtgtcatcgaccgatcctctgacccacctcgaagtgccacactggacagaattcaggcttgtacccaacaaggcctctcctcaaaaaccagaagctcatcctccttgaaggacagtctcacggacccatcccacataaaccatcccaccaacctgctggccaccatattctgggtcacagtggccttgatggagtctgattttgagtttgaatacttaatggccttaaggctgttgagcagactactggcacatatgccactcgataaggctgagaaccgagaaaagcttgagaaactccaggcacagctgaagtgggccgacttctccgggctgcagcagctgctgctgaaaggattcacatccctcaccaccacagacctgaccctgcagctcttcagtctgctgacaccagtgtccaaaatatccatggtggatgcatcccacgctattgggtttccactgaatgtcttgtgtctcctgcctcagctgattcagcattttgaaaatcccaatcagttctgtaaggatatagccgaaaggattgctcaggtttgtttagaagagaagaaccccaaactttcaaatcttgcacatgtcatgactctttataaaacgcacagctacacgagggactgtgccacgtgggtcaatgtggtctgtcgataccttcatgaagcatatgctgacattaccttgaatatggttacctacctggcagagctgctggagaagggcctccctagtgtgcagcagcccctgctccaggtgatctacagtcttctcagctacatggacctttctgtcgttcctgtcaaacagttcaatgtggaagttctgaagacaattgaaaaatatgtgcaaagtgttcactggagagaagctctgaatatcttgaagctggtagtttctcggtcagccagccttgttttaccttcataccagcacagtgacctctcaaaaatagaaatacatcgagtgtggactagtgcttccaaggaattacctgggaaaaccctggacttccacttcgatatttcggagactccaatcatcgggaggcggtatgatgagctgcagaattcttctgggcgtgatgggaagcccagggccatggccgtcacccggagcacatcttccacttcctcaggctccaactccaacgtccttgttccagtgagctggaaaaggccccagtattctcagaagagaacaaaagagaagttggtacatgtcctttctctgtgtggccaagaagtaggattgagcaaaaatccatcagtgattttttcatcgtgtggggatctggatctgcttgagcaccagacaagcttggtatcttctgaggacggtgcccgagagcaggagaacatggatgacacaaacagcgagcagcagtttagagtcttcagagacttcgacttcctagatgtggagctggaggatggagagggtgagagtatggacaatttcaactggggagtgcgcagacgttctctggacagcctggataagtgtgatatgcagattctggaggagcgccaactgtcaggaagcactcctagcctgaataaaatgcaccatgaggactccgatgaatcatccgaggaggaggacctcacagccagccagatcctggagcactcagacctaatcatgactctctccccctctgaagagacgaatcccatggagctgctcaccacagcctgtgactcgacccctgcagaacctcattcctttaacaccagaatgtccagctttgatgcttccttgcctgatatgaataatctgcagatttctgagggttcaaaggctgaagctgttcgtgaggaggaggacaccaccgtgcatgaggatgatctttctagttccatcaatgaactcccagcagcttttgaatgcagcgacagctttagcctggacatgactgagggggaagaaaaaggcaatcgggcactggaccagtttaccctggcgagctttggagaaggtgacaggggagtctctccccctccctcgcccttcttctcagccatccttgccgcctttcagcccgcagcctgtgacgatgccgaggaggcctggcgcagccacatcaaccagcttatgtgtgactcagatggctcctgtgctgtgtatacatttcatgtgttctcctccttgtttaagaatattcagaaaaggttctgcttcctaacctgtgatgcagccagttaccttggagataacctccggggaatcggatccaaatttgtcagctcttcccagatgctcacctcctgctctgaatgtcctacactttttgtggatgccgagactctcctttcatgtggacttctggacaagctcaagttcagtgtgttagaactgcaagaatatttggatacctacaacaacaggaaagaggccacactctcttggcttgcaaattgtaaggcaacatttgcagggggatcaagagatggagtaattacctgtcaaccaggggactccgaagaaaagcaattggaactgtgtcagagattatataagctacacttccagctgctattgctttttcagtcctactgtaagctcatcggccaggtgcacgaagttagctccatgccagagctgctgaatatgtccagggaactgagtgacctaaagaaacacctgaaggaagccagtgcagtcattgcagctgaccctctctattcagacggcgcgtggtccgagcccaccttcacgtccactgaagcagccatccagtccatgctggagtgcctgaagaacaacgaactcggcaaagctttgcggcagatcagggagtgcagaagtctgtggcccaatgacatctttggaagcagttctgatgatgaggtccagacactactgaatatttatttccgtcaccaaactctgggacagacgggtacttatgccctggtggggtctaaccagagcctgaccgagatctgcaccaagctgatggagctgaacatggagatccgggacatgatccgcagggcccagagttaccgagtcctcactacttttcttccagactccagtgtttctggcactagtctctgacaggagcctcctgtccccactgggttccaaactggcagtgctgccatgctggggcaacgtcattcagtgtcttctcggccttcaaaaggcttggacagactgttctccctcttgttacctgtagggctttttctaaagaggatggcagaacttccaacgtgtagcaatactataagaaccaaggtagcttagaacgtcctggacagactccactcatcatgctgtgtggcacaaatgtgttacatttgaccgagcatatgcaactcgctactgaagaagtgacttccgttgcataccaaagccgactacactgaacagtaccttcctttctagaaacaattttagattggcaaaagtgcaatgttttcttcactcaaaaaattttatattctcaaacatgtatattctttccctgtcttgttccattttcttttcttttttcttttttctttttcctttctttcgtgggctgagaaaggggcaggcaaaatgaagctggccactgaaaactgtaagatggtcaaaagctgacagcctgtgtatgtgaaaagggaattgtaaatggactgcaatgtaatgtacactgtaatttgaatacaattactgtatctaaaaggagctgctatgaagtacctttcttatgttgctaggctactgtttctgaaagccctggatctctttgcaccaaaaatggtccagatagactctttttaaggatcttggctgctttttactagaaggttgcttttatgagcatatttatactgctgaaggatgagtgttaattttaattaactttgccgttttgtagagaaaactattcacaagataaattccaagtcttttcacctgtcaggcatgcatattttaatatctgtttggatagtcagaagtagaatcataaaggtaaaatatgagttgttactttgtttcttcgatgtcatattttatgtgtaatatatatgtaaagggccattcttaagttctctccttaaacttaatgctgtcaagtgttagatgtgtgcatgtgaacttgttgcactgcagaaacatattcagagtttatctatgtaacttattcactctgtaaatacatttaaagtttttgtgatgtaagcttaattgatattctgttcagaactttctttagactaaaaaaaaaaaaaaagacaaa

SEQ ID NO: 252 - protein, 1392 aa, Homo sapiens
MASQQDSGFFEISIKYLLKSWSNTSPVGNGYIKPPVPPASGTHREKGPPTMLPINVDPDSKPGEYVLKSLFVNFTTQAERKIRIIMAEPLEKPLTKSLQRGEDPQFDQVISSMSSLSEYCLPSILRTLFDWYKRQNGIEDESHEYRPRTSNKSKSDEQQRDYLMERRDLAIDFIFSLVLIEVLKQIPLHPVIDSLIHDVINLAFKHFKYKEGYLGPNTGNMHIVADLYAEVIGVLAQAKFPAVKKKFMAELKELRHKEQNPYVVQSIISLIMGMKFFRIKMYPVEDFEASLQFMQECAHYFLEVKDKDIKHALAGLFVEILVPVAAAVKNEVNVPCLRNFVESLYDTTLELSSRKKHSLALYPLVTCLLCVSQKQLFLNRWHIFLNNCLSNLKNKDPKMARVALESLYRLLWVYMIRIKCESNTATQSRLITIITTLFPKGSRGVVPRDMPLNIFVKIIQFIAQERLDFAMKEIIFDFLCVGKPAKAFSLNPERMNIGLRAFLVIADSLQQKDGEPPMPVTGAVLPSGNTLRVKKTYLSKTLTEEEAKMIGMSLYYSQVRKAVDNILRHLDKEVGRCMMLTNVQMLNKEPEDMITGERKPKIDLFRTCVAAIPRLLPDGMSKLELIDLLARLSIHMDDELRHIAQNSLQGLLVDFSDWREDVLFGFTNFLLREVNDMHHTLLDSSLKLLLQLLTQWKLVIQTQGKVYEQANKIRNSELIANGSSHRIQSERGPHCSVLHAVEGFALVLLCSFQVATRKLSVLILKEIRALFIALGQPEDDDRPMIDVMDQLSSSILESFIHVAVSDSATLPLTHNVDLQWLVEWNAVLVNSHYDVKSPSHVWIFAQSVKDPWVLCLFSFLRQENLPKHCPTALSYAWPYAFTRLQSVMPLVDPNSPINAKKTSTAGSGDNYVTLWRNYLILCFGVAKPSIMSPGHLRASTPEIMATTPDGTVSYDNKAIGTPSVGVLLKQLVPLMRLESIEITESLVLGFGRTNSLVFRELVEELHPLMKEALERRPENKKRRERRDLLRLQLLRIFELLADAGVISDSTNGALERDTLALGALFLEYVDLTRMLLEAENDKEVEILKDIRAHFSAMVANLIQCVPVHHRRFLFPQQSLRHHLFILFSQWAGPFSIMFTPLDRYSDRNHQITRYQYCALKAMSAVLCCGPVFDNVGLSPDGYLYKWLDNILACQDLRVHQLGCEVVVLLLELNPDQINLFNWAIDRCYTGSYQLASGCFKAIATVCGSRNYPFDIVTLLNLVLFKASDTNREIYEISMQLMQILEAKLFVYSKKVAEQRPGSILYGTHGPLPPLYSVSLALLSCELARMYPELTLPLFSGKPAIPHNTPQRAPDHAYLPAALAAQHRAGGQQAPPPGVEPQQPRGRSQGPGR

SEQ ID NO: 253 - DNA, 25320 bp, Mus musculus
ttatgtatatgaatacaccatagctgccttcagacacactgaagacgggcatcagatctcatcacggatggttgtgagccaccatgtggttgctgggatttgaactcaggactcagtcactgctcttaaccgccgagccatctccccagcccgataaatactgtttttattttctgtcctgcctctaaaagaagtcctgcatcttgtaggtattcagtagagttgttaacaaaaggcaactctggagacctcctcagagactgaggctcacatgctagtgtggctttagaggaaagaagaaaagcaagaagaggctgctggagtgagcagctgtgagaggaagagcattcggtgtagagaatacacggggaggagggaggaaggaggcggggagagggaggagggcaggctggaccacgcatcccaggtacccttcaatgctgagaactctactttttttcaatgtatgaaaacatttgataaacagcccttttgatctttaaattaaaaatagatttacaaattaagatcaaatgtgtggttgctgctataaagtgagggtcaagagtgaccattggcctggatcgctgccctctggaccaactaaaagcctgggctttggttcctgattccttcccccagttctgagagcaagcgggtttgatagatgaactgagaacaggcacagggaacaacagattccattgctagacatgacaggctgcccacaaatcagatagccagaagaccttatctagaggtaggtgtggccatactgtatgtgtggggatctgctgttggatcccagaaagcatgtcatgctttggaagtgagagagagtgaaccataggccagcccaggaactgttaccagcctctgtggtcctttgactcagtagaggtttcttgggaagtggaaggctgcttatctaatgaggtactgaggaaagagctgagagatacagtggagaccaaggcccatctcccaaggtcaggattcagccctaatgtgggggttggcaacatcggccctcaggaagctgcccagggttcctctccactctcaagctgctgggtgctggatagaaccctcctcactccctggccggtttgcaggctggccttgagaagagtatcacacagttcaggaccctatgaaaagaacttgccaagttatggctaacgaacatggcatttgaaggccatccatcagggctggagagatggttcagtggttaagagcttgggctgtgttccccaaggatccgggttcaattcccagcacctacatggcagctcacaaccatttagagtaacttgagttccagggttctgacacccttacacagatatacatgcaggcaaaacaccagtgaacataaaatgaaaataaaaataaattgtatattaagaaaaaaaaaaaagccactcctcattctcgatgtatctgttccatcctgtgtgcctggcatttgttctagatgctgaggtaagagtgccagacactacacagaaaccctgccttcagagagtgtgtctgtcctggaggaggaagacgatttcagagcacagagtgcatctactttaccatggtaaacaccccacacaaacaaaataaaaatcccaaagcccttcagagctagtgcacttgaagcgtgccctgcaggttaacccataatgtgctcagaagatcagccattggagtgtcttcatgacaggcatcattgcgagcactccaagtgtctacagtgagagctagaaactgatagactatgttttatctttaacattatgatctaggggtttagtgtggggctctgggatcagagcctgggtttgtttgtttgatgtacgtgagtacccagttgctgtcttcagacacacaccagaagaagtcatcagatcccactacagatggttgtgagccaccatgtggttgctgagaattgaactcaggacctctggaagagcagtcggtgctcttaaccgctgagctatctctccagcccctctacttgagcattatgcaggaaataagaagccatagaatagcagttggcacacagcatctaatgttagttttttggtttgtttgtttgttttaaattgtggataatggagtactcatatgtgggagttaaagggaatgaacctaacctgtgtatcaacatgaagagatctaaaatatgcaatactccatcttgtattccagggaagcactagtgaaaaaaaaatgatcctgcccaggtggatctaatattgctagcggtggggaaataagtgtgcaatctaagggaattagtcctgtaattccaggaggaggctttggagagcaggagtgaagcccaggaggagcccaggagcaaagggttaaagtgggcagctggctgaactgagtcccagaaccaacaggaggtggtgctgatgaacagccctgggtggacggtccacagagtcacagccctgcccttgccaccttgccacctcgggttgaactctttgtttatgttgcaagattctctgctctacagaggcgagtaggggctctgcttttctgttgagtgaaaaggagaaggttacaaaggaaaaggaccttgtgtgtaggggggcggctgaagggggtgagcgtgcatgtgtgtgtgtgtgtatgtgtgtgtgtgtgtgtgtgtgtgtgtgttaaagactctgaggtaaactttggggctgtaaaattctttggaggcacaggttagcagagtcacaatgcagaaaaccacacagtaacacagaacaagtgtgacattgacaagccgtgcagtgcctgtggcatgtgacatctttgagctgaagatgcagcagtgatggcagggatgggtcccatgatgactgtgacagtgctgtcatttctgggagtgtgtggcaatgtgtgctttaaagctgcagtttcaggggtcgctgcctcttcctgtggtgcagaaccaagacgtgaagcctagagttgctgggcagctgggacactctttaggaatggtggctgcacagggctgctgaggacaagggagaaatgtgacccaagttcagtgatgcaactcagtgtaagaatgtcatcattggtgctggagatggttcagaggttaagagcactgactgctcttgcagaggacctgggttcatttgcagcaaccacatggtggctcacagccatctctaattccggtgccagagtctgatgctctattctggtctccacaggcatcaggcagaaacaaggtgccagacacacacccaggcactcatatacacacgtcactttttctttttaactaaggaagtgtcataatagaaggcagactgtaactgcaggtgaaggcacacaacgtgcagactgtaactgcaggtgaagacacacatgtgcagactgtaactgcaggtgaagacacacacgtgcagactgtaactgcaggtgaagacacacacgtgcagactgtaactgcaggtgaagacacacacctgcagactgtggctacatgtcaccgatatatgtgagacactaagatgcactctctcagagctagaagagtgcctagactgtgacaccacacagcctggcactctgtagacctgaaggaacactctggcggtgacacttggaaactctgaacgctggccagctatttaatctctccaagcagcagtttcagtatctgcaaactggaggaactattatttacttcataaaagtgttacaaaggttagggagagctcagaaacaccaaggtctttgtttcctgctgaccactctgggaaagtcactgaaaccataatggagcaaggaggagatgtttttcattgacattgttcagagacacttctgcaacaacaacaattaaaaagtaaaagtattaattttataaagggaatatccacaccactaaatgtaatgaaaacactagtaaagaaggcaagaagattgatccaaacataggaacaaaatgatgaagtcccatgacagctctaactatgtgcagtcatttggtacagtggagaaagtatttcaaaatgatgggaaagggtaagatacttacgcaacagtttgggaacaagcagggtcctagtaaaaaataagttagatccttaaccagtactgtgtataagtaaaatttcagatggacagaggaggaacatgttctagaatatagacacgatgacataaccttggggtgcgaaagacctttctgatgtccatcaaaggcatggtttgaagataaaagaagctctatgaggcagggctacatttgtacagacttaacctttattatctacagattccggtaaataatgtcaaaagccattgttctaacatataggaaagtagcatttgataagctaaatttccagctgaggactaacacactgggtagtcaagaggcaattcttaggtaaactgtgacgcatctctgtgcacaagtgtaagctgccgggcattgaaatgtcacacacatacacacacaaataatcccatagggtgagaaacaatttattatgaaaaaaaaaaaaactgccagcaaaaacttggtatggtttatatcacattcctggttttacacaagaggtgaaaattttaaagatgtagtctgaatgtgctggcacctgcctttaatgctggcacctgggagacagaggcaggctgatctctctgagttcctggccagtgaagacgacctagtaagactgtcttagaaatgaaatgagcaagcaagtgaggaaacaagcaaaaaactttgtgctaggtgatggcactagccaccaagccttatggccctagtttgatcctggaaccaaaatggtgacgggagagaaacgacccctgacacttgtcctctgacctcacacatgtgcataaacacacaaaattaatagaggatttaaagattttcttctatataagaccaaatgttagaaattatttttagttggaggaatacaggagcctacccttattcctcaccccccaacctccaatctccccgacccctcctttaatgtttcaatgtgtatctttgctaattaggaaaaaatgatacttttcacaagctggagcctcattttcataagaggagccagtttggggtgtatcaccaactaaatttgggacagctggaacatcgtaaagaacaatgagaggacgggatacagtgcttcatgcctggaatcccagtgattgggagacagaggcaggaggattagccatgactatgaggccatcctggtctgcatagtgaatttttaagcctgttagagctactgtagcaagcaagcaagctgaagtatagggtggtctgggtatggtagtgcatgcctgcaaccccagcacttgagaagctgaggcaaaagtagtttgagctacatagcaatgaacaaataaacaaataagatgaagacgatgaaaagagaagtgaggaggctcttattaagacatgacaagagtttcaaatgagaaacataagacttgcgggaccttgaggtcatatgcacagggaagactgctggaagccagggcagtcacatggtcccgggttcacacattagcatcatcactaagccagtcaatgagcttatctcacagtggaagactccatgaccccgacttttagccaagtgtctgcatgggcacagtgggtgggtgtcacatgagatcaggaacaacatctctcctccataacaccctcccaacaaggtttagtctggacccaatcctgagcaaacaaccggagactcatctggactcttccggggagcagggggagagagagagagagacagagacagacagacatggggacagttttagatgaaagacaccaaacgcatgtaattaccaaagatagcacttggaatgaatgaagatcgtttggggaactgtaagagaaatttttaaatatttaaatataaaatcaattaaagtaatttcaaatttgagactgtgagaaaattttgaaatctttatgacatgaactcaaacatcgtgttcacctagaagaatgttggcaggaacccaggagtaaagagccttgaatagaagagacagaataattgagaccaaatatgacaatctagtgactgcagacagagggaaagcagtgtacattgttctgcatcttccccatttgtatataaatttcaacattttctaaatagaagttgtgggcagaaaaaaaaaaaggtaaaggtgcaacctaaagaagggaaaagcagaggaaatgaagtgtaacatacggtggccagagaggatgtgtggatctttttaactcctgacccaaacaattcagttctagggagagcttactgagatgatgtttgctgtgcaggactatggtgggtaatcgcccaagctgggtcctgaatagggatctaccaacacatgtctgaaaatgtaaagtcaggggtacaagggagacttcctagccagcaggtcctcagctgacagatacccaccatgccatagttctgatcgtattgagagtaagttatgaaatacgaattagcactggagtccctctcgtaattttagtgaattgggagaagggcagcggaggaggggaagctacgtggaagtcattgtctattttctttccattcttctgttttttcatttgctcaattgccctaacccatgaggttcctgaccaccatagagaaggttagcgctgaggcacatgcctcatccctgatgctggtgcaatggtatttattgctcacacttaagttttacagttgaaatactgtcacttaatcacctctgcttcgctagtgtttctactgtcttgaattttcaagatgttgctatggcctttggtgctaatttgacatccaggtacaagtaagaaaaaaaaaattaaagcgacagaccaaaggaaaaagcagactgtcaccacactggtgatgtgcactctgctagtttgcagggaggactgtggagcccatggtcacatgtgtctcaggaatggagagcccataaggcccggtggtgggcctgagcggttttactctgagtaaaacatcgaagtcagaaaggccagcaatgttctgttttgtgtgttgtctagaagggactaagaagcgaataaagtgtgcagcaaacagcatgtcttgaagtccacctggagaaaaccttaaaaacataaatttctgtccatagcgtaagccaccaagagccaaaaatgagtccgtaaggattacacatggaaagagaaacatctctgaaaaggctcaacaaaccagacccagtctagaagggacagtagatggggagtacagaagaaaataagccttggtttcaacagtcagtcacttagcacacaggagagaggcaggggaaatgacttccatttgaatgatagattttattagaacaagtcatatttatgaaataacccgacacttgagagtgttgaccaattatcactcagcaaaatttaaaatacccatctttgaaatggcttctcgaactatgccctcagtcttcggggcttctgtcactgtttgtgttggagatcggggcttggttgtggggtttgaccttttcagctgtgtggtcaagctcagtgaaccttctctgtggagaccaaacctttgtcctcctctaccctctggtgacttctcccatctcccaccactctctatacccatgggtgactgagcattgccatatttcctgtgttcccaattccttcaagaacttgaaactgatttctatcatgccagttcacgagaggagactaatttactttgcctgacgcagtatggtgtccactcctgccctcctgcccaggggcctggagactcagagccagtcaaagccagcccaccagaagctcacaggaggcttatctagactctgcaccctgtgtgtgtgaaggacacccagcaagatcagaactcttgggctgactcagttgacactgtgactcccaagccagtttcctcccccttccataaacagactttctgtatgtgagaactgccatgaactgttcttagtgtctttaccataaacctgtccacttagatgatctgcggcatggtttccatggtttgtggtcacactttggattggttccagcttgccaaattcctcttaaaactttgcgtgcagcatttctgatgacttactgcaacaaaacggtctgtgcttttatttattcactcagggtgtgtcgctcctgccttctcttatcccctttcacaagaggtaaaagttcttcaaccctcaaggtccaagtcaaatgttatctcttttgcaatgtctcgcttatcaaactgttaatgtttctggcccaaattgtttgtgttttgtcagtacagcttgtcctacgtgggtcacacaaactgcaggaggaccggtcccttagccagggaatccagttttgaaaaactttaggttttgtgccttaacactttgtgtaacacttggtgtctggaaatcagggtttaataagttggctaattgctcctagtcctttgatatggaaatttttatctccgagctgaagagatggatcatctggcaacctcttggttgccagcacccacaaggtggtgtgcaactgcctataattccagctccaggagatctgatggccctcttctggactccatgggtccatgtgcagatagtgcacaaatagataaacaataaaatgaaatatatgcctacttgttctcacaagtctaccaaggacagtcaggttgctgttaaaaatcaaggtggccccgtgtgccaccacagactgtaacaaaatgcatttactttgtcgtttttttccccaactctgctgtcaggccctctgaagaatgcaggtagagatgcttgttttctgtctctggattgtgtatgtactgacatgtcagagcggaagctcttaccctttgccctctcacatccactgcaactcctagaaagcccccacgctcatgtgtactaagcctgggtcctgctggcaggctgggctgggtaagttactactgaccctcaggtttgctgagcacctcaccgtttacaaagtgctgtccctccagtccttcgcattgtcctccgtgtcttagagttgagaagacaagctcagacagatgggttcatggtggctgcagtggaggcttgagggtgtagcccagctcttcagctccatattcttgctgagttaaaataacccacctctagcgctgctgagagcagaagctaacagggcattcgcggtgtctccacctgctctgctctttgtcttcctgcccgtttcactttccacacagctgtaggggtggattccactcagcggcagaatctgttgggatgcagggcatgcatcgccagatattaagtttctctggtttgggttttttgggttttgtttttgtttattacaaggaggctgtttggtaccgactcagtcactatctgatttgatagtgcctgctcagatatgatgtaaccccaaactgaagcatctcttttgagattctttcctgcagatcttaactcccctctctatttggcatagaggcgctctctgtgatgtgacttgttttctgtgacattttcatatttcggtcggccaagagtggtagggttaaagcacaggggcaccgttgggttcacctctctccttctcttgtgcttttttcctgctggtttaggtattgttagaactcagagggtagctcacacacatctcctttatccacatttcatacctcagcaagaactagttgctcagatgggtccttacagagatcagagctccgaggaatgggacccaggacaggtaagagtttaggggccaagggaagggctgcagtgtgggggcatggtgcccaacgggaggtgtgggagggcactgctgtctcagagaggagtggccctggtaactgatgtccgccaggaaacagtcaccatgccttcgacttagcctcggagttttagtcgattctggttgctgcaggaggcagtggccgtgaccagtgacctctcacttttaagagttggcaactcgcacagcggcctctcggcctcctgttgaggagtgatgacttccggagataattggttctccttttaagtgaagttgaaaattcaaaatgtggagatcttagaattattttctgctgctaaagatggaaagaactgttggtgacgggaggatcccttttctgtttctccactttgcagacagctgcagcacgactaccccagagccctgattttcagcaccgatgactttttcttcaaggaagatggcacctatgagttcaaccccaacctcttggaggaagctcatgagtggaaccagagaagaggtgacaaattcctctccaaacacggggagggggcagagtcttatgcatgtaaattgtagcagcttcaaaatgaatacatttcctggaaggagctttaaccaaaagccttgatgcttttctaccctgcagaatggcaggacttaacccctgtagatgccagcaaacggaaccccctgataatggctcagcactaggtagcatttaactgtgtgaggagggcctcctgtaatgacagtaacaataatgtggatgatgcttgactgctgcatgttgttcaccattgtgttgcattgtgttacagcaaggaaagcaatgaggaatggcatatcccccattattattgataacaccaacctgcacgcctgggaaatgaagccctatgcagtcatggtagggagaagtatcattctgaattctcagttatggacattttatgagaaagttgaaatgtgggttctttcctctttttctagtcttccatgatttcacattcactaatggtagttctcccaaggagccaataaagttggaagtggtgtcttgggcttgaggggccacttcatctctgagggccttccatcaatagcagtacttgtctgagtccttggtagatattttccttccttccttccttccttccttccttccttccttccttcctttccttccttcctttccttccttccttctttcctccttcccttcctctctcttccttccctccttccttttctttccttccctttctccctccctcttttctttccctttttctttttctttcctttcctccctctcttcccttttttctttctttccttccttccttccttttctctttttgagacaggatctcactatgtaggtatggctgttctagaactcactatgtggaccaggctggcctcgaactcagagatttgcctgcctctgcttgcctccttgctagctcttcagtcatggctattttctgtttagaggaacatccactgacacgtgcatggaggtacagactagagaacgcactggcagggctatgggtcccagtgagtcaggtctacctgctgtaggctgggaatttcagcactcttttgctgagagttccagggcaacagaatttcttagtttatggacagatttaggattaacagtgtgacactattaaggcagcaaaatacaaatatcaacacatcactccactaaattctgatcttttcagactgtttgtatctgatgctaacaagttttcattccacaaacaacacagtaggaggcagacagcttcttgagttacacatgggccctagtgtgttgtgaggtctcttacacagagctcctggcagtttaaagatatttgccccccacgtttaggtaaacagacaggtgtgcttctgtctaccgatgccttcatgtcagttctgctcagccccagggggtacagcttggatgagtacacattcaagccacatgagacaggcgagtggagccacaaagagctgctgacataggcatagcccaaaccagcatttaggaatatcaggcagtggcctccaggaagccctttcatttctcagttttgggtactagccagccacggctgttacagtcacgagctgtgagtacaatgtgacagttgaattctttcctgagtagaaccacctatccaaagggtgaagaggaaacttaagtatttaagtgtgtttattagctgataaataataatgaccttacacattggtggagtgcaggggctgctctggtggatgtgttcctgcccgagtcaggggacttagattatctgcacctcaagaatcattgttgggcacaacgagaatgttctctcttggctgttttgatttgtgtaatactaactctaacctcctctgtgattacagagcaccacagcttatgcatgttgctcaaggaggaagccccccagcttagctcatttaattccgtttctaacatgtcaagtactagtgatagcagagggctgtttgaacaaagtggtcagcttatggatagatgcaaagaacattcagatgtttacaccagagccttactcattttctaaactcatggaaatggggcccagggcatggggccaagcactgcagagcaggaggggctgggcttgctggaaacagtaaataaaatatgtggagatcactcttatttcataagtggcgctctaagttacaaaccgaagtgggaggagatagatatgatccaagataatcataagcggctttaggaattccccaggcttgctgttcacacctgtgtttgggacgttttatcaagagctcagtgatccgtcttaaggatgttcagactcctactagacaaaactggccatctttgacactgtgacttatataacacaatgggagagtctaggtatggggatgaaatgcaggagatagattcagggcctggatgacttgtaaaacgggggtgtttggacaaggctgtggtgaatgctaagtgcaatgtgaatatccccaagtctacatgccatgtcttcactgtcttatgtgcttctgaaaaatcaggctcttgagaataactatgaagttatattccgggaacccgacactcgctggaaattcaacgttcaagagttagcaaggtacctctttgtttttgctagttcttcattacatattctgctcttttcaggaatttcagactgaacaaaagcatctttgcaggctggaaacggactagttttcaggccagaaatggtaattcttagaaactgataactttggaactattaatgtgaggcccttagttttgagcgagccagatgtctaacatgatgctaaatgctaacccgtggcttagacctggtcctttagaaggacacacttaactttgtgctcagttgcttcctcattgatgagcatttaaggtaattgctccgcatgggacaagatctttggttgttaagcagaacatgacacattcctgctgctttacagcaacatgtgtccaaatagtaacttggtttttaatgcttctgataaccacactccatgttacctgatgccaaatggcccaatagaagcagaatatttctaaagcaagtctatggtcatccccatgattacctggttgctaaatctgacatggctcagaactctagtctgtaattgaaaaccttgtcaaatgaacttctaaccacatccccaacaggtatttgtgccctccagaacttaacattgttttaataagcatcactttatggtatcggaccaattgatccaaaatgataacagatgtatcatgtcatgaacgagcagatcactaaatgcaggagttatactctggtggtggttgttcgaagtcaacatcacttggcctttctttagaaaggtctcaagccttcttttagaaaggcctttgtaaagctagccctaggttttttgggggtgtgcagggcagcatgagaaaccgcagcagagctgtcgaagtaccttgacaatacaacatatgcttctgcctggtctcctgaggcagagcagtagccacgcaatgcaggatttgtatgtaatgtaagttacttattgtgatagcctgccttaactaaaaacttgtggggttttgttttttgttttccttttttctacgtagaagaaacatccatggggtcccaaaagaaaaaatacaacgaatgaaagaacggtatgaacacaatgttacctttcacagtgtccttcatgcagaaaagccgagcagagcgaacagaaaccagggcaggaacagcgaaccgtccagtggctccggctactggaacacctacacagagctccccaaccggagagctaatggcctctactccaacgagggctacagaaggggtggccaccaccaaggatattaatggcccgggcacagctactgcagaattttcctagagaaagtttctacttcaatttttggtatttattctttgttcagggttagccagagctctaagtccagtgtaaatagttgagcccagaagtttctgaacagaggtcattctatttattatctccaacaagtgacgtcagcgtgcgtccgtactcatggtctgatgctggggacctgctgaggagtcaagggtctttctccagggaaagaattggattgaaattgaaatccaagattatcaattagttgctacagtcatgaataaaacaagatggtactagtacatttctataggctgcagtactactgtctctgacagatccagcctctccacagagctggagaggtgagggaggcagaggcaggaagcagcttggtgccattgccgctttgatgatctatctgcctccagagacctgagccgtcactttaatggcactgattttcttttagacctaaagtgcagaagggaatgtagtccttcagggtaacattaggagagttacccccctctgttaaaaatgcctgtgaattcttagtaacaaaggcaactaagaagaatcagtaccattatagtcaaaccctgtagacagcagtgtcaggacaaactcctccctctagcttgtagtctaacggtgtaaataattctgctttcgcaaaataccagtttttaagaatcatcaagtgatttctaaaatgatgccttgtaacgtgttattaattagtaacccagttatttaggagtgcaaagcaaggaagcagccagggtgatacaaggagatatgaaagccatgcccacctggatgagcagtctggctgttgtatgtggtgttgagacagtaaactgtggaatgcccctcatatcaattatggatgtgagtccaaattaaatcccagcaggctggagtcagattcattggtatgagaacgtgacaagaccatgtgaaatgtatgctctatttatttttggccaacagcttctttctaatgttttgtgagatattattttaagtgtcttatataatggtgcttttatggttattaaaattgtatatggtattgaatttatattgggttttccattgaatttattttttgtctaacaacaaaacatttaccaaaatccaaggacttcacccaaaaaatagcctttgcatatataataggcttattcttgaatcattgttaataactgggaggaatgaaggccatacattagaaagcctacctgccacgccattatcaactgttggaatctactcaacatcttcctgacaataagcgacacacttccctaacattttccaaattggtgtcttagtaataagtaatgttatataaaaataactaacaccaataataactataacaaaaaagcccagatgatgagtctcatagtaaattgggatgactctgccattttaaatttgcacatggcagtcctgtagcaattcatttaattttcttacctgccaggcccaggtaattgttggaatcatagcctgtatgctgcctgtgtgcatgactttggtatggatggcttcatgcatctaagttggcaaaggggagaagggtcagaggccaaatggaattcccttcctctagttccatacgtgcagccaaaggacaggatctgcgttctctgatgtggttggttggctctcagagctttggtttgcctgggctgagaccaaagaccacaataaatggctttggctttgggcccagagccttctcagagctctcaaagtcctgcccaaccatgtctctgctttcttctacatggaaataccaaaatacttggtttggaagcataaaattgattaaatgccaccaagcttatcccaaaaaccaactgattaaatgctaccaagtacgtatttaaaagcaatacatactttcccttccgactcctctggcttctgtcttacggaccctttgaacagctatcactgactcactcccgttactatagctccacttgcattattcatagaattagccgagcgctctgcaaccaaaggctctcagtaagaataaataacgccaaatgcttttgccattcatccccggtcatacagtacacactgtgggctttaaccattgtcactttcagaaggaaaatatgcacaagtagcaaagtttcatactttgttcactcagcgtggatgtttgtggcttctgtactagctgtttgtaactggtggcctgagagaattgagaacagaacagcacttttgacaggattcacaagaaaaaaggttaaatatcagctgggtggaagtggctcatgcctttgatcccagcacttgggaggcagaggcaggtggatctctgagttcgaggccagcctggtctccaacaagttccagcacagccagggctacacaaagaaaccctgtctcaaaaaacaaaaaaagttaaattttgtaaatagcataattcctgttatgtaagatttatttactctgctctaggttgggtctctagtacaatgattaggacatgaaaaccaaattacttagtgaacaaagtttaaatcactaagagcagagcagagcactttacagctgaagttcagtgagagcatccacctgccgatggggctgtggtcagggaaggactttgtaacccaccgcctagaaccttctgtgtaatgaagggtggcccaaactcccctctctatctcctacatgctgggatgacaggtgtgtgtcattatgcctgactggatttctagctagaataacttgagagattacactgggacagtggaaaggagtgacaaggctacacagaggtaaacatcacggttgtgtctgtttaccctgacaggatggagctctagcagaaccaatcatgcaggaaagaacactatttcataggacttcctaggtaaaaaaagaaaaaacttcaaaaacaggaaccagactatataaagtaaccatacttagccagtaatctaaactaaaagcaaagctatgtttattttgtatataaaatgatagttgtagtgatccagtctactcctaaagctttttaaatcagtcgatgacaaccagctttagttacaccaacacagaccaggtagagcatctgagcagtaaacacacgcttcagtagagtgcagctactcccgccttctcacacgaacacctatgagtagcctggaactgtacacatcttacaaaccgggaggctaagactcaacagctaatttctcactgctgtcgcctctacagtccctgagagactccttcctggacctgggccctacttgctggtctggcctctgtgctggctgggggttccttgtggaatcaccgggaaacgcttgttcatttcctcccacggagtcaggcgtaagggcctgggtgctgagcaaggcaagttcttcatcagctactgaatcacagtccggcagagaaacgccactggtcttctgaaatggcgttctcctccgcggggaactgggttcttttttaataggtgttgcgtatttcgtgccacagctccgtggcggctgaaaagccttctgtgcagctggagagacaaaggtacagatgggactgaccggggacggtaagggcagccgacttaggaaatccaaggctcttctttttcgacaggtttttgggtcatcaatctcgttctctccactccaagactttgctgccatctgggctgagtgagccaggggcatagacttccctttcagtgtgcagtgtgataaaggactttgataactttgctgaccagtaggtgaaatcctctaacaaaacacacaaaagaggagcctatcataataaacacttgtatataaataaattagaattaacctttcattagaaaatacctatatacaccaacaggacacctttcctttccaattgctaaagggtaaataatgccaaacattcatgctcttattcctcacccacaggaaataattttgcaaagtgacagatgtataaaaatggccagaaatgagtcgggcgtggtgccgcatgcctttaatcccagcactcgggaggcagaggcaggcagatttttgagttcaaggccagcctggtctacaaagtgagttccaggacagccagggctatacctgtctcgaaaacccaaaaaaaaaaaaaaaaaaaaaaaaaaaaaaaaggctagaaaaggaaaatgaagagatcctatataagattaaaaatagagaaaaaaagaaacaaacacatgacatcatttatgctttaacttttcagtgttataaccccccaaaacaacaggcttgtcaaaatcattttaaaaaggatacacactgctcaacaactcctcctcctccttctgaacatttacttactttgtgtacatgttgttcatgtgcatgtgtgtatgtgtgtatgcaagtactcacatgctacaacatacctaaggaagtcagaggactacctgtgggagtctgatctacttcctccagagagagaccacggctggcctccgtggagctctaacacctttcttttctcagtcctgagtctcaggcaactgtttagtgtttttctttgctaggctcctaactgtaacaagcacttttcttgtatggggtgaggactgcttgattgaattaaggtactaagcagtgccaccagtctggccagccctggcagctaggcacccctatgattaaggagtcacctgagcttagagactaagcaacagctgtgggccagctttcccagctcaggagccagcaaaggatcttgcaagcacatgttctcaaagtgccaacagtgtagtctgctcccagagttttacattcatacttcaacaaataagatacgatttccacatagcctatgcctcagctacagcaaactaaccacaggttaaatgcagtttagttccatcatgtttgctaggacatacgaaacaccttacttccatactaacttaccaggaactgacctcctgaaccaaggagatctgaagcacagcaagtggaggctgcatggggctctcgggtggggtctttgttcggtgtggaccacttgggactgtctccctcaagcacgtgtataagcttcttttctgcctccttgtaaaatgtatcgatattctaagagaataaattggaaaagcctgtgctgagttgctaattcacacatttatgttctcagaaagtgttttctttcagaaataaaacattcagaacagaagaatgaaacccacttttgtttgtttgttctttagctagggtcttgagatacacacacaacatatacacccatgtgtgtgtatgtgtgtgtttatatggcctatggtctggtgttcactgtatagccaaagctgacactgaaattctggacccgcaggcatgtgccaccatgccttgtaagacacttaaaatttgatgtaaatctaattctcagtactggggtgaagggggagagtactggggtgagggggagggtgtgaatgagcacacatgggtgtgtgtgtgtgtgaatgagcacatgtgcgcatgtgtggaatcactgggctgaaagcactctccaggcacctgttggtccagcttccaagtccctaatctcacctcaatagcatgcttcaagttgttgactttctcctgaaagtaggcctcctttggactggcagaaaatatggaaaaatggccagcaaataaggtcggcactcctgatgtggattctggctggcactggaggttgcttgcggcaattagcacacgtggctttatgtcttcattaaggtctatcccgaatttcaccactaataaattaaggcactcgtctgacaggtagaccaaaggagcaagacctaggatgaaaatgccagtcattgttatctttagaactgcgaggataacgatatacacagaattcctagaatgaaccattacttaaggtgtttgaacttcagtgccaaacatttcgaggccacagggcagcatatacactgataattgtccaggagagtggacatttgatgcatccttctgaagaaaacactggcattgcctagcaaagctatggccatcctaccttccactcggggttcttacttctagcactctgctctgaagactgatgaccattaaataatagtaaaatacatgtgagcaagggccatggtagtggctgcaccctaggtcactctccatagtctgaaactatggaatgctggaagcaactcatctgctctcactcacaggggagtaactgtgttccacccacacaatggtttcctgggcaactgtgaaaagaaggaagaaaaccccaaggcagtgctaactaggaaaagctctccagaaagacatagcaggaaggagacagggagaacgcatacacgtttctacagttctgagccaagagtgaggaaggctgaacaggaaactggacaggtgaggacttgagggccaggggaggaccagactcgggagagttagttcctcagggaggaaagatacttctccaagcacagcttttgtatggctctgactctgacaatcagtaacagaccttagctctacttgtttatttttggttttttgagacaaggtttctctgtgtactcctggctgtcttggaacttgttctatagaccaggctggccttgaactcatggggattggcctgtgtctgcctcctaagtgctgggattaaaggcatgtacccccttcccccatgtgtagacctcagtttccccattcacttcccactaaaggggaagcagtgttgatacagggctgcagcacagatcatagatgaaccggcagtgccttgtgcttccaaaatgtaaaaaactgttgagaaaatgaaggagggttactgagagctatgggtggcctggacctgggcagccctgggacgtacctaggctaggctctcccactctcttaggtaatgattccctgaccttccacatactgacctcagtggatgaatggatgactttgtttcctgttcagcaaggaaacaaaagccattaaaagaggtctgtgcaagtgtctacctctccatcaatttctgcattagtaccctatctaagtactcttgcctctctgctgatggatacagcttgtctcatctgtgtctggatacagaatgttctgtgctgactgcccagtgtcagccttgcctctcttccttagcttcttcagcacactctaccctcagtgtgccagcaacactttacctaaaaactattctcttgatcatgattctattttcctttcattccctttaaacaagtgacgaagcagagatatgatacaccaaactctcataagaacagacaggaaagagaggctacttaggagcagcccaggggcagaagagagaaagaggtgaggacagttttacagagagcagctagacataggggtggtgtgtgtgtgtgtgtgtgtgtgtgtgtgtgtgtgtgcatggcagtcttaccaggacagtattacagatacaggttacagagagaacaagctagacacaggtgaagacagaactagccagagaatgacgaggagccaaaagattagaacagattgccagagttagctggaagccaagcagagccattcagtcagaagcagagagaagcttctgtcagtttgaatcagtcagctcagggaaaagtttggcccagaacaccttagttgaactagttagccattgtctcctctctctctctgtctctctgtctctctctctcacacacacacacacagagcaatgtctcttctttcagcgtactgtgctcctcagcactccacctctctgcactcctctgcactccctgcctcctttatatgtgccccaatcctgatacccaagtgtcaaaacagagccctctgtctcctcttctccactcagagggaatacattcagtctctctcctttgcatctctcgggtataccaatgctcttaaagtctgcatctgcagctctgactaccgctcaagtactctgtctgatctaaagttcatgtgtctgtgagcacagtcctgaagccacatctcagaagcttcccatgcagctgagacaccagccgcaaaccatgcccctgggttgttatcaaatcctcttttgcaagtggcaatcccagtcttccgcagcttcggacacccatactgttcccctaccttcagagggtaaccagaacctgtctgctgttctgaatcgtgttcacagcttctatctactttgtcatcctctcctgcctagactcttaccatggcatcctcctggagtccctgtttgtgcccacaccctttgtactgtatgttcaatgtaatagctcaagtgatatgtgaaaaggtcaaagcctgtccctcctctaccttcctgtgacttcccatcaccattgaagtaaaagttaaaatatatacaagggagccagcaagatggctcagtgggtaaaggtaactgttgtgtaaccctgatagtccaagttcaatcctgagaccctacatcaaggtatacagaaagaaccatctccataaagctgccttgccctctgacctctgcacacatgccacacataataatcaatataaaatgtaaaagtatatccaagcacccatacacctggttcttttgtgcctctctcacactccaccaaagcatacagccaccgggactctcctcaggctctgcaggcttctctttcagtttttttctggcaccatcaatgaggtcttttctgaatgctgtctaaaatggcagctgagcatcagctctgtccccaccctgtcctttcttcttccctttggccctccattgttttgtttgttacctcctcctccccctccatcttccaccacagtgctcccaggaaggaattcttctctgctgtgcacctggcattgaacaattactcaataaatactaatggaatccacaaatgagctacctaccttctataacaggcagtgtgcggattcagtgtgactcagatagcagggaatgacatggctatgtggctgatgaacttaacagctagagacaaaccccacatcagtcagctactactcaccaaacacaagagggaaggaaggaaggcgagcagggaaggagagtgggaggggaagggagggtttgcaggcacagtggaggacagaacgaaacctgtaaggaaaacaccacagaacaaggaaattcttttttctttttcttttcttttgttttttgttttttgggtttttttttgtttctcaagacaggagacagggtttcactgtatagccctggctgtcctggaactcactttgtagaccaggctggcctcgaactcagaaatccacctgcctctgcctcctgagtgctgggattaaaggcgtgcaccaccaccgcccagcgaacaaggaaattcttaagatttttcaaactgactctgctacgaaactttagaccctcaggatcagggtcaacaaacagatctgtaagttggaaaggagcctgcaggaccacagaaactgacagcatgtgttattttaccacaacaggacagactcgtgcatgaaatggcaaagtgagatgtgcacagtgtgtgcagaaagcaaaattaaagacaaagttgcctgtgaccataatggataaagataggaaatacaacaaaaaaagcaaatagaagcagaaataaatgtactgtcatacaagtgacattcctgaggcaaggtgcctgacagggaatgaggacaaaaagcagagtgtgaagcttgaagagctttcaggcccagggctgcacagaagctggtgtcaggagcagtgaacacttctgctaggacactgctcttccagaggacccacgcatggttcctggccatctcaaaacaacgcaaaagactgagacaacagaaaggacagtaagtgagcagagatgggaggaatggggaaactctaactgcaaagatgtgccccaaggaatttatcacgtgtggtagagcttgtcctatggcacttgctcctttagggtgggagatgcagatagacagggccctgcctttacaacactgcatcccaaaagggagccagttgtggggtggagacactgttaggtgctgttaggtgctgaggagtgctgttgcaggatatttgatcacactgtgaaccccgagattgtgttatttactgaaaaacacctgtttctagttgtagtgtggttcgtccttaacacacacctttaatccctctggctagaatatagaaaagtccttaatatacatctttaatccaaagcaatgtaggtaaggttagtttgtagaaggaagcagtcaagtttgaaagtctaactgaggggcagacaaagtgacgaatcagagaaagatctgacagaatgaatcagagataggctattcccaactctcacaagaaaaggcctagaggttacttaagagagcaccacagaaaagagagaaagagaaaggggcagttttacttggacagttacagaaagatgggttgcagagagagagaacaagctagacacagaagacagaatgagccagaagatgagaacatattgccaaagtcagtacacgatcaagaagagcaattcagtgaagaggctgagagagaaagagacagaatcagtcggcttgagccagaacagctgagttgaaccagccagccagagctcagaaagaactggaaaaggtaagcttattcagcagtaagtctcaaaggttggaaacattctagaactagataagattgtatggaggccagaagcttccaggactagggcgaggttagcagattgtggcagtaagcctcagagacaacaattacttcaggagaacagaagctacttttacagagtgccaaggaagacagcaaagctaaaagaagaacacgggtttggaaaggagtaggcactgttttgccgggcctcttgcaaggctccatttgaccagcaccatgagggcacagaagccagcatggctgtctatgggaacagtgagggtaactgatggaacagcaagggcacatcacatggttaatgtgcaatgagggagagcaaggagctaatgctgaggcatctatatacaataaataatcaagaaatggaa

SEQ ID NO: 254 - DNA, 1847 bp, Mus musculus
ctctcacttttaagagttggcaactcgcacagcggcctctcggcctcctgttgaggagtgatgacttccggagataattggttctccttttaagtgaagttgaaaattcaaaatgtggagatcttagaattattttctgctgctaaagatggaaagaactgttggtgacgggaggatcccttttctgtttctccactttgcagacagctgcagcacgactaccccagagccctgattttcagcaccgatgactttttcttcaaggaagatggcacctatgagttcaaccccaacctcttggaggaagctcatgagtggaaccagagaagagcaaggaaagcaatgaggaatggcatatcccccattattattgataacaccaacctgcacgcctgggaaatgaagccctatgcagtcatggctcttgagaataactatgaagttatattccgggaacccgacactcgctggaaattcaacgttcaagagttagcaagaagaaacatccatggggtcccaaaagaaaaaatacaacgaatgaaagaacggtatgaacacaatgttacctttcacagtgtccttcatgcagaaaagccgagcagagcgaacagaaaccagggcaggaacagcgaaccgtccagtggctccggctactggaacacctacacagagctccccaaccggagagctaatggcctctactccaacgagggctacagaaggggtggccaccaccaaggatattaatggcccgggcacagctactgcagaattttcctagagaaagtttctacttcaatttttggtatttattctttgttcagggttagccagagctctaagtccagtgtaaatagttgagcccagaagtttctgaacagaggtcattctatttattatctccaacaagtgacgtcagcgtgcgtccgtactcatggtctgatgctggggacctgctgaggagtcaagggtctttctccagggaaagaattggattgaaattgaaatccaagattatcaattagttgctacagtcatgaataaaacaagatggtactagtacatttctataggctgcagtactactgtctctgacagatccagcctctccacagagctggagaggtgagggaggcagaggcaggaagcagcttggtgccattgccgctttgatgatctatctgcctccagagacctgagccgtcactttaatggcactgattttcttttagacctaaagtgcagaagggaatgtagtccttcagggtaacattaggagagttacccccctctgttaaaaatgcctgtgaattcttagtaacaaaggcaactaagaagaatcagtaccattatagtcaaaccctgtagacagcagtgtcaggacaaactcctccctctagcttgtagtctaacggtgtaaataattctgctttcgcaaaataccagtttttaagaatcatcaagtgatttctaaaatgatgccttgtaacgtgttattaattagtaacccagttatttaggagtgcaaagcaaggaagcagccagggtgatacaaggagatatgaaagccatgcccacctggatgagcagtctggctgttgtatgtggtgttgagacagtaaactgtggaatgcccctcatatcaattatggatgtgagtccaaattaaatcccagcaggctggagtcagattcattggtatgagaacgtgacaagaccatgtgaaatgtatgctctatttatttttggccaacagcttctttctaatgttttgtgagatattattttaagtgtcttatataatggtgcttttatggttattaaaattgtatatggtattgaattta

SEQ ID NO: 255 - protein, 192 aa, Mus musculus
REDPFSVSPLCRQLQHDYPRALIFSTDDFFFKEDGTYEFNPNLLEEAHEWNQRRARKAMRNGISPIIIDNTNLHAWEMKPYAVMALENNYEVIFREPDTRWKFNVQELARRNIHGVPKEKIQRMKERYEHNVTFHSVLHAEKPSRANRNQGRNSEPSSGSGYWNTYTELPNRRANGLYSNEGYRRGGHHQGY

SEQ ID NO: 256 - DNA, 45814 bp, Homo sapiens
ttagtgaatcattctagaactaatagttcaggacagtaggtatttcttaactgttctcataaacacctctatgggcaaagtagactcatttcgtctgtccatttaataaaaccaaatacatttttcctcatcttcttgtttctccttattccccatggagacattattgccacttaaaacacacatacacacacacagagcaatattttaaatgtttaaattgacatttgtggccaggcgtggtggctcatgcctataatcccagcattttgggaggccaagttgggtggatcacttgaggtcaggagttcgagaccagcctggccaacatagtgaaaccctgtctctactaaaaacacaaaaaaattagccgtgtgtggtggcacttgcctgtaatcacagctacttgggaggctgaggcaggagaatcacttgagcccaggaggcaaaggttgcagtgagccaacattgtgccactgcactccatcctgggcgacagagcaaaactctgtctctaaataaataaataaataaataaataaataaataaataaatagatattagatatttataggtgttttctttctttctttctttcttcctttcttttttttttttttttttttttttttgacagtcacactctctcagccaggctggagtgcagtggcgtgatctcagctcgctacaacttctgactcccaggttcaggtgattctcctgcctcagcctcccaagtagctgggactacaggcatgcaccaccatacccagctaatttttgtatttttagtagagacagggttttgccatgttggccacgctgttctcaaactcctgacctcaggtgatccacccacctcggcctcccaaagtgctgggattacaggcgtgagccactgttatatttcttttgtcattttaggagtgtccctacatgagtaaaatgacagtgcaaacttaactccaatgccaaatattaatattttatgtattttaattataatttctagaaaagacagaagaagattggttgaaaaatgaaaattccttgaactgtaagtatgacttattctagagacctctgtttgatcataaaatagttaatcttgacattatttgtttgtaatagctcatatgtattatagcacgactggagagtaaaatataaaaaatgaagtttgttaccatagcaaccttgtgtgctattatacatgtgatgtttttatttcctttaagtgtagatcttttttgaaatacagcaaagcttagattgttgctcccaaatttattttcccactttattggttagaacatattttataacattctatcaacacacaatttatgagacatttccccccttgggttggtatgtgatgagggctgggaattaggggtgtaggttctacttaaatattagattctctaggaaaagaggtaaaacatatagacaaactcatgttatattttaaacttatcaagctgacattaaaataaacacattgcattttttttcaaatgcctaaattatgaaataaacacagctgctacgatttcagtgcatatatgtctgcatttgataagaattgaatgcactatgcatttaccatacgttttttcattttaacttatttctaagaatattctagtttccatttctcaactagaaagacatgtataccctgtaaaaatgttttttgtttgttttaatcctgcttcccctgaaagaagaggaagaactgaagatttgggagaagagtttagagatttgcaggggccactagaaaaatgtgggataaatatggtacaggaggagatgagagacaatgaggaattccagaggaaggaagtgaagacattcattcaattattcagcaaatgtggccaggtgtggtggctcacgcctatactcccagcactttgggaggccgaggcaggcagttcacctgaagtcaggagttcgagaccagcctagccaacatggcaaaaccccgtttctactaaaaatacaaaaattagccaggtgtggtggcaggtgcctgtaatcccagctacttgggaggctgaggcaagagaaatgcttgaacctgggaggcagaggttgtggtgagctgagatcgccccactgcactccagcctgggtgacagagcgagaccccacctcaaaaaaaaattattcagcaaatgtttattgaggtgctcatgtcagacactgaagatatagcagtaaaaacacccctgccctcatggaatttatgttgtagggatttgatttaacgccatagcatgttgggcaaggacttggctgagtgagcctctagcctacctctgactgaagttagattatagtgagtgaagttcccctagatggccccaacatgaggagacaccagtacaagcagcatgcagcaagcatggatatattttcctgtggccaatttcaggagtcttttctgtctgctaaaattggtagatttgtgtcaaggacattttgcaaccacaattttgattttcatgatgatctcccacatgtatcctaaactgtcgggtcttctcacagagcattctgcccttaattattatttttttctttttagggaattttatgagtgctatagctatgtgcagatttttttactattttattgagaaagggcatcctgttttatgtttggcattaagtactgaccagtctgtctcaaggggtaaacagaaatttagaaacagggaaatagcaggagaatctggttggctctgggagccacaagtcggtgcccatttacaaatattctccctgctggttgccagggtgtttaatgtcatggcactcctttacggcagtggggcagggtgctaggaagaggatgggtccccatcttaaggctcctcctgactagctgtgtgtgaccctaaacagaggacccttctcagagtctcagtttcttaatttgtaaaatttttatcttttaaatgaggattaaatgaaataactttgcaaagttattaaatgaaaaaactggccgggcacggtggctcatgcctgtaatcctagcactttgggaggctgaggctggcagattgcccgagctcaggagttcgagaccagcctgggcaacacggtgaaaccctgtctctactaaaatacaaaaaaaaaaaaaaaaaaaaaagaaaattagctgaatgtggtggcacacacctgtaatccaagctacttgggaggctgaggcaggagaattgtttgaacccgggaggcggaggttgcagtgagctgagatcgcaccactgcactccagcctggatgacagagcaagactccatctctacaaacaaaacaaaacacaaaaaactgtgcaaagtatggagcctagtgcctgaaaaataatagattcataataagagtgaattcccttcccctaaatactgccttggattaaagcattgcctttctttttttcttttcttttctttttttttttttttttttgagacacggtcttgctcttgttgcccaggctggagtgcagtggtgcaatctcagctcactgcagtctctgccttcctgggttcaagcgattctccacctcagcctcccaagtagctggaattacaggcgcccgccaccatgcccagctaatttttttttttgtatttttagtagagacggggtttcaccatgttggctaggctggtctgaaactcctaacctcgtgattcacctgccttggcctcccaaagcgctgggattacaggcatgagccaccgtgcccagccttttttattattattattattttgagatggaatcttgctctgtcgcccaggctggagtacagtggctcactgcaacctccacctcccaggttcaagcgattctcctacctcagcctcctgaatagctgggattacagcccgccacaacacccagctaatttttgtatttttattattttagagacggggttttgccatgttggccaggctggtcttgaactcctgacctcaggtgatctgcccacctcggcctcccaaaatgctgggattacaggcgtgagccattgtgcccagccaaaacattgcctttgaaatgctctctggcaaaatagaaattgtgttctttaggagaggaacatattggcccagtaaacatgttaacacatttgcatgaattagtgcatttatttttaattttttgtaatgtacatagctggatcctcagggaatgggatctagaacaagtttcagctgaaggacaaggagttgggaaatgtcagggaacaggctcttgaatgaggcaggactaagcagtgtagactgtggggacagctgtgaagtcctggatgccaggggagtggcataactcaggaagtaaaggctgggaacctgaaaacaaactgttcatgtcacatgttttctggtcttgtctgggcttgtgtttgcttgtagttgagttctgctgtcttcatggtactgctgaagatcatgatcacggagaaaagtcagagtgctcagtgccaacccaagggattctttccagagacgtacccgttggataccaaaattagtttggataatctgttcaaccattcttgataagttatctgaataataaaaaaactcaacagaggaggtaacaatttgaacattttattgtctaatttgaagatgtatgccatactttgtttgatagaagaaagtaaggcacagaaaacttgagtaccttatttttaaaactgcattaggattaaaaggttagcccctatatccaagtattggtctgagatcccatttctagaattctgaaatccaaaaagctctgaaaatcaatagttatttttccaaatgtattcattgtggtaaaatacaccaatataaaatttaccatcttaaccacttttaagtgtgttataaatacattcatgctaccatcactagcatccatctctggaactcttttcatcttgcaaaactgcaattctatacccattaaacaatgacccattcccctttcccccttcccccttcctccttcccccttcccccttcccctcagcccctggcaaccactgtttctgttttttaaataagtttgacattaaaactaagtttgcagccaaacctgacccaaatacaagctgggcaccgtggctcatgcctgtaatcccagcgctttgggaggctgaggcaggaggatcacttgagcccaggagtttgagaccagtctgggcagcatggtgaaaccccatctttacaaaaaatacaaaaattagccaggtgtggtggcacgcgcctgtagtcccagctactcaggaagctgaggcggggatgatcgcttgagcatgggaggcagagattgcagtgagccaagaaaaaaaaaatacctgaccccaaaaggtaggcaattaattttactccttatttatcccacttggaatgtataaagtatattcatatatttcattgcaaacatattaatgtgtttaactacagaggtctgcgccacaccccactgggaatataggataatatacagtactattacctttaaacaacaaacactttctgaattctgaagtatatctgacctctacaattttggttagggattgtgggacttgtactatactagaagttactaatattattttttattctgttttagtttagttgtacttaataagcttaaaatatgaaaattcatatttacaaaatataaattaaggagtgactacgcactattcaacatgtagacatcaacttaatccccatttgcagaaagagagccccgggtcttatcttaccctacttctcccagatcttctgtctaatcttctcgaaggagcaaacctctaggcctgaggacgggcaggcagctgcttagggtatggacatttgtttgttaaacagacttgcaactgcccttctggtgtagagccccacctccaaatcttccagtttctgagatttagggtttatgctgggtaatttgtgttgtttcttggctgtctataaatcagaggattttttttttttttggccgaatcaattaacacttggccttttgctctccagtttccaaaagctcttccttcacaccttcttacttttccacatcttgttaaacagtgatagttagagaaaaatttcaatgtttcttcattcgccaaaaatggtgtttataagattattttctttatgtccatgacagtaatggtttctagtgcagcaaagtgagatcgtgctggctgtttatgttactcccttacattatcactatcttgttcagccttatttttatttatttatttatttgtttgtttatttttgagatggagtttcgctcttgttacccaggctgtagtgcaatagcgcgatctcggttcaccacaacctctgcctcccgagttcaagcaattctcctgcctcagccttctgagtagctgggattacaggcatatgccaccacgcctggctaactttgtatttttagtagagacagggtttctccatgttggtcaggctggtctcgaactcccgacctcaggtgatctgcctgcctcggcctcccgaagtgctgggattacaggcgtgagccaccgcacccggcctgttcagtcttcatttttagtaaatcccaaactcaggattatcttttaagaaaatagtttaggttcatatacaattatcaagcaccttctgaatatcaggctgatattgtgttacagcctgggctgacaaagataaataagacactatccatgccctctcacttcctctagtgagaggaaacagatacccaaacagtttactttaaactgtggttttgaggaatacattgggaaaaatagaacttgttgactagttaaatgtcaactaaagaaaagtgaaaggacagtgtgtaagatcgtctccaggtgctgctgaccatgtgatcctccttgaaactccctccctgggcttccctgcatctttcagtgttctgtttaattgttggtcattcaatcgtcctctcctttgctagatccacttgagggcacagtccttaaatgctggtgtcctcaggaccccttcctcagctgtcttctctcttctctatctccttgtaggggaaaggatttccaaagctctgagctcagccacctctcctaaggaacacactcacgtttcctggcatctgttagatagctctacttgccacaagccctgtgctgaaacccctacccacaaagctgcgttgtcttcctgcagctgctgcctgggacctcttaacagagggaaatggaagtggacggatgcttatgcagccctgtccagtaggaatataatgccagctacgtatgtaacttaaactctctaggagccacaatggaagataaaaataaatgaaattaattctaataatatattaacccaatatacccagcacaccatttcaacatataaccaatataaaaaaatttttaatatcttttttcatactgaatcttcaaaattcactgtgtatttttaaaattttactttatgttttttaggagacagggtcttgctctgttgtccaggctcgagtacagtggtaccatcatagctcactgcagtcttgaacttgctggctcaagtgatcctcccacttcagccccccaaggagctaggactacaggcacacaccaccacaacctggctaatttttgaatttttggtagatacagggtctcactatgttgcccaggctggtctcaaactcctagcctcaagtgatcctcctgccttggcctcccaaagtgctgggactacaggcgtgagccactgcaccgggcccgggcacagcgtgtttgcagtagccacattccaagtgctcactagccacatgtgaccagtggcccccatattagccagtgcaggttaaaatgaaaaaggtagcatgtgaagctgggcaaattatgataggatacagagattgtgtcactatttttacgatttatgtatattttctgttccttatgggttccctcctaatatttagaggtctttgaaattccattgtttcttagcagtgctgagaagaatgaggaaagtattcttcctccacgctgggaatggattttcaagggagagcagctcatctcccactccgccctatcccatccctagagggaaatcccaaggggaaggggaagttctcagcacagagcccctccccacttggatagtcccttcctaaaagctaactgtgaaatctctggattttgttttagaaggaaatcacttttttcatagttgcttttcacaattttagtaccttagctgccagaaatagaatttattactttacaataattattatagccaaagccaccatatattctgcatttcccaggatggtgtcagttttgaatgttgtttctttcaggcaggcatggtgaattttggttcagaaaacaggatcactctgtcacgctcttgagggtgaactgttggagagtcactgtggtgatcaaccaatgggtactccctagttcctggaactgagaacttcagtctggatacttctctataaatggtttcggtagactctgccactttccccggggatctgaaagagttctccaagaagcccccacttctcaggcggcaacagggcaggtacctgggcggtagcccttatgctactgttcataaatcaatctgagttttatgggtgctttttctgaggaaggagagatttaaagttatgtagcggcaacaaagctttctaataatatttttggcaggctgctaaagaaagatgaaataagaaaagatacaagccctgggagagtggtggtagcccttgggacgccagccagatgttggtgctcacaaatcgggggagacaatggcctttactgttgccatttacaatgccgggcagctcattaatcatcagctaaaatgatttcactttcagggtctaggcaggtcggggctggggttggggagggctgtggcaggaggcctggcttccaggccggggaagtgtcccagagacctactagacggggcccctcccctccactgctcagggcaaagggcaccaggaggcggagcgggggtcgaggtgggagtgggtgcgtcacccttgttttccgggctgtgagtctcccagcgtccccagctttccaggtagggacgccccctcccacgcagcacggttccggcgggtggaaaggaggggctgggctcccagcgcccgcccctctatccatcacatggccggagagtcacaaaaacaacagctttggccaagaccgtgacttcagtaaagggaacccggggctctcgcagccagccctcctgcccatggaggacagtttccttcaatcttttgggaggctgagcctccagccccagcagcagcagcagcggcagcggccgccccggccgcccccgcgggggacacctcctcgccgccacagctttaggaaacacctctacctcctgcgaggcctcccgggctccgggaaaactacactggccaggtaatgacagcggtctgggcgccggtgcacgggcccggggccaccaaacgccccggccgagcgcacccctgccccaagccgctcccgggcgccgcttgcgcccccgccgcgggtgcctgccgcggccccggccccagccccagcccaagcctgagcctggcagcgcggggagcccgagccgcctccctcgacccctgaggccgttgccacccctggcgcctgagggcgcgggcacggagaggagggagctcgtcctgtttgtttcccgccgcgctgtcccgggggggacggattcccgtactgcgcctcgcgcaagccccagcggccccggccccttccccgccgccgtgccccgcctggggccagccgggccgaagcagccttcaccgcccccagcctccccagccccaggtcgggagggactcttcttcgggaaaacccggtggcgactgcagagaaaaccgccgggccccgctggcgcgcaggcggccgctacagtgcgtcaacaggcgctgtaatccgagcgcataaacgaggggtccgggggtgggggcccggggcggccgtggcagtggcccggggctggcagcccgctttgaaaatctggcgaagtcggggagcctgcgtttgctttggcagctgcgaaggcgcacaggtgcacgggggcggggggctggctggcggcgccaccaccgaccgtcactgacagagcctcgccatgggcgcccaaattcgttcacttgcgaattgcgtaagcggccctccggtacccaacctctgggaattacgcgggcttgtgcctgtggccaccttgctaggccccaccgctccagcctgaactcccaccgctccctgccttgcgcttgatgttccagcaacttcgaactgtttttatctcctgtaaaccaagccgcttctctccttgacgctggccttcctgcctggcttgccctcccgccttcttttgccttttaagaccgggcagctatcccaccccgccagtatatgcccctcttctgggctccttggcttcctgtttatacctacgtgactgtgcttacttttttgcacatggtttttcttatccttctgtaagtttcttgaaggtaggagccatgtcttaccctgccaagcacattgtctggcacgtagtagctgttcagtagaggaagtggtccctttccctcaaagggcttcccgtctcactggagagataaggctagccatggtaccaaggaactgccgaagaatcaaggtgatggacagtcacgtgcggatttcgatggtgccgagatagtgaccttaggaggagggacagcctggggaggtgctcctggttgactcgcggagtagaagcttttggccagaatattgctacattttcacaaattgcagggacatgtgacttctggaggaccgtgggcaccctttcctaaaccagggacacatttcaatagaccctctctggctcgctggggaggggaggtggaggacagaggcagagtcggggagcctccttggaactcagcagttggttattttgtgatacagtcatggtgggtaaatctgttaccaaccaagtatcttctgaatgtcaaatcctgtttaatttcactttcgctttgctgatctgtggcctgcctcatactgagtgtcaaagagacactgagtgtcaaagaaggaagtaaacgtctttggccagatttaatttctgactctgttgggaagcgaagtaacatgatgggtgcaagatacacagaatggaacatcaggggcttggattcacattcctcatctgtgaagccagggcgttgcctgagtggtccttagggtcctttctggctctaacattctgcacttttaggattttaattcctgattgacatttggctaagcagaagacaccggatgagagaacacctattacagaccatctctctctctctagggacgactggagtgagcactggcctgggagtctgaagattgtgccttcagacctacttcgtcacttactagctggcgactttggtcagtcatctagtttttccgggccttatgttccttacatgtgactactaaaaggctagtagattataggatttattaaagatccttctgactcttaatttccagtggtcagattaaaaatagtttgctaataatggctatgttaaagagctctgaccttggagtcaatttatggctccacatccaagctctaccattcactagttttgcttttcacccaacccctctgtgcctcggtttccttttctgttaaatggggatatctgttctgtttgcctctgagggttttgtgaacattaaatgtgtgtgggaggactttttaaacttaaagtgctatatacattttaagaggtgttagttactgctccgttgttggtcagctgagataaatcttcagtgttccctggatcctggctctggagtgaagaaggtagcttggcagttgactttgagtcctcccgtttcgctgggcattggcagttctgggagcagagcagccttggcatgccatggggtggattgtgtgtttatagaaaagtctgggacgtaagcgaggaaatgggccacagctcagcggaagggaggccggtggtgaggatggaatggtggagaggcaggctcaggtgtggcccaccaggagctgccttccccacttttttgggaggtagggtggggaagaagaaaagagcaaattgtttaaaaatacacatgtatatagaaaatagtaaaactgtaaggttatctgtgtgttgttggattctgggaaattcacattttctctattctctgtattttccaaattttctataacgaatatgtatttcttagaataaaaatttttttcttcaaaatttggaggaaatcgctttttacaaatgtgggttcatctttttctgcttaaccttttttctcatttgattaaagaactaataaaaatgtttttgaaattaagatatgtcttgtctcccaaatcaatgttagatttctgtgctttttacatgttttcatagtttgaagtggatggaatgtggaaaaacatctatttaaattctttgaatttattttttaaaagttggagttttaactgattaaattttttgagcacatcaaagtactgaaaaattagcatgtgccctaaatctgctttatcacccgtgtttcatttaaaaagcatattacagataggttcttaccactgacctataagctctacttccaggaattcatcctaagaaataattggagggtggagcggtggctcatgcctgtaatcccagcactttgggaggccgaggtgggtgtccactgagtacttataagacctttagcacttgtttagggaagcatatgccaaataagcatatgagaaggcgcctgcctgggattaaccaatggaaagccataatcagcccactgctgtgggtaagggccagtggggagtggcatctcaaatgctgttggtggtgaaggctggggaggcagtgaggaggatgaaggctaattagggagaaaggatcttctccacatggagacggttcttgagctggccttgaagatgggaaggaggtggctgaacgaaggaaaaggaacaacagcccgactaaggagatggaggtggcagagagctgggtgtgctcccgggcttgattgaagtgaaggcttcattgtagtaagtgtattggtgaagtaagcccaggaccagatcatggagaacattaaaggctgaacaaaggagtagagagctgttgtcagaagaaataagattctaatgccaagaccctttcattctcagcagatgagccagaactctctctttcacagctcagctgacaaactcacctggaactgcacctgtcctttccgctacctcaatgaaagcatccatgggtgaacctctgtgctttccactgtgtgtgttaaaatgccttccggttttgaccatttaaaccatttttatatacaatccactggcattgtattatgtggaactacactcacaatgttgtacaaccattaccactatctatttcaaaaatttcttatcactccaaacacactctgtgcccattaagcaataactgcctattccccactcccccgaccccgggtaacctctcagctacttcctgtctctatgcatttgcctcctttacatgcttcatgtaagtggatcatatggtatttgtccttttgtgtctggctaaatttcatgtagcttaatgttttcaaggttcatccatgttgtagcatgtgtcagaactttactatttttgtatctcaataaaatattaccttgtatgggcataccactaaaacatcctttttaaatgaaattgccataatagagggtagcctttctttgttttttcatggtcttatttgaaaaattaaaagttgtcaatcttatttcagttccccagaatttttttgaatctttacatttcaatcaaagcaaagtcaggggaaccaccctgtagtacatgttgcatcctttgcaatgttctggttccttttggcaccatcacaaatggtttgtaacatggattcagttaggctcaaaggatgcccgctgacagctgtcttttctccttattcatatctctggataacatggaattttccatcatgagaagtaccttttcattatttcttttcattatagagccttgcacagaagtgaaaggatgcttttctaatgtgatgcaatggtaaggcggagatggggagaaaagtatactttacaaccagataagcagtggaatgtgagaaacagtgagaacagggggccagttaagttggctaagtagtgagtagttggaccccaaagaatactctgctccacagtgctcctagccagcaggcctggactgtggtgtgtttctttatgaggccagggctctcattaataaaagcaagctcacaatagaatgtttgcagcattccaactctgtgaatataaaagtggagggtcagacaggtgatatatcaaatctttagtcatctaggtctacttggaaaatgactactagctttttgtatttttcacaattttcctaaggtgggtcctaaatctcctctcctcactaccgagagtccttgtccttaccctctctctggaggctgggatgaatgaggacttaaaagctgtatctgtttaacaaagagtgcaaatatacagcgtggtatgtgcttgttcttgctcattggagaggctgtatcaggaaagattgcccagctatacaggagattcaccacaaacacattcctggagctgttggaacaatggaagaagaccctgctgaactggggcaatccgatattgcaggtgtggattatgacccgagaggaagtagaaatggatgaaggaaggaagaataggggaagaatactttcaaaggaaaagttcaggagatgtataggaactcccctggagttcatctggtctgagcccaagacactgagaagctaaacatcttgatcagggtcaaagggatgtgttctcctatttctaacagctttttttgtgtaccccaaaagaagaggccggaaagggggtgatctcgtgaaagggtaatgagtttggttttgatctgtcgtataatgaaaaaacaagagccttataagcgggctaagttaacctggatttcaattgtcagggtaaggaagctacatttttttgttgtcaatattaatgtttctcataatataaaaaatattactcaccagggaatttattttctttattaacgtaccattgagggcaatgggaggaaatgagatttagatttttaaatacgtttccatatttatcctggttatgatgtgttggagagagatgtggtagtcaacttccaactcccaagcaggtctaaagtctctttctcatctgctcacatgttaggatatttataagtcaatgccttagttccttcatggcagtttcatgaaccttcccctacataatagcacccgcctatggccactcagtctctggatgaacccaataagaatttttttttagtcacgccaagttatctgaagatactgaggctctctgggattaaggaaattttataataaagaaaaattagtctgccttccaactgttccttcataaggcagatcatatgtatggcttggggagaaggctgtttttatcaaggtaagagtctgggaaaggggaagggagaaatggggaaagaaaagccagcacatggttactgctgactgtctgcccggccctttttggacactggcttattgaatcttcacaataaccctgggatgtagtcatttttattttatagatgaggattttaggattggagagtcacacatttgagagactcaggggatttcataatacaccaagtgatcttatattactagggaagttcatggacaaacatacctacatccctttcacaattattggggagtcctgctgaagtatgattgtatagccaggattgtccagcactctttccccacagattttaaggatatgctgaagaagaaagagggcctgaaagggactttcatgctaccatttgttgccttgtaccttggctttcttttcttcttggcattggtaccactgacgtatatttatttattatctatttcttttactagaacgtaagcttcatgagatatgatgtaaattccatgagatcaggaactttattctgtccagctcctaaaagaaggccaggcacatcacaggcctttattcaacatttgatgaatgcattagttcatgaaacgcaatgtgagatgcctcctaagatgtggaagcttggatgtcagcatggctcttgagtaaagaacgaaaccaaagggcagattattcacataaagagaaatgtaaaagaatgaggctgggcatggtggctcatgcctgtaatcccagcactttgggaggctgaggcgggtggaatcacctgaggtcaggagttcgagaccatcctggccaacatggtgaaaccccgtctctactaaaaatgcaaaaaattagctgggcatggtggcaggtgcctgtaatcccagctacttgggaggctgaggcaggagaatcacttgaacctgggaggtggaagttgcagtgagccgagattacgccattgcactccagcctgggcaacaagagcaaaactcggtctaaaaaaaataaaataaataaaaaagaatgaatgggatatggaggacagacaagggggaagaaaaggaaaaaacagagccactcattccaaagttctcaattcggtgcataagaaaatgattcctatttgttgcaggtgaaaatgtttgatgtgccggctcctttacctcatagttacagtaagaagaaatttaaaaattgggatcaaagatgcagccgccttcccatttaagcagcacagacagcccaaagtgacagttttcctgtacagttactcttctgttatctgtaactgatctatgacattttgggaaaaaacagccaaaaaaaattagtactgaggtaggtgtgcctgattccttccccaattctgctcatgactgaaccaacagaacacaaacacaggtgaaacctgcacagctgtgagagcctacaaaagttcacatgcaagatacttaaaggaatttctgctcaatagagtctgtgggaccacactgacaaacgagaatgagggctctctgggagcctggctttggacctcatgaacatggtctactttggaggtatgaggggtaaaggtaagagaagtagggcagactgggaactgttccctgagtccccctagccactgtggcttggggacacttgaggctagcagtgattgaggcttggctctccaaggacaggacttggccctggtggggtgggtggcagcactgcccaggttcggccacacctggcctcaggggaggctgcccatgtcatctatagcttggctccctccctgctctcaggctgctgagccatggaatctgttttctatctcccagtttaaagtcctcaagaagaatgtcagtagcattcagaggaagtgctgggatccaggaagaatcctctccgtcagtctcctttaagggttgtattagtctgttctcattctactaataaagacatacccaaaactggataatttataaaggaaagaggtttaattgactcacagttcagcatggccggggaggcctcaggaaacaacttacaatcgtggtggaaggggaagcaaacatgtccttcttcacatggcggcaggaaggagaagtgctgagcaaaagggggaaaagccttatgaaaccatcagatcagccgggcgcagtggcttatgcctgtaatcccagcactttgggaggccaaggcaggcagatcacctgaagtcaggagttcaagaccagcctagccaacatagtgaaaccccgtctgtaaaatacaaaaaaaaaaaaaaaaaaaaaaaattagccaagcatggtggcaagcacccgtaatcctggctagtcaagaggctgaggcaggagaatcacttgaacccgagagatgtaggttgcagtgagcttagattgtgccactgcactccagcctgggtgatcgagcaagactctgtctcaaaaaaaaaaaaaaaaaaaaaaagccagatcttgtgagaactcactatcatgagaacagcatgagggtaactgctcccatgattcagttacctcccatcggaggtaattcccatgacgtggggattatgggaactataattcaagatgagatttgggtggggactgcccctggctcctccaaaatctcatgtcctcacatttcaaaacacaatcatgtcttcctaacagtcccccaaagtcttaactcattccagcattaactcaaaagtccaagtccaaagtctcatctgagacaaggcaagtcccttctgcttatgaacctgtaaaatcaaaagcaagttggttacttcctagatacaatgggggtacaggcattgggtaaatacacctattccaaatggaagaaattggccaaaacaaaaaggctataggccccatgcaagcccaaaatccagcagggtagccaaatcttaaagctccaaaatgatctcctttgactccatgtctcatatccaggtcatgctgatgcaagaggtgggctcccatggccttgggcagctccacccctgtggctttgcaaggtacagctccactcctggctgctttcacaagctggcattaagtgtctgcggcttttccaggcacaagctgcaagctgtcggtggatctaccattctggggtctggtgggcagtggccctcttcttacagctccactaggcagtgccccagtggagcctctgtgtgggggctttgaccccacatttcccatctgcactgcactagcagagattctccatgagggcaccacccctgcagcacacctctgcctggaaatccaggcatttccatacatcttctgaaatctaagtggaggttcccaaacctcagttattgacttctgtgcacccacaggcccaacaccatgtggcagctgccaaggcttggggcttgtaccccctgaagcaatggtctgagctgtacattgaccccttttagccatggccagccagagctgctgggaagcagggcacaaagtttcaaggctgcacacagcaggggggcccaggacccatctcatgaaaccatttttccctcctaggtctccaggcctgtgatgggagaggctgccatgaagtcctctgccatgccctggagacattttccccattgtcttggtgattaacatttggctcctcgttacttaggcaaatttctgcagctggcttgaatttctcacctgaaaatggggctttcttttctatcacatcatcaggctgcaaattttccaaacttttgtgctctgcttcctcttgaatgctttgctgcttagaaatttcttcaaccagataccctaaattgtttctttcaagttcaaagttccacatgtggatctctagggcggggcaaaatgccaccagtctctttgcatagcaagagtgacctttactccagttcccagtaagttcctcatctctgagaccacctcagcctggacttcatcgtccatagcagcattttggtcaaagccattcaacaaatctctaggaagttccaaacttacccacatattcctgtcttctgagcccttccattagttccagtctctgcctgttacccagttccaaagttgctttcacatctttgggtatctttacagcagtgccccattctctgtggtaccaatttgccgttctcacactgctaataaagacatacccgaaactgggtaatttataaaggaaagaggtttaattgactcacagttcagcatggctggggaggcctcaggaaacttataatcatggtggaaggggaagcaaacacatcctcacatggtgacagcaaggagaagtgctgagcaaaaggggaaaaagccccttataaaaccatcagatcttgtgagaacccactatcatgagaacagcatgagggtaaccattgccatgattcaattacctcccactaggtccctcccatgacacatggggattatgggaactacaattaaagatgagatttgagtggggacacagccaaaccatattgaggacgaactgaatctaaggtttgggtaaaattctcattgtacaaaaatgagtaaatagaaattctcacacagcttgggactctataaaaaagtttgccagctgggcctggtggctcaagcctgtaatcccagtactttgggaggccaaggcgggtggatcatgaggtcaggagttcgagaccagcctggccgagatggggaaacctcgtctctactaaaaatacaaaaattagccaggggtggtggcacgcgcctgtaatcccagctactcgggaggctgaggcaggagaattgcttgaacccaggagacagagattgcagtgagccgagatcatgccattgcacttcagcctgggcgacagagcaagactccgtctggaggggggtggggcggggaacaaaaaaaaaagagttcgcataattaggctaaaagagcgtcgtattcaggagccattaatacattcacagatatttactgagcatctcccatgtgcctggcattcttctagatgctcagaatggagcagtggacaaaggagacaaaaatccctgccttcatggaacatgtattctatcagagaaaaaaaattctcaaggaaaaaaggcaattttagcatctgctctgctctgttctctcaaaaaataagcaaaggatttcacaggtatgccaccggaggtatatatccccaggaaatgtccacatacacacaagaggtaggcataaggaagttcactgaaatttgttcatgatatggaaaattgcaaataagtatcactagagaaaatacataaataaatgtggttattttatagcgctcaagcacagcagtttagtgtgcggctctggggccagaagcctaggttttaatccagttgtaccactcgttggccctaatttctttgtctgtaacatggggattggggattcatagcagtgcttatctcccaggtctatttgagcattacgtaaaaaatgtaaagcctctagaatagtggttagcacacaataagcacttaataaacattggctatatttattattttgctgataatggagtactatgtagcagttaaagaaaatggactaagtctatatatcaacataaatagatctaaaaaatgtaatgctccttcattttttaattcaacaagtatttattgagtgtttatgtgttccacacagtgttctaggtacttgggaatcatcagtgaacaaaacaaagatcctgcccttgtggaccttatgtgccagaggtagggaaatggatataacctctaaggaaaccgtatgttaatttaggcggtgataagtgctgttgaaaaggggagagagaagcacggtaaaggtttctgggagtgccagagttaaagtgggggttggttgaattttaagccaacaaaacaagtatgagaaaatgttcatgattatgagctttaggtggtgtgtatgcaggtgtgttattatttcttttgtctttctctatatttacattttttctaaaaaattcctctctatgatataaaagattaaagaaaaactcctgattaggagtctgaaatacgaaggaagttggttaagaagcagaaaattaaaaaggagttaaatgatatataaaagaatctaaagtaagtgttagaattttaaagtatattagagataagcagagtcacaatgcagaaaatcaaacaataatgtagaagacaaatgtgaaaataaatatagccaaaaataaccagagtaaatacaaccaaagcaacaaataaagatatcatagaacatatttgacttgaaggctcagaagtgattaaaaaaataaattaaatatctagatatatcctggaaagactgttgcaaaagctgttagttaactaccctttcttctttagcaagcacactttgttgggtgtggcagtgtgcccaactataaaactagttttcagggcccccttgcctctttggctgtgtggaacatggaggtgcagcctggccctgcagtggccactaggaggccctctgaagaatggaagcctcttgctaaaaaagatgctagactcctgggtccatgttgatcatggagttgtgacaccagctctggattctacctctgtctttttacacacaagatatagacattttaattttattgaagccaccactgttagaaatccactaactggggtttctgttcaatgcatgtgaacccactttgaactgaaacctaaatttaaaatattaatgcctgtggggaaaagattgtagttcagtaattctcatctagcctgttgtctttcatacgaagacaacagaaaggctttctcagatctgcaagagctcacagagtctgtaatacccatgtgccctgagtgaatagacctgaggtaaggttctggcagccccacatgcaaacggtagaaacccaagccagtttttaagctcttgaagccctagtttctttatttgtaaaccaagtaaaagtaaatgatttacttcataaaattgttataaaggttaaagggacagaatatatgccaagctctttgttcactgcttagtactcttttaaaaaaataatagaatttattggaacaaccaatcttagccaaccatgagaggaatcacaaacaagaagaaaagaaagccactgcaccccgctaaaatttagacttttagagattattacaaacaaaattaaaaagcaattgctgtacataataaaaaattgacattcaataagaaagataaacctcctaataaggaggctttattcaccaaaggacgtgaaagtgcagttcaccaaagaatatctctaaatgatcagcacacacacacaaactaatattgctgataattaaagaagtagggacaaactaaatgcctaaccatagaccattggttaagcattaaattattagttaagcattatgttatggcacatccataggaataagtatgccatatcattaaaaatcatgtcatagaagaatattttataaggtgggaaataatttgctatgaaaaaatgcttggttaggccgggcacagtggctcacgcctgtaatcccagcactttgagaggcctaggcgggtggatcacctgaggtctggagttcaagaccagcctggccaacatggtgaaacctcgttgctactaaaaatacaaaaattagctgggcatggtggcacatgcctgtaatcccaactactcaggaggctgaggcaggagaatcgcttgaacccaggagctggaggctggagtgagctgagatcgcgccactgcactccagcctgggtgacagagtgagactctgtctcaaaaaaaaaaaaaaaaaaaaaaagcttggtgcaaacttggtgtactctacatgatgttcctcttcatgtaacaagagataaaatgaaaagaaattatatatatatttccagtcctggaaagaagaccaaaatgttaataattatttgtagatgggggaatataggaacctcactccttttttgcactttttttgttttgtgatcagagaaatagatgtaaagattgctgagggaaatgttggagaattggatcggtacatgggctcacagttttgtcccccatattagttaatattacaaaggaagcaagatacctttccagtggagaggtctggctaacaccaccctttagccaagtgatcgaacttagcattgaatttagcatggtgggacagactgtcattatgtgcaatcagaagtacacaaacatcacctctgtactttgcttttaaaaaacatttaatctgggtttaatcactaggaaacaaccacacaaacccagaatgcagaacattctcataccaactagagaaaccaaaacagcatgaggacagttctagattcaaagacgttaaccagacataataaccaagtgcagtacttgaagcttatgaaaaatattcttgagaccattggggaatttttaaaaatttaaatttaaaaacctaacattaggccaggagcggtggctcatgcctgtaatcccagcattttgggaggccgaggcaggtggatcacctgaggtcaggaattggagaccagcctgaccaacgtggcaaaaccccatctctactaaaaatacaaaaaaattagctgggcatggtggtgggcgcctataatcccagcttctcgggaggctgaggcaagagaattgattgaacccgggaggtggaggttgcagtgagccgagatcgtgccactgcactccagcctgggcgacagagtgggactccatctctaaataaacacataagtacataaatgcataaaaataaaataaaataaaaacctaacattagctcttatgaattaatcactctttcaggctctttcaggatgacaggccctgcggagtgagagccagccccaccagatgtgtgaaggaccttgcttagggcactctgccttaattttttagatgcaataatggtattgtggttatgcagggaattgttcttattcttaagagatacttgataaagaatttaggaataaagtatcgcgatgtatggagtttatctttttttttttttttttggagacagttgagacagagtttcgctctgtcacccaggctggagctggagtgtagtggcacggtcttggctcactgcaatttctgcctcctgggttcaagtgattctcatgcctcagcctcctgagtagctgggattaaaggtgtgcaccaccagtctggctaatgtttgttatttttagtagagacgggattttgccgtgttggccaggctggtctcaaactcctgacctcaagtgatccgcccgtcttggcctcccaaagtgctgggattacaaatgtgagccaccgcgcccggcctgcaatttactttcatattgttctccaaaaatatatataggagagacataaactaaggcaaaatgtgaacatctggtgaccatagatgaagggtaagcagcgttcaatatactgtttttcaactcatttccataggtttgtatattttctaattaaaaggttgtggcgggagaagttcaggtggaaataaaaaggagagggcaaactataggataaatgagacttaagggacatggcaaccaaatacaatgtggggatcttgtttggtccctgttgcacgcacaccaactggaggaaaacactgatgagacaagcagggagactaaacactgatggagtgactgatgcaatgaaataggaaggacatgagagaagactggccatatgttgataactggtcatgtgtatatgaggatcgagtatattattccatctacttttgcatgcttgaaaatttccctagtaaaaaactgggcgtcaagttaaaattacatgcaatgtctgactttctcagtgagtgactgactggctgaagagatatctaaatatatctctatggttctctattattaaataaagaattacacaaaagaataagttgtgaaatcaagattagcccctgagtttctcttataatagtgattttaaatgaatttgagcgggggttgtgggaggtgaaggttatatggaattaattatctttctattttttcccttttattttcattctctcaatttccctaatgcatgaggctcctgaccaccataaagatagaactggggcttaaccctcatcacttctgaagctgatggaatggtatttattgcttccacttaagtttgagaatctcaagattgtctatttaatcagttctttatttagctagtagagtttttattgtcctgcctattcaacatgctactatggctgctagtgctaatttaacatttaggtggagataaaacaagttttgaagtcattcaggaagatcatacaggccaaaaaaaaaaaaaaaatccttggccttaaaggtgaaaaacacccttagttttgtctgcctgtttgttaggaagagtatggaggccacagtcagatgtgtctcaggaaatgatggatggtgttcttgccccatagtgatcctgagccatttagcttttactctaaggtaaaattttgtgattaaaagggcagtagtgttatgtgctgtttttgttttctagaaggaaataggattcaaataaaacaaaacaaacagtgaattggatactcatgccttaaagtctttttaaaggaaatattataaagtattaacttccaatcaataatataaaccacaaagaggaaaacaagagcagataagggtatgtatatgaaaagaaaaattcaagtctgaaaatgttcaaaaaccaaaacaaaacttgtaagtagcagacttaataggagaacaaatgaaaccagatttagaagggatatcaaatcgggacctgaaagaaaaaaaaaatcttggattcagttaccatggttgcttaacttagtgtacagaggataagggaaatacattatacactattatttaatctctgaacacaactttcattatttaaataatattgatgaaaataactttaaaactgtacagtgttcacaaatataaaatatacatacctgaaaatgcatcagtgctacccttagatttttgtcctgtctgtataattgtttgcatcagaggttaaggtttggactttcgatgtgcgtatctttaaagaagtcgaataacagacattcatacggaaactatgagcactggttcatcaagtcttctttatacttatcccttccttcgtgtcactggctttatctgtactagatttaaagtggccacattttctttgctcttccttccatcaagaagtctactttcctcgcccttcaatgtgggccagcaaagtgactcgctttgaccaaaagaatgtgctggagcgctggtgagcagcttcttgtcttgttctctttaaataccgcggtctgtgaagagacctgggtgaggctctttcagaaggatgacaggccctgcggagtgagagccagcaccaccagacgtgtgaaggaccctgcttagggcactccgcccagccccacgtagtcaggtgacgcagctgccgcagggaccccgggcaaggcccgcagatcggcccacctgagcccagcccaaattgccaacacaaaagaagttcattcccgcgcccacacaatagacttcccagcgtctgagaactatccaccttatcccttttattttctattctgcctgaaacactccgcatgtctccgatgatctttgctcctctgacatggtttctggaccttgtatgtatttgatcactcttctctggacacgttcaagctggccaaatttctctttaaattgtgtggcagtcagatttgaaaacagtgtttcaaagatgatttgcgtcttttaacccttagagtctttctgcttttccctgcagccccttctcccctacaagccctccagcactcgcttcctcctctctttcctgcccgtgtgctcagcccctcccccaagaggcagcagttttctcatccctcagggaccaagtcaaacttgcatcactcctttgcatcactttccccggctcctgaccctttctctcagcgctttgctgggccagctttttcctctgtgcgctgcgctggctgtgccaggtctgactcctttggctgggccatgaattccttgaaagcagctactttctttctgtaccttaacgcttcacctggcatttggcacatgttaagtgctcaataaatgtttaatgggttggataattaactaatattctttcggtattaaagtgtattatctactggcccgcatttccccgcaaagctaccaagggagactgtcagattcctgtttaaacaaacatagtatgtccactgaatttcctggtttgccactgtttagttcattaaaaaagaaaatgcatttggtttggaatttcagtgatctatgctgccttctttttaaatgctatcaagcttctgaagaattttgacagatatttagttaccatttctggaatgtatattcactcgtttttgaaaatggaagcattttactttagttttgtctttcatctccctcttaattcaccgcagtatctcaaggactacttgacatgcgcgctccgatgtgtttattactgtggcgtagaaacagtctgggttggtcaatttggcctcattgttattataacaccattttacttttgtaaagtgccttactgggtacaaaatgttttttcatactggcctcatttcagtctgattagaagctctgtttaataggtagggataattatctgtgttttacagttgagaaaacaaaagctcccaagcctgtgggggcacctgaagtgcttactcatctgtggccccaaggcctcatgtttgttctgttcttcctggattaaagatctttctgctccatggagaagaccaacagcaaaaaagacattgaatagctttgctttctctttgcatttcctgcccttgtcattctccaaccttttttcctccgatttttaaatatcttcttattctgagcatggccatgtgaccatattttctgtttgttggctgggtttgtttgtcctcagtttttacagatgcggaaaggaagctcagacacgtctccagttcttgcggagcatgacatccaccttctgccaaaagatagtacgagcaaggattcaagtggaaacatcttctctttgaagttcttttgtgcagaactgaataagcgtattcattttgttttggttttgctttaaaggggagctccatggtggtgtttctttttgctgtgatatttcctacttagagtggtggagggtaggaaggtaggggacagtggctctgtcgctttccttctcctgttgtgcttttctcccatttggctcgggtcatcattaaaacataaatatgttacctgataaagtagagcacgtgcatcacttccccacatttctcactagaattagtttctcagatgggtccttacagagaacagagctccaaggaaatgggccagctcagagtttagggggccgagggaagggctgcagcatgggggtctggcacccatgggcaggtcttgggcaggggcactggtgcctcggagaggaatgggcaccgggattggtgcccaggaagaaagacagtcaccaggcctgcgacttagcttcagtttcttcttgagtcagttcttgccgctacagaaggcagcggcagtgactgtgcctcttagtttcaaggactggcaacacacactgctgcctctcagccctctcccatctcctgctaaggagtgatgccttctagacataataaacatctctcttttgaaactgcattttaacaactccaaacctggtggtctcagaattataaactgctaaatgttagagatggaaggagattatttctactgagactatacatatatttaaaacatctctctctctcatttctccactttccagacaattgcagcatgactttcccagggccctgattttcagcacggatgattttttcttcagggaagatggtgcctatgagttcaatcctgacttcctggaggaagctcatgaatggaaccaaaaaagaggtgacaaattccttcccaaactcctgggaaaccctgatgtgcacatagattgtagctgctgcagaatgaataaattttatggaaggagtttaaccgaaagttctgccaatttttcccccaaaacagaacaccagagcataacctccttagattccagagaaagaaaattattgattgatagtgggctctgaagttgtgtgatgaggagatgagggcatcctgtaataaaaatgacgaatagagattacgctcaccttccctctgattgttgcatgttgttcactgttatgtaacattgtgttgcagcaagaaaagcaatgaggaatggcatatcccccattattattgataataccaacctccacgcctgggaaatgaagccctatgcagtcatggtaggaagaagtatcattctgaattttcagttatggacattttgtgagaaagttgaagcatctgttctttcctctttttctgatgttccatgatttcatatttgctaacagtggttctcccagggagaaggtaacgaggttttattttagtgtttctctgctgttcaatggctgaagtttgctgagatgctaatctcacttgaggatacaatttaaaaatagtccttggcaaatggtctttggtgtgaatccttgataacttttctgtcttaattactttcctacggcaaggcatacagagaagcacccaccgaaatgttcagatcaatactaatactgaattagatggcgctcgtagtggagctacaggtcacaacaggacggttctgcctctggtgagccgggaatttccacactgtgtgctgttgctccctgggagttccagggcaacagaatattttagtctaaagacagatttagggccaggtgtggtggctcacgcctgtaatcccagcaatttggggggccgaggtgggcggatcacttgagtccaggagttcgagaccagcctggccaccatggtgaaaacccatctctactaaaaatacaaaaatagccggggcatggtggcgggcgcctgtaatcctagctacttgggaggctgaggcaggagaatagcttgaacctgggaggcggaggttgcagtgacctgagatcacaccactgctctccagcctgggtgacaagagtgaaattccatctcaaaaaaagaaaattaaataaaaaataaaaacagatttaggattaacactgtaaccttattgagatggtagaatgcaaatataaataaaaacaactcagctctcattgtcagaatagcaaagaacagtacgatgcctgtaacagtgtgcacattatcctttaattgtgaagtctatttggtcttttttcatacatattccatctcttgtgataatgttttcattccctattgggtctagaaaggaggaaggatccagaaccataaaaatggggcaggaaggccgggtgcggtggctcatgcctgtaatcccagcactttgggaggctgaggcgggtggatcacgaggtcaggagattgagaccatcctgactaacacggtgaaaccccgtctctactaaaaaaaaaaaaatacaaaaattagccgggcgtggtggcaggcgcctgtagtcccagctactggggagtctgaggcaggagaatggcgtgaacccgggaggtggagcttgcagtgagctgagatcgtgccactgcactccagcctgggtgaaagagcgagactctgtctcaaaaaaaaaaaaaaaaaaaaaaaaaaaagggggcaggaagcagatagtggagtatcctcctcgcatcatgcagaatccctacctggttaattgtgaagtgaataggtccagactgggctcacgattttaggcttctttttacatctggggctaactggcatacttacaggtgtgcttttctctaatgatcttcatcagttccacttatgcccagattgtggggctttggtgaatgtaaggaagaatgagccccaaacttgtggttacttcagttcatgtctagtctacttgggcgagaaatgaacaggcacgtgaagagtcaattgaatgaaggccatcacttaaaaccaagacttaaggactaactgacagcctaagggaagtcattttactttttgttttgtttcgagagagagtctcgctctgtctcccaggctggagtgcagtggcacgatctcagctcactgcagcctctgcttcctagattcaagcaattctcgtgtgtcagccaccccagcagctgggattacaggcgtgtaccaccacgcctggctagtatttgtatttttagtagagacggggatttgccgtggtggccaggctggtctcaaactcctgagctgaagtgattcacccgcctcggcctcccaaagtgctgggattacaggtgtgagccaccgcgcccggcctcattttactttttatcttctggatatgtataatctttttcagccatcctcagctattaattcgacttagaaatgagaggtttccggttgtgttatttaaatccttcccagttgagaagcgcccatctcaagaatgaaaaggaaacctttttgcttagctctttccactctatgttttataaacacaataaattatagtgataatagaaaattcagtttgagataaagtagtagtcaatttatgaatgcaaagaatatttggatgtttataaggaaattataatagttttctaaactcaaggaaatggggcccagagcattgacccaaattgtattgcataatggggagagctacttttggaaggaagatgatgtgaagtatgtgactatcacttttatttcaccagttatgttcctatggtactcccactttctaaaggaaggcatgaggaataggacaaggcatctgacaagtaaatctacaaaaatcccataagtgactttgagacgtcactgagttcattcataccggtgttcaggacgttttaaactagctcagtcatctatttttaaagatgtccaaaacaaagaacctttacaaatttcctacatactagataaaattgagcaaaatttatcatggagaattatgagagtggctaagtatgggaatgaaacaactgcatttattgtgataaattaaggcattggattactggtaaaacaaaaggaattctgaaaagatttgtagtaaatgttaaatggcagcataaacattcccaaacatacatactatgtcttcaatgttttatgtacttttgaaaaatcaggcacttgaaaataactatgaagttatattccgagaacctgacactcgctggaaattcaacgttcaagagttagcaaggtacttctttgtttttctagttcctcattatgtatcctgctattttcaggtatttcagaccgaacaaaagaatcttttcaggctggaaatggacatggtagttttcaggccagaaatggtaattcttggaaattgataactttggaattattaatgtgaagactttagttttgggtcagttttctaatataatgctaaatgctaaatcttggcttggacttggtcctttaaaaggatgcatttaacattctgctaaaatgcttcttcatcaaggaacatttaaaagcactttatctgcatgggactgcacatgtcaatggtgtttttgcatttaggctaaagatctttagaggttgagcagtctgcgattcatttatgatctagatgctgcttctaatttataaagcaataaatgttcaaataatactaacttgttgattgaatgcatgggttcagatattctctgtctgtattatttgataatgtcattgacttaaaatagccagtgaggtaagaatttacttcttaggagtaaggctggttcctcttatggtaataggcagatagtgtcttcaaagtggatctgtggactactccatcagaattgcctcaggtggctattaaaatccgagttcatggaccccattcagtagttggaatctctggtaattatatttctaactatatccccagttgattcttctgcccactagaatttaagattgttttaataagtatctcctagaaatatatctcagggactgattaacataagtagatagatatatgcatgacattaacaggcaaatgtatgattttttaaaaatctcatggtgttcttttatgtcttgaagcacgtaattgagaggaccagaaacaaagcatttctgaagctttagctccttgctagcctcagggtggtttgggggtgtgcagggcagcatgaaaaacatgagtggaggctgaaagagaactgctgaacaagatgtttgttatgcttttgccagagctaggtcctgagaacagggactgcaatatctgcaatactagaggacttgtaaaatataagtaactcattgtggtatcctgccttaactaaatgcattttttttccatgtagaagaaacattcatggtgtctcaagagaaaaaatccaccgaatgaaagaacggtatgaacacgatgttacttttcacagtgtgcttcatgcagaaaagccaagcagaatgaacagaaaccaggacaggaataatgcattgccttccaacaatgccagatactggaattcctacacagagtttccaaaccggagggcccacggtggatttacaaatgagagctcctatcacagaaggggcggttgtcaccatggatattagaggcctatcttacagccaggcagaattttcctaagtcagtttctacttcagtttttgttattttttgttgcattttagtcagagctccaattccagtgtaaatagctgaactcaaaagtttctgagcaaagtcattatattcactttcttcaccaaaatttgttaaagtgcttctatatgcatggtctgatgctgggaattctgcagatttgagtaaacagtctctttctctagggtaagaatttgaaaccaaaacttgagaacacacccaagaatatatttacataggttcatagatgaaataaagtgtttatattatatataagcttcagtaccatttgctctgaagtgatctatttattttttcaggaaattcatctccatcggtaaagttgggaaggtggagagaagtggtgggggggcattgctacttatcaaagtgccattgctactttgataatctatgtatctaaaaatgtgagatgtgcgactcttatgatactgattttcctttaatgttaatatgccagaaagcatacatctaagggaacattgtccttcaaagtagacactttgggaagttatttctttattttaatgatgtatcattgttaaaaatgctgtcaaatccttaatagctacaggagctactgagggaaatcagtgtcattatttaaagtcacgccttgtgtttttactactttattcagcaggattaaacctgaataacttttggctgttgtgctaatagtgtaaataaaataagcctgccttcataaaacactaacttttaaaaggaataaacgacttctaaaattatgcctattaacatgtgtaattagtcggcagctcaaatgtttgggagtgcaagaaattaggcaccccaggatataggtcatacagggatatataaaagccatgctcattacaaaatgagcagttgatgttttatgtggcattaagacaatcaagtcctcacaactctggaatgtcttcttatactgatgctgaatttatgaatccaaattaatttccaacaggttggaatcagatttaatgtgagatcatgatagacaagaccacagaggacgtatgctctatttcttgttggccaacagcttctttctaatgttctgtgaaaaattattttaagtgtcttatataatggtgcttttatggttattaaaaattgtaaatggtatcacatttatatggatttgtcattggatctttttttggttcaacaataaaaaaatttaattacctaaatgccaagaaactcaacaatataccagtttttctgtatcacaggcttatttaccagtcttttttttaataaataggaatcgtaaaggtaatgacaaaagcagccttataatttagttgcttatatatttgatctgtgtacatgagactgttttaacgttatctgacactactgaaacctgctcgacatctccatgactaccaacaccatgtgtaatgttttcttcactaacattttaaaaactggtatctcctttgagtaagtttggctgacaatagtaaatcccaatgaatctaaggtgttatcagctttgctaacttctgtatctccaagcacaacataaaataatctcctaatgatctacttaataatgctcccattttccaggcccaggtagtcctgggtatcttggttgatagggtggtggcataaccagctcaatatggatggcttgactcgtctgggctggtagaggggagaaatgtcagagagctcaaagtggaaattaccatcctttgatttcacatgagcggttcaaaggaccagattcaagccctcctgacttggctggctccctgctttagggtttttggctcacttgggttaagtgagtgaccactatggagaagtggctctgggttacataacttttctagagctctaaagaatagtttcctggcctatttaatgtctcttctttccctagctgacccctgaaatatttggtttgtaaaccataaaaattgattaaatgccatcaactttatcccctgtagaagtgatctgtttttcaactcccatggcttctgatttgtgtaactctttgaacacccaatattgacttgtattgtgttcgctgtttgcatcattcatagaactggcaaatgctctttatgggcaatagggtctcattaaatgattgctgaataaataacacaaatttttaccattatcccttatgatgcagtatgttgactttgtagtcattaaattgtcacttttgaggggataatatgcacatatactcaagcttcatattttgtttcatgtagcttggatgttatttataatttataaaaaagtgtgcgcattacatatctatcaacataatgggtgttctacatgagaacagacaatagcagttgtaccaaggattcaaaaaagaaaaggttaaattcttgtaattttttctgttctcctgtttgaaacccaagttttattccttgttctagagtggatcactgcaaaattaggatgtgaaaaccaaactgttttagaaacaaaacaagtctcattaataagacttgcagaatacttaagttacagggagtagcaaaatagacaattttgttaatgctttttacagaacagaaaaatcatggctcagagttatggaaggaaacaagtcaattttttaaaagatttattcttggctttaaacgtatttataattagatttgaaaacatgatattatacagacatttaaggcattaaaacatctgatttaagaccttctccatgctattaactcccagttagaaatgttttatcccttttctctattaaacctaagaaagtaacaaatattggccgggcacagtggctcacgcctataatcccagcactttgggaggctgaggcagatggatcacctgacatcaggagtttgagaccagcttggccaacatggtaaaacccagtctctactaaaaatgcaaaaattagctgggcatggtggtgcgtccctgtaatcccagctactagggaggcttgaggtgggagaattacttgaacccgggaagtggaggctgcagtgagccaggatcatgccactgcactccagcatgggcgacaaagcaagactccatctccaaaaaaaaaaaaaaaggacgtaacaaatgagagtatcatcttaaattgaattaatcttctgcttttgtggtaagtttaaaagggcataggctctgggtcctgtgatagcgctaaaaataaagcaggcagaatcagtgccaatttgaaagcaagatattttctcaagtttgagtttggatgaccattttgttgaaaaaaaaaataaattaactatgaaatcttctgatttaaagtatttgaatttttagttgaagtaatttaatttcagagatcacactggaatagtaaaaaggaattagagttacactgagggttctatttttcttataatcatgctgacttaaggatgaagaattgctcaaaaggaaacaccactcttcatattcatcctgacttttgaacaggatggaactatagcagaaccaacatatttgcattaaggagaactatttcatagtgagttacctctaaaaaaaatcccctaaaatagtagctaaactaaaaggaattatctgcatcaaaataactgtactaagagacctcattccatttaatgacacaatctaaaagaaaatggtatgtttatttcacttgtaaaataatacttgtagtgatcaaatccaaagatttaaaagattttcttttccccttttttttttctttgtaaagatgggggtctccctatgttgcccaggctggtcttgaactcctggcctcaagcactcctcccacctcagcttctcaaagtgttgggattacaggcatgagccaccgagctcagccaaagatgtttttcttgattagttaataaattacatttagttttaagatatgcaactgaagcaaaagtataccaatacggaatcgggcaaaacgatttttgcccgatacacaaacgctgaggtaaatttgaaactaatttcttttctcattgtgcaacataagtactaatgtgtggtttgaaattatattccagtcttataaactggaaaggttaagcgtcaataatttattgtcgcctttgcaaatgcttagatatattttttagttgtaattgtgtcctgcttatttttctcacattcttccgtactggcctgggaactctcctgttctttgatcagagatgtagtacaacgtcgtttcagtctgagataatcttctgaactggtgggagcagtcctagtggattcactgacagatataaattgtttttctcctgttgaaccagacaaaagagcttgggtatttatcaatgcaagttcttcgtcagctattgaattactttccaaaagagaaatttcattgaattttttaaatggagtcatctgaggagaattcagttcttttttctttatgggtgtttcgtatttggtgccacaactccttggtggctgaaatgccttctgtgcagccggagaaacaaatgtacaaatgggactaacaggtggaggtaaaggcagtctactcaagaaatccaaggctcttctctttttgcagttcttttggtcatcaatctctttctcccctttacaagactttgaagtcatctgggctgagacaggtgtggaaacagacttccttttggccatacaaagtgataaaggactttgataatatatctcacaattaggagaagacatctgataaaaaaatgaaaacgtagcctatcataattatgtagtaacataaaaaactaaatcaaagtaacttttcattgaaaatatttaagcacgcaaatattacacacagtctccctcccctaactcctaataggttaggtgatttcagttcacattattcctattctagatgaaagtaattttacataagaacatataaaatgacatgaaaaggaaggaagatgaagaataatcacagtaaaagataaaaaaggaggtaggggacgtcacttatgctttaatcttttgttttttattattaacagattaaacaaagataaatattttaaagccatcttgagaacacacactatctgggttctaatacctacttttctagctttgtgaccttattaggcaattgcttaacctctctctatgccacagtctcctcatctacaaaatcaggataatagagtcaagtcctcacttaacataattgataggttctcggaaactgtgactttaagtcaaacaatgtatagcaggtctttgagcaatgtcatttaaatcttcaacatcattttgttagaacagtgatgagaaaaaaaaatggttttgttatacatcacttcccttaaaatcagtttccaaaaacctattgacaatgttaagtgaggacttaggttttatctcatagggttgttatgaggattaaatgagttaatatagatacccttagcaagtattagctatttaagaatcagccattagccaatgttaaagactttagcttgatttgcatctactgtgatttaaccacttaaatagcttagaaacagcttacaaacagcttagaaacaaccctaattgtatggaacagtgaaataaatggcaaaaaacacttttcaatcacatgtaaatgaaagcacctgtttggaaagtgtgcacccagagtttcatatcttgcttcaataaataaaatttctaaataactatacttacaggagccacataacaaccacattttctaattaagtttaattacattttaccatgtttactaggtatacaacagaatatacgatggcctccatatatacttcttataatattccttgagtttacattaacttaccagaagcttgtttcctgtaccaggaatgatttgagcagtgtacggccctgaagtacagtctttagttggggtggaccacttgggatcatttgcatgcagtatatgcataagcttgttttctgcttcattgcaaagtatgtcaatattctaagaaaataagtggaaaagctgctttataaattgcaaacccacatatttatgtttccaaaagtatttcctttaaaagcagaaatgaaaagtttggaccaaaaaagaatgaaaaaccctaaatgtgataccaattgtcaaacatgccgatgcaaaattacaaaaccagtatcagtgatttaggggaatctagctgatagggagaggggaacagagaaaaagtatgtgtatctgaaggaaagagatcttctctgtcatctagtttaatcagcaagctgtcatatgatctggattgaagctggaagattggggctcaagtcctagctctatttactacttaatagctgggaatcatctcacatctataaaggtacttctttggttagagaaaagaaagaattgcctcacctacctcacgtctgttccaagaattaattgaaatgatttataggttaaactacatgaaactgttgcttgagaaatcacaactggtcaaatatcagcaatttcatatggtttaacctaattcatgacagtattttgtaaaactttaaaatgctgtgtaaatgacagttgtctcttcagcaggattagtaaactgcctttgaagacgtctcagagaaaatgcgggctcggtggctcatgcctgtaaacccagtacttggggaggccaaggtgggcagatcacttgaggccaagagttcgagaccagactgcccaacatggtgaaaccatgtctctactaaaaatacaaaaattagctgggcgtggtggcacgcacctgtagtcccagctacttgggaggctaaggcacgagaatcgcttgagcccaggaggcagacactgcagtgatccgagattgtgctattgtactccagcctgggggtgacaaagcaagactctgtctctaaaaaaaaaaaaaaaaaaaaaaaaaaaagaaagaaagaaaaaaagaaaatgtggggtgtaaacagtagatatgctgtatgggaactaaataatgaatacaactcccacccctaatttagaaactagatatagcagagtgttattcattatgcatagagtctctaggtaaaatgtcaacacagctttctttatacagctactctaatgcttttaaaatatatttttatataaattctgaataacacacatttcaaatattaaactacagaattaagaggcttattttttgtgtattcttcactagttaccaactcatgaaatctcaaattttactgggaagcagcattgcatagcagttcctagtctgggttctgcattcgatggcctaagtatgaatcctagttttactaacttggcatttgacctaaggcaagccatttaacctgtttctcactgataaaatagaaaaacagttccctacctcataaggttgtgggagaattaaatgagaagcttagaacaaggtctgacacatagtaaacactcaataaacaccagctaatattatataatgtatatatagatttaagcagaaaatgcatacatgatctagggaaaataatatcagtgtctcttatctgggattaaatcaagtcaaagaaatataatctgtataaaacactagatatggagtttaaatgtaaacctgtagtctctatattattaactaatcacactgctgactgctgcaaaccacagataactcatattattcttgtaaccaatttccagtttgcttacaaagtctgcatttctgaacatccttctcacaatttctcctaactcatttcccttcaagtcattcttctctttctagttgctgtcatttccccattcccccatctcctgaggttcatgggcaattaatatatgattaaactttacctcacatactacctcaactatccaatttgtataaaagctatttccttgatactggactgtcaaaatagaaaaataccaaaatgtgtggtgatgctgaaaagtaaccttacctcaacagtatttttcattttgttgaatgtctcttgaaagtggccctcttttggactagcagaaaacacagaaaaatctccagcaaataaagtaagaaggcctgatttggattctggtcgccactggaggttgcttgcagcaattaacatatgaggcttaataatgtcctcattaaggtctatccaaaactttattgccagtaaattgtaacattcgtctgacaaatagacgaaaggggcaagtcctagaatggaaaaaaaagaaaagaatgttattatagatgtgttagatgaattttaagatgcaagaaaggaaactctaatatgcctatttattttggtatatgctaataataaaagcaaatcaaaatagctgaatttggcgaaagctcaggttttccaaaatgacctgttgcttacagtgctaaaatttcaataccaatatgacaacacattcttttactgaggtcatgtggaagcaggtatacgcacacattgctaacaggagtacagatttgtgcaagatttctggagataaatttggcaatacctagcaaagacacatatccatttacctttgcacccagtaatcccatttcttgtactcctctctgaagatagacctctaataatagtaaaatacacatgaacataaagttcatgaaaacacctatgaacaaggttactcactgaaacattataattataaaatattggaagcaacttttattagctcatatacaggatagagttggataaactgtggtacatccaaacaatggtgtaccacgtagctgtaaaaaaagagtgaggacgatttctatgaactgatctccaggacagtgttgagttaaaaaagaaaagcataaaagaaaggctagagtatgttccccttcttataaggaagaagggaatataagaaaatacacatgtatctgttcatttgagcaaaagaaatcaggaaggataaactcagaaactaaaggaacagggtgtgagtgggggaaaaaggaggattaggattgggactgcaaggataaggaggaagtgacatgaagtatatctttttgtacaggtctgactccctagaaccacagtgatacttcacatacccaataaaccaaccaacaaacaaatccaactagacatgagggaatccaaaatggaagacaaacatttcccacctctgtctgctgagagggcctggcagtactgatgcctccacagtaaagtaatgagcctatctagcaaccagatcttggatctaaacaccattttctactaaaaaaaagaagccaagagaaatggctgattccaagactagggcagggaacatataagatgaacttggaacatcttgtgatgtcaaaaaataaggaagtgttcaaaaagtgaagaaagctggttgaaagaacacacgagtccatatgagaaagctcctaatggtcaaagctaaaaaaaaaaagttaaacaataaaataatgaaggtaccaaattttaacctgcagaataaaataaatgttcttgagtccatactgatataaataaccaaataaatacattggtggaaagggcacagcttttccttatagaattccaattaatgtagaaggaaagaaagggagaaaaatcataattaggcaaataccacagtaatcattgttgcaaacaaaatcaactgatgaatgctagtttgatgtgaaataggattcagtctcaaagaatctccctcaagatatttattaactacaaagaaaaaggaagttattgtacagaggagaaacccagcagattatcaccttaatcaagtgattaagatcagtatcattaaccccttgatatgatgtactgagaaagacacatcatcacttcagtggtagtcttgccagaaatgcataacttcatcctagtcatgagaaaacatcagacgaactcaaattgaggggaatgctacaaaataattgatcagtctattcaaaaacataatgatcattatcagtctattcaaaagcataatgatcatgaaaaagaagacaggaagtattaaagactggtagaaaatacaggggaaaaatgactaaatgcaatttgggatcccagaacaaaaaaggggaaacagggtaaaataccttaaactcaaacaatttttcaaatacatctacagtatgggtaataattataccactattaactttctgattctaattgtactacggttatgcaagatgttaacattaggggaagctaggtgaggaatatttggaaattccacgatttttgcaacttgtttaaaggtctgaaattagttcaaaataaagagttataatttttttttttttttttgagacgcagtctcactctgtggcctaggctagggtgcagtggtgcaatcttgggtcaccgcagcccccgcctcccgggttcaagccatgttggccaggctggtcttgaactcctggcctcaagtgatctgcctgctttggcctcccaaagtgctgggattacaggcatgagccactgtgcctagccaagagttataaaattctaaagtgaaagatgggtaggtgctatccattctatcctgggataaaccaggatagaactgaggctaggaaagctggagttggaagaggcactaagcatttaattctactctttatactttattgtttttgttactctgagaattatgtatccgttgtaaataacagggaatggaaatgtcattctcagataaggatttgtttattctattgcaaatgatggttcatcttttctttcttttcatttcaaatttatttaatggatcttaattttaaacactgcttttaaagaaattataagtttctcaagcatgttccattttctaattttggaacttgcctctaattatattcaaaacttgatgatagtactgtccttctcccaaatgtcctttttaaatatatcttgttttccccaaatataaaatacatgtttattgaaaaacatttagaatacagaaaaataaaaagtaaacagtgtagtttcctcattgcacttttacgtaagtggaggtttccatgtctggatcaaattccatcaaaagaaatggaagccttatttctttaattatcatacaactgataacaactggaagaatttttagtgtaacacttttagaatcctacactaggtaaatcttcacaagacaaaaggaaaagaagaaacttattttgcagctttgtggtctggcctactctgaacttgcatagaattcttcaaagcttttaattccttttagaaaatgtcactgaaacaataaaggacttagcaatttataaaaccactgtcaccgattccacctg

SEQ ID NO: 257 - DNA, 613 bp, Homo sapiens
gcggccgctacagtgcgtcaacaggcgctgtaatccgagcgcataaacgaggggtccgggggtgggggcccggggcggccgtggcagtggcccggggctggcagcccgctttgaaaatctggcgaagtcggggagcctgcgtttgctttggcagctgcgaaggcgcacaggcacttgaaaataactatgaagttatattccgagaacctgacactcgctggaaattcaacgttcaagagttagcaagaagaaacattcatggtgtctcaagagaaaaaatccaccgaatgaaagaacggttggaatcagatttaatgtgagatcatgatagacaagaccacagaggacgtatgctctatttcttgttggccaacagcttctttctaatgttctgtgaaaaattattttaagtgtcttatataatggtgcttttatggttattaaaaattgtaaatggtatcacatttatatggatttgtcattggatctttttttggttcaacaataaaaaaatttaattacctaaatgccaagaaactcaacaatataccagtttttctgtatcacaggcttatttaccagtcttttttttaataaataggaatcgtaaagg

SEQ ID NO: 258 - protein, 105 aa, Homo sapiens
GRYSASTGAVIRAHKRGVRGWGPGAAVAVARGWQPALKIWRSRGACVCFGSCEGAQALENNYEVIFREPDTRWKFNVQELARRNIHGVSREKIHRMKERLESDLM

SEQ ID NO: 259 - DNA, 65047 bp, Mus musculus
  misc_feature (1)...(65047): n = A,T,C or G
tggtctgaaggacttgatgtttggggctaaagcaatgggggttgggggctggtttgttgtttatcttaggggttcatggtacattgtacaagtggacccttagatatctgttgaaataataaaaagaaaggattttgtgtaattcctcaagacgtttggacacttcatctggtcagtgagagtgaggtgttcatttcaagcaggaagatgctgtggtaagatttgcattccataaagataactgcagcaggctggaggacagtgggggggctaggcagtaggtaagactactacatagtctccgtgcatataatatacatttgcaaagggtttattaccctctctttgttctttagcggtttttagtctggtaggatttggaaacccgaaaaaataaaaacagttttggccctggctcagtaaaacctcagccagagcttgtcaccaccagtctgaagaaagctggtgtggcattcaggaggggtggactcgtaggtgagtgactaggtaggagtaatgaaagatgatccctggttttgttagtttgtttgtctgttttctggttttgttttagagacagagttttactctaactgtcctggaactcactctggagaccaggctggcctcaaactcacagagatccgcctgcctctgcctcccagagtgctgggattaaaggcgtgcgccactatgccctgtgattcctgtttttttgggaggtgagggggcagggagggactagttaagctgcttatgggggcaaaagaggggtcaggttcttccagttgcctttcaaattactattccatctgggtttcgattccctaacagccaggaaatcgtcatggtactgtttagtaaggtttaaggatcaagtgaaattacgaatgtcatacccttgacacagtctgaggtgcattccaagtactgaataaatattagttgttccttcaatgacaacagtattggtgaggtagtgggatggcggaggcttgagaaggagcagtttaaaccagttggaagtccagctcaggcccagtgagctgccacgagtgtgtgagtgacgtgtcaacccagcatgttggataggcatcacacgagaagcctggaaagaagagagaaagcaaagacttttgcataaagtctttttagatgtgtgtggtaaactctgtgagatttgggggcaggggaaggcggggtttaagagcagtgctggtggggtgttcatgtggaatggcaggtgcatttcggagctgggtgtggagacacacaactgtaatctcattcattccagagactatgacgaaagaagattgccatgagtttgaggccagcctgtgggtgcatagtggaatcctgtctttaaaaattacaaaaacagccctggtggtggtggtggcagggcttcaatcccagctcttgggaggcagaggcagtcagatctctgagtttgagcccattctggtttacaaagtgagagccatgacagccaggggtacacaggaaaccctgtctaaacaagcaaacaaacccccaaaattaaagaaatgaaatgacaaaaccacaccttggtgtggcaacacatgtattttaatctcagctcttggaaggcaggggcaagctgatctcagagtttaaggccagcctggcctgtatttcaagtttcaggacagccagggctacatagcaagaccctggcctgcccaccccgacaccaccagatgaattttggtcatcatcagaggagaatcccaagttcttacactagttggctctgattccttctctttttctgctttctggtcaccactctcccatcccccacttcccagctcaaatcctccttactatgcagaaatgtgcaacatttcccccatgcttcctgaactacagatccttccatatctgccttcttttaggccagaaggatggaagagctcttacttcataggttaacttaaaagtggtgccagccgggcagtggtgggcacgccttaaatcccagcacttggggtggggggggggcagaggcaggcagatttctgagtttgaagccagcctggtctacagagtgagtttcaggacagccagggctatacagagaaaccctgtctcaaaaaaaaaaattttttttaaataaaaataaaaaataaaaaagtggtgccaagtgaaaaattacacacgcacacacacacacacacacacttgcacataccttacacataggattgtaattgtagtgtcctccgggtctaagcttgactgatgaaggacctagaaagtttcagaaaacaaatctcctttagcttcccttaggcagcagaaacaggaaagatctgaggtcatgtaaacttttgggctggttggatccggaagatgagcgctattagcctaatgagttattcagaggaccttttagttctttactacagagtgacaaccccccttcaccccccttcggaagcccagtttgtgtgacctgaaaaaaccccaagtgttatagtttctatcttttagattgtttgatttctagagcaaagattccatctgttttgttcactgtaaattccccagatatgtaaaaaaaaaaatgtgtttgtgtgtgtgtgtgtgtgtgtacatgaaggaatgagcccaccagctttggtctgcctttctgcatatgtttgttcagagggaaacaaaagaatgtgttgtgacaagaggccctacagtatttgcaagcctttaagaagatactgtgggtgagaactgatggttgtctgagccagctgtttccacgtgagatactgtaattattcgcttttcacagttcacctccatagctgtggggtgtggtaagttctccaatggagagatgacctctgtgtcgtagttcagtgttaactgcatgacacacagggcataaccttgttcataggttactgaccacagcttcctacttactgggagagctccctgggagagcctctggcatctctgtgggggatgattgaggatctagacagaaatgtgtccagagaaggctggttattagatagttctattgccccagcctgggcgttttagaatgttacctcaacaggccatttccctcaggagaaaatttgtgagtgaaaatttggagttttttagtctgggcagaaatgagaagtagagacatatgcctagttctaggacagcctagagatagatagggtcctagagaaaccctatctatctaagaggcatggggggaggtttttgaaataatatggtacccaaaagtggactgtggtaaaaaagttgataaccaaattttgaggacccgtatattcttaggttaaaaaaaaaaagttgtacttcatgataataaagatttttatgttggctattagtaaatctgagaaaaacttacccatcccgtcagattttggccacaaagcctcaattaaacttaaaatttaattcttcatcagaatcgcccctcatcagttaaaccacgcacgtcgccatggctctgatcctgtggattaagtgtcctgacaccgccatgtttctcctctgtgtgacttcaatctttaaacttcagttttcaactcaagtctgcctgccagatctgtaagcctgtgccacgtggtcggtgctgagtgtgaaacaccacgaacagggtttctacctctggagagatgcaaatcttagaagccctcccagggaggagccgataatgattgaaagcagggtgactacataccccttggcttccagttcctcttcatttggtaccttggtgttttccacaataggaacttatgtcccattaaacatgtgtccctgttctgcccatagtcacccaccagccctttcttaggcccacactttccagtgcagcgcagcgcccatcctcctcaaagagacagtttgccggtctgtctgctcctctcccgtctgcccctccctgtggcggtaatatctgctaggcttgcttgtctgcatggcctgatctagagccctggcttaagcaagcatctggcatccgctgtccctggcaccttagcctctctccagcttgtcttcacccctgcactgcctttcctcagttctgggaattctttcagccgcccttctgccccttccttccccttagtccattctgtgtctacagagtgttctgacactgacctgagacagaattcatctaagaactgagacagcatcacacagttccaagctagtaagcgctctgaagtggtgcaagcctgtgttctcagtattataccaactagccatatttggctgtggcgctctgaaatgtgaccgccctgtgctgagaaatacaacagtgtaaaataggaaacccataaaaacctcagtaatttttatgttgattacatcttgaattggcaacatttttggttacattggatgaggtaaaaacactaaaataagacacttacccattctctttttttttttaaaacaagcacttaaaatgataggataggcttacatatttcttacctaaggtgtcctctgtcaagttgatgaggaaaactagccattttctgcagagtaggggatcactgatgcctgccctttgtaagtttagttggagggctgtgtagatgattgggccttagaaagataaaccctccctaaggaattggaggtggtgacacttgaagcagcaagggctgaggccagggaggtggatgggcctgctcttatgtgcctggctagtcttagtgagggtttcaatctggttaactcatgcattcctccaaaccctcaccattgacaagctttaacccagccccttgggtcgcgcacaggcaagctggtgggaacctgaagtgacttctgtgatttctctcgggcttctttttccccttcccagctttcctgctgaagtctcaggtctgctgaaggcccgatgtgctcctcagttccatgcttttaattctttcagggaagcctcacggtttaactccgtccgctccttctcttcttcctctcccacaccagtcgggaaaaaagacggtctaatattaatcccacagcagacaggacagttccactgaccccaggcctcccctcattgttctcagcagcgcacgttcttaaagattttcctatattgaagtttgcataaatgtctcacaagatgcattaatgtgccatcacaagctactaccgagagttcgcattattttatgtctgtcactatttgaaatctgataaaatatttagcacttataacatgtgtcaatccaaatgcttcatttactgagtggtttactgaaaggaatcctgccagaatagtacaaatggaacacttttatggtgcttcattttttcctaagcatgtttgagtatattgtacttaatatattgtgaaccagatcaccaaagggtttttttttgtgttgcagatagaaactttttccatgtgcagctttccatccccgccctcccagccccgacacacatctcctttctgtttcaatgcatttgacaactttaggcatctcgtttggaagatggggaatgtttgcagattgttttgccagccgcatgacctcagggttcttttgtgttgtagcatgtgacagaaattccttccttttttttttttttttttttttaatgacagaaaaatttcccatatggaatataccacattttgtttagccatttatgtgccaatggaattctggcttcctttacctctttggtgctttgcatgacatttctatgaccataagcgtgcaaatatcatccatcaggaatgcagttgatagatgaagtgtcagttctatttgtgacgtttgaagcccctcctgtttcccacagttggttgtaccaccctacagccctgccaacagcgcacactcccacctctctgcagcctccgcagcacttacagccttctgctctgttgggtcggagccatcctaatggacatgaggcaacacctttctggcttgatctcatctctgcagcaagtgactttgcatatcttgccatacttggtggccatctgtatatcattgtagaaagtgctttccagttctctatccacttctgagtacttggagttctgaatgcattttggatattaactccttggcagatctggtttgcaaatactggctctcaagttgcacagttgccttttcaccctaccggctgtttccatgggtgtgcagaagattttagcttggtgtgccccattggtcagccggtacctttgaggtcatgtttttcatgacgatttttccttgctcccccaacccaatccctggagttgtattgtgtcaggtcttacagtgaagtctttaatctatttggagtctatttttatatatgatataagattaaggtccataaaatacaatctcttagactgtagctgtagaagggagaagttctgaaatacatagactggtttcaacgccagatgggggtggttggtggcagggactgggctaggacatagctcccgaagagtgcatccctgtgtactgtgtttttttttttttgttttttttttttttttttttttggtttttcaagacagggtttctctgtgtagccctggctgtcctggacctcactttgtagaccaggctggcctcgaactcagaaatccgcctgcctttgcctcccgagtgctgggattagaggcgtgcgccaccaccgcccagcccctgtgtactgttttatagattcctttatcctttgtgtttcttatatggaagcaattgtctaggcttaacagaatctgaaataaaaccagtgaggaccagctagttataggagagccagtggtgtgccctgtgtccccgtgacgggtatgtaatgtgttctgtcagcatctgcatccttgtgcactgttggatggatttcagagcgagctgagcaggtctcgtgtgaagcatgcagtgactccaagcatttctctgattttagactttgtgcttccattatagatgagatagttaatatgcttaaatagactgattcagtttttattaaaaatagggataattagctggtcgtggtggcacacgcctctaatcccagcactcgggaggcagaggcaggcagatttctgagttcgaggacagcctggtctacaaagtgaggtccaggacagccagggctacacagagaaaccctgtcttgaaaaacaaacaaacaaacaaacaaaaaaagggataatttgtctgaaacggtggctcactcctttttttgggtattatatcacgtttggatgacttttctacctttgaggaaatataatagcatggatttgttttgcaaatataaattttttaagaaaacaataagtgtcaactgaatagagaacaggtatgtgttttggctcacaattctaggctacttcccatcatgacaagggagtcagagtggcagggcttgaggtgggtgaggatatttcacccatagccaggaagcagagtggtcagggtactcatgtgcatcccctttctttgtctttagtctaggcccaggatgcagtgctctcatctcaacaaacctaatttagacttgcctcccagatgagcctagaggccaacctagtggtggtttgcctaagtatggcccacagaggctcctgtatgtcctaatacttgatccctagttggtggaattgtttaggacagattgggaggtgtgccttgttggaggaggtgtgtcactgggaatgggcttaggtttcaaaagtccattccaggcccaatctcccccagccccccactctctgacgaaactttggaatcagatgtggactgtcaggtattgctccagagctgtacctgtcttcctgtctgccgtgcttcctgctgtgacgaccatggactcaccctctgaacttgttagcacatttcttttataaattccttagtcatggtgtctcctcgcagcaatagaaacataaataagacactagctagtccgtctgtaattatgccagaagttctttttctggtttattctaagcctgtcatgttgacaattattaatcaccacagtatggaaactatttatagaaaaaaatatgtatataaaatgtatttatttatagcagattatagtgacagtttaggaatttttaatttgggtttttaagatattttttttgttaactttattttacatatgtgagtacactgtccctctcttcagacacaccaaaagaaggcatcagatctcattatggatggttgtgagctaccatgtagttgctgggaattgaactcaggacctctggaagaacagtcagtgctctcagctgctgagccatctctccagctctagaatttttgtttctttaaaaaagcctcagaagtatataagaattgttttcgttttaatccgaggtgtggggtacggggctgctttagatggtccgcagcagctgatgctgatctgccttgggctctagcagctgtgtgaatctgccagctgcagatagtctctgtgattgtgtgacatttggaattctggggacttttcagagggtatataaatgctagggccctaagagttgtcggtgggttggtgttggttaagtagtcacatgtaaagaagatgaaagaagaaattaaatattctgaaggcaacaatcagacttgccccaggagctgggcaacccccatcagcaggaagtagtctaacaatagcattgcctcctttccgacctctgaccttattcaggtatctcttcgttttcctgcctagccttttttcactctatctaaggttaaggggttagagggctggaagaaagaaggaacaacaaagtagaaatcactgggtacttctgaggaatggcattttggagaatacaggggatgatgttatgtgtggtggtggacattttaagagatgaggcctaatgggtggtcttgaggtctattggagaaaagttttcgaagggattaccggtcttctgaaatccaccccaccctccacccccgtgagtttatgtgtgtacacacatgtattcttacacatccatgagcacgtatttctgtggttccaagagcatgctaccattcccatcgttgttgtggaagttctggggatcaaacttaggtccttggcaagacaagagctttgtagactgagctgtcctccctgctctggagtgggcttttttttttttttttaagacatcaagttgtcataacttatcataacttcaagttgtcacaacttcataacttgtcaagttgtcataacttcactctctcacagttgtgcctgtcattttctgtaagggaaattctgctcttctggagtaagagtgaaggagggaaggagacagacggacagagagggggagggagacagacagacagaaggggagagagagacagagagggagagagagaatgagaaagagactgagactccagaagaccagcaatctctcactattgtcatggtcttgactctctagatctataactgtgaaccaggcaaacctcttttcttcataaaggcagcctagttcaagcattttgttatacctctaacaaatgataatgaatacagatggccaaatcagagcactcttccccaccccccctttaaatgagtgagtgcgtaacgaatgcatatggaagtcacaggacagcctgaaggagttgattctctttttttttctttctgccaagtgagttctagggattgagatcaggaaaaaaatttttctttgagagtttcattagatgaacccttcccctccccataactcttcctgtatgctcattcactacatctccttttcaaattcatgtccttttctgtgatgatggtggtggtggtgatcgtgatgatgatgatgatgatgatgtagtagtagtagtagtagtagtagtagtagtagtagtagtagtagtagtagtagactctccctccctctgcagctgtggctgcctgtggctatttaagctggggtggggccttgtgactcctttagccatccatcatccatgtgtaggtagactggcaaggccttggcaggtcttgtgcaggtagccatggctggtgagagttcgtggatgcagattcctgttatggccagaagactcttgacagcagtcctcctggtcctctggtccttagactctttctgcctccctttcctgcgatgtcccctgagccttgggtgcaaggcttgtgttagagatgtcacctttggagatggacaccctacagccgcacattctgaattttgatcacttgtggtttctcatggtgacctccatttgcaacaaaaagatgtctcttcattgatgggtgagaacctcacagtcatgaaagcccttcagttcccaaaccagagaactcttacacaccacacccaactgtcaagtgatgttcataaggctaactgcttcccttccaaaatgtgcctgtgatcaagttccacagtgtgacgttagccttccagacttgacatgcttcaggttgctttcctgtggtttgagccagactgaagcttgtaactgaaggaggcaaaacggactgtaaggtagttcttacctctccaaatgtaccatggtgacactaacgcagacagccttgtgggagctgagatgaagctcagaaactgtgggtaaagagcagtcttaagtggaaataaatttcataattctgcaagtcccgtggtagctatgtaactgattatattttccttgctactgtggtggcattccacacccaattctgttattggatatttactgagtatgtagtatgttccaggctgtggtgagtgtggcagactgagatcaaggaagccatttataaagagaatgaacacactgagccaggagtgggtggtggcatgtgctgcttattacacaggtgagcacacttatggagcgttaatggcgaatttcacctgaaaggcggcgatgtgtcagatctccgccatctatttctagtggccaaagtctgtaagtttccttttggctgtttgtccttttcaccagggaaccctgtgagcagttctgccacagaaagtcgtccccggaagtcagctcagggccgtgtgcattctaccactgagccacacgtccagccccagccacattctcttccttctacacaccctgtcctggaggtattcccacacaggagaaatgattgaagagcaagcgtaggaaggaatgaagaaaagccaggcatctggggaaggcaattctagaggagttttagctttctcgaagataggcatttgtttagttgtgtctgtcagcatctcaaactcacttcctgttcttctcttctgaattaagaaaaacaaaaccccaccagttactaggggaacaaggaaaataacgttgtcagtccttgaatttgcagtttgttttgaagtttctcacttcttaaagctcatctctgtcacgtcatagaagctgcaatatgtaacttagtctgaaaattgatgtgcaaaacttttgagctctgctctctttgatgataaggatttagagtgtgatccatgactcatcagctgacgtcctggtgcagttttagaaacaaagggggtgatagtagacttccccagaggcagaagtaaatacaagaaaaacaagatgtcgccctaccgtgtcgatgtggttagagccgtgcgttgagtgattctgagaaaggcattaattccagatgcttccgtgattctgagtagacccaggaagaaatttgtctcctgtaaaaagattcacattagcagcaaactggctgcattttctccagttttaagtatgaagtaactttgccagtgaatgtgaggcttgtctacatatttatttatttaggtttattttacatatttgggtttgttttgtgtactcaccttaaaccaagcagatgaagcaatgatggagatagcacatcatgagggttctgggaactgtctcgtttcctttctttttgatgtggacaccttcttcacctgctttgtctttaattttaaccatgtatataaggatctagttcagctggtttatcttctattactttcagcgcacactcctttgtccctgctacaggatattacatgagaagtcgcacatagattcaggctcttttatatcccagcaggcttgtttgctgtgtgacatcttgcatatacatctctatatgtgtagatggttttttttttaaagatttattcatttgtttttctgtatatgagtacactgccctgccttcagacacctcagaagagggcatcagatcccattacagatggttgtgagccaccatgtggttgctgggaattgaactcaggacctctggaagagcagttaaccactgagccatctctccagccatgtgtagatattttaaaacatgttatcttataccttgatttaaataagctcaacattagttctaaactgcttattcaattgaattttcacttggaaatctcttaatttccaggttgcaactaaatggtattcgttaaaacaaaaccaaacaaaaccgcattcatctcttgattacatgtaggtgttaaccgtgtagagactgtctttgatggatacagacaggaatgactttgaattttaggggatggggtactggtcctggaaatccaaaccagtggtcttgggggctcaagggatgctgcctcacaggggcgacatccacagctctctcttggtcttctgaggcaaagtcttcctatatatatagcctatagtgacttgactcagtatagcccaggctagcctcacacttaagatccttctgccttagcctcctagggctgggattataggtgcatgccagtgcatggatgctctcttctgtttaaaggcagtgctgaagccaagggcgactgtacacacctgtaatctcagcactgtgctctcgagcactcaggaggctgaggtacgaggatcaccaaggtcaaagctaaggccagcctgaactgtgcaggaaagggtgaggaatgccaagcacaaaatgaatttcattcgtttgtataactcagaagaaattgggatattatatatacacagtgcaatcaatcatgggagaaaatacctactttggccatgttttaaactcttctaaaaagccagatttttagagaatactatagtataaactgtgcctaacttaaaatttgcctgtttggcactactgattgctagctgaagaatgccttagtgtggtttacagggctcaccagctctgcacattacctcctctgcattaatgcttgtcaagggcactcggggtatgtttgtgttgtagaactgttgactgcatctgttttgtacattttagaaggtggtctttctactgaattcaatcagaatagaacgtcagccctggaggggagtgaatgtcttcagaaatgtacaagtgtcgttccagagggtttgggcatctccagggctccacagacatggatggatgggtggatggagttgtctaactgccagtctttttttttttttttttttttttttttttttttgagtttttcaaaacagggtttctctgtgtatccctggctgtcttggagctcactctatagaccaggctggcctcaaactcagaaatccacctgcctctgcctcccgagtgctgggattaaaggcgtgcgtcaccacgcccggcctaactgccggtattaatcataataggaatcaccgtttccatgatttctgcattgctgttggtcagctggaggctttccatctccctcagctgtcagaggcatcccatgcgggcagtactctgcaccatggactgggaggactgggaggcagtctgtagttcccacagggtacagtgactgcctgtgtttagaaaccagaacggctttaccacaagccccctttcctctgcactgcagcgggctatgtgagaaggaaaggctttgatagactcttaactgtctttccttccagctggaaagggcattgctagctagtgaagaggtaggctccgcgtggaacatctgcatctggctgcttaaactcggaacagggtgatttcacccgggcagtggtagtgcacacctttaatcccagcactctgctctctgagagcccgtacaaccagggctacacagtgaaccctgtcttagaaaactttaaaagaaagaaaggggaagaagaagagaaggaggagagggaaagagggaatggaaaagtaagaggaggaggaggagagcttcagtttattaagcaaaagaaattcagaatggttatttagttcaaatccagtatcctgcctggacatagtggcacatacctggaatgctagcattggagaactggagacaggaggatcagagttcaaggccagccttggctacatagtcagtttaagggcagctgtcctgggaactcactctgtagacatatatattatgtttttatacataaaacattcatattatatatttattaatatatcaaattatcaatatattttaccattaatcacattgatatgtgtgttaatcatattaatataatttaataataatattgagttaatattaaaatgtattttatatatagttttttaaagagggaggaggaggaggaagtaaaagttttatggcaagggagggtgtgtgttctctcattatctgtgtcagggcatcgttgccttcttaatgctctgcctcagcccactgcctgactttgagctggtgttgggagggtgcgcagggagggagagaagctgattggctgtggctgaggctgtcagcaagggctgacttccctttcctcagaccctgcttgcagcccttcagtgagatgcacaccagtgtggaactgtgttttatatggagttttcaaaaaagacttctcctcaccaattcagtagaaaatggcagcacaggagctagctagtgccaggagaggcccaccaacatcttagatgttggccttctgtcaaggcctccttccctgcctttccccctcttctcttctcttctcttctcttctcttctcttctcttctcttctcttctcttctcttccttctcagttagtttgtgaagcaatagaatttttcatggttttgtcgtgaagtaatccagcaatagagcctgggtaatggagcatcataggtgatttcttttcaaaagaaactcagtgggcttgtagtgttacagatccattgtagacaggcagtggcgaggaagagctctgtctctgctcatagtatgttcttgttcccattcttaattacggaacattcttgccgtgtccagtgacgttatgatgagtgagatttgtgcgctgtttataaggtcaggactttgactgagcccttgccagcctgcttccttggtgtgtgcggcttcccagaagcctaagcttacgctgtgtagcttttctgtcttagccttcgtctgtggcgtgtggcgtgtgggtcaaactgttactcagctgttacgtgaaaaggggaagacccaacacaaggaagcagttgctcttgccagttgtgtagtgtgtagggttggactgtgcacccctcagctgggagcgtctgcaccatgcagcccactagctgagctgtgttgcaggtaactgtgccagaggtggtggtggtgtttttgttttgttttgttttgttttgttttgttttgttttgttttgttttgttttgtttttaaagaaaacttaggcaagttggctatttgtaaagtggcgctaataaaatgtctgtattaaagttcagttgggtatctgctctcacttggagggagtacagtgactgtagtagttttttttttttcttttgttttttctttactgaattaaagtttgtcattggatagtgtaatgccatcaggttagtcagcaggcatttcttaaaactgtgttcaatcattggcgtttgtgtagaagaaaaataaaatctacttattgaggggtgaactgcccactggcacgttatatgggtagctgcgtgaaaagagaggtctgggtctgtgtaacctgctgtcgtctctctttcttggttatggggcagatggtactttattaatttggacagtcacccactgggttctgtaatgacattggttacgtaaggccacactgagaatggccataatgcattcaagagtgattcactcttagttttaggacactctgctgccttgctcaggatatgtggtcttaccaaggtgctttttaattttaaggctgacattaagtccttaccttatttcctcagaacgtatttaaaattagtcgcttgaattctaagagagctgtgttggagaaggtgtcagttcttgcaatgtaggaagtaggaatagcacttctaagagagactgacgacagtgtcctgctcatcgggcgggtttcaggtttttgtcacaggtctgagttatgagtgaagcaagccatagattgttggtggtgtaagtagtgagagatcagcagagaggaaagttattctggtgctagttccccgaggaacagtgctaaaatttggcaacataattttttaatgaggtgctaaatggaagtatagtttcagtcacatgacttgaaaagtaccacaaagtttatatctaagtacttaaaagttatagtagggctggaaagatggtgaagagcactggctcttcttccagaggacctaggtttgtttcccagaacccacctggcagctcacagccatctgtaactccaggtccagggtgtccgacaccctcttctggcctctgcaggcaccaggcactccccagggacatagacacacacgcaggcaaacatccacaaatgtaaaacaaacaagcacaacttttaaagtccttaaggagctttttaaagttttaaaattataatttctctttttgctgtatattttataaggctttatttattgtactttattctttataactatattctgttattccttaacaaaaatatccaactcaaaaagtaaccaaaatatcagttgctcacctgcagtttacacagtggctaaagtttaaaagactgacaacatcgaatgttggctaagaatgtgagcttatctttggaaatgtaaaactctctggggacaggtcttatgactgcttaggagactaagcatatgccctgtgactcaacccttccactttgaagtattcacccaagagaaaggaaaatataggttcatggaagctcttgttcataatcaccaaaaatggaaacagtccagttgtgtttctgtaaggagcatattgtcacggggaactcctaagcggctggagggaacactgatatatgtcagaaataggcggatctcaaacattcgcagagctgggaatgctgggggtgtggttaatcccggtcctctgagttcaagttcaacctggcctgcgtatgagttccaggctagccaaggctactaagtgtgaccctgactgaaagaaaaataactcaaaaaaacacatgaacaaaaatctttgctgaatagaagaactactgaaaagaaagaatattcagtgttcatgattaccttcgaatggccacactcacctataaagagacaccagagacttccaggttgctggaaaaggtttggaagctgtgatctgacagggaacttaaatgacagtaaagcgtggttgtgggtgactcccccggtggacacatgggaaacctggggcagcctgtctcagagctccagtcaaggcaccagaccctggctccctagctgccacctcagtaacctgtgccaccctctctgaaggttcagatcaaggtagcttgctgtgtgttgaaattcctcacgataggctgtttgggaatattactgggcccattttctcatgaagggtttgttattttctacgctttgactctttgcctcgctgatctttatcctcagcacgtgaacttgtgcctgtctgaggactgttgagaatctatctctcctgctaattatataacattatcagctacctgagaaggtgcatcacagagcaatgtcgcctttccttgggccgatcatagttcccaccctgaggccgtcagccatagcctacatcacgtggcctctcctcctctgtatcacctcctcctgtggcgtggctttctttactgacagggaggaggacgggaactctgggaagtttcccaatttcaggtcccccggacatggactcagggatcagactggccagggtttgagtcactttcagcctgacctttaacctctcagccctctcttcctctgtaaaatgatggtgcttctccagagggcttgttcatggcagtgataacatgaagcggtgcttgtggagtagttggtaatagtgaggggttcctcacgtcactggaagtggggtctgagttgctggagaaagtagaaagatggaatgtttttaaatgaaaatgtgtgtggggtgtgtgtgtgtgtgtgtgtgtgtgtgtgtgtgtgtgagtgactgtgctcctggaacagcacctgggaagtctccagtcttctctgaggattttgaccagtaggctaccacagaaagagttcggtatggtgaagcctggtatttcaagtggtgcttgggaaggagcctggctcggtgtccactgttcaacaccttgcctccagccacagtcctcagtttcatttttacagccttctctcttccgtgcttctgggaaagttaacatcgggccctgttttggaagtaaccaaggtttaacccactaaagtttcacgtgctccttgctactgagattggttcaagttgtcttaaacttaagacatgtcccaagccaaactgcagagtcagcaagccatgattctgggtatttgcatattgtggaggctgagcaaggggctctgtactctcccaaaactactgcagcagctgccacccacagtttgaccacacatgtacccaactcagaggaggcagggctgtctgagtcagccacacctgtcctattggccacttttactcagttttctggcatatgaggcggagtgagaatcctacacccacttaatcaccaggcagtctgccgtctcctgcattgctcaagactccctcacgcactaacactactgtatgcctctgtttctctgcccagatgctctgctcctctaagtggttagtctggtggccaacattatccagtgtttgaactatagctagtaccaactggactgtgacataaacagagtagtgtggtgttggggagatggctcagcaggtaagagcacgtgtttttacagagggcctgggttcatccaggcttccatatagtggtttattaccatccatagccctggtttcagggtacctaacaggtactcacatgatgcgcatacatacatgcaggcaatacattcatatacataagattaaaaaattaataattctagctaggtagtggtagcgtacacctttaatcccagcacttgggaggcacaggcaggtgaatctctgtgagttcgaggccagcctggtctacagagtgagttccagaacagccagggctgcacagagaaaccctgtcttaaacaaacaaacaaatctataaaaaatttaaataaatattggatttcagggtccaagcatgaagaaagtattatgatagttcagtattcgttttacatggtgactacatggtaactgatactttcggatttattagattaaagtatcgctacatattgtagtggataccatctgtttctccttaatgtggctactgaaaaatttaagttgtatgtgcctcacattatctttctgttgtgtcactgactaattaaagtctctgtaccagactagtctctgtgagggcagggactatttgtttagccaaagtaaccctatctcttaagcttggtgcccagcctgcagcatataatcaacaaatatttgttgaatgagctgtgagtgttctggtggcttaatctctgtacctgccatgtaccgtgctagttaactgataggaagaaacaagataaagtggttttaagaacatattccatgctatgtgttcttcttcctgacgtttccatggaaacagtacccaaaagattgccaggatttctgtagtagtcttcagatggcattttctccatttaaccaaatgcatgaaagtttaaatgtttggataggaggtgtttcttgggtttgaagtccaaattatagcactctgctttgaaaaaaaaaaaaggtgttaaatgctcacattctccctatatttatggaaatttttctattaaaataattttcattgttttaattttattggcttatgttaattatataataattggttttgttatgatgttttatgtgtatatttaacatattttgatgctcttcgagccccttagcttgtcaccccatccacacccacaccgattggtccccttccctgtcagttttcctcctacttgcatgtcttctgcttgttcgtgaccaatgggcttcctgcaggctgcgtccctaagcccacgctgggatacttacaggggcttgagcccactctgatatctgaggccctgaaaatgtctgactggctcccattaaccactgactgcccgtatgtcctcaaagaggagggtaggaacctgtgagccccctttccctccatcctgaaatatcgagggacccaagtgtgtagggcttgtcagataatcatcacactgctgtgggttcaagaggacggcactcctagcatgcccggatacagtgttccacaccactcagcccttcctcggctcttacagcttcctgcagtgtccctgaggcatggaggtttgggtggaagtcctgtttagaaccatgctctgtccagtccgtgggttcattctgatcagttagctgtctctgcagtcgcagccacccattgtagcttctctgacccagaccacaagtaccactggtctgattcttggctctgcagcgtctcatctttcaggcccttatggcaggtgggtgctcttccagacccgctgccacctagttctgaggcttcggacagaaacagcttacgacaggaactatgttggcttatgataggcgacccttcatttttcacggtccaggggacagagccagtttagattatggcaggcccagagtgtggctgagactattcatgtcacaaccaaccaggaagcagagaacacccaaaacaaggactgcctacttctatttgatgactttatggcttctagtttttcttttatcactgtttgtaaatacacattgccagttgaccgttatataattgaatgtttgttagaaacacaaattcagattgctttgagagtgctaggagagatcaaggtcctggtttgtagccatttatgtgtataacctggggccactaacctgaaaagaccaggcgagaatctagatgctgagtggccgtagatgatgggtttgttttaaatgaggaaacacagtcttgctttaggtctctgtgggcaaagcctagggagaaagccctaagcccggttaaaacctttcttttcagtccctattgtagctcaaaaactttgtgcctcgaggcaagtacaagggaatgtttttaagaagattttggagaaaccgatccgatttgagctgctacccagctttatgctcattcagattggttttgctgtctgactgcagaaaccgctgttgaattttgtggttgtcaaaggggccagagatagctcaacggttaagagcactgtctcctcttggcagaggacccagatttaattcccagcacccacatggtgtcaggaagccatttgtaacttcagtgtgcaatgctcttttctggcctactaatgggacacagagatacatgcaggcaaagcatgcacacacatattatttaaataagcaacgtcaatgtccttctggcattctggcctttgtacaaataggagtatgtggtttcttctgaaagcctgtcacccaggtgctaacagtataaaagaaataatttgcctgtgggtctgccatccagttatttatgcaaaatatatacttatatatgtatatgcaagtagtacatatgtgtgtataaagcataccatgtgcaatctctgagtattgtttgattagcatgtgtgtgtgtgtgtgtgtgtgtgtctcgcaatcactgaaatcagactcccctgatttgagtcccattttcatcagctacagctttggggtctttgcaaactgcctactgtttcttacagtttcttcatctgatcagtaaggaagaaggcaacagtgatcccaacttggtgtcatcatgtgggttaaacctgtaaccccatctcgtctcatcaggcctgtcacacagtgaacagtcagtaactgttatctcccggaatccactcctttgagagcttccccaggagggtagggacctagtcccctgttggtcgcacaggtagaggtggagctgtgttccccctggtcaagcttcttcatgtatcacatgtcccatcatgcctctgcatggaatatgatcttcactattgcgtaaggcagagcgcaccccaggagacttaaaccagccagcatgcatccacacacggcactcaaggggatgccccagattcccgcacagtaagctaagctagtgagtgtctgctgtgtcacagggaggctaagggattttaatgccattgtcagaggagtagttttcacaaccggtgtcctcattttcctttgtttcttttcctctgtgggcaggcgctcagggtctttatgctgctcgcctcccctgccctctttgttggaaaaacagatctttcccatatgcaataaaaacaggaagcagaaagtcctccacacggccttgaagggatcgacactgtcggcttttacttctaacagatctgtctgtgtcaaaaacaaagtgaagggtaaaggtagaaaccgagagaggcctcctgaagcagccatccaagcagcgatgaggctagggagccgcgctggacagagctgcaacgacgagaagtgactcaatttcaaatacacgtaaggcaatttcagcaccatttgctgctgaggaggatgggatctgccgatggcagaaaagtcgaggtgactccaggattcttgccctacgcaactggaaaggtagaaattgagtgacagagacttgaaagagcaggtttaagggtggtgctcaggtttagacctgggacgctgacgctcgctggctagacagctcaccaacgagtgaatctgactggaattcaggggccgggtgtacaaactgcgtgaatgagcattagactggaaaagtccccggcaggagagtagataaataagctttgtcccccgttgggatgcttcccagtgagaagtccttagaggtaaagagaaagccaggaagagcgactggagagaaatgaggagcatgcgactcggagagaccaggcgcaagggtttcatgcaggaggacatagtcagttgtgtcgagtcttgcagacaaggccagtcaaataagattaggactgggaattaagcagtggatttagcaacgtggaattcactggtgaccttgacacagagtttcgatggggaaagcgacagctcctgaagtataaagttcaagagggagacgcaggagagcagccagggcagaggcagttctgtgagaaactgcaccatttggggtaggcagaaatcacgcactctgggaggaaatgagagtatgagaggtgccgacctctaatccctttgccgtcctcatcccctccacagcacggactccccctcatataaagctttattacatatatctctggatactcttagggcctcctgtttaatatcctatccccctggctaactctcttcaatttcttcacatgaagaaagttcatgtctcagtaacttcgaaaatgaaagtattcttccttaagggttaccctcccctgcatgtaagagtcccattctacccaaggggttccccaccagctatcacagtggttagcttgggggttgtgattgccatagtgtggacagaagctgaacagctacatcccccccacccccatccccatcccctgcgttttctcctcagttctgctggcattcttagaccataatgttttgtttcttgagttacctattactctttcgtgagcgctgaccagttacttcctgtgaacaaactaaaaacaaaacaggcaaaagtacaaccaaccaaccaaaaaacacctaaaataaccaggccagagtaaaaagaatttatattatacaaactaccctcttgatcagtggttcccaacctgtggcttgcaactcctttgggatatttgcattactgttcatagcagtagcaaaattgaaaatttatggttgagggccaccaccacatgagaactatattaaagggtcctagcatcgagaaagttgagagccattactctagatagtaagcacaattttgattcctgtgagcaatgtatggtttgtttgtttgttccgaaatgtttcaatccctgttacctttgtgttgatatctgtaaattttacctttgaaaagtatttttttctgggggctggaaagtcgggtcaaagcaccggctgcctttgcagaggacccgtgttcattccagcactcccagggcagctcttagccatttgtaactccagttccaagggaatccaataccgtcttctggcctgagccaacacagcaattacacgcagtgnnnnnnnnnnnnnnnnnnnnnnnnnnnnnnnnnncttggccttttgtttgtttgtttcagtcaaaaaaaaaaaatgttaacccagttccctcctgactaccctatccaaagctagctgccctttaggcctccgttccccttgcttttgtgtgatctgtatggcttgagtttacagcatttaaaatacaaagctgagatacggttccgtggttagaacataggcgtattgcgtcatgaatcactgagcgtgcaccagcactgagaaagtgaggccacacgcgtgttatttatgggcaccagtaccccacccacccaatgtaaacaacacagacacagcccgacagagctttttgtttttttaaacctttatcactagtgagccagaaggcccacgagagtctgcgctggtttgttggggaagaggtggtttgagcaggtctgtcttttccgggctcaaattggccttgaacttatagtccttcccctgagccatccagtgccggcactgttggtgcgcaccaccaggacagacttcataagtcctgaacgagtgggaggaagagaggggaacgaaagagactggagtcgagacaaatattttgctttgaatatattttgtttatgaaagttacctagcagagctgtcaaaaaaacagtaaattggcgtagtcatttgtgaactaacaacataaaacctggaggcttgaacgggttctgaaaattgggaaattaatgtaattggttgcatccagcctctctgtgtttctggtctgacagcaaacggtctatttccagtcatggagcattagtcatgtgtattttaaagggatgttgtgtctgtggcgtgtctgcatggatgctgaactgtgacaacactgtagacgctggctgctccctttactcatccgaaggcccaaacacaggtcattcagaggaagcactaggcctgcggggtccctgacccgagccccatggctgttgtggggaatcaaggtgatgcctttgaagtctggcccaaagccgtttgatcagatgagtctcatctacagtaagctataatgggagcaaactgagtctgttgtttcaattgtcactgagtcagtctgagagctgcggtgtttaagttggcatcttgtctgtagtgagggtaatgaaggcttaacctaactgattaaactgagactgcccccctgagcccatcctggcaggttacttccacctagataggcagctactttacaggtgtcgtaggatggggctggccaggcctcatggcgcaaagctaggagtcctgtgtgaacctcctggtcacccatctggtgggacagcacaactgcccagctctctgtcaccttctcccatcagtgctaccttagccctgaggggctctacaccagtgacacagtactccacagttatctcatgtcacgacaccatgacaccatgacaccatctctgcctcacagggccggcggaggtttgcagagctgagtttttgaacctagggccctaactcaaatcattacttttttgatgacctttcctgccttgtgcaattttgagtaaaaattataggaagtagacatcgagacaggccttaaataatttgtcagctatctgaagataatttttaaaggatttcttctaggagttaagcatttgaaagctttcatctgctaaaagaaagtaggcgattatttgattaaaaattgaaccctcacctttgagtgtcttataaagcagcatttaatacctgtctatcacctcagcagataacggcaataaaaccaaggcaggggataccacagttcccttcccccgccccactgtatattatgggatgctagtgaggctgtggcattgtctgagatgtgaggaatgccactgttcagcaggatggcaaggcatgccctgggaaggagccatgtgctgtgggcttctctgcaattgcattctttccacagagactttttgtatatgtttgcagtttgtttttgcattttaaagacgggatctagtatatagaagactggtctcaagcttgatatgtagctgagtttgaactttaataacccaatcggggctggaaagacagtcctggaactaagagcacttgctgctgcttctgcagaggacacagatgagttcccagcacacacgtgatggctaacagctcaagggggatccagagcctcctcgcagcaggcagtgtgtgctgtacatgtgtacatgcaggcaaaaatctcagatacataaaataataaatgcaatctttaaaaaaaaaaaagaaagaaagaagatgctaagcacttgtgaattaaattgctgtggagtgggccggtaagatggctcaaggggctcgtggatgacaaccagccgatgactcgagttcagttcctacccaaagctggaaggaaagacccattctggaatgctcctgaccctccacacgtgctcctgcacgcacgcagtaatggtagtgatacataaaattaaagttatttaactcgccgtggctatgcgtgtgtgtgtgtgtgtgtgtgtgtgtgtgtgtgtgtgtgtgtgtgtgtgtatgaccaataactagttagtcccggctactggttaaagacaggaagccagggcatcagggaacgttacctagagtatcctgcagtggatggtagatgagtgtggcgatgaaggagcgcactgtggagtgacctggtggccaggttggcatagagttctgggctttaatttcacagtgtctagcattttgtttgttcagcttactaattttgtagatttttaaataggggtacatctaatgacaagtaataacttaaaaattagtcaaaagtgattctccagacacttgaaatgattccctgctattgctgagaggggcaggagatgagtagctagctggatgcactgaagtagttacagaggcgaggaaaccgtgaatgtggaactattgaaacttacttttgatggtttcctagctcttggtgttgtgtgttaggaaagaaaggttgatgaagaatagaatttatgggaagctcccatgtgacatgctacctataaaggacctgcccgccatcttccactatcaccatgctgaaaaccagagctttgcctcgtgggcctgttggggacacttaagacctgacctgtagcaggcagggctcatcccgacattttactctgttcagtttttattcttttcaaaagatgcctctgaaaatccatgggctgtgtccattccttcttatcgccgagtggtatcccaaggtacagctgtgtcactgtttggtggctggttagctgtacagggtctgtgggtccgtcccttcagctgccctccttctgagtggggccatttcagcattcttgggcagatttttgtgggaagcaagattttttggcttctttgagatgatgcacggggctggaggtgctgtgacctatgggagctgggaagtttctgtcttggtttttgtttggttttttttattcagctgaacttgcagagtgggtgaagagattttgaggtcaaacagttccacaaccagtgcttcctgagaggcagcggtcagaggtgacggccatgggaaccataaggagagattggtgctggcatcatggagaaccttttgcttagccgtggagctaaaggagcagtgtttgctctttgtaagttagttgctgggtcagctccattgctctgtggaggcacaagcatacagtttcctcatgtgacacatagtcacatatttcaaactcctgtaagatttctattagcgtatagtatgtgccaagaagcgggaatgggagagctcactgctgtttagcagaactgctaggcgccaggctcctaggtggttatgtttacagccatagacaactgctgctcctacccttagtcggagaagcttcccttgacgatgagagccagtgaatgcagaagaacatggctgttcaagatgctgagagtaagtgacggctgagtggcagtcccaaatggcatttataccaccctcacttaacgggacatcacagaggagcaaggaggagggctgggaaacgccgtcttcctcaggacacagccagggctgcagtggtttccccccggtgctgtgacttccttcaataggcctgtcagcagtcagccgtactgcctgttggctcctgagcgattctgggggagccacagctggtgtctttgtgtgctcactgatgaaccgcccagcctccagtggatagatccaagcacaggtgaccccagatcagtggatcgaaaaatgaagcaaaaagacacgaatgtgggaaagggactagcagagaggtatgggaacaagaggtgagagggggataaaagggtgggagagggcagccaggacgcctgagattctcaacagacttaaaaattaccaactatggagaaattttaaagagacaaataatatacataagcaaacacaccttataaaaagagttacaaatgagggtgtgtaaagaggttgtaagagctgatggggaaggagtcgccggagagctggcagggttccagagaggggacttcacagaggacgagagagagagagagagagagagagagagagagagagagagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagagagggagagagggagagggtatgctcaaatgcccgccttggtgagtcagagggaccacagatgttgccagcgcttgtgtatgtgcaccgtgtgtgcttgcagaggccggaagagggagcctgaggctgaggccttgggagccagcatgtgagtggtgggaacagaatccgggtccttggcaagagcagaaaggctcttaaccaccgttccatctcaccagcccgagcttgttgttgcacctactcgcttttgtgggaactaaccagggtcttatgaggttgcgtccagttcttgccagcgtatatcttcagtgacttgaacacttctgttaggcaccttcccagcaccatcatgctgggaccaagatcccggcgctagggcctttaggggacacccagacacacaaggcttaaccctgaggtgtgtgtaaagctcatagtggactctgacagaaaggagggaaagaccctgttaggctgccgatgggggagcaatagggattggaaagtagggccaggcctgccttgcactgcacagaactcacctcaggaaatccttctcctgctgaaatcatttagttcaccattcaccatttggaagcgaggaagaactcgggatttcttctcttactaattgtaagttgttagcattgagcaaagggcaggctggttctgcagttttgtcgtattaataactaatgcttttgaacacgtgtgatgttctttctataggccactgtcacccgctgacagacacagaaggtctcaagtctgctcagtgaccagcaaggacttgaccccccccccaggcccgctccgggtctgtgttcctaattagtgctgcaagttcaaatgagcgtttatttcgtggcagcaaaggcatgttttgtgggcggagataatgtagttgttattatgttaattttccttatgaaaagattttgtgataaaacgaaaataaagaactaaaaatagttagagacttagggaacagctaaaacataatagtcttaagatacgtgttgtcttagtcattatgtgggaggttagcagtaccatatattttcttgtggaaaagaaaacttagaataaacgctgtcacatcagaggagagcagaggatatgagagttttcttgcaaatgaggtgggaaacaagaggctgcaggaaggaattctgggttagcgctgttgctttcctcctgtcacctcctgcatccttcactggcagaacaactgccgtgttcaaaggatggagaccaggacccatgagccaccacaggaaggacttgcagtcagaactaaggggaggcacggttgtcagtttatctgtggttgggtcaagctgtcctgcctaaatcctgctcccaatcatggccattcttgttaaatcccttagaattaattgatacttgtttttatttgctgagctaggtgtatttgagatatggtcttcctctgtagtccaggctggccttgaacttgcctcagtctcccaagtggtgggattatgagtgtgcaccactctgctcaatttttatgttgtttttaaaatgactacgctacgtaaaatatcagtcactgggcaagcgagatggttgagcaggcgaaggagtctgcctccaagcttggaaacctgaagtcaatccccagattccacatgctgagagaaaactgactcccacagctctccgatctctacatgtgctggacacacagacacacacttatgcacacactaaataaataaatagcaagtgctggcacgtggtttggagcacagggaatccacgtggcactaccctttctgttctccggaaggggctctcagttttggagttcccaagtgcatttcgtacctgagatgctttgcctgtttgccgtctcctggctgtgcgctgtgccccgtggccactctgcctgtgtgactatgtggcatgcttctctcccgagatgcccttatcccacacccacatccctgctctgcctgatgcttccagtcacgactcagcagtacagtttttatggttttttggttttggttgctttttttttttctccttttaaaaatatccccaaccacaaacacaatcaaatggcagtttttcactctctcctactttgttatcctatcctgcctttgacttcacgccttagagcactcatcccgtgcagttttatgatccgctctgtaattgtctgctctgcctctcctgcccacgttcactcttcagcaaacactggaggctctgccagtgtctgcagaagggaggcagggagccgttgctctggagttgagttcttaacccttagtgccttagcagtgaggacgaaaggccttcagatggtgagcatcctctgggcctcacctgcaggtcacgttagtgaaggcatgcgtgcacagctagctgctctaagtaataagaccaagtgatagtggagctaacggaaagaactaatttataacctctttcatgtgtttaattgaattgtagcatttttttccctttggcataagaagtgtttccagcgtttgcagaggtgttatttcgatgtacagtcaaatgtgtctttccccgtattttgtatagggagagtattcaaatcatacatgttttgaaatgtatttcccccatcatgcagagcaaagtcttcttcttttcattggcaagcagaattatccttgactgcatttaagaggcgctgcctttactgagggctcagctccagcagcgtgaggagctgtaagtgagccgatagtgaatgccacactgtcggtgccttggggattgattagccctgagagtcccgggggacatcgatgtgcggggaacaccagtcggtggaacaaggcaacataattgattaattagccttgagagtcccaggggacagtgaggtgctagcgtgcaccagtcaggagagcaggccggctgctctcactggtgccgatgttcctctgggtgacacgtgggcctttgctttggcttgcaagttctttgtgcagagcttggcagagagaacctttctcactcaccggggaaattaatttcctttattatttttattactactttgtttctaatacacttttgttggcacttggctttaggcagacacgcaccccgcaagtgttagacccatgagcctccgggaactgccgattcacaatgggaacaaccagtgacgagatggtgcccgtggagcaggcctcctcgacctcctccctagatcccctgtgcttcgagtgcggccagcagcactgggcgagagaaaaccacctgtacaactaccagggggaggtggacgacgacctcgtgtgccacatttgcctccagcccctgctccagccgctcgacacgccctgcggacacacgttctgccacaagtgcctcagaaacttcctgcaggagaaggatttctgcccgctggaccgcaagcggcttcatttcaagctgtgtaagaagtctagcatcctggtccacaagctgctggacaaactgctggtcctgtgtccgttctctcccgtgtgccaagatgtgatgcagcgctgtgacctagaggcacatcttaaaaacaggtgagcgggaaggcgtcagaggcaccaaggaagtgggccagagagccgctacaaccagtagccacacgccatgcggggccgggaatgatgcctgtgcctaaactcccctcacaggtgtgctgaggcagggggatgagcaccggtaaatccatgaaccagtcaaataggaggtgcgataaataagttgcattggttcgtatttaataatatacctcaaaggcatggatctaaaagccacaacaagcaagaagcacttattaatattttcttcaccataccatgcaatttaaactcaaatggacgtcaggtaaaacactagcgtccttttgcaagccgggttggcatcaaaggaaagaagcaagaaaggaactaaatgcaaataaattcttttgtctagtttgtttccacaaggaagagcctcgcatgaagattgttacgcagccttaggcatggttggaacgctggagtcagtccaattgcctaagggtgggggaagacaggcggggctgcactggcctttggcaggcagacctctgtgagttctagaccaccctggtcttcagagtgaaaccctgtttcaaacaaaacaaacaacaaaaagagaggcgaagagttaaatataccccagaactgtaacccacagtcagagaaaacagcagtcccgctagcggggaagggcaggaatgggtcggctgatttaagttgctgaggtcttgaagactttgtgttgagagccttgactgagtaagaactaggaattagagacagaaatgtttaggggtgattttagttctaataaacatttgtttcaaatgttaagtaatgtatttgtgccagcctctgagtctcacaatatgattttagtaagacttggcctttgatatacattgtaaaaacctgagctggccccagggctcattgagtaaagaccctgagtcagacagcctgagttggatccctcgagcccacagggtggaaggagagaaggggctccctcagcttgtcttccgacctcctcatgggcaccggggtccctgctggtgcatgcactcacacagagacacatgctcacacacatgaagacgtaaatagcaaccaccacgtctttacactcaagtgacagaaacacatgtatttgtttctaagcgtccgttgaaagaacttgtgtggtcgtgttgactctggccaacagcacatcgcacatcacactgggttcagatacagcgtaggtctaatgaggaatagcacataaggtcctagagctaaccagactgatccaatcctgtcatctgggcacatggagatttagagctagttaacctatgcgcatgtttaaagtttgctgtgtgcaccaggctactctgccgtcgagtctttgcactgctctgctggagggagcggtcggcctctcatgtgcaagtggctgcatgtgtgtattcagcccggagatcacagcgttataaagggatctcactttattcattagaaatgattgagaagtgagaaactgagtctctcagctggggatgagaacctcatactgtgttgacacaaggtcgtgggtttggttccctgcactggagggaacaaaagtcttaaaatgtgagaaatgtggagatttacagagaaactgcttgaccccaaggtatgttgcctacaacagaggttaggagatagtagggtgtgtgcctttggaaaagcagggatcgtggctttgcattctccgtctccgtcaccagcaggcagagtccgaggacccaccagaggcgcaagtgtgctaatcttagtcaagcctaattgtgtgtgaataatacttcagacctgccccttccttccctctgtccatccttcctttcttccttccttcctgtctttttattttctttttaaattagcacacaaagcactatcatgacatcttcatactaggcttcttatgtgtctcaaaactattattagggtaggattcttttgtgtcataccaaacatttgtgaccaaactgttgtgctgggtacttgccaaacagcattctgtatacagcacttctcctttccagtccctccagcctgagtctgaacacctaacattcaaaaggtgcaagcaataatgcgcatgctaagctaagaagttctcagcctaggtcgtctcaagcagcctcgagtctgccaacgcctctctgtgctgtggagctcagtgcgtttcccatctcattcaccgtgcccctcagcgctgggcttccctgtgactgcgcttcttcattgtctccagtgagctggactctcctgttggcctccagtcacgcagaagtggttctccgtagttcttgaggttttacaaatttgccattgtctgagtgaggagtatcaggcatcctttggtcagtttctgctgctgctgcttgccctgtgcctggacctcacttcctctttattccatgcccagtgctgggctgtttcactgagcactgcagtgtgtcagctcattgcgcatcagtcttcctgttgtatgccccaggctggcgtagaacccccagtcctgcctcaactcagttccaaatgctggaattacaggcatggaccaccgtgcctagctttatttgatctgtttataagtactgtgaattaaacctagggcccgatctgctacgcaagcactctgccagcagtcagtctggcttggtttggttttaatgttgagaacaagagtaatgatttgcccgtgtctgtctcctcgttcgctgccgtgagggccaggctagctgcccttatacacttctgcccttatccctagggtcccaggtcctcactccatcagcactaggtttttgcccaggttctggggtccaagctcaggtttgcaggacttaagccagctcccccgcccacctgccacctttcttaaatcaagtatttctagaccgctgcgcacttttgctggtttccagaatccagaagtggttggttctgatgacttctccaggcttctcattgcttttatggaggggagacttctggtagccttgctgggtccttttgctctctgtcaaattgatttttgtttgtgttatatgtctttatcatcttccttgaccctgagccactcactgcttcagtctccagcacggggcttagcaagcatccctttgccatctccctaccacgatgcatacataataatgcacagtgccttctgctgcgccatgtctcctgacgcccctgtgcacctcgtagcagggaaagatgtccccgtagcctaaaactagttactttgcatgtgatttcctttagagagcaggattcccttcatggagcaggtacatagccagcaggaaaggagaacttgtgtttgggctctttgatgttacctgagccctttggtttctttttcatcgggggttggtgtggccccgtgcagcgcccagcctgtggctggctgcactgtcccaaccactgctgctttggaccagtgtggtctcagccgtgcgtgcatgtctatagtctgttgactttactttctgctttcagtcctctgtgctagcttcccatatgcgctaggctgcccctgcagtgcaagcaggaaggagtctgtgttactattgagtgctccatttccaaggacacatagacacacaggggctttgatgtttgtgctacctaagccagattcaggctcccgaagtcaaatgatgcacttgcctcagcttctgaatagctgggctgtacgtggttctcttgggatgaccctgtcccacacctggttcttggaggtttggggtccttttgttttggtctgtgtgcacacgtgcatgtcaagcccaaggacagcctggtgtggtgtggtgtggtgttgctgagacactgtctgcctgctccttatttcctttgcttgtctctgaggcaggggttctcactggtcagcaggcttcggggggggggggctgccttgctgcccggctcagtaaccccagctctggggttagaaacatgtgccaccacacccgctttgttttaatatgagttctgggatttaactcagatcttccggcttgtaaggcaagcaagcatttggtggagctatctcctctcagtgttggcttggcttgtttgtttagagacaggctctccaaagagcatggatggccctgactggcctggaattccctttgtgggccaggctgctcccagactcagcgattcacttgctgcttcttaaaggtgtcaccacgccccccacccctttggttttgttgttgcatgattgtgtgtatgtgtttgtgtgtgtgtggggggggtgttaagaaggtctcccataaccatgctggccttgagctctgtacagcttaggttagctttgaactgatcctcctgtctgtagctcttaaatgctgggattgtgggcacatgccaccacacccacctcagccttttggtcgcttaggtctggttacccttgatatcccatagtggtgttttgaagtacttgttagtagaacaaatccaatttgttttttttaggacttaaaaagaattccacacaaataaacttagtattgctgttgaggaaaatgctaaaagcctttgaaatttgatcagagtgtgtttgggctgtacccctacaattcaattgctttgtgatgttggcttagctcggtttcaggtgtcccgtgtatattaatagaacagttctgaggatgcaggagctttatgcacattgtggttgtcacatggggactagcagagcgcagcctcctggggcttcagttctgtgtgtaccaagcaaggggcatagctctgagtaggctgtggtcctggattttcctctgttcgagcccaccaagaactactccatccttggccttttaacagcttcgctttgcatttcacgtgtgaaattcacctctttaaagtgtatgtgtctgtgcctcttctctatgtgttcccagtgctgtgtatcatctagattctagaacattccaacaactggaaaggagcctgaaacccattagcagcctcccctccccttccctccctgctctcacacgcccaggcttgggtcaagctgccctgacttagtcttccacttagactctgtcatttccagtatttggtcttttgtaggatgcttgctattatgctggtggactttttatcagcttgacacaagctaaggttctatggcaagagggagcctcaactgaggagccacctccatcaggtggccctggaggggcagcgattgatcagcgattgatgtgggcattggcacccctgggtgggtcctggattgtataaaagtcaggctgagcaagccatgaaggggaagtcttccacggcctctgcttcactttctgcgtctagtttcctgcctcaggtacttgtcctgactctaatggactgtaaactgtaaaatgggataagacctctcctccgcaggctgcttttggttgtaatgttttatcacagcagtagagagccaactaggacaagaaatgctagtgctctggccatctctctgtggaatccccctgccttaaccctgtcctctgagtgcttggagcataggtgtgcacaccagctttcactcacctcagactgacactttttggtccttgtgtcttgcacggttgtgtccctgggattgaaactaggacctcagccctactagggaaaccctgcctcaggccacacctgcagccctgggtctcactgtttgtcccttgtagcagttggctctcttggctgttgctctgtgtgggccctctgctctgccttgaatagtttgctgtcttccgctcacgatggccctgccgtcctgtcgaagtgcgggtgttcccgaaggttctatctatagacttcctcccctgaagccgttatcccaatgttttcccgtgatgccattttagtcttttcctgtcctatgggtggtttcctgttgttaaggatctgcctgtcccatcgggaatgtgagcatgattgcttcttcctttgtagcaagcttagatttttccatttttaaattctttttttttttttaatgtattcaatagcactaggataggcgttgtataccttgtagggctgttagttcagcgaactctgttcatgtagatcaggctggcctctgccccctgagtattggggtaaaaggtatgtactgccactgaaatgagctgttacccatttaacatggatgcttacgtgtaataatatgttctggaaattaaatctttaaaaaaaatttttttttcttcgagattagggtctcattctatagactgagctggccttgagttgacagttctccctgcctctgcctcttgtgtgctgggattaaaggtgtggaccaccatacctggcttttagaaaagtattttcaagtgagcatagagagcaagaggtttgtcatggcattttcatacatgtctgcacataaacagaacaaagtatactgacatgttattatatcttgttcttatttctgttcctccaggactctccatccctggcttcctgccaaataatcgtactttcatatcacacgtattccatcacgtgtccttcctccctcccctcccataagatggctaccctctcataccctctgtctactctcctgaccttatccacacgtgagagtgtatgtgagagagcgtgcagtagacgtctttccacagctgacttattgtacagtgtgatccatcctccagtgggtgtcatggttttcagttttcatggttgaagaaaatgtcattacgtgtacatgccgtcttctttatccgtcattgatggatgccggggctggttctatctcaagagctatcgtgaataacacagcaacaaacagggacgtgcaagtgtctctggggcgttggtgtcacatacgccagaggtgtgtaccaagagtggtatcgccagcttccgaatttcacttgctgtttctgtggtcttggtttggatttttgaggagcctcaacactgacccctgaggctgcacattgatcttctcggaagcagcaatctgagacccctctgcctgcacacccttcccgagcaagctcgttacctctggtgtgttttctcgggggaggccattcccgctggggtgagaagatgcctcgatggctaaggacacttcagcacttgagtgatactggccacccatgttcattctgcatgaattgtctgttcttttcatcagcgcaagtattcattcatcaatgatttgagagcttgctaatgaaccacctggctgatgtgttcctggtgacagtttttccctgttctgtagactcctggggagggggttacttgtcagtcttagggaactcagctctgaccccatctgcagtcacaccactccattgcctccgcttctttccctcattgtgaggtagctttcaaacgtggctctggttaatccacctacggtcctgtgttccttgatctctttttcaaaatgatttgccaggcattctcgagaacagttcctggagtgttgctcagcagcgcaagacggagtctcagctgagtccctcctcggcagggtatgggggggaggagtgggaggcacgtccctgttcacccttcacagtactcgaaagcagttttatgtctatctatatatccatgcttggcttctgggggaaacgtgttgatttatggcccaggctagctttcagttttaactgaatctgtcctgtgctttgtgaccgtgaaaatttcggaatttctaaatactatcattgaaagcaagtctgtgaccctcagcatgtgctctgctgtggctctggatcttcactgactctgtccatgtctcccacccttcattctgcatgttaccgatggccatagccagccggtgtgtagataaaaggggtgtcagcatactctggccagccagaccagcaagaggggcttctgtctaaacgtgtcattgcttccgagtataaatgagcctctacctgtcatgtgcttaaataaaaacatggtagcagttcttattcagctcacattgcctatcttgagattcagatttaacaaactaaggagcccttcacgtgttgtaaagcttcctgtgtgtgcgtgctcacaagtgtggcacagtggcacagacacgtgaagaagactgcagattgccgccctgggctgagaaccctggcctgggaaaagcactgtttggtccaggtttcgcacccattctctcagtgcagacagtcgggactcttgggatgcttccaggcaactagtgtctacctgagtattggcttttggctgttgttgtcttcgtgtctttcctggatctgactgccaggtagagtagcgagaacttagtttggacagagattaggatcagaaccgtgtgctgaattgtgggtactccaggctcccttgtgcataagcagtcgctgtgtatttgttcaggtgtgcgctcgctgttgatcaaccccacctaccctcttctccatacccaacttcttctcatctgaaaagcacctgctgctctttctaggtgtcctggagcctctcaccggagagtcgatctagagagaaggaaaacgagtcaaactcaaacacagattgagggtgaaactggatctactgtcatagatcctccaggcaccttgcccccagaaacggactgctcgggcaccgtgcctggcgagaggaacttgacaccagcatctcttcctgtgtggaccgaggagcctggcctggacaaccccgccttcgaggagagcgctgcagctgactgtaggtgcacacctctccctggtatatctggcctcccttgcctttcctcccctgcccttccttccagcatgcgctcgtgtcctgtccagacagttgcactggagtgtggttttattggcatagtcactgttcatccacaagacccccctgtgttgagctggagaatacctgaacgtaaacactgctctctctttgacttggcagctgtacagcagccgcttagtttaccagaaggagagatcaccaccattgagatccaccgctctaacccgtacatccagttaggaatcagcatcgtgggcggcaacgagacaccactgatcaacatcgtcattcaggaagtctaccgggacggggtcatcgccagagatggaaggctccttgccggagaccagattctccaggtatcagctccagcacgacaactgtgatgttgtcgaaactgaattataggaaagttggttttgctggttttaagtgtgtgtgtgtgtgtgtgtgtgtgtgtgtgtgtgtgtgttattctgaggcaggtcttactatgaagctctgactgatgaaataaattgaattgattgaaataaatgaatatacgcacaagaggaagactgccttctcagagctccagctcaacgcccgtctccctcctccaaggcctccctctttccctgctacctctccagtccaggcctccaacactccgttcctgattcagtgcaacgctccttccagtatcctgactctcgctctcctccctgattccaggtggttcacttacagggcgatgccgctgcagccctcattgccaacggcagtcacggtccaagcacctcatgcagcctcatcgtggtttttcataacagggtttctctgtgtagccctggctatcctggaactcgctctgtagaccaggctggcctcaagctcagagatttgcctgcttctgccttcctagtgctgggattaaaggtgtgcgccaccacttggctgtagtctcactttctaatcagagttcttccctacagtgctccagggatacattttaaaagtaaaagtctgtcctgccctcgcagagcatctcttcccattggaaggtcgagcatgccagccttcctgcctttcctctgggaaaccagctctctctcctgagcctgctctcaggccgtgctccggtctgtgcgctctcctctgcacgctgaccagccgttcttcccacactgatcccgtgcccctggttactgatcacacttctgcgcacgatccaccacactaaggcactcctggagtttaacggtgtgcacagtctttctccggtgtctgccacagtgtccagtggtccggtttgtggttcagacttgtcaggtatgacagggaagacactcagttggtccaaagggcaacagaagagtaagcttggctgtgacatcctgttgggaatagtcgtcccctgtagcaaaagaaatctgcaatgtctaggaacctagctgtcccgggaggaatctgtagaccaggaagagaaggggccaggcttcgggcagcaggcagggaaggggttttcactggggatccacagcattagtgtgtctgtccactcgaccgcgtgttttctctttagtcctcaggccccacgcccttccaggccactggtgtggctggcacagactgaacttcgaattgcttttgatctaccgtttgcgcgtactgtatctttcctgtcatctatgtgtgtcctctggctgcacaaggctgccaccactttgaggacagttggcctgtattcctggttcctacctcctgtcccgcatttacaggccgtctgaaagctgtttcccaggtacactcctcccacacagcctgacgcctggcctttactgcagccccgccgctcctcatccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatctttccaaggggagccttgctctcacagctttcatacacctcttcagagattcatatgcaggctttgagtaattttagagggaaaatgctgctctttataaagtatgtcaatattattaacagagatacaacttctagaacattaaaagtaaatatttttggtttgaccggaaacatcagtgactgacgtcctgttggttaacaaacaaagaccatatttagtcaaaatgcacaacagcgcttactgtttttgctctttgtataaaatcaagaaacagtctgttgcagtcggtcttctctcaagctcaccgacagccgtgcatgcattcttagagaaggagtcttctcatagttgggttcccccagcctgctctgcagagaaagcaggctgcatgcttctggatgcagaacaaaccgggttttcagcccagcatttttatcccgtgtgaccgtctgaagatgaacacagaggtatcagctcgcagcagagccactaaaatgatgacaggcccatgggtcctgtcggcagcctggctttctagaacatgccttggagttctgacctccatccagtgttatcaattctgtcaatgtcttggaattgctgctgcttgcacaaatgctgtaaacatgcgagaacagtaagctcatgtacagtgcctgaagatttgatgactggattttaaaaggtatccatctgtagacaagaattaacaaggcaatagtgttcaaaactgtaaaactcagaataaagcaaacagcccaattcaaagagctctaactgcccatccgagttaggtaagaggaagaaggccttttgtgtagcggtgcgcacacatgcccgggctcctgatgtcacagtactaacccttagctctcccattagaggtgcttagacaacattggtttttatctctgatggattcagagaactctaattgtgataaatacgaaaattatactcacctcctagatgggtaattgaagctggactattttcctaagtgatatgttacatgttcaaagatcagtcactgtaattgtatcaaggctgtacattctaatgagtacatgaatattgaattacactcagcatattaaatatgcattatatgagtatgctgataattagagtggaattgtaattacatactttaaaagtcactcagaatatgcaactttttaagaaataaaatgatttattttgtctaaagtaagtgtgtttcgttaggtaaagcagctttgaagtccaggaacctgagcctgcgagcctgcgagcttgggagcactagagctgtctgatgtggcttgccctgccaggatgtagctagcctgctctctctcacactggttctgggaagtagagtggaccctgaggagccaaattccatattcccccaggttaccaataaataactagcagacccgaggactgtaatcccagagtgtcaccgacttctgtgtcctaagtacaacactgtgctgtagtgcattttaaattctctgctgtaaaagtctttagaggccttttccttgtagatagggatcctgtagtgttttctccatattgctttcctttggagatgtcatctggacatttctgcaagttaggaatatagaatactataatgtcatatacatataaggtcataggagttctgtttgtctgtttgtcgtaggtcaacaactatgacatcagcaacgtgtcccacaaccacgcccgggccgtgctttcccagccctgcagcacgctgcagctgacagtgctgcgggagaggcgctttggcagccgtgccaacagccacgcggacggcagcgcgccacgggacgaggtcttccaggtgctgctccacaagcgagactcgacagagcagctcggcattaaactagtccgaaggacagatgagccgggcgttttcattcttgacctcctggaaggggggctggcagcacaggacggcaggctcaacagcaatgaccgggtgctggccatcaacgggcatgacctgaagcatgggaccccagagctcgctgcccagattattcaggtaaatgccctgtcctgagcctggatcctcacacggccgtgtctgttttcactggcgcataaccaggaccagcgatggttctttggaaaatcagacatggttatctaaaaagcagccttcagaatctacactgttatatataactccctaaacagagctgtgtttgtgtgtgtgccacttgcttagggtgttgtggactgttttcctagagcctgtggtcccatgcacttgtttgtacagtgttgacacctcagttttacctcatttcaagaaaagcaagggttcacgtcaaccagtaaacttgtcaaagcagtttccaaggacggctgaaatgctggtttggagctctgggtatgaacagtaatgacaatgagcgtgtattataagaaagcccagtagccacctgacactccccaccgtgcgacgtagcaatcatctgcctctcagagcctggagctgctgctggtgggtgaatggcttagtgcagtatcaaagctgtttgtcacttattttccaactgaagagcagaaaacacagcaatttttatattaaatttaattttgcatgtgtgtgtgtgtctgtgtatatttgtatgactgtgtgtgtgtgagagtgactgtgtgtttccgtgtaaaaggtttgaaaatactagcctgtgaccctcctgccaccaggtagtgactgcccatgaggctttgctgagggactaactggtacacagaaaatcacagtatcccaggcactgcgaagtggtagcattcactggcctgaggctggagcccccagccttgggctactcagtgagaacttgccttgatgagagagaagagaatgggttccactggcaatctttaagcaatcatccgtgatgggtactgatgaactgtcttccccaggccagtggagagagggtgaacttaacaattgccagaccagggaagccccagcccagcaatggcagccgtgaggccggagcacacagcagcagcaaccacgctcagccaccctcgcacagccgaccgggctcacacaaggtgaggggcgggtctctccttcaacccctgtggccctctaaggatcaccgttaccccgaaaaaggtgtaagcgtaggccttgtgtatgcctgccagtcacaacacaacgtaaagtcaggtctttttggttttgtttggttggttgggttttgtctgtttttttgttttaagcctgaaatgcaggctgtcattctgttgggggtctgagcctaggtgtttggggttcgcaatccgagagtctcctcccacgtcagccactgtagtttctcatctgtctggtgagtgacaagaagtgaccctccaggacagtccttgtgcttagtgctacctgggagcaggttctcggcttgcctgctcagatgtgatcatcagatttaccacgaaaaatgcatcgtgagaacatgataaagtccgtggttagcagctaggcacgttgcctacgggaagagaattagctgtgcgaacactgagactggggatcgcaggctttgacagacacgtggatagtgtgtggtttcatggtattaaaatccccatctattggctgggcagtggtggcacaggctgcagtgccagcactcgggagacagaggcgggcggatctctgtgagttcaaggccagccagagtgagttccaggtaaatgcaaggccttccctcgaaccgtaggacctcacccggtgcgtcacgtgccaggagaagcacatcactgtaaagaaggagccgcatgaatccctcgggatgacggttgctgggggcagagggagcaagagtggtgagctgcccatctttgtgaccagcgtgccaccccacggctgcctcgctcgagacggcaggatcaagagaggtaaggcaggcaagagtcctggaagctctgcaaggtccaatctcagaagtacagtcacatttttaaggagtaattactgtgtttcatgttaaacctgacttttaaaactcttttaaaagggtccttgtatagaaaacgtcgtgttctcctgtaaggttaggaattaaccctgaccgtggttcgagactctgcagttactcggaccgtcggctgatttttatcttggaaaagagcctctgagattcttgcgcccccggccctggcagatagtgctgaagaccatgtccctgaaatacagcgctgggtacagtaaagcacccagggcccgtgtgatggccgagcagggaaaagcgcctgccatccaagcccagaactcagcaaagaagacagggttctgacactgcagagcgtgtgtggaggacaaagctagttcagagatttgactccttcacaccatggccccctcaagtctgttaatgtgcacaagggaaaccatataagtgagcactgttgccatgacggagcagccgtctctatggtgaggttcacatgggaagaaaattaaagctgaaaagttattttcccaggaatgaaggtgggctccctccccaacctcacacaagcaagctcacaatgaatttaagaccccgtgtaaaaactaaggcccttgtgaggagcccacaggccaagtcttatggcctgtaattaggcagtgatgtcttaggtaacctgcagagtgggatgaacagtaacaaatcatacatttatgtatgtgtacgtgccatagcaaggaattgtacagaacttttccaaatcagttaaaaccatacattacctaatttagggacagaaatagacatttctcctaaggcggcaattgcatggaaaacagctcacccgactgcttgccagagacagggttctgatgccctcagactgctgtaaaatgttctcgggcacggtggtggtgctctgcggcgggcagaccaaagcccacagtgctgggcgtgtatttcaacaaggctactatcttttcttaaggtacttggccaattatagaatttggtgacagttcagttccttcttgggttttggttggttttggctttgttgttgagcacacatgggacaagggcttcccgagatttttttttttttgactccacagctatttgtttatttttgtagtgctctcagaaattgagttacacaaaacaacaatccaaaccccacctttcctcaagaactatacaaaagggttgtttctgtgacagccactcctccataaatagtggctcccgagtcaagctactgcaggagccctgccaccactccatgctgcagcaaacaatgaagcccgacaggggcctccgtcccctaacctgcagtgggctccgagcacaggttcacggagcaaaatgttgttctacacaacagcaaaaataagccaaatacctgattcacacaggaagtgcaatgaagaggaaaaaaaacctgcagattcccagcttaacaagctcccagttttatgttctctctgtacacacatgctaccactaccatctgaacaactctaacctttctcagcccctttatgtaagaggaggaaaacattgtagctagcctgcacaaaagacacagtctggttgttataagccagaagcctaggcaggtttggagcgattctaacttacatcccagccattatgtccctcgttacttgctgtttctcctggccacatgttcatggtccgtctcctctcatggcggcagccaccacctccgtgttcttttttctcctccctttggcctcacctgagactcctcactcggtcctcaagttctacctttctccctccactgcccagtcacaggctctagccttttattgaccaattggggagcaaggttctcgtagcatcacttggtatatgggaggatctgctcatggaggcagccatgtcttggggagcagtacttaacgtttgaatatatagcagcgtcagaccaaccccctacacttgtatcctttaataatccccgtgtctcctttttattgttttgttttatcttattttatttcatctaacttgggagaccaacaaacatgctgctccccttcaagcaagggaagatgtttcatatcaccaagtgtcccgagagtggctgctctcatgatctgggatgtgtgccctgtatgtataaaattgtgtaatattaaatagaatctgttaaaaaaaaaaagtgatttctaaaagcaaaggatcagatggtttggtgttcagaaagaactgtagagctctcagaagctcaagagggaagttgtcaccctcatcctgtacacagctacccagatggtgactcagactcgggggcctcacaaggtgcttcaagccacagtgtgctcctctggagtctgaccttgtttgagttccaagctgttttaaaatgtttcctacgagttgtccttggtagcacagaaaagcacaaatgcttttgtaaaaccccacttccacccatccaagctcttgaaaccgccccatcaattagttggcaagcaggagcttcggggagtcacgtggtactagggtcactcactctcctggccttcccaacggcacaggtgacgtgttgctgaacatcaacggcattgacctgaccaacctaagtcacagcgaggctgtggccatgctgaaagccagcgctgcgtctccggccgtcatcctcaaggccctggaagtgcagatcgccgaggaagcagcccaggccaccgaggagcagccgagcgccttcagtgagaacgagtacgacgccagctggtccccgtcctgggtcatgtggctggggctgccaaggtaccaagagctctctcggtctgatgtctcagagtgagcgtgttttaacttttatcagttacacggttaactcacccagtgcgtagagagggcgttagttaggtaaagtgcaccaaattataaaagcaaaaaagtgtatcttcttgtaaaacgaagacaattccctttaaggagggatttttgtttgttgttgttttgggggttttgttttgtttagtgtttttgagggggggcggcactgcgtctcccccttgtacatgggctgagagtccaggcacacaccaccacacctggcttttctgtttgggctctgggaatccagactcagggcctcacacttgtacaggagagtttctggggcagggtctcactctgtagcctaggctagccaagagcttagaatcattttgtaaaaaggtagttagaactgagtctgtactgaacaaaggagacgtgaccagcaagctgctctctggctggccggtagggaccagggaaacgttggaacctccctggcaccctggggtgcttgcctttctccagatggttgctgctggtgctgagataggaagagcgtgtgttactgtgcttatttgtgtctaaagtaatttagattctcattatctataaaaagcatggtgaagcatgtttgactattagccaagtacgaagctgctggttcctaaataaaaataaaccagaacgctgcaccactttctgagtcatctgcctcatgtggggtaaggtagtgtacagccaggagcgcttcccgcacgctgtgcgctccgtgaagaactctctcatgaggaacagcaggtacctccgaggggttgcgttcattcgctcctgccccagctctctggctggctcccgggagctcttggtggttttgtttcttggttttcaatcccaaggcctagaagtgatgtctctcagacgtggcaggaccttgtggagtgggattgatgatgggaaagtgaccttcttgtgtcctgcatgtttatcagggcatcagccctgggagtcagaggctgcagagatggctctgtggatctgagcacttggcgttcttgcaagggcccctggtgtggttcctggcacccccgtgacggctcccaactgtctgcagtttcagaggctcccacaccctcttctgtccccgctggcactgcacatacatggtgcacatatacatacatgtaggaaacagacattcacatagaatggatcctttttgaaaaccgggcgcaaatgattactatcccactgctgcaagagctactgtctaaaccgggaactcaggagtcttgttcagctgatacctgggtagtcaggttcatcccagagtggctgggagacaaggatggaacccgaaggcacaggcaggtggacctctgttattttgaggccagcctggtccacatagtgagatacaggatagccagggctgtctcaacgacaaaacaaaacaacaataaagaggttagaagctgtttgcccggacaatgggggatcggtcagaatagcaacctcctaggaaatcccgggaccctggtgctgcctttagctggctctgtgccagcctggtttgggggctgcatgttctcactgttgtgcattgcattttatggcacgccaggcatagcaagaaaggatttgtgtcatctgtgtgtgcatgtgtgtgtgtgtttgtatgtatctgtgtgtttgtatctgtttgcatcagtgtgtgtggtgtgagggtgtgtgtgtgtgtgtgtgtccccatccacgagtgagtgtgtgtgtgtgtgtgtgtgtgtgtgtgtgtgtgtgtgtgtaggctgaagatcaacatccgctgtcttccttgatggctctacacctttgcttgttgaggcagcatctctcactgaaccgtttggctaggctggtagccggtgagcttttggggtctgcctagcgctgctgcccccgccccgtgcccagcactgtggttacagatgtaagttgccccatgtccggctttttttatgtgggtcctgtagcttaccaggcaagaactttagcaactgagccagcccctcccctcagctcagaaagggttttagacaagttgtcacaagttgacagtatagtgagatacatttttgagcttgcctgaatggatgcctatacatataggctattgtgtggcctgagttcccctgcactgccctgctacaccggatgctggcctgcttgctgtaaaggatgcagagctatgaaggtgactgtactgtgcctgaggatctgggccaggggtgagacttccggcttgccagagcctctttagaagtccctacccctgagctaagggttgtggcaccatgctggaggttgtttgtcatttgtagcagattagaaaccagatagccttgtctctgatatttgtattagttccggtggggacaaacaaatcacaagcaacatgaggaggaggaggaggaaggcttgtttcacatgttgaggctgtggccatcaaggcagagagggagggctggctctgaggatggagcctgaggcaactgctagtcaccggcatcctgaggcagatggtcacatgacatcctgaggcagcagagatgacagctggtgctcagcacacctcctctttgtccctttttattcagtgtgggactctggggtggtggtatccacactcagggtgcatcttcccaaaggtgagtctcccaggtaattcccaacccagtcaggttgatgatgaagatcactgcatacccgatttcacttcccagtgaggacttttttttttttttttttttttttttttggtttttcgagacagggtttctctgtatagccctggctgtcctggaactcactttgtagaccaggctggcctcgaaatcagaaatccacctgcctctgcctcccgagtgctgggattaaaggtgtgcgcctccacgcccggctcccagtgaggacttttattaaaaggatttcactttgtttgtttttaagatcttacttgctgcttattcccaggttcatagaccgctggacatataagtgtagtgtgccccctccctccctggctagcatcctccaagccatgagtaggcagcactttgcctgtagcatctctgtgctcatggagaacaatgtgtttgttggtgttctccaggccgagctgccgttagagtctcccagaaaggtgtgagtccttgtgagtccaggggaagggacaatatcagcccctcctctaaattaaagcaccgccctgtagcatgcttccagaaagggccaccgtccaaatttcttcctgtcccttccgttcttcctcttcctcctccttttcttatttttggggcactgaggatcacctagggtctcgtggttgtagcatgacacctgcacagccccttacccccgccacctgccacctgccacccctctgccgtgaacagctgtcctgcctcccttacgcccttggtaggtgcagctctcgaatcgaggtgccgttgacagtgctgtaagcagtcccagtacacgatctctgtgcagatttctaaagtatatttggcagctgggctgacttcatctccctccgtgtgatcatgtcttcacttggcaagagaaacctaaggaaagctggagaaagcaagcctgcctcgggatacatccgtgctggagaatgggttgtcagacaatagtacagacagggccagtacatcttgcctagcacatgtgggaccctgggtctgaccctagtgcccatgtacacacacacacacacacacactaatcatgtagtcagaggggttacactagcctgtttttcacacgtgtgagcgggaagcctccgtgcccagtctttctgctgtttgtttgtttgtttgtttgtttgtttgtttgtttttccggtctgtatcattgtctttttttttttcaaatttttattagatgttttcttcatttacatttcaaatgctatcccgaaagacccctataccctccccctaccctgctcccctacccacccactcccacttcttggccctggcgttcccctgtactgggacatataaagtttgcaagaccaaggggcctctcttccaaatgatggccaactgggccatcctctgctacatgtgcagctagagacacgagctctaacaacagtatgaactaaccagcactctctgctgttttacagtgcccttcacagctgtcacgacatcgtcttacgcagaagctacttgggaagctggggcttcagcatcgtgggtgggtacgaagagaaccacaccaatcagcccttcttcattaagaccatcgtcttaggaacccctgcttactatgacggaagattaaagtaagtctcgttctcgtcaacggtgcagatcgcatgtgtcacaccagacctgacctaactgagggttcggctctgctctctgcgtagtgttatttctacacagccatgctcactcatgtgttcgctgtatgtgcctacttacactccaaagctaagttcttctgtactggagactatggatgggccacggggcctcatcacaggaaaggtctgctactccctgagcgagcctgaagccatttcttgtaccatccctgccccttggagctatactgcctttgtctagaccagatctgaacccgagtcttctgagtgtgcctcagaatggcagtggcctctgagcgtttcccatgcagctcgtgcaggtctgatcctgccagttgatatttcccgaggctcgatgtctgcctgactttgtgagatccatgaatggcaaccagagccccattgtgggccccatgtgtagtgaggtttcaacacatgtgggtgaatgtgctggcaggcacaacactggggtctgtgtgttcatttagtcaatggggtgtgtgtggtgtgtgcacaggagtgcgggtgcccatagaggcatcagatcccctggaaccggaattatagacagttgtgaactgctgggaaccaagccgaggtcccttgaaagagcaagcgctcataccacgagccgtctcctcagccttaacttggtactgtttagagagatggactcgcaaatgacgttattcttcatgcccttaagtccccaccagttgtgggaaggttgactcggctacttttgattgccaagggagagacttgagacatttctcagttggtaatacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgaagtcagctacagtgtacttatgtataataataaataaatctttgggctggagcaagcagggatggagttgaccggagcgaacagagggtcctaaataaaaaataataataataataattaaaaaattcaattcccaacaaccacatgaaggctcacagtcatctgtatagctacagtgtactcacatacataaataaatctttaaaaaaaaaaaaaaaagataaccaagtcacacccaccttaaaagaggaatggttgatttgggcccatagtcccagatttcaagccgtggtaggttaggctgttgctctgatgcctgtgttaaggtggcatctaaagcaggcatatcgttattatggtggcatgatgctgcttgcttcactcaggatggtagcaggaaagggacaggaccaaagtcccagcatccaggtcccaccaatgcccgcctccttgatgtgctacctcacagtagcaggagaagccaggcgccaagcggctaagggcacgtgaccctccgaggacgcttgcccaagctacagcagttgatttagagggtttcattttcttagagtactgtgcagtgtgacttggtttttgaatggccaaatcctccctctgctgctccagctgccaactctttacttcctttttttaaaagatttatttattttatgtatatgaatacattgtagctctcgcaccagaagagggcatcagatcccattacagatggttgtgagccaccatgtagttgctgggaattgaactcaggacctctggaagagcagtcagtgctcttaacctctgagccatctctccatcccaactctttactttctaactctggaacttcagaacttggtttctggtcctctgcgttttacagcaggctgcagtacgatccctcggatagctgaagctgtcgttggataaacggatggttaaacttgaaagttcacacacctggatctcgcctccaagggcgtttctctcccctttcctcgagcagtgggcccacgttacagtcagtaatgccccatttagatttagctgggttgtggtttgaaaagctcgagagttgaagcaataggatagttttgttttttaggactttgtgtgtgtgtatttttgtgtctgtatgtgtatatgcacatgtgtgctggtgcccagagaggccagaagagggtgtctggcccctgccccaaacccactccttgctggagttccaggcatctgggaactgccccgtgtgggtgctgggaattgaactcattcctctgcaagagcaacaaatgcccttagccacagagccacctctccagcccactatatacagaattcaaaattacaggtggccagatgtggtggcacacatttttaatcccagcactcaggagacagatacaggaggatctctgagtttgatgccagcctagtctacatggcaagttccaggacagccagggctacacagagaaaccctgtctcaaataataagcataaaatatgaaaggtagagtatttaaggtatgtgatacccttccctacagtcaatgccttatgtcattaaagaatgtatttcgcacctactgtgcatgctgtagagattggcctgctctgtatggccttcacagggagtgatgtttataattcagctttcccccccatttggtcaaatttgttgatcaggccatacagaccacagcagcgcaggggatttgggaattcaatgattgaacttgtctcttgagtctgttttccccgcctgcaggaaaggtttcagcccttgggagttcttatctaaaagctcttctgtcactttgtagcgtaaatctgttccatttaactacaccaccaattaatttctatggcaacagagaagctctttagaagtaaagttgtacctctatgtgcaatgcctaatagctacaaagtgcctgagaaagagaagcgaaactgtcaatcatgtagaagaaagatgtatgccgatgtgagccgggagacaagagttgggctccctcatgcctgaagctgcagcagctccaagctcctcagggtgccccacaggctgtttttgcagacttgagtcaggacattcccacttaactcagcgaatcaaaccacaacccttttcctttgtgccactctgagactgaccaagagtgcttaagttagaagcactgatggcttcagctctggtcaccagaagtgacaaatgtccaatggcaaggttgggagaatggttgcggctattaattttgttctgttttgttttttgcatcactgcagatattaaactgggacccacatgttaggcaagtgccctaccactgaactacactgccaactccattcttagtctttgttgtatagtagactttttaaattactttaacaattgtgtgtatgtgtgtgtgtgctctgattatattgcccacccacattattgtttttctttctttttttttttttgcattattgtttcttatctctcttccacctctcactgaacttcccactgaattccccctctctcatgtttttagaggtgaatattccctattgcattaattagggtcgatggcatgggaaccatttacatgagcagagctcaccttacctgtggccacacactgagcagtatgacttccccactcccaccccagccaccaaagtgccacttctcagggaggtgcgggggcttccacttcccctgtttgtgatgggacattagtgggtgccatctcgtgcagatagccactaacactgacttcatggctacaaccagcccatcatctttggaggacgcatctcaccgtggtccacggcagccaccagcgcctccctgcgcgctcactcagcactcctgtgtcctgatacctgagccttgggggagcttaactcttcctttccagacagggtcttgagaaatcgaccaagctggtcttgaacttttgtagtccaggcaggctttaaacttgtcatcctcctgcctcagactcctgactgcctgagcttacaagctcaagcctccatgtctggcaaaaaaaaaaaaagttttcatcttatcaagtttttattgtgttctaaggccatgaaaatatatgtttgctgtgagctgatgccctagggaaatgacacgagagtaggcttgtgcccctgtgtaccggctggttttgacacaacctagagttattacagagaaaggagcttcagttggggaagtgcctccatgagatccagctgtaaggcattttctcaactaatgatcaaggggggagggcccatggtgggcggtgccatccctgggctggtggtcctgggttctataagaaagcaggctgagcagccaggggaagcaagccagtaagtaacatccctgaatggtctttgcatcagctcctgcttcctgacctgcttgagttccagtcctgacttcctttgctgatgaacagcaatgtggaagtgtaagctgaataaaccctttcctccccaacttgcttcttagtcatgatgtttgtgcaggaatagaaacgctcactagttgtggtggctgtgagctatactgcgtccatattgaggtaagtaggcatccatggcaggtggacttgctccacgcagccatactgaccctgtgggcaattagcatacacttaaggaaaactgggtaagtcagactgaaggatgtggcagagagaccactatctcatttaggcaaagacaagacacaaaacatctttttttttaaaactcagtattttgtttaaaattcattatttaaatgtacatataatatccgtgcatatgaatacaagtgcccacagagaccagaagtgtcagacctcctgggtctggagctacaaactgtgaattgcctgatgtgggtactgagaactgaacctggatcctctgtaagaagagtacgtgaaccatccctccagaccctcagtaacttcctaccatctactctatactaggcgctgtcctaggacctttaaatccgtcagtttccaggtgaagttgttgaactatctgatggggaaagaagaaaggaaggaaggaaagaagaaaagaagggaagaaaaaagaaaagaaataatgttggttttggctgacccagaacatactgggtcttgaattcagagctctgcctgcctctgcctctagaatgctgggattaaaggtgcacaccaccatagccagtctggtgtgtgtacgtgtgtatacagcgggtatatatctccactgtaacccatgctgacctcaaactcagaatagtcctccaactttagcgcctccacactgggattgtaggtctgagccaccacacccatctgaaaactactcgggattgccatggccatgatgttttgttctctctcagcagtgcgtgtctgtgttcctaaacaggactctgatcgtcaggattcccgtgagcattaatcacgcaagtgattcacattccccagaccccaccctggactttcccgtgaccaggctccttcttacactgtctcgggcttccaggggcaccttgtcctgattccttggtctgactccagcctgtccaatcctgttgagcctcaatgcagtcaagtgctggctacaccaaggcagacctcaaacttgaagctctcctgcctcagcctcccaaataggtgggacatggaagtacaccctgtcctcgactgtccctgtagagtctgcaccactaccaaacagtgccaccaactgggaagttggggtgagacttgaggaacatgattctggtttccacgaacagcagggccacttgagaagacaaagtattgaaaagggaatgtttagggcacactttcagagttgggatagtccttagtgggaggagccttgtgatggatggaaccgccttcaaactctctgtcgaagaatgaaagatgagaggaaaggaacagggcagggcagttttcctgtgacaaactacagtggcagcatggtaacagaagtgttgggggggagggggggaggggggtgtcgcatgtacaaagccctggagtcggagattggcagcattgagtcttccccggggcgatacaagattgctcttagttctgatttccccacatcacctccaggcaaatatgcagtttctactgcattctagaaatacagctggtgccctggtgagtgactttattttcagcccttgggagccaggcagaggcaggcagaggcagatctctgaattcaagacctacctgatctagatagcgagttacatgcctggaccctgcctcaaaataaatatgtgcaattggctggcgactaaccctgagatgccatgattttggctggtgatatgcactactctgaagacgcccatgcccacgagtatggtattctccacaggtgcctcacctgatctcagagcagcctggcaaaggtatactgttctcatctgatctataaggagcgtgggggatttggtcatgtgacttcccttgcacaaaaccagcccacaaaagactgacaaggagaacccccactctgcccttcatccacatcctgaccacaccctacgcctaaataggggcagtcattaacccatctcttacacatacccttctccaagaggagaacactgttcccttcaacatccttccagatagatggtctgagaccagccctgctaatccacactaccctaagggaagtgagagcggagtgcatatcgttgtcagggggctgtctcccatactcctttgctggatacagaaacccatgtgtgcatagatcccttatgggaggcaacagaacatcttcacaagactcgggatccctacaggctgcttacaaccacctagcgtgacacagatgctgaggggacagtcactatgctggatggtttaggagatcatggccaaaaatgagtctgtatgtgttccaatcagatccttcctgtgtactattatctgtctctggttggttgaatcctggggtgtggcactcatagacacaagaaatcgtattattaacctctgtgggaattatgccgagtacataactttagataaacttccctagtttgtaagctgtcctgaatctaatctgtgttctgatttgtgggtttggggtgggcggtggggttcttgttattgtttgtttttgaggtttttttggggtttttttgagattgtattacatgtgtagcctaggctggcctccagctactcagttttcctacatcaatctcctgcgtgtcttgagtagaacataatgtctccatgcatggctccttctgatttattccgtctttatctttgatctttatcttacatttagcattcttgatctttgaacaaatttagcattcttcattcatagtgtcaaaccagcttcttttgcagttttttttttttcttttcttcaatatttcactgggccctgcctagcctgggcctgtgattcacttatgtagaccaggttacccttgaact

SEQ ID NO: 260 - DNA, 2441 bp, Mus musculus
atcatccatgtgtaggtagactggcaaggccttggcaggtcttgtgcaggtagccatggctggtgagagttcgtggatgcagattcctgttatggccagaagactcttgacagcagtcctcctggtcctctggtccttagactctttctgcctccctttcctgcgatgtcccctgagccttgggtgcaaggcttgtgttagagatgtcacctttggagatggacaccctacagccgcacattctgaattttgatcacttgtggtttctcatggtgacctccatttgcaacaaaaagatgtctcttcattgatgggcagacacgcaccccgcaagtgttagacccatgagcctccgggaactgccgattcacaatgggaacaaccagtgacgagatggtgcccgtggagcaggcctcctcgacctcctccctagatcccctgtgcttcgagtgcggccagcagcactgggcgagagaaaaccacctgtacaactaccagggggaggtggacgacgacctcgtgtgccacatttgcctccagcccctgctccagccgctcgacacgccctgcggacacacgttctgccacaagtgcctcagaaacttcctgcaggagaaggatttctgcccgctggaccgcaagcggcttcatttcaagctgtgtaagaagtctagcatcctggtccacaagctgctggacaaactgctggtcctgtgtccgttctctcccgtgtgccaagatgtgatgcagcgctgtgacctagaggcacatcttaaaaacaggtgtcctggagcctctcaccggagagtcgatctagagagaaggaaaacgagtcaaactcaaacacagattgagggtgaaactggatctactgtcatagatcctccaggcaccttgcccccagaaacggactgctcgggcaccgtgcctggcgagaggaacttgacaccagcatctcttcctgtgtggaccgaggagcctggcctggacaaccccgccttcgaggagagcgctgcagctgactgtagcatgcgctcgtgtcctgtccagacagttgcactggagtgtggttttattggcatagtcactgttcatccacaagacccccctgtgttgagctggagaatacctgaacgtaaacactgctctctctttgacttggcagctgtacagcagccgcttagtttaccagaaggagagatcaccaccattgagatccaccgctctaacccgtacatccagttaggaatcagcatcgtgggcggcaacgagacaccactgatcaacatcgtcattcaggaagtctaccgggacggggtcatcgccagagatggaaggctccttgccggagaccagattctccaggtcaacaactatgacatcagcaacgtgtcccacaaccacgcccgggccgtgctttcccagccctgcagcacgctgcagctgacagtgctgcgggagaggcgctttggcagccgtgccaacagccacgcggacggcagcgcgccacgggacgaggtcttccaggtgctgctccacaagcgagactcgacagagcagctcggcattaaactagtccgaaggacagatgagccgggcgttttcattcttgacctcctggaaggggggctggcagcacaggacggcaggctcaacagcaatgaccgggtgctggccatcaacgggcatgacctgaagcatgggaccccagagctcgctgcccagattattcaggccagtggagagagggtgaacttaacaattgccagaccagggaagccccagcccagcaatggcagccgtgaggccggagcacacagcagcagcaaccacgctcagccaccctcgcacagccgaccgggctcacacaaggacctcacccggtgcgtcacgtgccaggagaagcacatcactgtaaagaaggagccgcatgaatccctcgggatgacggttgctgggggcagagggagcaagagtggtgagctgcccatctttgtgaccagcgtgccaccccacggctgcctcgctcgagacggcaggatcaagagaggtgacgtgttgctgaacatcaacggcattgacctgaccaacctaagtcacagcgaggctgtggccatgctgaaagccagcgctgcgtctccggccgtcatcctcaaggccctggaagtgcagatcgccgaggaagcagcccaggccaccgaggagcagccgagcgccttcagtgagaacgagtacgacgccagctggtccccgtcctgggtcatgtggctggggctgccaagtgcccttcacagctgtcacgacatcgtcttacgcagaagctacttgggaagctggggcttcagcatcgtgggtgggtacgaagagaaccacaccaatcagcccttcttcattaagaccatcgtcttaggaacccctgcttactatgacggaagattaaa

SEQ ID NO: 261 - protein, 698 aa, Mus musculus
  VARIANT (1)...(698): Xaa = Any Amino Acid
ASGNCRFTMGTTSDEMVPVEQASSTSSLDPLCFECGQQHWARENHLYNYQGEVDDDLVCHICLQPLLQPLDTPCGHTFCHKCLRNFLQEKDFCPLDRKRLHFKLCKKSSILVHKLLDKLLVLCPFSPVCQDVMQRCDLEAHLKNRCPGASHRRVDLERRKTSQTQTQIEGETGSTVIDPPGTLPPETDCSGTVPGERNLTPASLPVWTEEPGLDNPAFEESAAADCSMRSCPVQTVALECGFIGIVTVHPQDPPVLSWRIPERKHCSLFDLAAVQQPLSLPEGEITTIEIHRSNPYIQLGISIVGGNETPLINIVIQEVYRDGVIARDGRLLAGDQILQVNNYDISNVSHNHARAVLSQPCSTLQLTVLRERRFGSRANSHADGSAPRDEVFQVLLHKRDSTEQLGIKLVRRTDEPGVFILDLLEGGLAAQDGRLNSNDRVLAINGHDLKHGTPELAAQIIQASGERVNLTIARPGKPQPSNGSREAGAHSSSNHAQPPSHSRPGSHKDLTRCVTCQEKHITVKKEPHESLGMTVAGGRGSKSGELPIFVTSVPPHGCLARDGRIKRGDVLLNINGIDLTNLSHSEAVAMLKASAASPAVILKALEVQIAEEAAQATEEQPSAFSENEYDASWSPSWVMWLGLPSALHSCHDIVLRRSYLGSWGFSIVGGYEENHTNQPFFIKTIVLGTPAYYDGRLX

SEQ ID NO: 262 - DNA, 53954 bp, Homo sapiens
ggcagggatttttgtctgttcagtgctcaactcctaaccctggaacagtagtgtctggcacataggagattctcaataaatcctagatggatggacgaacagacaggaaaaagaatgggaggtcagatttgaggttagggaaaagaataattagtttgcttttcaatatagttggtttgtgaaagttcactccctagtggagatgtcagaaaggcaggtaatagcaacttaacatgtgaaacctgggattttgtttgaatccgttttggaaacacaggaaactaatataattggaggtgcattgttgatcatcctaggggcttcatatagtacagcctctttatagttctggctttacagtgcaaatattttattaatatttgaatcatgtaacattatgcatttgtattttgcagggatatttgatatatatgaatctgtaatgaattacaatgtattttctttcttttaagttttctcagtgttagaactgtaacttaagtaaattagaagacattgtgtcagcacatgggaatcattctgtgtaaacatcaaggccaacaaggctctggtccctgcccctgaggccattgtctatttagtctggccttgagaaagcacaaatatggctcttcaaggtctgacccaaagttattcttaatctgatggtatatatgtatatgtgtgtgtgtacacacacatatatatacacacacacatatatatgtatatatacactttataatacatatataaagttataagtagagcaaattgaacatcctaaatatgctttttaaattattggtgtcactgattagctttgaaagctgcaacatttaaatttcttatatcttgttcttagttaagataatgaagcctgggaatctttattagtaatatcaccatgatattattttagttctatttcctttaccttattgcataggttgatcacagaatagcagtatccacccgattcttttgcatttattggagaaaataggactgacaagtttcttctgtagctttagatattttttatgaaaaagtataagattggctctggggcaaaatctgctatctaaaaccacctatttactaacatctgggttagtactaaagccatctatgctgctaacatttacctgtgcttgccttaaaaaaaaaaaccgggctggggatggtggctgacgcctgtaaccccagcactttcggaggccgtgggaggccgaggcgggcagatcacttgaggtcaggggttcgagaccagcctgaccaacatagcgaaaacccatctctactaaaaatataaaaattagccacgcatggtggcatgtgcctgtaatcccagctgctcaggaggcagaggttgcagtgagcagagtttgcagtgagccgagattgcaccactgcattccagcctgggcaacagggtgagactcaaaaaataaataaataaataataaaaataaaaataaaaaaccaaccatagatgcagcagcatctcctaaatagcacttttggctaacatgtgaaacctggctaacatggtgaaaccccgtctctactaaaaatacaaaaaaattagccgggggtggtggtgggcgcctgtaatcccagctactggggaggccgaggcaggagaatggcatgaacccgggaggcggagcttgcagtgagccgagatcatgctactgcactccagcctgggtgacagagcgagactccgtctcaaaaaaataaaaattgccccaactcagctggctggtgaagactgctgttaatgaagaaagcccacgtgttggaggtgctggagaagtctttcttgttggagcaaagttctttccacagcggtcttattggcagaggttcacctagatgttactggaaaggtttagcatgatatttaatatatttcctttttgaaataattttatgtaaattctgtttccaaattaaggtaacatgatttagagtaacctttgaaagtataactttagtataactgtcttcagtgtaggaatcaggcaggtaacccagtttggtttttgccttgatcactttgcactaaaaaaacctttttcatcatggtttaggagaatttcaaaattaggagaactaaaggtgaagggggtttaaaattttaaattttctattagccacaatttgacctcccttatatagaatatttaaaagattaaagttatcaaaaaataaaaatgaacaaatactgagactaaaaggtaaatataccaataagtgttttattatatataaacagatacagaatcgtgttttagagataaattcaaactccctctgtgtgtgtatgtgattaattactatttaagcaaagccagtagattatagttatagccagtagtttatagaataaaatttatgtgaagctcccatatgatacggtaaatatttctatgcagctaaatatccagatatgcttcttccagtaggaagaggctctggggaaagaactttattccgggaaagacagactcctatagcaaggctcaatcaagcatttttccatttttagtttttgcttttccaaaaggattgttggttattgaccggtacttcttgtgaaagaagggttttagaactcttcgatgctgtatatcagtcatttacccccttttctttcattgaatccacagggtcaaaactgttttcacaatgcctttctcactctttttggcacaagtgtctagtagaattttccagacctcacatgtgagctcatgacagattaaaaacagaaacatatatgagactccagattaacaaacatgtaaaataatatatttcttctatgttttttactttgaaaaaagttattttccataaaaatgttaatctactgggtttgttttttttattaacatggatatttgaattttcattactaacataatgaatacagacagataaaagctgtttgggagcttcagtaattttttaattaaactttttattttgtgataattgtagattcatatacagttgtaagaagaaataatacagagagatcccatgtaccctttatccagttccccccaatagtagcattttgcagaactatagtacagtatcataaccaggatattggcattgatacaatttccgttgtcacataaccccttgtgttgccctattatttgcccctaacccttcttgatccttggcaacctctaatccatttctataattttgtcatttcaagaatgttatatgcatggaacaatacagtatgcagctttttagcattggcttttttcgctcataatcttctggagattcatagaggttgttgttcatagaggttaatagttcattcctttttatcgctgagtaaaactctgtggtatagatgtgccacaatttgtttacccattcatcagtggaagtacatctgagttgttttgtagtttctggctactacaaataaaagttgctagaaacattcgtgcacaagtttttgtgtgaatgtaagttttcacctctctgggataaatgcttaaaggtatagttgctggattatatggtagttgcatgaattttttaaggaaactgccaaacttgtccagagtggataaaagggttctgaagtcaaacaagtttgacagcactgctttttttttttttttttgtgacaagagtctcgcactcttgcccagactggagtgaagtggcgccatctcggcttactgcaagctctgcctccagggctcacgccattcttctgcctcagcctcccgagaagctgggactacaggcactcgccaccatgcccggctaattttttgtatttttagtagagatggggtttcactgtgttagccaggatggtcttgatctcctgaccttgtgatctgcccgccttggcctcccaaagtgctgggattacaggcgtgagccaccgcgcctggcgacagcactgctttatacagaagcagctatcaaagctgatatgtgacatataccatgagaaaattttcctgtgttgataccaagtaaggaaacttttttcccttacccctttgtagattaaagggagtattaccttattctttgtgcatttgtaaattaacgggctgggttcatatgttgattcctttgaagtgccacaaatgcacaatatttcctcatatatgaatatagttatacatatcaggaccctttttgcatttcaggatcatgtatgagcctgagaacaatcttttttaaatgcctaatatgtcttaagaagtgggaatacaaaagattaaaaaggctatttttaccctcaaagaggaggggaggcagatgagcaaacatgcactgtaggaattgctgaagggaaaatatgtgtaaagggcagcaggagcagaagggaagggggggagcgctcaagagtaggaggaggcagaatttgagctgaagctaaggaatgagaaggatgggccagggggacttgagaggtagggtattcttagacccctggtaccgatgagttaagggaaccacagatgcttcctgtctaaccttcagtggtaactcttagctcatcgtctttttccctgggctggatctcttaggttagggccagtgaagaccctttaaatctgagtcaggagtaacatcgagagaaatgaactgaataatacatagttttggagtatgcaaaccgatggtggaaaaccatagttctttctgagagtctttgtggatattcttatcccttaaaccaggaagatcaagcatgttaatcttaactggaattaggtagtaaactcccttcctattgcactggctgtttttcaagatattattttaaatgtgttgtaataatcccgcccaagctaacagcttccttctctttactattccagcaatactgttaaatagattatacagttagaaaagatgcacattatgctacattttatctttatattttaggaaatgtttgagactattatttaacctgtactttagtatttcacactgctcacagatatataatatctgaactcaaacatatatgaacatgggcatgtcctcctgtatacatagatgtagttttgttcacctaaacttgctgaaagaaagcattattgtcacccagttggtcattcaacatttattgagctcctcccctgtgggaggctcactcttagagctgatagttcagtgagggaccccagtgtgagagtagtgtgaggcagtacagccagcttgcacacaaagcagaaagagaaagatctgcctgagctgggagaagaggggtgggattggggcttagagaagtgaggtcaggatgcctttctccttccaaaactcatactctaaagctttcctggaatatctttcctatcatgttattttaaagccagaaggaatgggtttatcttccttctttcttactaagtaactatatgctatatggctttgcacaaataataaaatctgtgtgaacatttgattctctatttttaataatagatagcacttacattgcacctatgatttgccagatacagcaatatatatgtgtatgtgtgtatatatatacgtatatatatctgaacttagatattatatagatatagatatatgtactgccttatatatataagtatatgtatatataagtatatatatgtatgtaagtatatatatatatatagtgtatatatatacacttattctttatattgaccctttgagatagaccgctgttactaaatgggaacatgttaattttcttcatgaaaagttttttgataaaatgaaaataaagaactgaagttatttagagatttagaaagtagctaaaatataatcgtcttaaatactttcttagtcatcatgtgggaggctagaattgtagtatttttcttgaggaagagaaaaattagaataaacactatcacaaagaggggtaaaaaataagtgaatattcttgctaattggtaattcttgctattgggtaggaaacaagaatctgcagaaattccgtattaaaatacctagcttggacgtgtctgtctggctgagatacaggatgtttctctccttaatctcatgtacttgcactgacatgttaaaagttacgatgctcaaagggagaagaacatgaattataaaatgcgagaaatgtttgctttcttgatgttggtattgataggagtttagattacaggctgctagtatttttttttattatttttatatatttatttatttattttatttttttcctttttgagacagagtcttgctgtgttgcccaggctgcagtgcagtggtgcgatcttggctcactgcaagctccgcctcccaggttgatgccattctcccgcctcagcctcctgagtagctgggactacaggcgcccgccaccacacctggctgatttaaaaatatagtagagacggggtttcactgtgttagccaggatggtctcgatctcctgacctcgtgatccacccgcctcagcctcccaaagtgctgggattacaggtgtgagccaccgtgcctcgcccatttttttttttttctttttctgagaccgagtctcaccctgtcacccaggctggagtgcggtggcatgatctctgctcactgtaacctctgccgcctcctaggctcaagtgattctcctgtctcagcctcctaagtagttgggactacagccacccaccaccatagccggctaatttttatatttttagtagcaatgaggtttcaccatgttggccagcctggtctcaaactcctgacctcagttgatctacctgcctcagcctcccaaagtgctgagattacaggcgtgagccaccgtgcccagccttgctggtattattttattagttcttaaaaacacaatttatctgaggccaactgtcctgcctgaatcctatgccaccacctcctaatttatgacagttgttaaatctgttaaaacattaatgtttttcttttaaaatttttatttatttagagacagggtctcgctttgttgcccaggctggagtgcagtggtgcaagcttgcctcactacagcctcaaagtcctgggctcaagcagtcctcctgcctcagcctcccaattaactgggactacagccatgcaccattgcgcctggctaattttcttattttttgtggagacagggtctcaccatgttgccaggctggcctcactcctgggctcaagggatcgtcccacctcagcctcctgagtagctgggactgcaggcacatgccaccatgctcagctattttttttttttttttctgtagagacagggtcctaccatattgcccaggctagtctcgaactcctgactcaagcagtcctcccacctcagcctcccaaactcctccctcactgcattacagcagtgagcctctgcatctggcctactttaatgttgtttttccaataaatactttaaataaataagcaaatacatatacgtgattggagaattttgttattgaaatagaaatgctagtagcctcaacatggtatcctactcttaaggttcttgtggcaggcacgctaagttctagaattcccctcccttgagtgtgttttctttgctgcacagttttacctgcttcatattccctgaatgtgctgtgtaccctcaagcccctgcaacttagctgatgctttttttcacccaaggtgcccttgtccattttttctctctggctgatacttcctgtcacaactcagcagtcccatgtttttttttcccttttgaaagtatttccggccacaaagccagagttagatgccagttcttttcatgtctctccatagtcacgtaacaccctgtgcataacttttcttagagtacttactaaattgaattttaataatgggctttaactgtcctctccctacctcttctgtctcgatgttcaacgtttggtacattctagagtctcttcttatgtaaatatttacagaagaagaaatacagagctgctgcctttggagttgaatatttaatccctgatccctcagcagtagaaagatggaaaccgttagatgaggggagcattcctggctaggctcgcgctaccctggaggaggctgctctaagagttatattggagggccgggcatggtggcttacacctgtaatcagcactttgggaggccaaggtgggtggatcacctgaggtgagcagtttgagacccgcctggccaatatggtgaaaccccgtgtctactaaaattacaaaaattagccaggtgtggtggcgggcatctgtaatcccagctgctcgggaggctgaggcaggagaatcgcttgaacctgggaggcagaggtcgcagtgagccaagtacgccgctgtactccagccgggcaacagatcgaacttaaaaataagtatgttggagaggacgcgcgcgcgcgcgcgcgcgcacacacacacacacacacacacacacacacacacacacacacacacacacacacacacacacacacacacacacacacacacacatgctgctctgagtaagcaagcccaaatcgaagtatggaatactatgaggtgaaattgaaatgtataacatatcttatctgtttaattgaattttggcaggtttttttcttttagtggaataaaatagtattgtactttgcagcatttgcgctgttatttatatacgctatgcagatgtatctttctataatctgtgtgacatatggagagagtattcaaatcatacatacgctgaaattcatttttcccatagtgctgagcaaaggtcattttttattattatactttaagttccaggatacgtgtgtagaacgtgcaggtttgttacattaggtatacatgtgccatggtggtttgctgcacccatcaacccatcatctacattaggtgttactcctaatgctatccctcccctagccccccatcccctgacaggccctggtgtgtgatgttcccctccctgtgtccatttcttctcattgttcaactcccacttatgagtgagaacatgtggtgtttggttttctgttcctgtgttagttgattctgaattatccttgagactacatttcaaagacgcaatctttgatattgtactgtaaatgtgtaaaatcaatcagaagcaaagaagcatgtctaagatgacatgcaaatgtattatatacctcaaacagcattactattagcacaattaattggctttaaaactaccattgaacagtgacatatttggggatttcagtcagtaaaacaaatcgattgtttcttatgtcacactatataatctatggtgtctttacctttcatcaaaagttgtttttttatcaagaacttgacagtgggagccaggcacggtggctcacacctgtaatcctagcactttgggagggctgattgcttgagtccaggagttcaagaccaccctgggctttccaccatggaaaccctgtctctacaaaaaaatacaaaaaaattaacaggacatggtggcgtgcacctgtagtaccagctactcgggaggctgagatgggagagtcacttgagcctggaaggcagaggttgcagtgagctgagattgcaccactgcactccagcctgggtgacagagcaagaccctgactcaaaaagcaaataaataaaaaaatcaaaagagacaattaaaacttataataaaaaagaacttggcagtgtaagtccttcttagccaactagaaaattaatttctttttttatgactaatttattacctgattcaacctttaattttttactaaaaaaagctaaccagtaatattacattgatacttttaacctatcttgattgatattaattaccttttttaatgtgtttgttttgcttatctagaaaaacacaccttgactttagtcagatacatcactgtctgttaaaggaaaccaagcgtgaagtggaagtctaacacatgaggatacagaattgattcaaaatgggaacaacaagtgatgagatggtgtctgtggaacagacctcctcctcttctctaaaccccctgtgttttgaatgtggccaacagcactggacaagagaaaaccatttgtacaattaccagaatgaagtggatgatgacctagtctgccatatttgccttcaacctctgctgcagccactagacacaccctgtggacatacattctgctacaagtgcctcagaaactttttacaagagaaagatttctgtccgttggaccggaaaagacttcattttaagttgtgcaagaagtctagtattctagttcataaactcctagacaaattattagttttatgtccattttcttcagtgtgcaaagatgtaatgcaacgttgtgatctggaggcacatctcaaaaacaggtaagcaaaaaatataaaagaagtaactccagattttggaaaaaggtggttcaaatgaacataaaaacttgattaaaacaaaacaaaccagagcactagtaagtaaatgggtgaatcaagtacagaagagatacaataaataagttgtatggaacagtatttaacattatttatcaaaaacatgaatacaaaaactacagtgaggaagtactgttttatacctgttaatatttctgctgctgtaatatgaaactgatatattcaaatagatgacaggatattatgatagattctttctataaagcagtttggcagtttgtttttaaaaactatatgaatgtaaatctccttttatctagtttattatcctaaggaaataatctaaaagcaggaaaaattgtatgtaaatatgttcagtgcaacattgtgcatagtttggtaaattggaatcagttatttaaaagtagggaagggttaaaaaatactatgcacataaactcagtgggatattatgcagccaataaaaacgataattttgttgcaatatggaaataaatacattattttatttgctaagatcttgtaaagattctgggttcagggactagactgaacaagaattaggagttggaaaactaaatatttagtggggatttctgttctcataaaagctttttaaaaggttaagtaatttatttagctgatgagttttataatttgattttgctaaaagacttgatctttaacttaggaagagttacagtatacgtcatttgtgtagaatcacataaaatggcagaaataaatactggtttctaatttcaagttaagccagttttacagtataaatctgcagtaatctcgattgctgtgaaaaacaatgcatactacatcatactggacttagatgtaagagtgtaagtctgatatagaatggcttgctattatactcacacataaaatcatagacttgaaggagattatctaatccccctcattttatgaataaggagactgagtcacaaaaatttagttaatgctgtagttagactcaagctttactgttcttgtttactattctaataaaccatgttgactctatcgtaggtcaagtcatgttctctgctgctatgtagtaaaagtttcattcatgtgcacatgaaatacacattcattttgtatcaatatattgttgatatttatttctaaacatcagagttaagacatgagaaacaatgaaaaaaacaaagatgttattaaaatgttggaaacatttagatttatagaatgcttaactctaaactgtgttgtctagaactaggaggtaagatagagtaggatagacagacttttgaaaatgcgtgtaataatgtagcattgcatttttttatatcttctgtaaccagcaagcatagaatctgaacatgatggcagaggcctcctggaaactgacactggtcttttgaatatactagtctgagtcaggactagttatggctgaagaatatttcaggctgcttctttcagtagaactgttcttttcagtgtataggcttcttttctaaacatcagttatgagatgttagaggaactgaatgaaatgtcagttcagttatttatgattttgagagctgaaagataacagtttcacagattttcaggaatattcctttaacatgcattcaagaatttaatttgcagttgaactattactagtgtttcttatcaaaccatttataatgagaatgtaaaaaaccttggtaattgcaaactgccttttcatttacatgttggtaaaggcttatccagttgaaggtttcattttccagctgtgcttattagtattgaagtaaccaattttatcatttctaaagtatcttaggcctgtaacatgaaagatacagtgaaaagatggatgattggaaaaggtggtgatttgcctgatacagacagctaagagtgattactgagtatataaatgtaaaaaaattataaaatgtaatatgatttttatatgccatttgaacagatagtgatgaacagcctgacctttctctgttctcttaaataagaacattgaaattcaggtagaaatgtatattatacaacattcaaccctaaataatatagttcatttgtttattcagcaaatattgattatctgctatgtgccagatacttttctaggtgttaggtagtctctgcaagttagaatctaatgccgggttgtagattcctttagaaacagaaccatgtctttatagtctttcagtttatttgcccaaagttgacagtcatctcatgttagtccaattaaattgttgatctgtgtttcagttattcattgctgagaaactaaccaccccagacacactgacataaaacaacaagcatttgttgattctgtgagtcaggatgcagacaggatgaaacagggatggcttgtctctgctatctttatgtgtgccacagctgggaaggagctgaaagccagggactgcaacagttgtaactggagagtctacttccaagatggtttcttcattcacatttctgacaccttgatgggaatgactaggtgcgtgggacttgtcagctggagaggctacaggtagccttcccagcatgacagcctcagggtatttaaagttcttacataagtggttcagtgtctagtaggctgcatggcctcatatgatttagccttgaagttgcctggcatcccttctctgttggaagcagtcataaacccacccatatccaaggaaaaggggacataggtttcaccttgtgatgggaagtcaaaaaaatttgcagccatgttctaaaaccaacataaactagcaagaagaatgatgttatgcggcgcagaatatgattactacgactgtttgcggcttctcggtatacaaatctcacttgtttgttagaaattggtaagtctgtaagtttcattgaaattcataggattttagcatcagcaacaaagagtcattgtataaaagttgcatggctgtcatgtgcctttgctcttgagcttttagggtttacaggaatctcttaattattggtagaaatagagcattagcagtagtttgcataaatttgataatttcacatttaagatcaccttcctatttgaatgaaatcctgcccttaacaaatgtgttttgatttgagaagagcaaacatttttctcctacagataaaatatttatgaaagatgaacatgtttaaataaaactgctatttttaactgattatgtattagtgaaatgaagaattttaagagacacggacagtctctatctttgaacagagaaataaagcctttgaaaaatattctacatgttgtactaaatatgtaacattttgattgtttctttgaaattctgccaagcaacatcagctatatagcattcctcctacgctctaccactcatctccaacccacccttaacgatttaacatttaagcctttggtaattgtaagtgctagttgttgttgttgtttttaaattgtgtgtttgtgccctagtttatggcaaggttcagaattacttttcctcttaaaaattacagtttaatgccattataaaaagtttacaatagaaaacctttaaagaagcctctttccttgctgagaacttttcttgttcatgagatggttatgaaaccttaagttcaagtttgttcagcctgtgccacatgcagcccaggaaggcttttgggattattttttttttaagcttatcagctatcattgatgttagtgtattttatgtgtggaccaagacaattattcttcttcccgtgtggcccagggaagccaaaagattggacaaccctgctttagatgatggtccaggaaaaactaaatagaaaaaaaagggatcaggataggctgaggcatgattgcactcttaaattcacactttaacttggagggaagtttgtgtttagcacattcttatcagtattgttttttcatgtatggtgtgaaaaagcagatatatgtatttgcaaatcatgtgtattctagtatccagaatatataaagaactcttagaaatgaaaagataaatccaattttaaatgggcaaaggatttgaatagatagttctccaaagatactcaagtggccagtaagcacatgacatgctcaacatcattagttcatttttatattggattatttgtctttttgctaagttgtaagaattttctatgtattctggatactagacccttatcagatatatgatttgcatatattttctcccattctgtcagttgtcttttcactttcctacatcctttaaagaacaaatatctaatttttatgaagttcattgttgtttgcttatgcttttggtgtcatatctaagaaaacattgcccaattcaaggtcacaaaaatttacatgtacgttttcttctaagagttttctagttttctctcttataattcagtttttgatccatttggaattaattgcaatgagaaatcataatgtgtattgttcaatcctttaaattttattgaggcctttcttttctttttttttttctggagatagcatctcgctctgtcacccaggctagagtgaagcagtgcaatcttggctcactgcagcctccacctgctgggttcaagtgactcttgtgcctcagcatccgagtagctgggactacaggcgcactccaccatgcccaactaatttttttttttttttgtgcttttagtagagacggggtcttgccatattgcaccaggcttgtctcaaactcctgagctcaggtgatcctccacctaggtctcccgaagagctaggattacaggcgtgagccaccatgcccagccttgaggccttttttaaaatggcctagcacatggcctgtcttggaaaatgtcctgtgtgtacttgggaataatgtaaattctgctgttaatggatggagtgctccatatgtctattgggtctaattggtctatagtgttaaagggtctattttctggttccatgtctagttgttctgttagtattgaaagttgagtatcaaaagctttattgttgatttgtctatttctctctttgtcattttttacttacgtattttggggccattgtttggtacaatttctgtttataattgtcatatcttgttatgtttttctgtcttttgctttatttatgtctttgaatctgaagtgtgtctgttgtagacagttggattatgtttcttgtagcccattctgccagtcactgactttttattgggatgtttcattcatgtaatttaatgtaattactgataaggtaggctttacatttgccattttgctgtttgtttctatatgtcttatttcttttttcctccatttcttccatttgtgttaaatatttttaatatgctattttaattcccgtgtcatttctcttaattaaaattattttcttagtggttaccctggggcttacaattaacatcctagtttatagcagtctattttaaatgaataccagcttcattttcactaatgaattagtcagggatctgtaaggaaatagaaccaatatatgaggagttggctgacatgattaaggagtctgaaaaattacacgttctgctctctgcacgctggcaacccagggaagtcagtagcataattcagaccttctcagtcagaaggtctgagaactaggagagccagtgatcccagtctgagggcaggagatgagatgtcacaactcaagcagtaaggcaggaaaataaggaatgaatttcttcttcctccaccttctgttttcttcaggcactcaaaggattgaatgatgcagccacattggggagggcaatctactttatactttatggagtccactgattcacatgctagaaacagcctcacagacacactcagaaacaatgtttaatctggataccccatggcccactcagttgacacataaaattaaccatcacaagtagtatacaaaaactttcattctctctcccctcctgtgtgctattattattgtacaagttgtatcttcacacattatgtgcccatcaacacagaattattgctttatatgtttttcttttaaatcagataggagtaaaagaattacaaaccaaataattcagtactgtactgatgctcttcatttttcacatgaacttgagttactgtttagtgtcctttcacatcagcctgatggacttcttttagtgtttcttgcaggttaagcatgctaccaacaaacattttgtttttacctaggaatgtctcaatttctcttttatttttgaagtcggctggatatagacttcctggttgagagttttctccccttctctgtctctccttccctcagaactttgagtatgtcatcccactgccttctagtctccatggtttctgaagagaaatcagcagatactattgaggatcctttccttgtgatgagctgttcctctcttactgttttcaagattccttatctttggctttcaccagttttattatgaggtgtcttaagtgtgtatatcttgtggttttcctacttggagtttattaagcttcttggatgtgtagataaatgtttttcatcaaatttgggaagatttttggccattatttcttcaaatattctttctactcctttcactctctctccttttggaactctcattatgtatacgtttattctcttaatggtgtcccacaagaccatgaggctgtgttctttttttttttttcttccctgttcctcagactggatgatctcaataaacctatctgcaagtttgccagttctttcttctgattcaattctgctgttgaacttctagtgaattctttttctgttttgtttttttggagacagagttttgctcttgttccccaggctggagtgcaatggcgcaatttcagctcactgccacttctgcctcccaagtagctgagattacaggcatgcgccaccaaacctggctaattttgtatttttagtagagacggggtttcaccatattgttcaggctggtcttgaactcctgaccccaagtgatccacccgccttggcgtcccaaagtgctgggattaaagcacccggccatgcattctttttcattaaactttttaaccccagaatttctatttggttctttattatgacttaatgtttctttattgatattttctttttgataagacatcattctcatatttttctttagttctttagataggtttcctttacttctttgaacatatctaaaatagctgatgtaagttattgtctgataaagctaatgcctgggcttccttagggacagtttctgttggctgctttttttttttttttcctgtgaatgggctgtacttgtttctttgcatgtttcttaattttgtattgaacagtggacattttaaataatataatgtggcaactcagaaaactagattcttctccttcctgaggacttgttattgttgttgtttgtttgtttgctacgtgactcttatgaactaattctgtaaagtctctgctcattttgtgtactggacagctaatgattggacagagaattctttaaatgcctgagattaaaaaaatctccccgtcttccatgggggttctgtgtgcatggtggggcatgccacaccctcaacactcacgccactgacagctccaccttagcctacacacacagccctgaacatagctgaacctctgtggacgtgtcattccctggctcttccttgtaaacattctggttagccttgtatttgtcttcaggcagccacaatcttcagcaatgacctctgattttttttttttttaaccaatgcttaacaaatgcccccaatgaaaaggaagtttgccctgggtgagctctgagtcaagccaagtaaagacaggcacacagtcatacaggaaacaagtatagggggaaaaaaaagaagaaaaaagacaagcacacaagaggggaaccatagacaggtcagttaataacagatctctgggaatagggctttgaaggttctccagtctgctcttccagtgtctgccagcctcctgatttccactgtgatgtgggctgttgcttttccaatattctggggaggtgaggatggaaatagggtaaactcaaatgccacagagctctctcttcttactgagagtcagccatttttcttgaacaaatgttctccctactgctataattctttggctaatttccacacttcagaaatggctggttctgacaatttcttccagtgttcttactgcttttatggaggagagacttttcagatattcttaattcaccattttcactgacatgacttgaattaatttttgtttattccctagctatttttatcatttttcttgattctaaggtgttcacattctttcagtgtcattaaatacctggcattgtgcagtggttagtatgcattgttttattttgtttctactgcactaccaccacccccactattaatactaatattactgacaataatatagtgtgttgttgcaccatgtgtttcctagtgtgaactagctcatatgcagttgttatcagggaatgatgtcactgtagcataaatcaaattagtccatatataatttttcccttaggaggagagccagaatagtgggaatagaagaacaaccttcagcaggaaaggaaaaatccctatttgggtcttggctgctgcaagagcattttggttttatttaagaaaattaaaaaacacacctacatgtacagatccctccctcaggaggtgcagccctcagcccatggcagattgcactgcctcagcagcccaccatctcagagctccactgtatggtctcagcatgtgcctacctcaatctaattagatgtcacatgctgttctgttctattgtttttgtttaattttgatatcctctgtactagtctcctgctacactgagtcacctgcctgaataaaccaagtcacctcccccagtgcaatttcagtttgtgttcttaaatgttccatttccaaagatggataggtttttatttttgtgatttctgttttttaatgatcgctaatacccttctagccccaacgttctgtgattgtgtttctaggtacaaatttttagaagaaattcaatttatattttcccaaggcctagaaaaagaataccataggaatgaatttagtatgatacactggaaagaacagaagctagaagcctttgaaattagatctgagtttgtttggattatggctctgcaatttaatatctgtgtgatgttggcttagttggttaagtctcaagtttcccatttttaaatggggataacagagtaattgtgaggatttaatgaaataatgtatataaaggttgttacgtaagtaattggcacaaattaggcactccacaaatgttgagtttttcctttctctttcagttccaagtatttgcagcttgagggatgatggctctgagctgtctgtattcatgagcttttatctgcccaagtctgctctgatctactcattccctaatactttttttaaaatatagttttattgagattcacatatcatcaaattcacctattttataaattcattgtaaattgcccactttaaataaattcactttatttaaagtgtgcaattcagtgctatttagtgtattcacagaattacgtgaccatcatcacaatccaatttttagaacattttcagcatacctaaaagaaacccaatacccattaacagccatttcccattccccgatacacggttttgagtgtctaccccaactctttttttcctttaagccctgttgcagtttttctagaatgcatatattatgttaaaagaaatgtttgtagtataatctgggcttttgccctcatcagtgaaagtgttctttctgaggttaccttctaattgccaagtctaccaacactttttggtccttattttatttgccctttctgtggccatttgcactattggtcactttttgttgttgactgcttgtctccctagttaagtttgcactctttgtctcataatctccttctgtctagttgttcaatttcatctactcaggctggtccatctcatttaaatatgggttttcccaaaggttcaatctatggccttcctcttctaatgctgagtgaaataatttttctgtatttttacatgatgtcatttttaatatttttctttagttcctgttagcagtttgctgtctcactgggactgtaagtatacttgttactttacctctctaacaactttagcttttccttttaaaagttatttttgtgtgtttaataactataagataggccttacatatttcgtttgtgaaggtgtagagttgttagctagactgattcccaggtgtacataatctgtctgtatttcttcttaagttccagttcctggttcattttttccattgaacactagctattcttgtgtagatatttgtgtatgatgtgattttgtaaattaaatctttacctgtcttttcagtcatattatttttatggtctagttttagcctcaacttttttttgaataaaatattttaaaaatatatttcgaattaaacctgcttacttgacaaaagtaatttttttcatgatctaattttcaaaaatacttgtcaggcccttgcgagagcattccctggagtgctgtacaacaatacagaggagaaaaccatttgtcccccttcttaacaaggtgtagagcaaacaagaaatgagagaaaggtgaataaagatatttcatagtgaatccctttcaagaacttgaaatccaggatttaaaagaaatctttagttcaggagggaaaatattacttttatagttaagcgatagcttttagttttaattgtatttaattctgtgttgtgttagaaattttggagttttaaaaatattgttgagtgaaggtctgcaaccctaggcataaggtctgtgatcacccatcctaccaagcgttactgtagctaattacaaccaaagcatgtggcatccgtagagtcgtggtaggcctcaggtatatgtgtccaactttccttcactaatcttcttgtcctcctcccatccttcaaactaggggttattagtcactgtccaatcaaggtgtccaatggaaaggcactggccccttgacatcatttttaatatttgttatatagagcctttatttaaatgtttccttgattataagtttaaaaacaagcatccatcggctccttttatttgcttaaataagtaaaaacaaacaggttaacggttgtgatttctgggtgtttatgtaagtttccaagtacttggaatatattcttcagtttacatagcatatcaataattctattgaaattctaatttcacaaactaggaggcatatttttctttccatgtctatcataaaataaattatatgggtctttcctttgccttgcagtaagttgtaaagcttcagatgtctcactacccactaattaatgagcgtgtcgtgtgtctgtgaagagtgtagaagcatggtggcacaatcaaggtctaagtcaggacgcaaccacttgtgggagaagactgctgatttcactgctgtggttaagccatttaacctgtaaatgggttatgtgatcagaatttcagaataattattgcagtacagagatgactatgagggtgttttctggtgacaagtatatacctgcatacaattttttactgacgtattctttggatacataccaaaccattgttcatgctaatccttctgttcttgattatctgctctatggagcagtaagaacttagtgtgagtggagattaggatcagaactatgtgctgcctataggtacttctagcttctggttctgtttgtgtagaagctattagtccccctccctattttatttgtttgtttgttttcaaaatcatctggaaaccatctgatattctttttctagatgtcctggagcttctcatcggagagttgccctggagagaaggaaaactagtagaactcaagcagagattgagaatgaaaatgggcccactctactagatcctgcaggtaccttatctccagaagcagactgtttggggacaggcgcagtgcctgtggagcggcacttgacatcagcgtctcttcccacatggagtgaggagcctggccttgacaaccctgcctttgaggagagcgctggagctgacagtatgtgtggtgcaactccttgtgtatttcatctctatttcctttcttcccactacttgcccaacatgtacttttttcatctttaaagaaaaatttaaaaaataaaaataaacagaaataaaagaaacttcattgagatataatttatatacatcattcacccttttcattgtacaattctaacagtttgcattttagaaacaaatcacaaatcttacccccgaggcagatggtcctaacccatcccttttctgttgcagtctgtgcactcactagtcattcgcgtggttattactgtctgtgttcagaaacttgtttgcttcttgtcataagaagtcaacatcaagaacaacacaattaaatgctattctgtgtcaggcactgtgctaaacattttatatgtattagctatttagatgcttgtaacattttaagtttgggtttttgttttttttttaaacaagaaaactgaggcttgagagattaattggtcaagtttatacaaccagtaaatgactgggtttgtatttgactccaagaccatgcatctcaccgttatacacctctggtaccagccactgctctgttacccactaggaagttaacagaaggcccgtagtcatggatcttgggcatatcatggtagtgggcccttgatatttccttttaaaaatgattttctttttccaagctctactacaaatttgaattttccttgccgcaactatgcgccttcttcatttcctacgtctccgttcaagacccacctcttcttatgagcttgatgtggctactctctcaacacctgtgctgtttctatgccacagagctagtgtttcctttgtactgcctctcattatgtacagttgtttcgtggtccaaattttctctcatcaatgaggacagaatgactttcttttcatatttcttaatcagatcactgtgtcgtccctagtgatctgatacatagtagctatttattatttactgatcagttttagtagagaaaatttttagataatcttaacaacagatattttgtcattttgtttcttatccagtgatactgcttagctgttaatcatgtattaatgtgacatacttacctgaagataatcagaatataaattgttgggtttgtttatttttttaacatctgtttttgtctgtctcatttttaacttggcagccacacaacagccacttagtttaccagaaggagaaatcaccacgattgaaattcatcggtccaatccttacattcagttaggaatcagcattgtgggtggcaacgaaacacctttgattaacattgtcatccaggaggtctatcgggatggggtcattgccagagacgggagacttcttgctggagaccagattcttcaggtatcagttttaattattctgttaacttgtgcctttttgttccattcttaacacttaaaccttagaaaattgtgctgttttggaacctaaattatatatagattagttttactgtttctatatgcaaaacatcagaatttatgtgtaatttgtggtattttcccatatacacagagtattttttcttcctatcttaattttcattcctgcatgcgatgtggcttggcacatgatctcaggcttgctgagctagctagactcttccttgggctgactagcctcttcctgcttggacttcttgaatgactgttcaagggtcaccttcatccatgttgaaattatcatctcattggtattattttatacccagttttcccattcattaccttcattgttggatttatccttttctatacagactactaaaatctagaaaagaaggaaccatgcagcactcataatttataccacagattataagatagagttcagaaatcttgcagtcatctcctatcaactccctaatgcactctcctcagcaaacactctaactctgcattttcaataatccccttcgctccccttactgttttccctttcagaagatgatctttaagaagaaacaggtattctccagaaataactagcatgggacaagatattttattagagggcaagttgagatgaggggaggaggatggtaagagttctacaatcccggagttgatgttaataccggcctggaccattttcatcatacaaaggtgataataattgaagcttaaaaacggataacttctaggagagagaggaaatattcatgaacaagaaaaaatgtctcctgtcaacccaagcgcagggactcctctctctccttggatttgtggttcggtccttcaccatgacctgttgatatctaccccctacttccattttcctgccacttcttgagtctaggacttctcttcttcatatctaatttagtagaataccccatcatatacttctgcctcccaactctcctcccttaaatctgaaacaatcactgccaggttaatacatcagtaaccctgcttgccttgcaaaggttcaactaggaggtcaagtccagactgattaatctaatagtcagggtcctccacggtctcttctacaacctgtcttgttaatctcaattcttcatttcaggcacaccagctcattcatttctcacaacattctaggcactatactagttgctggtggtacatttcagagcaaaatactgacctgtcctcgtggaatatacaatctagtggaagagccagacatagcagtcttcttccttccctgcaaacaccttattcccacattgcagcctgtcctcatctcatgagccagtttgttcaccttcatccttaaagcttttgttcagccattctcccccatactgattcctcctacattagttattattggcattcatcacttttctcttcatcacttggcatgtgatgagttacagagaattgtttgaacattttacgtatgtaggcatgatctaaggtaattgcaaccaccctaatggtacagattatgatacagatttctcatagcttgtagtaagtgctcagaaaatatttgctgagtcaataaaagagtgaatttgaatataagatgctgttgggaatagccatctcctttattaaaagaaaaacttggttaggatttttagttgttgaaaagaaatctctagacttggggctatgggagtctacaaaggcagccaggattgaccctactagggattcttgggtttgatttccactcccgcttgtatgctgcttttcatggtgtattattcctgaaaataattaacaccaagcctaaaacctttccttcattacccctaggcatggctgagacagactgagctttcaaacagtgttttttttaccaaatacttagacgtaatagacgaatacaggaacataactaatccagctcatataaaatcagatttctgatcctgtcatagctagctatttagttatcctagctgcattttatgatattagtactttagctgcacaggctggcacaacttgtaggaccccttgtattatttacatcctagctcctgacttgattttgcagagagggactcttacagctcatttcccaggttcatcctcccagacatcttgacactttggtggtcaggaccaggaagggcagatagtccttttctgcagcccactgagtgttctttgactctcccacttctgggctttttagctgaaatgtaagtgtacacttattttttgctactagcccagtattgttacaaatgtttttatttatatttctttgaatataacagatttgtttaagtttttttactaatacatttcatcagtgggcttgtttctattttagagaatggttcattaacactactgaatctttagacctcaaaagattgtaattatctgaaattatcaaccatatttttgggaattaattcagttataaagtctacattgtagaaattccactgcattattactgtttatggaaacctgtatactaataactccaataatggcaatcttacatctagtttaatgattcaaattgataagaaaagtctgagcacataatctgattaatgaattcacaaagggtctctcctattataggccctgacttctggttggcttttaactggtgtgttggagccaagtaaagccacccccctttcccacatatggactatttatggttattcaagagtaaacacttggaaagaggcctattggtattttttactatctggttacctccaactttgtataagctaaataaatataacacagtgagccaatttgaaaatctcgaagaggcagtaagatggttgatttgcagaccagagagctagcttgcattttcatttttgcagaccatatacataagcagtgtgtggctttggtggttttcccacatttatatatatttatttacatatacaaatgttattaaatagcctctttgaaaaggagaaccatatgctgttagagctttttgctactcttagagtttcatatgcagcctctttgagcagttttgaagaaaaaaaaatactgctattataaattacctcaatatcattaataaaagtaatataacttagaacattattaagaataagtattttcagtttaatgaagtcatcaataatggcattttcagttctgaaggaaaataattacagctgttgattgtaaaaatacatttagctcaaaaatgagatagtttgctatgctgatgttatttttacaaaatctagaaacaatattttatttggtttctgctttctctgaatttcactggcaaccatgcattcctggaggaaaaatctttttccagttgtagaatattccccagcctgcttcacaaagatgttatgaggctgcatgtttacacatggctggattttagccagacgttttgtaaagtcatttgtgatatgtgtgatatgtctgaatataagacagaaaaatgtgaacctacaggtaggtagctttgtagctaaatagttggaaatggtggtttgactaatgaatctatatctgcgtggatttttagaagctgctttctaaatataatagaacttcagaagttccattcttgaccctgtattattcaatacttttaccaaggacttggatgactaccaaattaatagatgttgcagacttgggagaaagcaagtttgtgtgtgacatctgtgcatttggtgactgaattctgaaaggtgttaataggtcaaaatcaacaaaattcaaaatagtatttacaactatcaatcctaagtcaataggaagaggaaagtcttgcctaatgtggatttgtgtgaaaaagatgtaagaattttaggtgatcataaacacctaactcagagcctgtcatataacagatggtcagaggatgttggtttcatctcagaccgattcagagaagaactctaattgtgataaatgctaagaatcatgctcatctcttgtaactaaagaaataattgaagttaggtgtattttctaagtgctgttacatacccaaggatcagtcactatactttttttgagattataaaggtgaatacataaatgttatatgagtattgaataatgcattagatatacattatattttacttttaatggtaaaaaccgtaattacttttgcaccaacctaatatttctgtgctgaagaattagagtgaaattacaattaacctggttttctttcaggtaaaagtcacttatctaaaataagtttgtatacctgaaatgtgctactttccttaaaataacaatttattttctctagcttaagtgtatttaatttggaagaagcaaatttgtaatctagtaaaacttaaatttctgttccactagaattagtatttatttcattagcacttgccccatgttaatctgttcattctcatactgatcccatgaagtaaacacattttacagatgaggagactcattcagacaagttctataatttgcctaagttatcagttagtaaatggtagtacctaggactctaattcaagaccgtcattaaagcccgtgatcctagctactattctctccttgatgctagtcattgtaagttaatattagaaactctgtttttaaatgtctttaatgtggttttctttgtaaataatgattgtatagcattctcaccatacttagcactctcacaatacttagtttcctgtggaaatgccacataaacattcctacaaattggaaaaataaaaggttgtcacacttcggtcacaattctttttttctaggtcaacaactacaatatcagcaatgtgtcccataactatgcccgagctgtcctttcccagccctgcaacacactgcatcttactgtgcttcgagagaggcgctttggcaaccgagcacacaaccattctgatagtaactctccacgagaagagattttccaagtggctcttcataaacgggactctggtgaacagcttggcattaaattggtgcgaaggacagatgagccaggggtttttattcttgacctgttggaaggggggttggctgcccaggacggcaggctaagcagcaatgaccgagtgctggccatcaatgggcacgacctgaagtatggaactccggagcttgctgcccagattattcaggtaaaccctcttggccttcattccaaaggcttggccgaaatgatcatatagtagtatttgttttcactggccaataacatcagaattcaggggacattttatatttcattagaaaatcgggtgtggctacctgaattctttaaaatccacactagtataacttcattggagatagtcttttctaaaaactatatccctgtgaattttggggatggttatttacagagcgtaggctctactgtttcacattcatttctcatttgggtcctgggttctactattaagccagatgtagcagatgatatgtccaccttttagaagtgaggaaagggaggctcaaaagagctgtgattaccaaggatctgacttacctggtctcttaactccctgtcaggatctatataaatagaggaagaataactcttatctctatagtgctttgttgttgtttctaaggaattcacagtgtttaaaatacatgataaaatttgtcctcatagcatctttgtgacataagtaaggatagtcattattagagaaagaacatgtttttcataaaagcatgaagatggataagttggaaagtcatccagaggagatctatacattctgcaacatgccatagcatttaatgatatgagcaacttctacagtgataagggtgcaacaaaaagatgtttttcttaaagttagcaaaacaaaacactgtaaaggaaaccaagaattatgtaattgaggatcaggaagtagggtaggccgatagtcattgaagaatgtgtttacaacacagaatcaaataacaatgaaaatttaagactataagaaaattcaagtctcaactctctttattgtattgagaggagattctgatattggtctaatttcatagacttgaggtttaaagaaattggatgccttaaaatttcctcaaatcaaaggcaacattaggacctatatctgtgggtattagccagcagctgcaccactaaaacccagctcatcttgtaagagtggagattagtgggagggaggggagaaaagaggaggaggaagaagaaagctaatagagttatagcatctgtttgagtaaaagagtcaagtgagaggccagatcaataagatagaaaataatagatggactatatgtatttcaggcaatgtttaaattatctaatctagttcattcaattggatgattctaactaaatttctaaccaaaatgtgaaaaatacagatacacagatagaaaatgtattttaaattgtccgtgatcatattttatatttggatgttataaatagtttcaacgtattttgtgctataattttctccaaataatggaaaactaaagttgctctgtttctttttgaaaataagtaaaagcgttattgtttttggattttaaaaaataacatatactccatgtcttaaaaggagaccaatagtaaatgattttagtaaggcattaaacttgtttcttacttcttttctaatgtaagatttgaaaataaagtgatttcttaacattattgactataatcatgggagaggtctccactttgtaccacaatttctttaaagcaggctatcatattttcccataggaattacagtaaaattgggcattgtggtcatgaccaagagtcagcatcaaataaattagacttataatttaaaaggaagtattaaataacttgtaaaaatgtaaccaatgtaaacatatgttcaaaatatgatagctaacaagcctctaaatttaaaacgacagtcatgaacctctaaaataatttaacactggagacgtgtgtcacattcacacaagtatgctatatatatatatatatatacacacatacatataaagtcttgttatgcaggatttctgtagtcattcttttcaagaatgttgaagccgatatcctacttttgactcagacctatagcagcagaaacaaagctgtgcagaatttcattatgatttctgaagtagccaccatggaaatttatttcaaaagtcacaatggactttaatcaagttttgaagcagttcttccttttatttcctttgctctgtcttgcaatattaaggccaaccttgaagatgcaaagaagtattacaagaaaagttaccaatcatggggcaataagagcccaggcagtgtgaccactttgccttggtcattttggaggtggggttgcagacggcatgcccaagatttttgtgtgtatgtgcttcaactgctgaagttttaagatattagctaatgaaatgaactcattcctcttgccaccaggtgcttgcagtcactgtccagatgacgccctggtacagtgattaagaagttcattgaaaattacactgtgtgtaatctttaaaatgacaaacatcattagtcacttatggtaatgtatttgtgttttctccaggccagtggagagagagtgaatttaacaattgctagaccagggaaaccccagcctggtaacaccattagagaagcaggaaatcatagcagcagcagccagcaccacacaccaccaccgtattatagcagaccaagctcacataaggtgaggatttttttttttttttatgccaccatcaaaggatcattgttacaagctggtaagatttaaatgaaggtttttttgtgtgtcagtcacacctcaataaagcagtttttttaaaaaaaagattcaaatgagggttgttattctgttgaaaaatataggtgtttggaatatgaaatgtatatgttttgctaccttggaaagtgactgctttgttccttagatctggagatagtttcttggaggggaagtttcctttgccaggcgattaacaagaagcgtgaaatcttctatctgtttaatcctacttgaaagtggaatttatcttgggttgcttatttaaatataagagttagttgatgaaaaaacataagacaagattgacaaatctatgcttaataattgagcctgttgcctacagaacctgaattagatacatgaagattaaacatatgaatcatgaattttgataggtacatatatagcatatttacgtatttgataggtacatatatagcatatttctttttatgttaaagcttagaggaatattaccctaaatcatttaaaatttccatatgttaagctttgttactgtttcttcagaatcagtatttcactggttttataatgtattctacctgagctgagaattttgatgctacctcactttcagtccaaaaatctgaaaggatgatactttagcattcttgatattatttacttcatttcatccttcatttgaactcttaacttccagtgggccagaagttttaaaacaatgatgttatgcttacccaattatgcaaaaataaaagctaaatgtgacctaccagagtaattctccttaagtaaaattaaattgctttactaagcaaaaacttatttattgtcacctgaaagtaacatttgagtgaataattagctttggagtctgtctctggtaccctaagaaagcatagcttaaagacacagtatttttggcccattgggtttatatggttttctgagcttaagttctctacagacttgtcattggtctttgatttagttaatactaaaaagaaattataatcacagacttcattctcatttctgagcaaaaccaaaatgtatgaaggaaacctataatttgcctttaaataatgactgtggaaaaggggtaattgttttaaacaggactttttgaataggtgttgtttcatatagctagtccttgctttacaagttttttatacatataaaactataatataaggtacaagttgataattgaatcttttatgttattgaattttataatttgagataggggtgtatataacaacattatagttttaagagagtttgaaaaactgtaattaataattccagtattcctatagcaaactctccttaattcaatttgttgtgggcacatgtatttttctgtcataactatgctaattctcattctctttaattttatatgacaatgttctaaatagtgatgctgaatttattctattccaggcactctgcaaacctggctggttagaaaaaccacttgaaatggaatgtgttcatttagctatttactactaagatgctccatttgttttgtcaaatcctgatacagaaaagtaaaggtctcctagggaaaacacatacacattcaccaaaacaatcttttcagacaattataatcattctgaaaaaattaaagtatatattagtcttctataaagcttcccagtagctgttctgataaacattcatgtttgttttaggaagttccttgaagcaaactgagtataatctttgaagtttggttgggttcctgggtaaaaattgcatacattttagacacctagagtaataaaatacccacactttgcttaaatatgtaagggctgaacctgcttaaatgaatatactcaaggttgagtttacctgagttgtcttcagaataaagttgtgtttgtctaattttgaaggctgctgacaaaaatttcatacctttagataggagattgccttaaaacatttacagattttctccttggtcataacattttctgggaatactatgctgctattacacatagctcctttggtaaaatttcaagagtatagatttcacatctggagaagggtagataggcctagaattccaggccctgatttagagatttgataaatgccattattaacagttaaatacatgtcaattctctaatgtgatttaaggaaatgttataattctgtgaatgtaatttgtattttttatattattaacaattttaattatctacaacattctcttaacagttaataagtgttaaaaccttctgagacattatcttacactgtacacttaatgggatagttcttgtgtaggtgcatatatacaatatgtacatgtagtctatcacactatataaacatatacaaaatactatttgtattaatatatagtacattcttttaacatacataaattttgaatcccaggacagttgcctatattaacatgattcaggacaagttacatgacctccctaagtttgtttcatcatctgtaaaatggggtcaataataatatataatttcaggacttttgtgaaggttaaatgaaataatgcatgtaaaggcattagcttttcacaggctaagcccaaatgttaattattattttaatattaatattgcatatgtacatcttattttttactgaattctaattcaaaagaaaagtgatgttttaaattctttttcttccaggaacatctcaataataagtagtagtaacaaatgtcagtaaaaataggagatattaatttgttgggaatttatttccctgtcattaactttttcaaaaattcagtcattttatatccttttagcttttcatgaagattttgaaggtagatttgcatcttcttcatgattgagcactcatagtagtagtcagtgagaatcaggagataggtcgatgacctttttctggcagttgccaaaatctacacttttgtactactctgtcaacttttctgtcaaagaaatgggggaaagatggaagtaaaattaattgatttgtcttcagaatcttaaaactcaaaagcatcatttacttttgtgaagttgatcaaacatgaagctcaaacaaattatacaaatgatgtgcttattttactttgactgctgtatttcagcagtcctgagttttttcagctacataaacagtcatgaaaataacatagtccaaaatttgacattgatccacagcagacttattaagaactgtgtattactttcatttgcaattaaggaataaaaaataattactttataaatgccatgtaagttattaccttagtttgaagtaataactttacttcaactatattttattcattatccaatgatttttttcttgtatgttttaggatcttactcagtgtgttacatgccaagaaaaacacattactgtaaagaaggaaccacatgaatcccttggcatgaccgttgctgggggcaggggaagtaagagtggtgagctgcccatctttgtgaccagtgtgccaccccatggctgccttgcacgagatggcagaataaagagaggtaagatgggatcttgaaaaattttaccacatcttatttctgaattaaatgcacatttaaaaaaataaagaatatctacaaagtatctattaaacatgacttttttaagttctttaaactgtcccttgcatatggaagcataaagtcattctatgaggttagaaaaatgccttatataaaggaaagttgctgaaccttgatgacagttccagaatttgctaacagttactcagactcttagattattttatcttgggaaaagatcctctagcattacaacagacttagatactccaaagggccatctcactgaaaaatgtttcttttaataaagtgtctgtgtagaaggggactcagagaggaggtggagcagaagacaaaattaattttagggataaatgcatttgccatttcatattccctatcaatgctatataatttgcatagatgggggttgcagctagccactattgccatggtaaaaatagcagtctccattgacttagtttgtatataaggtaagaaaagtgactctgaaaacctatttttccaggaatgaagttgaacccctacctcacaccataaacacaaattaaatcataatggatgcaagatctaaatataagagctgaaattcttagaagaaaacacaaatgtaaatcctcatgaccttggattaggcagtagtttcttagatatgacactaaaagcaaaagcaacagaagaaaatatagacagactggactttaaaactgcaaacttttgtgctacaaagaatacaaccaagcaaatgaaaaaataacccacagaatgggaaaaacatttgcaaattatatatatgacaaatgacttgtgtctagaatatatattcttacaactctaattaaaaagacagaaaacacaacataaagatgaggaaagaatctgaatagacatttctctaaagaagataaataaatggccagttttcccatgaaaagatgctcaggctgggtgtggtggctcacgcctgtaatctcaccactttgggaggccaaggcaggtggatcgcttgagcccaggagtttgagaacagtctgggcaatatggcacaaccttgtctctacaaaaaatacaaaaattagctagctgtggtggtgtgaatctgtagtaatcccagttaggagctgaggtgggaggatcacctgagctccagaggtcaaggctacagtgagctgagatcatgccactgtactccagcctagcatcagagtgagatcctgtctcaaacacaaatcaaaaccacagtaagatactacttcacaaccagtaggatgacaataatgaaaaagacagccaataacaaacactggcaaggatgtggagcagtggaaaccctcattaattgctggtgggaatataaagtggtacaactgtttttggaaaacggtttggtagttcctcaaagagttaaactgattcctcatatagtttccatatgaccagcaattccacttctagagaaatgaaaacagctgttcatacgaaaacttgtataccagtgttcatagcagcattattcacaatagccagaaagtggaaaccactcaaatgtccatcagctgaggaatggatcaatggaatgtggtctacccatacagcaaaatatgatttggccatgaaaaggactgaagtactggcacaaattacaaggatgaaccctgaaaatattatgcaagtaaaagaagctagatataaaagaccatgtatgattccatttacatgaaatgttcagaagaggcaaatctgtagagacagaaagtagattagtagttgcttagggttggggaagggaaatgatgggtatagagggagtgattaaaatgttctcaaaattactgtagtgatgattgcacaactgtgaatatattaaaaccataaaattatgttctttaaatgggtgaattgaatagtatgtgaattatttctcaagctgctattaagtaaaggttatttgtccagttgtagtattggggtaattttatttcctttttgttcttttattgtgttttctaaattttctacaatgagaatgatttgctttaataatctgaaaaactgatgataaattgggagagataaatttctgtagactttgtagcacaaatgtctgcttcctacaaaactaatcctttcctaacctttgatataatcctcattgccattttttattatattacttagcagagcaacagttcttttcttcctgaaacagggaagacattcaaactgcaagtttcatttcttcatgtgggcccagggatagcttctttgtacatattctgatgtttgccctgaataaactatacagggctgtccttatgtatagaactgtgtaaatataaagcagaatacattaaagatttatttctaagggcaaaggatcaagtgatttttgattggacagaattgtagaaatctctgaaactcttaagaagagaaatgaacctgcccagggcctgtacacagctaaactcagactgatgattcgaacttccaatcatgtcaaggtgcctcaggccacacttttttctatgtattatgacattattttaaaattatggaatgttttctgtgtattgggtttcttctcaatattataaaaattacaaagaaataataaatgccatttattattataccttatctcatcagagttgggggaactaacttttgttgcttagtttataaacaacaagatttgcaggtgaaaactcagtggctcagctcatttttcttgtttcttcatctgaacaggtgatgtgttgctaaatatcaacggcattgatttgaccaatttaagtcacagtgaggcagttgcaatgctgaaagccagtgccgcgtcccctgctgttgcccttaaagcacttgaggtccagattgttgaggaggcgactcagaacgcggaggagcagccgagtactttcagcgaaaatgagtatgatgccagttggtccccatcatgggtcatgtggcttgggcttcccaggtactgagcgctttcttgttgctttatggaaatcataatcatgcttgcagcccttatcagtgtgtagcatgataaatttactcgttgggataaaaaaaaaagctttaattcagtaaaatagcaacatcaaatcaaattacaaaagaaaaggataatttttcttaggatattacactttaaaaggtacacaaagaaagcagttgtgtccattcctgtcaaggctcctcagtgggctagccatgagattggataacccagcctcttgcttagaaaagttgtcgtttaccagcactcattccgctatgtgctgagacttcatgcatttttcatcagaaaacccaggccaatcttggggcttccccccatcccagaagcctttcttaacacctttttaaatttattttaactctcgctaaaaagggtggcatttaaaactcaatttttattggatacaagagtctattaagccaaaccattagtgttcaagaatggctgcttcacttttattttttataaatgtgaccagccaagatatgctgtggttggtcagtgtcggggtcacagaagcacatggaacctccagtggcatcccagggtacattcctttccgcggttgttgtttgacatttgagataggaagaatgtgttcctatcatcatttgttgtctaatccgtttagattcttaccgtacctaagaatcctaaaactaagctatgaagcattttgacttttgaccaagtatgaaaattattgattctttaaaataaaacaataagaatttgctattttctgagccacctgactcgtgggatacatttataacaacaactagcatttatatagtgcttcaaggcgctttgcgcatagtgggtgagaagtggtctactcgtgcagtggctgggcagcacgttgcagacctcagagcttgtctgcacctctaatgatggggcaggcagagagcagcagcgtcctggagaaacttggtccctagtgcttcctttaattttccttatctgatataccagtctagtttggaggttggcacattgacctctttttttcagagcattttctggtgtgccaggcataatagcaaagattttagatgagaaatacacagtatagtaaaatctgtttttgagcccacctgtgttgaaagaatacctgtcgataaaaggctactattcaatgtgtgtatggaggtctctgttgaatgcaaagctatattcaacagccatgtgtcctcctcagtgggtgcaggtggcccctatatgcaggtttcacacggcatagtgtagcagctctgctctgcttttcgtgaaaagggagattcttccactgcgatttgctggggtatacaagaaagctgtttgtttcagaagatgcagcattaggaaaataaccaacactgtccctttaaatccaggccagtgcatgggaccttgttccatcccagaagcctttcttatcagtgagctaggaaactagataagatgagaagttctggcatggtaaacattgctttatagaattggctttattaagaaataataaaacaggatttttaaaattaattatttatattatgtatatttattattttattatggatttaaaacaggaaaccttgccttccgtgcatttagatccagtttcacctaaagatgaaagatatttatttattatgaagagtttttttttccttatcatttaggtgtgctttttttgtttgttttgtttttaagattttactcactgcttgttcccaaatccatagagctatggaaacataagtacattttttttttctccctctctggacacatcctgcaatctggcagtagcattctaactgtagtttctcagtgtctatgatacatttatatatgcatgtgtgtgtatagatgtgtatatattttctttttttttaaagatggggtcttgctctgtcacccaagttggcatgatcatagctcactgcagcctcaagctcctgggcacaagccatcctcctgtctcagcctcccagtaactgggactacagacacatgacgctgtacccagcttgtctatgatagaaaaaaaaagaaaaagattttttgttagtgtttttcagattgatttctctattttggcaattagagtctcccttaaaatgaaaacatcctaagtaaaggagaaaataacaaataactcctcatgtagactaaaagcctataggacctttagaaaagagagataattatctgccttcttttcggaagctgcgttcctaatctttttcttctttcatttgcatgctgggcttggcagtactagacctctttcatcccacattgtaattcctcttgtagataaaagtgattagtagaattgaggactttgttgacaatgcagtgagctgatataggtacatgacctttttgtacaggttactgaggtgtaatttgtaaccaggttctctacttgtgtgtgtgtgtgtatgtgtgtgtgtgtgtcttcacttgggaagactgaaaaaagttggagaaatttgagtctacctaggactgtgtctctgctagaaaatggattgtcaaaataatctatttattaatagccctttttcttttttccaagagtggtaaatataacatggtatggggttataacaaaaataagcggctataaaagcctccatgttaattttttctttatttttctgtttgtttatagcacacttcatagctgccacgatatagttttacgaagaagttacttgggaagttggggctttagtatcgttggtggatatgaagagaaccacaccaatcagccttttttcattaaaactattgtcttgggaactcctgcttattatgatggaagattaaagtgagtcttgttctaattaatgatgtgattcatgttgatgacattggacatgatctagaccaggggtcaggggtcagcactaaatccagcccattatctttttgaaaataaagtttcattgcagtgcagctacacttactggtttatgtactctctggctcccacactacaccagcggagttgatgtcatcatgacagagactgtatgggtcttgaagcctaaaatatttaccatctgaccccttacggaaaaaatttgccaatcccgatctagactgaaatgttacctttactgtcttgtcacttatagctatgtttcattaatctgatgacagaaactgaacctgagttatttcattggacatatttcattcatcacgttgtgatgtgacattgagcgctgagtaagtttcccacacagcctactcaggtccagtcctgtcattagatgactctgcttcatttttctccatagcactcatctctacctgagatcgtatttatgcaagctccataagggagggatcttgttgcatttattgttatatccctagcagtcataacaataccttgcataaagtaagatctccataaatatttgatgaatgaatgtacaatagcttacaggatgcctggcgcggtgctaagtgctgtgcatgcattatgtaatctttttaacaatcctatgaggtaagtttctttattatccctgttttaaaacaaacaagataactgaggcttggaaaggttaagaaacttgcccacaatgaaatagctgaaagtggttggctggcattcaaacccaggactatctggctctagatccctggactttaacccctctgccagcctctaccactgagcaaaagtcctcgctcagtgtacagcgtcttatcaaagcccgggcactgggagaagaaaagagaaggtgtcatggcaagacatcatcaccagcagagaggaggtggttgattgtaaattcttaatacctggtttacgaaggaagaaccagttcttaaaaagtaaatgttgacattctatatagaatgctatgcagatggagaatgtacactgtttgcaaggagtaagtgacatctaaataatgtatggaaaggtgattgggagtggtatgctccaggtcagcctatattgataaagatgaaaaaaaatcattttaggaggacagagtagggaaaaatgaattaatcactctcttagctaagttacttaaccagtctgggcctctgttaattataatttgtattcctcctacttccaaaaagaaattgaggtagttaacaataaaatagtatatttatggtataaatagaagaccaaaaaccataaggataattatggtaattataaggctggaaaggtcctccaattcatcatccatccataataattctgcttagagtacagtgagcgtcaacagctgaaagaagaggaagtatgggtcttatttccaatttaattcagccctcagatgtatgagctctaagaatgaatagaaaaatagcagtcaaaataataacccccttcaaatgcatgacttggtatttttttaaagagagagcatatttactctatattttgcttaaattagtgtgaaaattactctgcttgtccttgacattcacctactggttatggagtcatcggcacaggggtttccttgattggcaagggaaagccagcataggcttaagggctgtcccagacaaagtagattatacaccctaaccattgacagttcagtggtaagtgaaaccgcatttttcatgctacataaatctcaattgggatatttttaataccatgaaaatagtaacattctgtatctgtctctctttgtccaggtgtggtgacatgattgtggccgtaaatgggctgtcaaccgtgggcatgagccactctgcactagttcccatgttgaaggagcagaggaacaaagtcactctgaccgttatttgttggcctggcagccttgtatagattttggaaattggtttcaaatcttgcatcttccttttttagatttttgaaagaaaaccctttggtttcattgtgtttgtggtttaggagctgctgacactgctggtatacacagggccaaaacccactaagattgtccgtttatgtttatttaaatggtttcctaagttagttacatttcttttagcttggaaacagtcttccactaacctttgtgagtttatattttcagaattcagacttagttgttaaaatgttacctatggtaatgagcaaagctcacccaaactgtgccccagatggagtaaagaccttctggtgggtctttgttttcagtaactgaatcatagaacgagttctgtatccctcaggcctgatgtcagcaaagccagtaacaacagcgtgtactgccactgtcataaccaataccatgaatgaatatactttaaattttggtgataactgttccccatttttttttgaaccacagtctcactctcacccaggctggagtgcagtggcacaatctcagctcactgcaagctccgcctcctgggttcacgccattctcccacctcagcctcccgagtagctgggactacaggcgtgcgccaccatgcccagctaattttttgtacttttagtagagacggggtttcaccgtgttagccaggatggtctcgatctcctgaccttgtgatctgcccgcctcagcctcccaaagtgctgggattacaggtgtgagctgccgcacccggccgttcccattttttattggtgccaacatttcaaaacttcatactgtttataaactgattttctggtttatttctactgtaatctctcaatattcatagaagatgaagaaataagtctgacaacactaaagaaatttcttaatatactattattagaatagtagaggataaaagataatgttatccagttacaaaggaatttggatgataattataacttaatgttagagatggtaaagctgcacttacttgaacagcccaaaagcattaaaaatctatttccagaggaatgttttgctatgtagggaaattttgaagtagtttttgctaaaaaattatttctagagttgtgttattcttagcagtaatcttggctagaaatgtttttgtgatttatgcgattaaacgaaatgataaagataaaaccatattattaaatacctatatatcacagctaagtaggagaaagggagacctttttattttgttcaggtaggagtatttcttgtgtattttagaaacaattatttttcccattatttcttatgagattagttgtttcaagtaggagacagaaaagttctgttttgttggaaatgtaggttttagatgtatctttcagtcagctctcagtcactagactatttcatattttttgaaatgtttttgaaaattatgactagcccattttttgtcctttattcaacatacttatcctctgaacacataaataagtgaataagataaaaatatctttaccttattaatattatacatacttgaaaaaaatttcatttagaaacctagttcagaatctgagcaaatttacaagtgacctctgtaataaatggtattgataatcagagaatgtatttcagaatactacagtacaatatattatgaagcatgaccactttattttgaaacttagcaattgtattgctggggtttattgtatctgtagcatgtcactgattatttcagttagttttataatgatttttaaaaaacatatctatttggaataagatacagcaacaatcattgctactgacttgttcaaccccttagttacactgtatgatcaacatataacaagatacagtggaatggcccatacagtatattactgttgtgtgatgattggctttggaagcagtttgattttgaaatgctttgatattctaattgacatggaacaagttttttccctgctccccaaatagaattttgtaaccaactttgctatttttttaaagtttgtaagaatgtgtcatttcttggggagtagccatccatcaacaaatatcctgactgctactttgttatatacaaaatacttacattgaacctggtggcataatgagtattttgaaagaagaaatttcttcactctcatttttatagaaatcttggaatcagcttaagctgtagcttttatgacaaaagacagtcatttttggtcagagtgatatttggtgacggaaacttgttcataatttattgttactatagaactatttggattttctcatttttagttctgatagttaaatattttggtttgttctgtgccttcagtttaaattatttcaggatttttcagatgtttaaataatggtgtgaatcattcaggatggaaataaaagtcatcctttctgtaatagtgacgttgtctcttttcttgaacagcagctgttgacttagtctgtgatctgtatttttgttgctggctccactgtccttataatataccgagcaccgagcatgaaacctcaggatcacaaacccaccttattctcaccccacagtttctttttctttttcctttttttttttgagatggagtctcggtctgtcacccaggctggagtgcagtggcacgatcttggctcactgcaacctctgcctccgtggtttgagaaattctcctacctcagccttctgagtagctggaactacaggtgcccaccaccaggcctggctaatttttatattttcagtagagacagttttgccatgtgggccaggctggtctcgaactgctggcctcaggtgatccacctgcctcagcctcccaaggcactgggattacagaggtgagctaccaggcctggcctctttttcttttctaatatggttactaggaaaaaaaaaatttgtaactgaaagaaagaaagttgtctcctagttttctggtaagttaagttcaaaccaaggcctctgtggtcagactcctaattggattgtccagatggctccatggtgccatttaccctcccttgctccagcagcctcctcagagcacacacttacagtatttcctccaactgtaaagctttttcttctctgctggttcacgttgttcccatatctggagtgagggcttaagtgacgctccatgtgtctcactctcaactccactccccactttccttcctaatggtgaatctccgtaggcctttgtgtatgcatttcttctggcctcgatctcttgctacctagttagagttttaagtaccatctttaaccttgcaactttgagcaccactgacacctaagtctacagctcccacagtccacagcctgagacagacacccagatctcagcacctccaaaactgaaatctgtgctttcccaagcatttgcctacttcctatctcttcatctttcaatccaaactcttaagccttgagagtaacttctgaaccccaactctaatcatatccttgccctgtttaaaaatcttcatttggctgggcgcagtggctaacgcctgtaatcccagcactttgggaggccgaggcaggcagatcacgaggtcaggagatcaagaccatcctggctaacacactactaaaaatacaaaaaaattagccgggtgtggtggcgggcgcctgtagtcccagctaactcgggaggctgaggcaggagaatgttgtgaatccgggaggtggagcttgcagtgagctgagatagcaccactgcactccagcctgggtgacagagcaagactccgtctcaaaaaaaaaaacgaacaaaaaacaaaaaaaaccatttgttccatgttgtctgcaggataaatcaaaagccttggtatagcacaaaaggctttttgtggtctggcccccaacctgcccctgtggccttatttcccatcctttcttgcttcctatataaaccaccccagcccgcatacatcccctgctctctgcgtctgcaggggctgacttagctcaagtgacaccactcttttaggaaatctttaccaatctctctgggcaagctttttctggctccttttaaagatttcagtaagttacacatttatggtcatagctatatgctaggaagaagaaaactttgccaggtagatgcttgattaccccatctgtggcagtgttttaaaactagacaataaatatcagagattctgtcacttctgaagagctcaagatattgccaagatagaatcgaggcttaatttctttttctgttcagggagtctacagtacgtttagtcgtcatgttttcttattctcctcttggctgtgccattttctcagactccttgctcttgagggtgctgagaatgctgatgctggtcaggtatattgcaagttgctttctattggaatttgctgttttttcttattatgactggcaaatgggtttttggagcgatatccccaaggtaaaatgttgttgtcctcatatcaaggatacctgctgtctgtgtgctttatggctgctgaagttggcctcaactacttatccggtttctctacaatagtgtgtgcagcccatgcttgagcagtgggagttattctgtccgtttatctttgagctggtcaggaaaattgaggcctctagtgctgcttagggagcaccttgtgggtagaaggcaggtagaaatccttggttaagagtatcaggggcagtagtccaggtgcggtggttcatgcctataatcccagccactttgggaggccgaggcaggcggatgacttgaggtcaggaatttgagaccagcccgtccaacatggtgaaacctcgtctctactaaaaatacaaagattaactgagtgtgctggcgggtgcctgtaagcccagctactcaggaggctgaggcacgagacttgcatgaacctgagaggtggaagttgcggtgaacggagattgcactactgcactccatcctgggtgacagggtgaaaactccatctcaaaaaaagaaaaaatatcaggggcatatttcatattttaaacaaactcagccaggcagagtgactcatgcctgtaatcccagcactttgggaggctaaggtgagaggctcgcttgaacctgggaagtcaaggctgtagtgagccgcaattgcgccactgcactccagcctggacaacagagcaagaccttgtctctaaataaccctctcttgactctgctattcatagtaaagtttcccaaaagagttgtctccattttgcattctttagctatttttaattcataataatttttctgacacaaaagtcagaaataatacagtgaacacttgtgtacccaccacccagcttaaatataagcagggccgctgccatttgacttccttccccatttgtgtctaccctctggccttcccattgtttcttcatagttatactacgtatttatacatcattcaaatataatattgtgtgtatggttttaaatatgtaaatgatgtgcatatgtggtgttctgcaactacttttgctgcaagattcatgcatgtttatgtagctcaaatttttcttgctagtcaatgattatgacaattttctatccatattttagttacttgacatttaggttatttttttcttctcatcattaacagtgctggtgggagcacccataaacaagtattcatgtgcatgtggagagtttctgcagggcagtgattctcatttaatcctggctgcacacaagaatcttttggggagctttgctgttttagttggtctgggctagggcttggacatcaattttgtttggttttgtgtgttcctcaggggggttacatgcagccatagttgaaaaccactgctctaggagttgcattcctgcatttagagtaggtgcatctttacgaggtaattaatttcccaagtggttgcactaatgttacatttccactagtaattgggtaagttttgttgatccacattcttgccaacatttggtgttctcaaaccgaagagggtgaaaagggcatcccactgtgacttcaattcccatctccccatttactggtgaagtcgaggaacttctcacatatttacttgtctttcaggtcccttctttggtgactaacctgttggacaattttctaaagggctatttgtgtttctctttttcatgtgtagacattctttattctggatgttaatacttcgtggatgatgtgaggtataaatatcttctcccaatttgtgacctcatttcagctgtaatgatgtgataaaccaaagttcatcattataatgtgaacaagtgtatgaatagcatataagcagattcttttctgttacttttggaatttgttattttgccaagggttgtccatgtatgttgtgatgattattatatgttttctttccaccctatattaatttcctctgcctctctgtgcttcatgttttcttctaccgaattgtagctctgtttctgttcactttgcagttacccttgaatttttcttcgtgcatatttaacataaagtttcaacgtgaacaatagctctgtcccctctgcacaatacaaggacctgagaccacgtgactccaaccaccctgaggtctgacttagtggcaagtgttgtggctcctcctcattctcctgtccagttagtgttattgtaattgttatatactgttggggtttggttagatttcatttctgagctatgtaaaatactgaaaggctgatgcaagcacagtttatgatagttcctaacattccagtaacatcccacaaaggacatgtgggcaacagaaggccagagtgggattaatggcagcacactgacccatactatctgaaagttgaagttgcaatccagatataaggaaagactttataaaagcttgggacgcaacaacattttcaccattatattacccgtttccaagcagtctggaaatcactgaagcaatttgcctttttatgggaggggttgggggaagggcagttcagcaaaggtcactatcaccaacttttctagagcaaatgcaacttgcattgtaaatccagagacatgttttcataggaaattttggaaggcagatttagagggtttcgttttctcaagatactgtgcacagtgaccagttctcaaacagctgaatcctccctctctgtcctagctgtggctcttttctcactagaagaccctgaggtctgttcattctgttgctgtaccttcagaacttgatacccattcttttataaatgaaagtgggctgctgctttatgattcctcacatgtttgaagctgtaatcagatacatggatggttaaaattaaatctgaagttaacctgaatttcagcttctgtgggcacttcacccatttcatcatgcctgacacccatgttacagtacattaatgccctgttaattcagacttaactaatttggaatttgaaagcttaaagagaggtgaggttaacttggcactttatataagcaataagtatctttaatcaacattgaaaaatggaaagtgagatgtttcgagtgcatgctaaaatatactgtttccaagtttccttaagcactataaaatacccaggctcattcgagtgatggctgtgttgcttttccatggaattgtttaaacagtttatccagcacctgctgtgcacaacacatagtgagaggctctgggtcacttcctcacagcacctaatttcatcttttacaatgcagattttctttcatttgtccaccttgggtgatcaacaaaaccatatagatgacacaccaacatggtaaactgctgccctggtaacaggctaggaattcatgagttgaggtttttctcttaagtctgtcttgtcttcttgctgagggaaagatttcagctccctaaggtccttgttagaaagctcttttgccattttatggtgtaaatatactactaattaatttctatggcaacacagaagctctttagaagtgaagttgtacatgtaagcacagtgcctaatagctataaagtgcctaagtgagaaatgctaaaactttaatcacctacaagaataaaagactaggccgggcgcggtggctcatgcctgtaatcccagcacttcgggaagctgaggtgggcagatcacaaggtcaggaaatggagaccatcctggctaacacagtgaaaccccgtctctactgaaaaagaaaaatacaaaaaattagccgggcatggtggcgggcgcctgtagtcccagctactcgggaggctgaggtaggagaatggcatgaacttgggaggcagagcttgcagtgagccgagatcgcaccactgcactccagcctgggtgacagtgagactccgcctcaaaaaaaaaaaaaaaaaagactagcacttggaggactcacaccatccccgcaggtggcagagagcatgcctcccatcaggagaaggtggcttcgctccatggctgagtgagaagcacttagagatttccatttgagctctattcactcactcacctgcaaataacactttcaagatgggctatttcaaaaacttggatcagcatttgctttatttcttcaaaagttttcagtttaagggtgaattcaacaagaactcccttctttagattgcctgaaagctgaccaagaacggttaagttagagacatctattccccagactctaaaagatgagaagcaacaacgacttgtccaatgtcaaggttgtaagggtggcggcagctattaaaaataaggttttttttgagatgggacgaggtgactccaactgtaatcttagcactttgggaggctgaagtggggggatcacttgtgctcaagagtccaagaccagccgaggcaacagagggagaccccatctctgcaaaaaataaaaaatttgccaggcgtgatggtgtgcacctgtagtcccagctactcgggaggctgaggcgggaggatcattgatcccaagaggtggaggctgcaatgagcagtgactgagccacagcactcccgcctgggcaacaaagtgagaccctgtctcaaaaaaatgaagtttttctttactttacctaggtttaattgaaaggtctcctttcactcacctcctctagaaatgacctgagaatgtcttagttcatgggatgtgtttagtcccattctcctgactgctagcctctcccaccagggaagcaataccccagagccctttgtagattcacccctctgtgcctgttccttcctgcgtggctcagtcctaaagagttggagtctgggatccttgcctggtctcttggcggctgtgggctaaactcctgctcctggagtcctggcctgtgctgagatagatgggcacctgtggaggatggggggtgctcacagcaacaaaactccctctgtggatacttagtaaatgtttgaggaaaggcagtccttgtcacctgtcatatgtaagtcattccaaaggatatgatgtccttgtgtcatccaggtccccagtctagagctactttttccccctgctgatcccaagtcatggaaccttagaaagggaagctcttgtccatttttctggtatacaggtccccgctgtgatatggtcatctagctcctgcttgaaggcttcccgtgacagggacctccctgctgcattccaggcatcgcctccgttgggcatgtctaattgtaagtgattcctttttagtaataatttgtccctgtccctcttcctagctagagtgtagaaacaaggaggccaggcaggtgggatgtctcttcatttgttacttttcatatttaaatgaatattaggcaggcccaagacacaaaacacttactgattcatcttttcattgtacttggccaatgttctcttagcatctactatgtgccaggcactgctctagaggctcagaattcatccgtttttaggacggagtagttgctatctctgtgcttacacagagatacacagggacataatcaagaaataacatgacttcagggtctcactctgttgcccaccaggctggagtgctgtggctcagtcactgctcattgcagcctccacctcttgggctcaatgattctcccgcctcagcctcccaagtagctgggactacagatgcataccaccatgcctggcaatttttttattttttgcagagatgggggtctccctctgttgccttggctggtcttgaactcctgggcacaagtgatccccccacttcagcctcccaaagtgctaagattacagttggaatcacctcgtcccgtctcaaaaaaaccttatttgtaatagctgccgccacccttacaaccttgacattggacaagtcgttgttgcttctcatcttttagagtctggggaatagatgtctctaacttaaccgttcttggtcagctttcaggcaatctaaagaagggagttcttgttgaattcacccttaaactgataaatgcaatggggaaacaaagccaggtaaatggagaacacaggatggaaatgaaccaagtgagagaggtgtgcggggaaggcctgaggagacataacagaggctgaatccaggttctcggtggcatg

SEQ ID NO: 263 - DNA, 2660 bp, Homo sapiens
atgggaacaacaagtgatgagatggtgtctgtggaacagacctcctcctcttctctaaaccccctgtgttttgaatgtggccaacagcactggacaagagaaaaccatttgtacaattaccagaatgaagtggatgatgacctagtctgccatatttgccttcaacctctgctgcagccactagacacaccctgtggacatacattctgctacaagtgcctcagaaactttttacaagagaaagatttctgtccgttggaccggaaaagacttcattttaagttgtgcaagaagtctagtattctagttcataaactcctagacaaattattagttttatgtccattttcttcagtgtgcaaagatgtaatgcaacgttgtgatctggaggcacatctcaaaaacagatgtcctggagcttctcatcggagagttgccctggagagaaggaaaactagtagaactcaagcagagattgagaatgaaaatgggcccactctactagatcctgcaggtaccttatctccagaagcagactgtttggggacaggcgcagtgcctgtggagcggcacttgacatcagcgtctcttcccacatggagtgaggagcctggccttgacaaccctgcctttgaggagagcgctggagctgacaccacacaacagccacttagtttaccagaaggagaaatcaccacgattgaaattcatcggtccaatccttacattcagttaggaatcagcattgtgggtggcaacgaaacacctttgattaacattgtcatccaggaggtctatcgggatggggtcattgccagagacgggagacttcttgctggagaccagattcttcaggtcaacaactacaatatcagcaatgtgtcccataactatgcccgagctgtcctttcccagccctgcaacacactgcatcttactgtgcttcgagagaggcgctttggcaaccgagcacacaaccattctgatagtaactctccacgagaagagattttccaagtggctcttcataaacgggactctggtgaacagcttggcattaaattggtgcgaaggacagatgagccaggggtttttattcttgacctgttggaaggggggttggctgcccaggacggcaggctaagcagcaatgaccgagtgctggccatcaatgggcacgacctgaagtatggaactccggagcttgctgcccagattattcaggccagtggagagagagtgaatttaacaattgctagaccagggaaaccccagcctggtaacaccattagagaagcaggaaatcatagcagcagcagccagcaccacacaccaccaccgtattatagcagaccaagctcacataaggatcttactcagtgtgttacatgccaagaaaaacacattactgtaaagaaggaaccacatgaatcccttggcatgaccgttgctgggggcaggggaagtaagagtggtgagctgcccatctttgtgaccagtgtgccaccccatggctgccttgcacgagatggcagaataaagagaggtgatgtgttgctaaatatcaacggcattgatttgaccaatttaagtcacagtgaggcagttgcaatgctgaaagccagtgccgcgtcccctgctgttgcccttaaagcacttgaggtccagattgttgaggaggcgactcagaacgcggaggagcagccgagtactttcagcgaaaatgagtatgatgccagttggtccccatcatgggtcatgtggcttgggcttcccagcacacttcatagctgccacgatatagttttacgaagaagttacttgggaagttggggctttagtatcgttggtggatatgaagagaaccacaccaatcagccttttttcattaaaactattgtcttgggaactcctgcttattatgatggaagattaaagtgtggtgacatgattgtggccgtaaatgggctgtcaaccgtgggcatgagccactctgcactagttcccatgttgaaggagcagaggaacaaagtcactctgaccgttatttgttggcctggcagccttgtatagattttggaaattggtttcaaatcttgcatcttccttttttagatttttgaaagaaaaccctttggtttcattgtgtttgtggtttaggagctgctgacactgctggtatacacagggccaaaacccactaagattgtccgtttatgtttatttaaatggtttcctaagttagttacatttcttttagcttggaaacagtcttccactaacctttgtgagtttatattttcagaattcagacttagttgttaaaatgttacctatggtaatgagcaaagctcacccaaactgtgccccagatggagtaaagaccttctggtgggtctttgttttcagtaactgaatcatagaacgagttctgtatccctcaggcctgatgtcagcaaagccagtaacaacagcgtgtactgccactgtcataaccaataccatgaatgaatatactttaaattttggtgataactgttccccatttttttttgaaccacagtctcactctcacccaggctggagtgcagtggcacaatctcagctcactgcaagctccgcctcctgggttcacgccattctcccacctcagcctcccg

SEQ ID NO: 264 - protein, 690 aa, Homo sapiens
MGTTSDEMVSVEQTSSSSLNPLCFECGQQHWTRENHLYNYQNEVDDDLVCHICLQPLLQPLDTPCGHTFCYKCLRNFLQEKDFCPLDRKRLHFKLCKKSSILVHKLLDKLLVLCPFSSVCKDVMQRCDLEAHLKNRCPGASHRRVALERRKTSRTQAEIENENGPTLLDPAGTLSPEADCLGTGAVPVERHLTSASLPTWSEEPGLDNPAFEESAGADTTQQPLSLPEGEITTIEIHRSNPYIQLGISIVGGNETPLINIVIQEVYRDGVIARDGRLLAGDQILQVNNYNISNVSHNYARAVLSQPCNTLHLTVLRERRFGNRAHNHSDSNSPREEIFQVALHKRDSGEQLGIKLVRRTDEPGVFILDLLEGGLAAQDGRLSSNDRVLAINGHDLKYGTPELAAQIIQASGERVNLTIARPGKPQPGNTIREAGNHSSSSQHHTPPPYYSRPSSHKDLTQCVTCQEKHITVKKEPHESLGMTVAGGRGSKSGELPIFVTSVPPHGCLARDGRIKRGDVLLNINGIDLTNLSHSEAVAMLKASAASPAVALKALEVQIVEEATQNAEEQPSTFSENEYDASWSPSWVMWLGLPSTLHSCHDIVLRRSYLGSWGFSIVGGYEENHTNQPFFIKTIVLGTPAYYDGRLKCGDMIVAVNGLSTVGMSHSALVPMLKEQRNKVTLTVICWPGSLV

SEQ ID NO: 265 - DNA, 46625 bp, Mus musculus
  misc_feature (1)...(46625): n = A,T,C or G
aaccatcacacctttctccttgggaacttgactgcctgctgctgtatcatgcagtctaggattgtggtcacattgtgttttcaccttctccctaattgaacagctgtgtgtgccagaagtggtggcgtactgcatgaattctaggcaaacatgggctacatagaaaagccttcccctccttccccccacaccccccaaaacaaacaaacaaacaaacccaaaactgggggctggacagatggctcagcagttttagcacactggcagcttgattcccagcaccaacatggctgcacacaccatctgtaaccctaaccctgaggaagaggatgtgttcatctgggttccaactgggctgtaattaggctctttttgcttttaccgtcctgggccctcctgactacccttctagcctgtgtggcttccactatttttatgcttctgcttttcccagtgagcttgtctcggccatgctcttcctcttccccacatccctcagagtatgtcagcctgggagttcctcctcacagcttacaaaacctttatccctttcccctgggaataagtcactataatagcaaagtacctggtatcagggatgaaccaggggtgttttgtttgaaagataggaattttttcttcatcactgtttgaagggagagtcaaagtctgaccttccagactcctaccatgggaagagttctgtacttgtccctggtctcaagtaaattaacatgcatgccatgctctagtatttgagacacccatctttgcatctaaattctactttttatcagattattgttggtctttttgccgttcatttgttgatgtttcccctctccccaaacttttaattccttcctgtgctgtgtagaagagtgaccattcaggagttatttcattgctgttactgttgtccacccaggtagagttagaagtgctcttactgcattcaggcagcagcacgacaccaccctctgattcaggatgttgttcagtattgggatcagcctgtgtatggagtgggtggttccatcactccagcgtgtgtgtgtgtgtgtgtgccttagtgtgactgtctgaaaaaacactgtgggaaggtatttttttttttttttttggtttttcgagacagggtttctctgtgtagccctggctgtcctggaactcactttgtagaccaggctggcctcgaactcactttgtagaccaggcctgcctctgcctcagcctcagcctcccaagtgctgggattaaaggcgtgcgcctttttgtcatctttgtttaggaggataggaatatgagtcttagtgatttctttttaattaaatctatttccttggtttttgtaaaggtttgtttattgacttggaagctatctgcaaaggaagataaacatttgttctaagtgacatttttttcttttctttttcctttaggtttttcatgatagggtttctttgtatagcccaggctgatgttgaactcacagggtcacctgcctctgtctgtcaagtgctgggactaaaggcgtgcgccagcaatacttggctgacattttttcttttaagcaatacttttttcatatatctatctcacaatatcttcttttataaacaaggtctcatttgcaccctggctggctggctttgtagactagccgaccttaaccccacagagctgcatgctgagtactaggataaagacacaggtcacctttcccagctcattaagtctatgttaatgtctgcagaataatttatgctagtaagtcagtcccctttcctttctttttcctcccttttttctctctgagtctgggttgtactctgtagcctaggctagcttgaaattcttgagagtcattgacctttgcttcctaggatttagtgtaaggcaccacacccggcagcccattcttttccttacctgtttatcttcttagtcctgttccttagttcagtacaaatctcgaatctctacaagactagtagatcttggttacaaaaaaccatttctgacctaggccttctctgagcattaggggaacctttgggcactagacatgtacatggtgtacatgcatacatccaggcaaaacattcatacatccaaataaaatacttaaatttaaaaaactcgttggggcaggcataaaaagtcagaaaaggacttacaggtggctgtgagacaaactccagccctctgtgagagcagagagtgcctataaccggtgagccacctctccggtgttctttttaattttttttattttttcaagacaaggtttctctgtgtagccctggctgtcctggaactcactctgtagaccaggctggcctcgaactcagaaatccgcctgcctctgcctcccaaatgctgggtttaaaggcgtggactaccacgcccatgcctctgccctctctttagtgtactctcttagcaagacagagcctgccacctatcaagctggctgtgctggcgtgcacctatgatttgtgtctggaagcttgaggacgacatagttcttttgtctaggcaatgtataactccacgtcctataatccttaaaccagcttctaagttcagtagctatcgagagaagtgtgagagatcttgaaagttgtgttcctgacatggtcatgcccgtctgtaattccagcactagggaggttaaccccagcacttgggatgagtttcaggacagcctggtctgtataatgagttccaggagttcagaactgctagggttacaagtgagatcctgttttgggtgggcgggtctttaaaaagaagaaaagagttctgggagctgggagacctgccaccttgtcctctctaagcctcactttcctgttctgtacaatgaggattgaatccatttgatgtccttgaggtctctcttttactgcttaatttaaactgttaagccacaagacccccagtatggcagtgtaattataattaggcttagcaggtcctggagggagagggaagagccagcggtcttacccagagtatcattctttcatggtgctactgatgtttccagactccaagtgacaacccttgtttttctgtgcattgccatttcaagcccataatcttcttgtatctccttgaacttgtgtttactgttagacagccatggtgcagaattcacatttcactgtgctgtttttgtacttgagggagtttgagtggatcacagctggtctctggagagaaggagggctgtgtgtgtgtgtgtgtgtgtgtgtgtgtgtgtgtgtgtgtgggaaagggagaggnnnnnnnnnnnnnnnnnnnntgttggagctctagttttgttttttaatttccagtgtcatttttggtgactttagttaaaaataatggtttcaaaagaggcaggtttttgtcctctgagctttgtggatttgtggtgtggatcagcagtaaggacctctcttcttgtttcctttgcttgaagcatttcaccttgagagggaaaaacaagacttgtggctggcttctcagtacaagatgaggtgaccctgaatagcaacaccttattgattggtttctttccagtgaacagtagaagctgagctgctgccatgatcttcactttacctcagatctactagtttgcctttcattctctggaaagacttaaaaatgttgaaagtgctataagaattcttaaaggaaagaaggaaggcaaggcacaggtcttgctggtgctgccttggcttctgctcccatgctcctgcatggactgccttaccattatgtagaatgggttagcttttcaggacttctcatgagcttgtgtgtgactctgccttcttgaagcgaagcatgaaactattacaatgtatagaagagaaatctgaaacctggcaaggaaaggtggtttgtgcagagtcccacttgttaatcaagttagtggatcattaagttaaggccactgacttcactcttccacccccaggggcctccggtgtgtctgaccatcacagcacacagcctgtcccgcgggtctggtgggactaggactctggaaagcacacctcagcagtcatttccttaggtggtgaggaagggattagaccctggacatggaagtcagaaaggagagaaggaaggaaggaatccatggacctggtctcttttggaaaatgccaaattaacttgtgactactctgctcccctcccatctcttttcttcccccagtggaactcactctgttgaactcagagagtcacctgcttctgcttcctgaatgctaggattaaaggtgtgtgccaccccactccagcatctcctcccttttaaatccattctggaagtagaactcaggcccctatcttgtgtgccaagtgtttttactcactgagccatctctctggccctcttctttttctgatagagtatcactgtgtagcccaggctagcctgagacttgtgataatccttttgcctctgtctccctagtgctgggattataggcatctgtcatcagagttgtagtttgtttctgtagagctaggcaagtgatgagtcagcatcccctttcaaaccttggggagcaagtttttactggcatgaactcacagagaggcagagttgctcctcttttattgaagaaggttagataggttgttgtgcaggggggatgaacttgtgtctgagacaaagttgcctcctttgaaatatggaatatttggagtaggtatgatgttaaggtttgagtcttggctttgctgttcactcagctgtgtggccttggctcatttactcctcccgcccattcttgagtttgctctagtgatttgtttgatcagttccagttcatagatggaatgcacatagcagtgctagggaaagagtgtgttctctctttagacattctcctcctagctgtgctcatgaatggtgtgtgcacgctcatgtgtgtgtgtgtgcacgcgcgcgtgtgtgttttggggatttcggttctatgagataaggtcttatatgtagtccagactggcctggatctcaggatccttctgcctgatactgggattatagtatccctataatcccagtcatcccatagtaccctgtcatttatgtggtgatccaaactcatggctttgtttgttaggaaatcactactacctgggctacatccttagtcctagtctatttatttttgacagcagcttttggattctgaatttatatgcctccctaagacttccaggcagctgtaatgtcacctaagtttggggggaagtatctgtctgtctgcatttgacatgcgtttctaaatatggctatggatccttttgtgaagagactagagagggaggaagggcatgtgcatccctaacctgttacacagtcttacatgttagggtctcataaccgagggacgagggcactgtgaaatttaactaaatattttagcagaataagaatatcaactagctgcctcgggctcttcatctaccttaacaaaaggctgttgggtggtttaagtagaaatgtattttatcatacttgttgaggttgggtgttacaagattaggctgtcaacacaatatggttctagggaaggcccttcctggtttgacaatagctgccttttctttgtgtggtctttcactgtgtgtactgggagcaagagggccactaagcctacttgactagtatccaacctgtatgacctcctttagtcttaattcccttcggaaagacctgtttcacacacatccgtatgtgactatggaagggtgtgcactgtttagaccatggcaccatcctttccccatagttactcaatgaggtgtgccagtgacatcatcttgtggcttctcctgcagtgttggaccagcctgtattctggagccatgagatctctgtttctttcttcttggcctttggagaggatgccaaagaatagaggattatacttctactttgactggcatatctgggggacaccagcactctgatgtgtaacaagtcctgttttgtcacttgtttagactggagagtgacatcagatgaaacacagtggatgccctctttacaattcataagattaagcaacaggcttcactgaaccttcttcagtctctgtatgaaacactgtgatgtccgtggcatgccatgtgttcagctggtggctgcttcctgccatgctcacttggtttctgcgagatagctggctcccaagcccgtctctgcagcttttggcttggcagctcagttgtttacatcagatcgactgatgtaaatcagatgcagtgcccctcaagtgaagtgctttcctatttgtctgtctttgaagactaggtaaaactgatgagatagtaaggccacgatgctgtcacattagaggagcagtaagactgggggaatgaggaagttttgaatttgtagactagacatgtgtttacattttcattttatctctcagaattaggacttggaaatcatacatgatatttggcattctgggttcatatagacctttaatctcagttctctgagttcatggctagcctggtctacatagcaaattccaggatagccaaggcaacaaagagagaccctgggctttttttttgttgttgttgttttttggtttggtttgtttgttttttaaagatttggagccagatccttactcagagggccttactttgcattaaagaatgagttggggcccagtaaatggctcagtggggaacagcatttaccatataaacctgaggactgagcttgggtccccaagaacccacgtaaagctggattcattagtacatgtccgtgatcccagggcttctacagtcgggtgaggaggggaagcaggaggctctctggaagcttgtgggccagctagtctgtctgtcctgtgcagctggagagtgagtgactctgccttgaacaaggtagaaagtgagagccagcacctcaggttgtcttctgacctcctccacagacgtcctgcactcatgcagacagacacacgtgaagaccgagtaaaggagtgtgctatacaaaagtaacagacttaggtgtgtcttttatggattgtgatccaacttttctgattgccctgcttcctagaccatatactagaacagaagaaaccgggcgtggtggtgcaggactttaatcccagcacttgggaggcagaggcagaggcagaggcaggcggatttctgagttcaaggccagcctggtctacaaagcgagttccaggacagccagggctatacagagaaaccctgtcttgaaaaactcaccaaaaaaaaaaaaaaaaaaagaacagaaggtttccactgctctgttccaattaaaagtgggtttggttacagttgagaaggtttagtgaattttattttgtgtattgtgtaaatgtaattaaaattcattgttttatttctgaggtagggcttgttatatagccgcctaaaccagcctaaagctcacagtcatcttgcctcggcttcctgagtgctgagattataggtagtcaccacacctgtctctagtgagggtttaaaaagtgacatgtatttctgtgtgtctgagtttgagtgtgtgtacatgaggacggctccagaggcgttgggtcctttggagctggagtcacgggtggttgtaaactgcctgacatgggtgtggggagcacccatgttctctagaagagcagcagcaagtgcttttaatgtcagagccatctcttaggtgcttgttttcactcttactagattccttggttcctcttgtagacctttaatatgttgagagaaatccaggaccctcattgttcaatgctgcgttgtgagataaagcagggttgaaggtgaggccctagggatgactgaaatgagcagagccctggcgagttgaactctttctttcgggcgttaccttccttgagtcccctgtgggcttggcccaggagtgcacggctgcagggcaggcggggcagagcgagcgtctctgtgctgcgccagtgctgacctgggcctcctcggggcaggaccaacctggaggccttgcagaagaagctggaggagctggagcttgacgagcagcagcggaagcggctcgaggcctttctgacacagaagcagaaggtgggggaattgaaggatgatgactttgagaagatcagcgaactgggagctggcaacggtggagtggtcttcaaggtctcccacaagccatctggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaggtactgcacgagtgcaactccccgtacatcgtgggcttctacggggccttctacagcgacggcgagatcagcatctgcatggagcacatggtgagcagctggctgtcagtctttgcagtggcctgggaacaggctggctctggcctcattgttggtttggatggcgaccagctcttccctgcctccccattccacaccctagaggcctaggagacccgggggcctgactggagtctggtatagtcacaggatgacagcattgcttctcttcaaagagaggtgttagatgccaggaattctcagtgggcttttctccagtatatttcctaattttctcctattttgatagccataagattttgatgtagttcaaatctggctaatacagtataagtccagtctatgtctctgccttcagaaggtttatgatatactttaagggcagccttgggattttttttggaggagctgacgagagcaccccccccccccccacacacacacacactagtgaaaggtaagagcaagtcagggagtgggtgtttatgggccagttacatgtgtgggagctagtctgcaggcccttccttttcttcccagtgatggtgaccataaaaaggctcatgcttattgggcatatatatagtaatcaagtgtcatcctaaacagcccagaagatttcctgtgcttcccaaagacatggctgcactcttgttggagtgaaaaggggcaagaaccttctctataacctttagacatgtagaagtggttccaggatccaagttctaaatgacaccatgactaatgcctgcaacagcatatatggcccttcctgatcatagaaggaatattcaaggccagcctggtctacagagtgagttccaggacagccaaggctacacagagaaaccctgtctcaaaaacaacacccccccccccaaaaaaaggatttatttatttatttaatgtatatgagtacactgtagctgttttcagacacaccagaagaaggcatcagatcctgttatagatggttatgagccaccatgtggttgctaggaattggactcaggacctctggaagggcagtcagtgcttttaaccactgagccatatctccagccccttgctgctacttcttaactgtaactttgcatgcagttagtaagtcctatttagtccaatgcctgtacttggttgacttcactacatagagatgtgggactgggctttttctatcctttaagcttaggattgccagctttgtagctgatagaatggcataggaatgttgggaatcagttgtttatgtctttttccttacataaatataaataaggatattgtcatgtttgtcaccatgttgtgttcctgtcatcctctcttgtatctaggatcttgtgcatagtaggtaaatacttaactcctaagctgtgtcccagctccaccactgtcttgaaagttcacattactccctgacaccctgctacagagcaggcactcagtaagtctgtgtttacttaaaaccattgtcttagttaggcgtcaattgctatgagaaatatgataaataccacaaccaaaagcaactgggggagaaaagagtttatttcaacgtataactcccagggcacactccattattgagagaagtcagggagctaatgcagagtccatggatgaatgctgcttactggctggctcctcatggcttcttcagcctgctttcttgtagcacctaggaccaccagctaagaggtaacatcaccccacaatagtctggtcccttccacatttgtcattcaaggaaatgcactacaggcttgcccataggccagtctggtgggggtatttttaattaaggttccttcttctaaaatgactctagcttgtgtcaacctgacataaaactagccagtgcactatttaactgtgaccttgagtagacgtcctcatcgctcagattctcatttcttacaaatgagtcttctcatttgtaaggtggtcatgattctatctgttttgttgctgtgcaggttagaatgacaaacatcagtcagtatgccctccaattcagagtatgcattctgcaagtgctagttcctgctttatttccatggggctggcagttcagagtcaggggagtctacaaacttgatgtctcttatgctttcagcctgccacagtggctgatgtctcctgtacccatttcctttgacctctacacctaggctgacgttcagaatggtgcctggtctgaatggatgtcccctcctctacctaaggagtctgtgctggttgccccctgcccctcaccctaacacatataccatcattttgaatatttgttctatgatcaggaagggccatatatgctgttgcaggcatcagtcatggtgtcatttaaaacttggatcctggaaccaacttctgcatgtctaaaggttatagagaaggttcttgccccttttcactccaacaagagtgcagccatgtctttgggaagcacaggaaatcttctgggctggctgcagtccctgacctggggtgcaaattcttacttgggtcttagctcctgccccttaggactatttagatagggtctcattacacagtccttattggcttggaggttatgtaaaccaggctggcctttaatttagaggtctacctggctctgccttctggttgttgggattaaagaccatgccaccaagcctggcaggactattctactttttctcctcttcttcctcctcctcctcctcctcctcctgctcctcctctttgaacttgcagtgttttttcctgcctctgcctattgcctactgggataacaggtgtgtgctactgtgcctgacatctttggacctttgggtttcttgtactctttgttgatggttcctccccgaccctcccttcttctagcccaaaaagagttttgatgcaactagaaagggaagaagagaagttgagtcaatgctgataagccagaaacaggaagggccagagtagccttctgtcctcttaggacttgctaaagtaatagaaggtggatgtcggcataaccagttataataacaactagctttcaactctcctatcatttgccaagtccttttcacattatgtaagttattaatcacatcacccccatctcatgagatggattgtcagccctctcagctggcaggttgagatagttaagtcctaggagatttcataattgacataaatcatatagccagtgagtgccatcgtctaagcaggtctgcttcctttggtttcatactctctcctctctgtgcaggttctatactcactggaattctgcttctcaacagagaaatgactggatgagttctctagggcccctctccgagcttacactgtttccatggtttggggcacttgtagccagtcacgatttacactagttaatcagcatggcccagtttcataaacttacttttagtgcttattatgtgcattgtcacatgaattgccctgagaactgggaggatagagctctgcacagctggtggttgtgctctcacgttagccgtcagagctgctgagcaccaggtatgctgtttcaagcccactctgctgaagcatcacaagttctgtccctagttccatgcactcaaatgtctcccgctaatatgggatcaaagaggtggtttgtgggtgaatggggctgcactcctggaagcttacttcaggggctaaagttaggccccaaacattgataatgggtttaatggtctggactggggcttggagggagagagctaactaagctttggaagcagcaacaaggcctttgcctcacttgctctaataaagaacagtatcttttcctactttcattttattttgtaagtttttttctctttgtaactcagtgttttgcccatgctgggtaccactgagtgacacctcctgtcatggaccagtgtttttatactagagaagaactcatcctgtcctgaaggtctaacaggactctgttgcaagtagctgttgttagaaggccatgcagccataagagccacaagaggtctttcccagactcgggtctctgccaggcctcctatatcagagccccttactgcaaaaactggctgccacttgcctccagggtgggtcatgtgaagaactctgccctgtagtcacatcccagcttctaaaaggttttgattggtccccactgtcacagtctgtttgatattctatgtcattaacatgccattccagcaggtgattagattgcaagcatataaagctcaaggaattttacatcgtacagtaactatcacctcagttctgcatctggccatatttgcttcatcgactattgtccacctatctactgctcaaataggttttgagatgcattttaaagtcagtttgtgtcaccagcatgcactatccattttctgaagcacccagccagggattcaattcccctagaaatcagtctgaattttgagagccaagcagaaaggaagctccctcaccagaacggaatgctcttgtctgcagagaggagcctttctgctcaattggtagctgagcaaccagggagaagggagttggagttggtggttttgaggcaggagtaaaagcttttgagctattattttcataaagcatttgtctcttctatagagaatcatcacaaaagtaccattgacttagttaataattggcttctaaaaataagcaccatgtcagcagtggtagtcggtgatcgcaagttcttggcaacagtgaagcagaactagagtgctgcagggctggttgcaggggcctgggcagtcctgactagcttgtgctcctggcatcttgtgagctcattgttctccctctaggcttgtcactctcaagggtaaagggaaggagtcattttggcttctttttaatagcttttcttttcttttttctttctttctttctttttaaactaggggagtatgcagtgtacactcagagtgctcgctctctccttctctctcttctcgctctttccctcctttccttcctctctctcagctcatgttctcatcttaaaacaccaggagcagattccctcacttctgcctctatcaagtgtcagttttctacatgggaactcggccacagctggccatttctaacctagtctgatcagccctgcatgtcttcatggagccatggtaagatagaaatactttcttagcaaccctgtgggaaggtcatatgtattaagttagctgggttgccttctgtcctttgccatggttactgtcgtttgaaaggcagttctatttgttgcctaaatggagaaagaaacatgagaaccacctggttctttctgccctatttgaatccagtttcacagagcagctttgtcaccttgttttatacagtcctttcttgactaggcaaagccattcaaactaaggagctgaagcagattctgctagaggcaaattagaagtagcttgttagttttctgtgtttttcctccattggtgaaggaaactgagagatgcatggcttttgtaggagcctgctgacttggggaaggggttcctggggtccggtatcatccttacttagaccaaaggggcctgtagcactgaaggcagccaaatcacaggaccagtttgatggcatgagctcagcatggtcacagctaaataaaggaaagtaagtgtatgtataaagggcgttctccctctgtctcaatgcttccactccctagacactctgccatagtgaagttctggattgaggtccagagttctctactctacttggttggctcacccaccaaggtgctacagtattcatcatggtcagaagtcatttctatattactcttcactttctgcctttgagacagggtctcactatgaaccaggagctagactggtagccagcaagccccaatgatctcctgtctcttccctgaacagtggttggggttacaagtgtgcacacggccatgcctggctttttatatgtatgctggtgatttgaactcaggtcctcatattgcatagtcaacactcttactctcttaagaagtaagagaagttttctaggtttggccttgaccacagctgggcatttctagccatgtctgttcctgtgactgcacagtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttactgtacctgcatgtacatgtgcgcaccacacgcatgcatggtaccctccagaggccagaggaagatgacattgaattccttggcactggaattaaagatggctgtgagctgccatgtgggttctaagagccaaaccagggtcctctgtaggaacaagtactctgagatggttgagccatctctcccaagacctcatttaaattgtaaaaatgtgtgtgtgtgtgtgtgtgtgtgtgtgtgtgtgtagagcatgcacatgtggaggacaaatgacagcttttgtgacttgtttttctctgtccactgtgggttctgggcactggacttaggttgtcaggcttttttacctactgggccatggtgctggtccctcatagctaactaatgtatcaagtttttactgtgcttcatgtatattagtttgtttaatccatgtaacagcccatgattataatagtgaccttataattaattattcacagcattttgcaagttgcagaacctgtttagaagtacactagatagtaagggacagagttagtgtttaaacttttggcaggttgactatagagcctgcacagctgacgctatcttatgctgtcagtgtaaagcaagacttttttcatgaccactgtatataagtcatttgtttaaagaagctcacaggattttgtttgattgtttgaagcctgcctgagttctttgatagctggatgaaactgaaggataataattcgttaaacagatgtgttgcatgtgaaacttactttcttttggattttaatagttgaggtgatagaaatgttgttactaactggtatgatattcttgttcttaggatggtgggtccttggatcaagttctgaagaaagctggaagaattcctgagcaaattttaggaaaagttagcattgctgtgagtatgtagtagagtttttttccagagtaacaaattttagaaaaagttagcattgctctgagtatgtagtagagtttctcttctagagtgacgaattgagagaaaataggtgagagaggaaggtgagtcagtgaaggagttgatttcagaaataagcttgctagagcatttcccataggatgaccttaaacatctgtacttctgtccctgctgcttccctactgctgggatggcagatgtgcaccccacacccagttttattctgtgctggggatccatgtggctcttactcctgcaaggcaagcactttacccattgagctaaatcctcagcctcaactttaggttaaaacctgtgtctgaaaaacagggcaaggtatctttgttagagacaagaaaaggtctttaaagttgggggtttagaaaacaatctttcacagagtgttttgaaaacttacattggccacccttaccttaggctaacagtagtgctttatagaactataaagtgatgttgttgcttaatagacagataagttgttggtggaaatgtttaagaagagccattgtttttctaagccagtcccatttcagtttcctttttttttaattttcctctcctccaggtgataaaaggcctgacctatcttcgggagaagcacaagattatgcacagaggtgagaaggattgccaggtgtttcattctgaattacagttgaaatctggaggtttcacatctttttaaaatgtgtttaggggctggagagatggctcagcggttaagagcactgactgctcttccgaaggtcctgagttcaaatcccagcaaccacatggtggctcacaaccatccgtaatgagatctgacactctcttctggtgtgtctgaagacagccacagtgtacttaattataataataaataaatcttttaaaaaaataataaaatgtgtttagccgggcagtggtggttcacgcctttaatcccagcacttaggaggcagaggcaggagaatttctgagttcaaggtcagcctggtctacagagtgagttccaggacaaccagggctacacagagaaaccctgtctcaaaaaaccaaaaaaaaaaaaaaaaaagtgtttagttttgttttggaatgaaagccctttactaaacagggcatagtggtgggtgccttgggaggcatgggtaggtgtatctctgtgcgtttaaagcagccagagcaatatagagtgatcctgtataaagtgttctattactaacatatcctttattgtgagacaaggatcttattatttagccctggcagacctggaactaactatgtagaccagcttggcctgagaactcagacccgcctgccactgcctcctaaatgctgtgattaaaggcatacacatcatgtacatttgctgatatagtctttgttttattgttttaaaagaattatctattttatgtatgagtataccagagctgtcttcagacacaccagaagagggcgtcagatcccattccagatggttgtgagccaccatgtgggatttgaactcaggacctctgaaagagcagtcagtgctcttaaccactgagccgtcttcccagccttgcttgttttttgagacagggtttctctgtgcagctctggttgccctgaagcacctctttttgtaaggctttcttttcaggcagattctctttagtgagggcagcatagacctcaccagccacttacacagcaggttctgcatgtgctcaatcccaggaaagcttcaccttctctcccctgtccacaccagtgctgggcctctgatgggctttcaattaggcctgttgtgccagggcattaatgtgcttgtggctggtcacatagattgatacccaagcaaaactatttggtgtttcagaagaagattatagtaatgaggaaatttgttaataattgttgaggagaaggaatggatgttgaaagcaagcaaatggaatgtagggtggagcacagtactagagcatgttgtagcatgggtaaggctgggctcaattcccaggattttggacaaaaggaagtaaaagggtttccatggcaaagtgactaagccttgagtcaaaaatacaaacaaacaaacaaacaaatacccagtaattcctaacagatggtcaaaacaggagtgagcagatagcttataggccacattgtgcctgctttctttagatttgtatgttctgcaagctaaggatgattttcaaagcttggtgacatgtgatagttgtgtgcaattcaaattttaacatccctggccaggtatggtggcacatgcctttaatcgtagccctggggaggcaggggcaggtagagctctatgagttcaaggccagcctagtctatatagcaagttcagaacacctagggctattggagagactctgcctcaaacaaacaatgagcttaatgtctataaataaagtcctgttagaacacagccacacttacttgcttaagtgttctctgtgactgctttgtggctgtattggtattttcaaacagtctcttgtgaaagaaatgactcatcctaaaatatttactctccagttctttactacaaaagcttcctgttgaggccctgaagtgtgttgacatccataggaggccttctcttttctgaagagaaaggcagagggggagataggggcagggagggggcagagaagtgggcctggaaggagaggagggaagggaagctgtggtcagtctgaatgtaaaggaaatataataaattaattaatgggggaaaaaggttcctgacccaagttaagagaaggaaggattaattgccttggagaaggtaagcaccaaccgtggctctcagcttgtttctgtgggttcttgaagaatgacagctttacagctcttttttttttttttgcttttttgagacagggtttctctgtatatccctggctgtcctagaactcactctgtagaccaggctggcctctaattcagaaatccacttgcctctgcctcccaagtgctgggattaaaggcacttgccaccactgcctggcggagagcagttctttaggggttgccatagcccagtaacacagaatactagagaagggggggggagagggagggagggagggggagcacccatgaatggcaggaggagacatgagagagaagtaataggttttctgagaagcccctaggagcggagggcaggtactagctggaggggtggtgtcaggaggacttgactttggtccttttggaatcagtgtcacattatagctgtgggttgggggttggggggaggggagctgtgattgaacctgctggtcatggagagcagtgacctactagcaaccctggggccctgattgccagtctgttagcggtaacactcagagaggagtctcatgcccaaagagattggtttgctatggaagtctcattacctggttattactctaaaggtggtcctattaactactaccaaatcaagagggaaggcagctcatgagacctgacaccgtggaggagcaacagtagagtcattctcagcctgaggctaggaaccatgttaattagaggcttctgttgtgggattgtcttctatatgggaacagctggttttcttgctggaagtaaatgctgactggctccatacagcaccgccactcagaggtggctacagcaactctttggagtttttccaaacatgtctttccccagcatcctggttgcaggtaaaacttcatggaaagttccttccaactctacccctttgagtgatcctagcaaaactgtaggtaatttatctgtcttacctcttccatttcttgggacaacccaggatcagatgaaactggccagtaaatctctaatagcaccaaggtgatggtacttaataaaagaacattaaccctagcattgtggagtcagagacaggcagatctctgagtttgaaccagcctgctttacattgcaagttccaggccagtcccagtcagggctaagaacactttgtcatgtgttattgcccccatccccccttaaaaccaaatacaaacgtatggtcctagactgctatgtggttgctgccttcacagaggttctggtccaacttggagaagtgagaccatagtgagtcagattaaagactgatgggtggatgatgcaaagggttgggatttgcattgagacagtgggtttcctttcaccctatcagtaaagggctaggattttaggagcatgattggcagaaagtgagctgcagttgaaggtagtgatgagcacatggttactggttactctctctatggatctagagtaagcgaggactaaaactgtccttaaattgtcagtctctcttaagtgtttctttaagggcctggctctctctaaaccaggaaggattggtaagtggcctcttaacctctggtctggacttttttttgatgcctgactttggagcctgggtccacatagtaacatcactagttatcgttcccacccctacccccatttaaggcaaataaatttccatgggcctatcatcttatggctcttattttccacctcctactgagcaaattaggttgaacatgtcaaatgggtttttagcttattttctttagtgtataattagtgtgcaaggtaataagtccttttcccgtcagcgtcagcagagagctgattggctttgagataagcctgcttttcttctaaagtaacagaaatagcacttaatacaggtgtcctggttggtggggttttggtgtgtctgtgtgtatctctgttgtttgttaacttgacataagctagggtcatctggaaagagggaatattaaatgagaaaacagggtttctcttcctatcctggaattcactctgtggaccaggctgaccttgaactctacctctgtctcctgagtgttgggattaaaggcatgcaacaccatcaccatgctaggtcttattttcttggctaatgattgatgtaggagggcccagtttactgtgggtggagccaccccggctgtgatcctgagtggtataagaaagcagctgagcaaaccacagggagcaagtcagtaagcatttcctccacggctcctgcttcaggagtgtgacctgagagtttcttttggtcatagtgttttatcacagcagtagaaacatatggagggagggtttgtgtgtttgtgtgtgtgcacgagcatgtgcatacgagtgtatgcctgtaggtgtggaggagttgacatgtcttcttcaattggtctctgcttcattttttttcagacaaggtctctttctggaccttggagttctctgatttagctagcatggctggttagtgagcctcagggatcctactgtccctgcctccagagcactgagattacaagtgtgtactcctgtgacccacaggtcctcatgcatggcaggcacttcactgcctaggccatccctctagccccaccacaggtgtctttgatgggaaggctacttttttatttttgtcaaggaacttcattatgaatcctcagtttccatgtcaacagggtgggcctgctctgccagatattgctgtagaatcgtagaaatgagaaaagagggtttgaaggatttcccttgctgacctctttttctactctgctcattgaatgtgacccctgttgtatgctggccctcagcctacatgaaccgggtatttctggaaggcaggctggggctgaaagagacttagacttcgagaaaagataatgaagtcaagacaaatatttctctgatcaaggccggagagtttgctaagagagtgtgcttataagggggaaggcccatcccccgtcagcccattcttggtgcctggagccagcctgtaggcgatctacagggtgtgtcttcggaatgtcactaggacctttcagcaggaagcagagtcttggagaagagcaaatagagccatcaaggtcagaaggctccaccctaggtaatctccttctcagtggcagcaaggtcaaagtctggatcagcctgcttcaaggctgagggaggctacagacccctatatatcttgctttggcttttcttatattctgtctccaaaatctgtacaactgctcagaatgtcatgtaccataagaaaggaaccctggactctgtaatatgtcagtgatatcatttgtgggcccattgctgttgggctaggtgagcggtgagttggtgagagggtacaacctatcatgtcttgactaggagagagaaaatcctttaaatgtgtttgtctgggcttgggtatgagatcttcagggtggagaggatttagagttgctggttaggactgatgggcttcccactgggactctgctgcttgaatttagctacaaccaggtggaagacaccttgaaggcctcttgcagttagcgagtctggaggaggtgaatgggctggagctgaggaagcagcgcgtggtaactagaggaggtagatttctctcacacctggatctccaggatttctgcctgtcccaaggcagattggttcccagaaaggctcattgccacagccaactacagcttgctaatggctttaccaagcctcaaggcatgaccggtggtgtgtgagctgtagtcagggccttgactctctagtttggcaggagccctctgttaggagtctggaattcaaatcccaaactactcttaggttgccctgctgttatgacagtgacaatgctgtggtcttctgctccctgttcccagtaccctcccactgctactgggaggagcaaagggagagtgttcaaaagatctgggccttcagctttggcttgcccaaactcctagcctgccccagctgtcctcagctgtcttcagctgtcctcgttacatccattctttctcaggaagtggaacctggtgggaaactagaacctttcatcagcagtctagggaaagtttaggtgggaaaaaattacatttacaagtaatggctagttgaaggctttggagttcttggagttttgttttgtttttgttttgtttttttcttttaaatctctgctgctcagttctctgaggtcctgggtagccagaggtagctccatgaaggctaggagtagactcatttcatttctccatcttaaggagggttcttaatgctctcctaagcatgctgggaagggggtcaggccatttgaaacgtaaagttgctattttaaaaaatctccttagggattggaaatgtagctcagttggtaatgtttgcctagcaggcatgaagtcctagatttattaccagcactgctggcccgcatccttaatcctggtcccaggtgtttggaggcaggaggatcagaaggtcaaggtcgtcctcagctacataggacgcttgaaaccagcctgggttcatgagaccatgtcttcacaatacgtaaacaatagcaaatacaatagctcatttgccttcaaaacaaacatttcatttctcactatctaagatcctgtcgatttcggatccagccttcatcacaaatgagcctgtctggcatccgtctgtgtgtccctctgcttgctcttctccagggctcttccttcttccttccattctctcctcacactctcttgggtgtcccacccacacctgtctcctgcccttctcttcctccatgccttgctcataaagttacatcttagggagtgcagctaaatgtgccccccccccccagcccaagaaaaaaaataaaggagacatagaacaaaggaatcccctggaaggcggagggcttcactgcctctttcaagcacctgccagccttgccagctaagcagctgccatcaggtgggtgatagcagctctgtctgctgtcgtggtcatccctgtgtacactgtccctctggcgatcacagcctgctggacagcgactgcccttctgatcattgcatagtgcaaggattctatgtagcataaccaagtggctcccgaggcattcgtagacccttgttttagcaggtaggaaatgtttagaagttaaacttgccattatgtgctttgaaccgtggttaatttggtgtcaagaaagaatattttatccagttagttttacatataactttttgttgttgttgtcgttttgttttcctttttggtgctagataagcactctttctctgaactgatgaaccctgaaccctctgcccttactctttgatctgctttttttttttttttttttttaaagaagatattccccagccgggcatggtggcgcacgcctttaattccagcacttgggaggcagagacaggcagatttctgagttcgaggccagcctggtctacaaagtgagttccaggacagccaggactatacagagaaaccctgtctcgaaaaaccaaaaaaaaaaagaagaagaagaagaagaagatattccccattgctaaagcgaattggcccgatggggcaggaaagggagtaccattcagtatgttatgggcttcctagcagcttgggagcccagtggttacttcacactgcttggcttaccaacacctggccctgaaaggttgggggagaactggaggcttagataagctgttgagaagtgctgggcctctcctgtgccctttgaggcttctgctgggacagtgggaagaagctcaggtaaatctcccaagtcgggaaggggactcaggctctagacaccagaagtggacacgggagggcaggtagacaggaagacatttcggatgcagggaacagcaaaagagaagaaggcaggacttaacacactgggcaattagagtcaggccaacctggattagctcagggagagagggagataagaaacattgggaagttttcagagccagccaaaggggctttgtttggactgtgtttcaaggcaaacgggagccatagcagtctgtataggggctattctggaggagttctagctgtcatgtgtagaagatagagggggaaaatatggggagaggaagagtggggggcagcaggcagctttgggaagctattccacagtgccctttgagattaggaaatgaattcattctagccttgttggacacctcacactttctactgccagaaagagttatctgggctaactaggtgggggtagggtgaggcgcattttctgcctgacactctggcagcattctctactgcgctaggtctcctgatcacgaggaggggcttcatgcagtatatctggctctcaaggcctgaagggtaaagcctctcattttctccagccccagtaatccctgcagatgggtgggtctaggaggctgaagctggagttcagaaccacataagggagagcagggttatgtaagctcaagtgcagatgcctgcttgccatgtgaatagaaatcagatgcaaaacccagctagaggcagctcagcctcggagagcagcagctgcagcctggagggagagaaagcagcagtgccaaagaatgcggccaccatggaggggatgctctgggctgagagggtcagggcagcttcctctgggatggtgtgtgtgtagtatatatgtagacaagggctcactctgtgatgtgagccaccctgctcagaggaaccaggactttccaaaaagtacctgtagcataggtggaagggctcccgccagtgctcctctcttgcttcaggttatacctgaaatgccatgggaaacatttgcggtgggggagtgaggggccttgaggagaaggcttatgttagaaggccttccatgtgctgcctctaccagccctacaggcacatcactcccttggctcttcctaagttgctcccatatcccgaacatgtgacctgaggtctgttctgcactctgtaagctggttagagaaagaacagctggcccctgccacctacctagtgttaaagtagtgctccaatagaagaccgtgcaggtgtgccctcacaccttgcagagtaatggctgtgagtgttacacagtctctcattggttgaattatctcctaacaccagtagtatatacgctggatgctactgggaatttggcagcatgcccctgccctttctgtggtattgcaggggacctatttgaggcaggtgctcagtaaccagtaggcgaaagactggtgaggatgttagacagagggccgtttttgccctgtggccgtgaataaacccttgacccatacatagctctgtattggaagtgggggaggaacctgatacatttaagatttctccctgtgcctgaatgatcactgagagtctctgtgggaggtagagttgtagagaggtttctggctccatagagatgctagaccgatagtgagggctgggtcttcgaaagatcacaccgtggtgctgagtgtagatatgctcattccatggtttgtgttggctcagcgtttaccaaggtaagacagactctgagagctcttcttgccttgctagagctggtgtgaactgacgctgaggatgatacgggctagcccgctcaggggaagggctacctggaatattataagactgtctcccctctgcccccagtttactcttgggaagatttttagaatctattgaagaagaaacaagtaagccaggcagtgctagtgcaggcctttaaccctagcactcaggaagtagaagcaggtgaatctctgagtctgcgccagcctggtctgcacatgagttccaggacagctaggactataaagtcgttttgaaactgtctcaaaaaacttttataaagagtaaataacttagctgggtttggtggcatgaacctgtgatcccagtactggaagctgagcaagcaggaccatgcagccttacattcctttttaatcttagtagtagacacaccgtgtcttgctagtacaggtacctgaagtaatagcctttgagctctcctcctcctgtttgttttggtctgttgagacagggtttctctgtgtaaccctgggaactagctctgtggaccaggctaaccttgaattcaaaggtctgtctgcttttgcctcccaagagccaatgtgccctgctccagactttgacattttgactggtgatgatagctgactccttctgatgagtcatatggccaggtctgagtcctcagagaatagacatctactatctactgtctttggagtttgcaagtcaaggattgcctggattggggcatatggtgtggtctagagagcactgatccttcccctccccagccaccctgccttaagtctctcatttcttgttttctcttcacagatgtcaagccatccaacattctagtgaactcacgtggggagatcaaactctgtgattttggggtcagcgggcagctaattgactctatggccaactccttcgtgggcacgagatcctacatgtcggtatgaactaaagttccctttttccagtgtttctgcaggcttcattcttagcatcagcagccacatattataaccatggagccataagtttgcactgtatggtgatggatagggattgagaaatgagaggtgaattacagtgggcctctgggggagagtaagaatcttccttttacaaatgttcacatataattggggtctcaggcattgagacaacctcaagagattgtgctgtccaagctccagagtctgacttccttttctgaagagacttgagaatatatctgacatcttacgtgattgtcagaccctcaaacccaagacacttggacatgaccacaccccacctggcttactgctggtcctgttatcctctagtggccttgcgtagaggatatgtttgaaaccctttcctccactctgcttctgtcctccctatttactgaatgtctctgggtcatttcccggcctggcgtccagctcctgcttagagtccactctagctcagctacatcctatcttatccttctccccagagcccgactctcctggctcccagtgtcacctgattactgcatgcagctgtcccattgcccatggtcatattatcatggagtttttcccctccttgtaccacaagcttcagcccaggtgtctttcgtaggacctggcagggtctggcacattaagggttaggaatgctggtgagtggctgatgtggggttgactgaatgagagggtctttggatagtccatttctaagtgtagcagggaaagatggaaatctgtgggaagtgcttcagaggcagtgcacaggaggatgagagtaagggtagtttttatacaaccaagggaaaagtgcagaaaaaaggtgcagatggtaaggataggcctaaggcccagagtgtttcatgcacagtcaaagagttgtcatagccttagggggtctcagtccatccctgcagctatatcatcagtagagataaaggttcctatgtaagagatgagaacagctagagctaggaagccagcagcccctactgcttatgtaggggttatgaccaactccccattgctccttgctgctctcctcctcccctgtgactcaagctactgtcagtatcacaatacccttaccccacaccccctctttagtatctatagggaagttctaatgcacacatattccccctccccccaactccactggctacagcggagttctgctctttgctgatctcttcttctgtagatggggaggctgaacagtttgcacctggggccgcacagttgccaattctcaagttcattaggccttggaacttactgatccatgatttagtggctgggtttttgttggttatatatggtcagttttaaagtaatccatagtagagttggtggaaatttttcatgggagaagctagttatgtgtctaaataaatgcactatgatcactgaaggtttttgtagggtctgtgacaaactaatgctcagtgtgcagacactgtgctgtttcctctctgctgcttgtcacctttgtcagcgaatgattgtgtagagttctgccttgtctgaatgttttcatttcacttggttcctgctgtgacactagaaagtagagtggaaattttgttgtcatcactgttacgagttagcagtggtgatttctgtatataaaaatccccattttatatacagggaacctgagattcaggatccccacagtgcttaagtctcagagtggggaactcatgataagcctctcgtgtgtctgagacatgctacttatatgtgaaggtcaggggccagactgggcagagcaggaaccacaagcggccaggacctgactctgcggatgctgccggctgagacagggtccagggaaaatggagcagtgaggagaggtcagagctgtaatgcatggaggccagaggaactcttttaactttgaggtgtcagagtaggggacaccagaaggtaaaagcaccaaagccgccctgggggcctgtctagagcaagaactaaccatccatctcccccgtagcctgagagactccaggggactcactactctgtgcagtcggacatctggagcatggggctctctctggtggagatggcagttgggagataccccattcctcctcctgatgccaaggagctggagctactgtttggatgccatgtggaaggagacgcagccgaaacaccacccagaccaaggacccctgggaggcctctcagctgtgagtgaggactgggaggcagggatggtggtgggtgagtctaccctttgactcatagtgacaagtagcctcttgtctgtatctataaagtattttctttttcttctttataaatctgcagcatatggaatggacagccgacctcccatggcaatttttgagttgttggattacattgtcaatgaggtaagtgctgccaggtttccttgaccttctgcataagacagtaagtagagggctggagagtttactgctgctagattgctcagcagttaagagcactgactgccctaccagaggtcttgtgttcaattcccagcaaccacatggtggctcataaccatatatgctgagatctgatacccttttctggtgtgtctaaagaaagctacagtgggctggtgagatggctcagcggttaagagcactgactgctcttccaaaggtcttgagttcaaatcccagcaaccacatggtggctcacaaccatccgtaatgagatctgactccctcttctggagtgtctgaagacagctacagtgtacttacatatgataaataaataaatcttttaaaaaaatttaaaaacagaaagctacagtattcatataaataatttttaaaacaagtaaaagaaagcaagaagaaggtggtggtggcatgcacttttaatcccagcacttgggaggcagaggcagatggatctctgagttcaaggccagcttgatctacagagtgagttccaggacagacatgctacactgaagacaccctgtcttgaaaaacaaaacaaaacaaaacaaaacaaaaaagtaagtagttatgggctgtggggatagattagtggttcagcatagtggctactcttgcagagaacctgggttccattcctagcactcatacgacagttcacaatcatctgtaactccaggtcctaggaatctgacaccctcctttgtgggcacggcatgaatgtgatgcatagaccaacatttgggcagaaaacctatacacaaaataaaatggggggaaaaaacaagaaaaaggaaaaacggcttgggggaaaaacaacgcactagttattgtgtgtggtgtgcacctgtaatcccaatacttagagtgagactggagagttccaagcctgaggtaggcctgtactacatagtaagatccctgtctcagaaagggaggtgggaggggaaactgtggttgagttgttcatatggtgtggtcctcagggtgcctgagctttgctcttggaattgtcagctcagagtcccttcttcttttcccaagatgaggagcctcccgttcactactgatgtctgcctgtctccatttactaggctgtctaatgcatgtgcagacatctgagcacaggaggtgcgaggcagagtaagtgggatggatcggagatggaagagcaggagcccctagtcccccatgatagctaggagtggtgggtggagaactgcaacatacagacttggattattattttatgtgctgttaaacagttgtaagtgactatagaaagagatgaggaagccaggcgtggtggcgcatgcctttaatcccagcacttgggaggcagaggcagacgaatttctgagttcgaggccagcctgatctacagagtgagttccaggatagccaggactatacagagaaatcctgtctcgggggaaaaaaaaaaagaaagaaagagatgaggaatatccatgatcaatttctgtgaaaaacagcaaattacttttggattacttcctgcaatcccaacacctggcaggccaagggggaattccatgatttctaggctggcctgcactgtagaatgagactgtttcagagtaagtgggggagggggatcttttttaatgtatatgcctattgtaggtgattaaaaatttcaaactcttggatgattttactatgaagaaccagaccacttgtgaaattatgtataagtaagtttacattaaggaagggtaagactcactgaagtgtaggttgggcagtacagggacgtgagaaggagcccactgggccagcatgctgccctgcagcaggagcagccttggcagttgagaaggggtgagtgctgacatgtttcagaggcagcactgtgctgtggactgggctcagatcaggccatcacccatccttgattcaaaacatttaaacatccttgtatactcctctgaaaacagacccttaaaagcacaagtgggtctattgcttgtcacgaacctaacagggaatatcctggtcaccacagaggttataaatcagtgagtgcttttctgcccatcacggagctgtttccttctctactgtgtgcagagcactgtgcgaagcagcagagagagacaaggcagagcagtgcaggcttgggttcatcagtgcagggtgggccatctgtcctctgcctgctgaaacctatatggctctgggagggaggtccgtgagaggctgcctggaccacctcctgtacagctctgcacactgctttgcccacagtgctcacagtctgttctcactctgttcttaaagccagctgaggtggggaaactgtctctgtcctctttacataggtaaggaaactgaagctccaggatgggcagtagccggcatcttttccccagtgctttcacctgcctctttccgttccctgatgccaagagcctttgctagcacccagtcctttcttgcctgtcccctcctgctcaggaggaacagacactgtccttctggaagccagctgtttcctcttgaatattccacacaacctcagcagttctctgggtggggcttgtcctacaggattgggccactgttctacaatctggttcgcagctgacctcaaactgactaagacgtcagggtgagagggagggcttgctgggctttttagtaaggggcttgtgttttgttttttctgcagttttgggaatcagacctatgcctcctgcatgctatggaagctctgccactgaactgagcattcctgcagtaccactgcttgttccatttgttttagatcgggtctcattttgtagcctagagtagtctcaaatgcctcagcctccccaagtgctgggacgagaagcaggcaccacccaattcagagatctatctacctctgcctctggaatgcttgggctggtatttcattagagcagcgacatcttaggtactggcacaggtcatgtaaactaacaggtttcctggaggtactctcaggatcctcgtgctgcatcatccacactcagcctctgtagttaatgttttattaacctctgactctccagggttcagcaaggggggttgtggctgggagtaccatgaggagtatctcctggtttgggcatccctgtagcttctgttgttggtaactgctagtggcatttccaggtcagccagcactcttacactacacttcctgtacacctgagtacctacactcagagggtccagagctaaaacacagccttctataggagagtgaacaggctgaggggaataggtttgttctgtcagagtggtagaatacttgaagtactcccaataaggtgagccaggaggagttagaggtcccaagccactttcctggaactgatgagggcagcagaggccagaggcaaggtgggtgtgatggagaggtgatggagcaggaatcaagagtttctcacatgttgacatgtttgcagcctcctccaaaactgcccagtggagtattcagtctggagtttcaggattttgtgaataaatggtaagtttgtaccatgttctaagactccacccccctccccctgcccttaccctatcccctattaaccttggctgctgccatacctcatatcccttgtgatgctgggactcgtgactatctgattctgggtgccactctcccctgaatttcagggaccatcctgttgctttctgaccttgatttagctcagcaagacttttgtgtgtttggcgtaatgatggtgtgcctataatggggggtgattgcaggcactggccctcagccttcataagaggcaggcagacaaacataagcagggactgggaagtagcactcctaacattatttatcttcttttcagcttaataaagaaccctgcagagagagcagatctgaagcagctcatggtgagtcttacagagcctgtttgttcatctgagccatttttctgctcattcccactccttatacttcagtcaggtttagggtttcacagtgccagggatcaaactcctctgtcctgtgggtttcaggggcacctgcgatgcagtcagggagggacttccccgcagccttagttctgactagttcacctcacatatccagtatcctgagttactctccaactggttctagtttgatggcagtgacacacacgtggtactgtaatgtccagacaaggccatgccctgtgtagccttgagtgtagtgtactttctaacaagttgcccagggcctcacagcttctctgtttggcagagggggtctctgggctgcagctggcctacttgctgctcaagagtgagcactagaggcatcttctgcgcggtccccaggccacctcgcttttccttcttggccatttttaacagaatcccctttccttgtttcctgcacaggtacatgctttcatcaaaagatctgacgccgaggaggtagacttcgcaggctggctctgctccaccattgggcttaaccagcccagcacaccaacccacgctgccagcatctgagcctttaggaagcagcaaagaggaattctctgcccagtggcatgccatgttgctttcaggcctctcccatgcttgtctatgttcagacgtgcatctcatctgtgacaaaggatgaagaacacagcatgtgccaaattgtacttgtgtcatttttaatatcattgtctttatcactatggttactcccctaagtggattggctttgtgcttggggctatttgtctgttcatcaaacacatgccaggctgaactacagtgaaaccctagtgacctgggtggtcgttcttactgatgtttgcactgctgttcatcgtgactcactagctggctgcctgtattgtcaggattctcggaccttggtacttcactcttgctggtgacctctcagtctgagagggagccttgtgagacccttcacaggcagtgcatgcatggaaagcatgctttgctgctactgaaatgagcatcagaacgtgtacgtcatggtatttttattttttgcttttggtatagaactcagcaattcccatcaaaaaaacctaagcagagcccatcactgccatgatagctgggcttcagtctgtctactgtggtgatttttagacttctggttgtatttctatatttatttttaaatatacagtgtgggatacttagtggtgtgtgtctctaagtttggattagtgtttctaaattggtggttattttgaatgtcacaaatggattaaagcatcaatgtatcaagagttctatctttcttccagtctaagtaccaatgctattgtaaacaacgtgtatagtgcctacaaattgtatgaaaccccttttaaccactttaatcaagatgtttatcaaatctaatctcttattctaataaaaatactatcaagttaaaataaaagggacaagagatttctgcttttgtggcacacctttcaatttctctagactacaagaaatgaaatgattgtagtggtttaactagatatgacccccatagactcatgtgtttgaatgcttggcccatagggagtggtacttgttggaggaaatttgccacggtggggtgggggtgagttttgaggtctctcatatgcctaggctatgcccagtgaagaacacaacctctgggtcaagatgtagaagtcctggctccttcagtactgtgtctgcctgcatgatgccatgcttcccacgataatggactagacctcttaaactaagccagccccaattaaatgttttctcttataagagttgctatggtcatggtgtctcttcacagcaatgaaaatcctaagaatgatttagccagagactgtaaaaacaggaacacagctagaagacacaaatactatactgtcttatgggtgtttctgttgctgatatatgaacactctgaccaaaagcagagaagaaggggcttatttcagcttacggcttggctaccatccacagaacaacaggaacctagagacagaaactgaagcaggaggccatggagggaccctgtttgcagactctttcttatactaccctggggtggcactgctcacagtaagctgggtcctcccatgtcaaccgttcatttaagaaaatgtacaagtttgctcacaggccaatctgatatgggcagtttcccaatttaggtttcttctgaaattactctagcttgtgttgacataaaaactagccaaaaatgccattaggaagagtatacttgactttaatccagtacttgggaggcaggattgggtggatctgagtttgaggctggccttatctgtatagtgaattctaagacagcccagagtgtgtggagagaccttgtctcaaaagaaacaaaagatagaaaactaggcaaagcgcacacactgaccagatctgtgcagtgtgctaatggggctcctgtaatttcaatctttgtaccaactcttcttatgcgcaactttaacagcgattcctaccaccttcccaggacctgtgaatgagtagtctctacaccagagaacaactgtaggtgggcatctaacaccctggccaaagcaactgtgggaggaaagggataacttggcttacatatcctgaatcacagtttactgaaataaaccaaggcaggcaggcattcaaactcagtgaacccagaagctgatgcaaaaggcaatggaggaatgctgcttagtggtttaagtatagcaccacttcccacctcaataagaaaatgccctacaggcttgcctaaagcccaatcttaaagaggcagcttctcagtgacgattcctcctttcagatgactttgtcaaggtgacctaaagctagcacagaggtgttgggaacctgcctgggcaaagaacattcctcagtttatgtagcagtaaggcctgcctgcacttcaagccatgctctcaagaggtccatgttggtgtgagagccttcatgttggtctggtcagtctgctgtattctgctaggaaatggtttcactattacaattagcgacaccttctcagtgatggccttgtcatgctttgaggtggctgtaaagtcagaaaaacaagatgcagagcctatgaatattatttgtaagtactgttgctgggcagtggtggcgcacacctttaatcccagtacttgggaggcataggcaggcagatttctgagttcaaggccagcctggtctacatagtgagttccaggacagccaggactacacagggaaaccctgtctccaaaaaccaaaaaaaaaaaaaaaaaaagggctatactctgcttgtgtgggagcatgtgtaaatacatgtacatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttacaccatggtaagacctttcattgtgctttgttttcattctccctccaggctggcttcacagcagatgtcaatctctcttgctagagcatcccaaagcttgggaatgcaggtatgtaaatgccaaagttggctaaaactctgtatgatcttttacataatgatcagatgttatctacttttccccattcctctggtagtaaaattgaactgatttatatattgtagcagaaaaaaatcaaaacaaaatttttatttttgcagcttgctatttaatcccttttcttgtgtgctgggattgagatgtgctgggcctctatgccattataactgttctcttcagacaggtctctgagtgaatcagaactcactggtttggctagacaggctggccagtgtgcttctgggatctgttgttcttcctatccccagtgctggggttacaggcatgtgacactctatgtttttacacagattctggggctccaaactcagctcttcatatttgaatatagatactttatgggctgagcctcttccattcataagtttatctttcacataggccctgcaagatgactttgaagagatgaagcacccaagacttagtttgtataactaccctgcccttgatccccctttacgaatcagattcttcctcctcctcttcctcctcctcttcctcctcctcttcttccatagggctccttgtgctcagcttcagtgtagtctgatttattgtcacttcgttgtctacatgtagggacatctgtgcaaaataacagcattagaattactgtagaataacagcattagaattaagcctcaaaacagcaaattctttttttttttaaatatttatttatttattatatgttagtacactgtagctgtcttcagacactccagaagagggcatcagatttcattagggatggttgtgagccaccatgtggttgctgggatttgaactcgggaccttcggaagagcagtcggcactcttaaccacagagccatctcgccagcccagcaaattctttttaaaatcaaatctcatcatgagttggagaaatgattagcagttaaagtacttgttgcctgcaaggtgatggtggtgcacacgtctaatcccagcactcaggagacagaggccagcttggcctacaaagtgagttttaggatagccagggctatacagagaaaccctgtctagaaaaaacaaaacaaacaaaagagtacttgtttcttttccaaaaagatccaagtttgagtactaatacccatgctggatagctacaagccccaactctagggtgtctgatgttcaatggagacgaacttgcattcacacacacctataaaaatatctttaaagttcaattttaggttcatctttttatgactttcctctttctcgtttctcccattcctggaaagcggtgagaataagtccttcatgtttactatgatcttaacttacctaccatgctcttttagaaatcatcagtaaagtaactgtgtaggctacatagcttataaagaattctcaaagcacggtatattcaggaacactgtattggctctgttgaaggcagttggtaagcgtgagtagggtaatacctgcacctcatccttagctttgtacttgaagccacacttaacagagcagcgaccatgacatagtcctaaagagagcagagtttctaaacaggatacgagtgcacatgcctgtaatcccaggaggagagaagaacatacggtggctagcctgggtacaaaagacactgcttcaacagaagccccaccacaaacacacaacaaccactgctagcttgttggggttcctttgagtagctggaaaggatggagtaatctgagacctgggtaggcgaggcatattggtgtacactagaagagtagaggctgcctaaacttgacaaagtataaaagataagctattgtctggatgattaatatagattagctaattactgaactacaaattatgaggggctggagatgcagctcactggtagcgtacttgctattgtctggatgattaatatagattagctaattactgaactacaaattatgaggggctggagatgcagctcactggtagcgtacttgcttaccttgtatgaagtcctaggttcagtgtacaataaattcgcccaggcccccaaatatttgaatggtacttcccagagtcctttggacttggtaataatgtgccatacagcatttgcctgcccaaagagctcgggcacaatgggactctacactctctctggaagtctgtacttgactaaacttacatcacataactgttcaggtgcaggctgagaagacagtgtctcggtccttcctcgagaatttatcatggattgaagggctaattcttcaacctaggaaagaaaagtcaaagatatttatttcactgagtattctgctgggttactatagtgagtgaattccactagatgccatataggttggcatccctgaactgctctagaaggggagggcagctttacctcctcacccctttctttccctatgaagaggttctttgtaacactggcagtcctacaactcagtagaccaagctggccttgaatttacagatatctacttgcttctgcctccaaagtgctgggattaaaggcaagtgccactacactaaggttagaaatgtgggaggcaaggggatcataagtttaaaactaacctgagctacacactaggttcaaagcatgcttgggttacacaggcgagaccacttctcccctccctcaccccaggagacagctggttccacagacacagatggatgtcctatgattgagcttgtctactcattaatgagaaagtaaaggcagaatgttaaaaaatgcacgtgtttcctggtgcaccagggtaactgcgtttgggaggtcatcttcaacacacgatcatgtacttgtaagaggttctgttgcaataagggtgggcagtttataaatgccctgagaaaaactgcatatcgtttttttaccacaagtatacaagttcagtttataaagggctcctctaatcctcatgtcacttacatttaaagatcttgcccatgagtgctgaccagggattaccatgatcatttcacagggaccaaattacccctatgtctaggacgtgatcaaagcgcacctaaatctgcatccgagtcattctctgttcccagaagagttactgggaactcaagcggacaagtttctttcccagacttcattcgcgcctcaagcgggtctgagattcagtactagcatgacaacactaaagccccctctagtgcatataaacagcagtaacccgtgagccggcgtgctgggtcggggtagatgcgggctcaggagctaaacctgctcaacacctagcggcctggagctgtaccgccgcgctccgtcgacgtcccgaggggctagagctggaaagctgtacgctcaccttgaggcggttcagttggtcgtgtagagccgcctttagacgcagcagggtttcctcctccttgcggagctcctgcagtcgactcaacatccccttccacttccttagggcgctgccttctactaggcgcgcggtgatgacgtcaccgccgactgcggagaccagcgccgggctgagggcttactttctcgtagctgttttctgaagggccagtaggggcttagctcccacgatctgaaaacaaagtggaatcccaaagagcatggagattcttcagtcccttggtaatccctcacagtaaattggccccacaggctttaggatagcattcatctcagcaccctgtcacctactttccaagtgactttaatctctgcaaaggctacttatgcaggcaggaaccaaaatacccaaaatacctaagcctagtaaggacaggaatgctactaacctttaggaactgccttgtctcagggagtgtttttacccacgctcatcattatctgctagcagttttaacatcaaggcaagaggaaacgatgataattctaggatgatcagactgattcatacaaagaacactgcacctctacagacacagtggccatagctgtggtggtcccgccattcccttttaccatcataggccctctagtggctaccataactacacactattcataggacttggcccctagctatttatcccaagttcagtttataaagtagactaccatgtggaacaaagcagcctagagaatgaaattttatttaaaaaattttgttctataattctgatgacctaagtttgaccatgaagtctcacatcttgccacttgttcttcaaaaggttaatttcaaggggcttggaaacatccacaatttaagagtcacacaagggtttgtcaccacatgtttgatttattgaaatatgcggtctctacttgctctctggaatttaacaatttttaatagtttatgcagctggcttcttttcttctgtagtaggcttcttctctgctggtttcttggcaaccacctttttccctgcaggcttctgcttcttggcatccaccttctttcctttcttgcctaccgctggcttcttgtctgcagtccccttctctggaacaaccttctcggatttggttgccagtgcagtagctgctgcttccagctttttcacacgaagtttgtgctgcaacaaaaacaaatagaaaattaagaatcttatcttcaatgagcgcatcgtggttcacatctttaaccccagtacctggggaggtagaaacaagtgtgtgtggttggggggggggggggcgccagcgtcttcatagtaagttcctgtcttggaagggggcaatctaataaaaaaaaaaaattgacacgccaaactgacttacatttctggcctggcgaagaatggtattcctgcgcatagtcttggcgtaagggttcagcttcaacatgattctcaggttcttcagtggattcttcttcaagactctgcgatgaatcttcttgctatcaagaggtagcattcattaatcaacatgtatccctttaatagtcaaggggtcgtatcaagtgttagaccttaagttttaaaactctaccgtggtgctcggagggctctttggatttctgggcttttcaagattctgctaaggtcggtgttcatcatcttgtgcatgggcaggctggggggaaggaagagagaagtccaaagtctcattctctaactgaacacaaagcagtacaaattttaatttaaatgtttcaactctccagatacagaataaacctttacatcttcatttaataatcacaggtgaggcacatccaaacaatggaaaacgcaaacaaaatgtgaatgcagaacttatggaggatgttagtgcacacattagtcattgacgtgtaataaataagggaaaactcacttatagttactcttgagggaagcagccttccgccaagtgccatacagctcatccaacttccggaaagcactctccgtccagatgcagaaacggcccacatgcccaccaggagccagtttcaaaatgttcagcttgcttacattaagcagagtaatacctttaagaggaagcagaatcaggaagcctgcatgcccaacaggagaaatacaacttctatggctcctcaagctacctagggcacttagaagctcaagccatcatggctggcgtagctcactcacgtaggactcagaacttccacaatatcatgttatttcagaaacacggaccatgaagtggaatttcatcataaccaagctaagtgagcctgcacagaataggcagttaaaccacgtgcaaggatttaccagggatgttgcggaaggccttgatgataccattatcttcattatagatgatgcagggccccctgcgctggatccgccgtcggtttctcattttgcccttgccagctctcattctctgagaggcatagacctataaagtaagtagctttagtattctgatcaagacttcccacatcctcaatcttagcaaaacgaaaaactgtctcagcaggcaaagcaactttcagcagccacacctgacacttttatccatgaaattcacaactttctgttaccatttcaagtctcaaatctcagttaaagttttgagctgctcagcaataattttcgtcaaccttctgattcagcttactgacagcaggcaactgtcactgaaaacagagtaagacgcaaattacaacatcattgcaagcccaaaagccctttctgtaccccccccaaaagacagcaagacttctctccaatgtatttacagccaggcagtggtggcacacacctttaatcccagaactcaggaggcagaggcaggcagatttcttgagtttgaggccagcctggtctacagagtgagttccaggacagccaaggctacacagagaaaccctgtctcgaaacaccaaaaaagtatttacatgtccatcttcctttaaatactacaaaacgccatctacactggataggctacctatagggaacttgggttaacgcaaccacccctatctttgctactttggctctttgaaaggaagtttctatatccaataaaaactgaagccacccacccattaaacctcaacttatcctttgaatccaaatctgccagtatggaagatcagtgtatatggtgagcttacctttttgatgtcattccaagctttgagtttcttgagcagctgaacagcctccttggtcttcttgtaaccttcaaccttatcttcaaccaccagcggcagctcaggaacctcctcaatacgatgacctaacaaaaccaatttaatacttaacagcaaagtctcatctttccccccagaaacactgttccagaactcaaaagatactgtctctgctttcagtggcagatgtctcactttgcaccacacctcaaaataaaccatcatgcaatttgcgccaaatcagaatttccactaatatcatgcgtttcagaaacacggaccattaagtggaatttcatcattttgacagtcaagaacattataagaatgtgataagagcctactatgttgatgtaagcataagtgactttagcaggcagagagaaacagaattcatgaaagcaatttacttaggtacaagttaaaactaaatgtcacatatcaaagcatcagacctttagacatcaccaaagctggtaaggccgaggcagccagggcagaacagatggcatatcgtttttgggttgtattcactctgcggtgccaacgacgccaggttttggttggtgcaaacatgcgtcccccacgacacatctgttttctttg

SEQ ID NO: 266 - DNA, 1734 bp, Mus musculus
caggtactgcacgagtgcaactccccgtacatcgtgggcttctacggggccttctacagcgacggcgagatcagcatctgcatggagcacatggatggtgggtccttggatcaagttctgaagaaagctggaagaattcctgagcaaattttaggaaaagttagcattgctgtgataaaaggcctgacctatcttcgggagaagcacaagattatgcacagagatgtcaagccatccaacattctagtgaactcacgtggggagatcaaactctgtgattttggggtcagcgggcagctaattgactctatggccaactccttcgtgggcacgagatcctacatgtcgcctgagagactccaggggactcactactctgtgcagtcggacatctggagcatggggctctctctggtggagatggcagttgggagataccccattcctcctcctgatgccaaggagctggagctactgtttggatgccatgtggaaggagacgcagccgaaacaccacccagaccaaggacccctgggaggcctctcagctcatatggaatggacagccgacctcccatggcaatttttgagttgttggattacattgtcaatgagcctcctccaaaactgcccagtggagtattcagtctggagtttcaggattttgtgaataaatgcttaataaagaaccctgcagagagagcagatctgaagcagctcatggtacatgctttcatcaaaagatctgacgccgaggaggtagacttcgcaggctggctctgctccaccattgggcttaaccagcccagcacaccaacccacgctgccagcatctgagcctttaggaagcagcaaagaggaattctctgcccagtggcatgccatgttgctttcaggcctctcccatgcttgtctatgttcagacgtgcatctcatctgtgacaaaggatgaagaacacagcatgtgccaaattgtacttgtgtcatttttaatatcattgtctttatcactatggttactcccctaagtggattggctttgtgcttggggctatttgtctgttcatcaaacacatgccaggctgaactacagtgaaaccctagtgacctgggtggtcgttcttactgatgtttgcactgctgttcatcgtgactcactagctggctgcctgtattgtcaggattctcggaccttggtacttcactcttgctggtgacctctcagtctgagagggagccttgtgagacccttcacaggcagtgcatgcatggaaagcatgctttgctgctactgaaatgagcatcagaacgtgtacgtcatggtatttttattttttgcttttggtatagaactcagcaattcccatcaaaaaaacctaagcagagcccatcactgccatgatagctgggcttcagtctgtctactgtggtgatttttagacttctggttgtatttctatatttatttttaaatatacagtgtgggatacttagtggtgtgtgtctctaagtttggattagtgtttctaaattggtggttattttgaatgtcacaaatggattaaagcatcaatgtatcaagagttctatctttcttccagtctaagtaccaatgctattgtaaacaacgtgtatagtgcctacaaattgtatgaaaccccttttaaccactttaatcaagatgtttatcaaatctaatctcttattctaataaaaatactatcaagttaaaat

SEQ ID NO: 267 - protein, 278 aa, Mus musculus
QVLHECNSPYIVGFYGAFYSDGEISICMEHMDGGSLDQVLKKAGRIPEQILGKVSIAVIKGLTYLREKHKIMHRDVKPSNILVNSRGEIKLCDFGVSGQLIDSMANSFVGTRSYMSPERLQGTHYSVQSDIWSMGLSLVEMAVGRYPIPPPDAKELELLFGCHVEGDAAETPPRPRTPGRPLSSYGMDSRPPMAIFELLDYIVNEPPPKLPSGVFSLEFQDFVNKCLIKNPAERADLKQLMVHAFIKRSDAEEVDFAGWLCSTIGLNQPSTPTHAASI

SEQ ID NO: 268 - DNA, 122923 bp, Homo sapiens
  misc_feature (1)...(122923): n = A,T,C or G
gattctcctgcctcagcctcctgagcagctgggactacaggcgcgtgccaccacgcccaactaatttttgtatttttagtagagatggggtttcaccatattggccaggctggtctcgaactcctgaccttgtgatccacccatcttggcctcccaaagtgttgggattacaggcgtgagccacagcgcctgggtttttttttgtttgttttgttttttaacttggagtctcgctctgttgcccaggctggagtgctggattgcagtggcgcaatctcggctcactgcaacctctccctcctgggctcaaccagttctcctgcctcagactcccgagtagcagggactacaggcacatgtcattacacccgactaattttttctttttttttttcttgagacggagtctcgctctgttgccccagcaggagtgcaattgcacgatttggctcactgcaacctctgtctcctgggttcaagcaattctcttgcctcagtctcccaagtagctgggattacaggtgcacaccaccatgcccagctaattttttttttttaaacaaagtctcactcagtcacccaggctggagtgcagtggtgtgatagctcaccacaacctctgcctcccaggttcaagtaattctcctgcctcagcctcctgagtagctgggattacaggtgtatgcaaccatgtccggctaatttttgtatttttagtagagacagggtttcactgtgttggccagggtggtcttgaactcctgacctcgtgatccgcccacctaggcttcccaaagtgctgggattataggcgtgagccaccgcacccggccaaatttttgtatttttagtagagacggggtttcaccatgttggccaggcttgtctccatctcctgacctcgtgatctgccttccttggcctcccaaagtgctgggattacaggtgtgagccaccgcgcccagccgattgctcttaattatattaaagaaattagacttttattatattgcagatattgtaaatgtttattttctcagcttaccatttgtgtacttatatctctgtacaaggtgttttttctccatggagaaatgttaaatctttgtgaggttaattttattaatctttgcctttatggttttgacagtttgtgtctttcttcaaatgtttttctcattccaaaataaaaaaaaaaatttcccatgatcttatctagcttctctagcagtacttgtatgatttcacctttctttctttattcttttcttccatatttttttttttgagacagggtctcactctattgtccaggctagagtgcagtagtttgatcatgactcactctaacctggacctccggggcctaagtaatcttcccacctcagcctctcaagtagctgggactacagggatgtaccaccatgcctggctaagtttatcttttgttaattttattaaaaatattttcttaagaaatgggggtctcactatgttgactaggctggtcttaaactcctggcctcaggcaattctctcgtcttggtctcccaaagtgttaggttacaggcatgagccgccgtgcacaaagtttttttttttgtagagatggagtcttcccatattgctcaggctggtctcaaactcctggcgttaagcaattgtcccgcctctgcctcccaaaatgctggaatcacaggcatgagccactgtgcctggccttgattgcatctttgatgcacctggaatttatttagctatttacttttctccaaatcaacaggtcttttattacatcatttaaatatcacaagtaggtcttaggagtcatctggcgtcttctttctgtagctggataactcttagatcttattcatcatcctgctgaacagttcctttttcagagacatagataccattcaaaaatttcctgatatccttgttttaaactgttgtggcttgctgaatcaaagccgctgaatttgaaacaagctcaatgtcatttccttcaaggattaattcatctttctgggcttgagatactgaacaagcaacacctggtctcatccgcaccctgcggatgtatttttcacccaagaaatttcggatttcaacaacagacccattctccgggataacgacgatgatggggaagtaagcatacacagacctcatcttgtaacggaagcccagtgtaacacccttgatcatgttctgtacatgactacaaatagtccgaacggtagccagttcttttctgttaccccaccatttgtcaaccagagcctctttttttttctttccaagaagactgagttctacattgatgtgattgaagtccctccgcagggttcctctggggccattcacgataactgtgtgtcccttcagagtaatgttgacattttctggaatgtcgacagtctgattaatgagaatggtcttcactctcgcagtacacacggcaaaggacctggaatttattataggataaaaagtagggatacaccttcatttcttttctttctttctttttttttttttttttttttgagacggagtctcgctctgtcacccaggctggagtgcagtggcgctatctgggctcactgcaacctccgcctctcaggctcacgccattctcctacctcagcctcctgagtagctgggactacaggcgcccaccactgcgcccggctaattttttgtatttttagtagagacggtggtgtttcaccgtgttagccaggatggtttcgatctcctgacctcgtgatccaccccacctcggcctcccaaagtgctgggattacaggcgtgagccactgcgcccggcccctacaccttcatttctttttcaaatggccaggtagttgtccctgtttccttaactaaatactccatgacattgaaagtcctggccatttcccagatacctattatgttctattggtttttaccaaaaatagttgtgtccagtgctatctcactctactttcatttgcctttgggtgttgatatagacgttacgttttttctgtttatgacaaaacaatagagatctgggccaggcgcggtggctcatgcctgtaatcccagcactttgggaggccgaggtgggtgaatcacctgaggtcaggagttagagaccagcctgaccaacatggtgaaaccccatctgtactaaaaatacaaacattagctgggcgtggtggcgggtgcctgtaatgccagctactcaggaggctgaggcaggcaaattgcttgaacctgggaggcgtaggttgcagtgagccccaattgcaccactgcactccagcccaggcgacagagcaagactccatctggaaaaaattaaaaaaatagagatcctaggtttttctagaagtactgttaaaaaatattaatccctactgtttgaaatttctagaaatgaaagtcttttcttgtccagtatttaatcatacgggtgtgtcataaatgatgtaatcatttctcttctgttgaatatttaggtaatttcagattttacctatttaaataatactatgttgatcattcttctgtatagctttcataatttctttacaagagagtcatggaagtggaattactgaatcaaagtgtgtgaatatttctgaagaagaaattgtctccaggaaagcctctataaattattctccttcggccgggcacggtggctcacacctgtaatcccggcactttgggaggctgaggtgggtggatcacctgaggtcaggagttcaagaccagcctgcccaacatggcgaaaccctgtctctactaaaaatacaaaaaaattagccgagcgtggtggcgggcgcctgtaatgtcagctactcaggaggctgaggcaggcaaattgcttgaacctgggaggcgtaggttgcagtgagccccaattgcgccacggcactccagcccaggtgacagagcaagtctccatctggaaaaaatttaaaaaaaagaatagagatcctaggtttttctagaagtactgttaaaaaatattaattcctactgtttgaaatttctagaaatgaaagtcttttcttgtccagtatttcatcatatgggtgtgtcataaatgatgtaatcatttctcttctgttgaatatttaggtaatttcagattttagctatttaaataatactatgttgatcattcttctgtatagctttcataatttctttacaagagaatcatggaagtagaattactgaatcaaagtgtgtgaatatttctgaagaagaaattgtctccaggaaagcctctataaattattctcctttggccgggcacggtggctcacacctgtaatcccaccactttgggaggccgaggtgggtggatcacctcaggtcaggagttcaagaccagcctgcccaacatggcgaaaccctgtctctactaaaaatacaaaaaattagctgagcatggtggcgggtgcctgtaatcccagctacttgggaggctgaggcaggagaaccgcttgaacctggaaggcagaggtggcagtgagccgagattgcaccactgcactccacctgggcgatgagtgaaactctgtctcaaaaaaaaaaattattcttctagcagattatgtttacatgatgaaaacctatcaccatcaccatttatttagctcctgtatgttaggcactattctttcaaagtttcatttaatgctcataactatttagtgcagtagtagacagtataattctcattttataggtaaattaactgatgctcagagagggtaagtaatcagccaagggcagaactggaattaatctcaggtctttctctctcaagttgatgcttttttgttttgtttgattttgaacctaagatatagaggtctgagttaaatgtactcctcaattcttgatatgttttcatcactggttgtccttgtatttcttctgttttccaggctggtgtgcaagatcatggctcactgcagccttgacttcggctcaagcgatcatcccacctcagcctccagagtagctgggactgcaggcatgtgccactatgcctgtctaatatttgtattttttgtagagatggggtttcgtcatattgcccaggctagtgttgaactcctgggctcaagtcatccacctgcctcagccttccaaagtgctgggattacgggagtgacaggagtgagccaccacacctggcctgtatttcttggatcttcacatttgtgatctagctacactgtgtacaaatgggatgaaccagtatttgccaatattcaaacatttttgacctacaaatagagcaacctgatatggttcaaccaaatatatatgttacagtgtttattattatacatcactgattcatacacatatagttcagtcttattcttgtctgtatggtcagcacttatgttaggccctcaggaaaagttgacagaaccgatggatcactgccggtctgaaaaggaaatgaggaaaacaaattctcctaccttgaactattctgcaaactttaaccattggggtaattgtttatctgggcttcttggatcatgataagggcttagggtttactcagtggaggccaacccagcatgcatagaatcataatatttcaatattaaaaagaatgctgcattttacacagagtggaagtgaggccttgaaaatttcaattaattgctcaaagtcctaatagtttttatttgaactagtaaatataaaattataccagaattcagatagactgccttgataatagattactttgaaaagtttcaattttttttttttttttgagatagtctcactgtgttgcacaggctggagtacagtggagtgatcttggctcactgtaacctccacctcctgggttcaagtgattctccagcttcagcctcccaagtagctgggactacaggcacccgccaccacattcagataatttttgtatttttagtaaagacagggtttcaccatgttggccaggcttggtcttgaactcctgacctcaggtgatcctcccacctcagcctcccaaagtgctgggattaaaggtgtgagccaccaccacacctggccttcaattcactttttaatgtttattattttactctgatactaaaaattatgcatgtttaacatgaataaggacacacttctacacacacatgcatacatttacatctatgcctctatattaaaaagtatgggggaaagaaatggggagatgtaggtcaaagaatataaagcagcagatatgtaggatgaagaagtctagagatctaatgtacaacatgaagaccatagttaataacattgtattttatttgcgttttttgttaaataagtagattttagctgctcgtcatactttacacaagcctttatgtgacggtatagatatgttaattcacttcactatagtaaccattttactatctatatatatcccataacatcatgttacaaacctcaaatatacacaataaaatttatttttatttatttaatttatttatttatttttgagacggagtcttgttctgtcgcccaggctggagtgcagtggcgcgatctcggctcactgcaagctccacctcccgggttcacaccattctcctgcctcagcctcctgagtagctgggactacaggcacccaccaccacgcccggctaattttttgtattttttagtagagatggggtttcaccgtgttagccaggatggtctcgatttcctgacctcgtgatctgcccacctcagcctcccaaagtgctgggattacaggcatgagccaccgcgcccggcctattttatttatttttgagacagagtcttgctctgttgcccaggctggagtgcagtggtgcaatctcggctcactgcaaactctgcctccctggttcaggcaattatcctgcctcagcctcctgagtagctgggattacaggtgcccaccaccatgcctggctaatttttgtaatttagtagagacggggtttcaccatgttggccaggctgatcttgaagtcctgacctcaagtgatcttccagctttggcctcacaaagtgctgggattacaggtggtagccgccactgcatccacccagaataatttattttttaaaaaactatgagttcaggccgggcgcagtggctcacgcctgtaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggtgaaatcctgtctctactaaaaatacaaaattagccaggcatggtggtgcatgcctgtaatcccagctacttgggaggctgaggcaggagaatcacttgagcttgggaggtggaggttgcaatgagccaaggttgcgccattgcactcaagcctgggcaaaaagagcaaaacgccactcaaaaacaaaaacaaaacaaaacaaaaacacccccccaaaaaacaaaacaaaacaatgagttcacactgatacctccaattccaatacaatagcgtaaggtattctcccttcccatacttctaacttcattctaccacagtgagaaagctggctctgtcatgcttaatatatttagtgacttaatcaaccatcctgaatgcaactaacctcccatctaagcttctaggccttccccacttggatgccttgttctcccctcttgggccctacggctaagactttgtgtaggactgcctcccaggtgttcaagccctcttcattttctcaggttcctcagcctccttacctgctaggtcaccaacacctggctgtggataaccaggtgtagatgtttcctttgttctgtacacgtttcctttgttctgtacacctaatgtctttgacacttagtattttaggatgggaaaggggaagaggaacactgaatgtgcacttttaaatgggtattgtgcctcttattaagctctttattcacatcttatttctttagtaattcacagaattggaatttttggattaaagttctttttttttttgagacggggtctcactctgtcgcccaggctggagtgcagtggtgtgatcttggatcactgcaacctccgcctcccgagttcaagcaattctctgcctcagccccccaagtagttgggattacaggcacccgccaccacgcccagctaattttttgtatttttagtagagatgggtttcaccatcttggccaggctggtcttgaactcctgacctcgtgatccacccgtctcggcctcccaaagttctggaattacaggcgtgagccaccgcgcctggcctggatgaaagtttttttaaagggagtcttgctctgtagccctggctggtgtgcagtggtgtgatcatagctcactgcagcctcaaactcctgggctcaagtgatcctccagcctcagcctcctcagtagcttggacgacagctgcacacaaccatgcccagctaatagagacgggggactcactatgttgcccaggctagtctcgaactcctgggctcaagtgatcctcttgcctgggcctcccaaaattgggagtacaggcgtgagccaccgctcctggcccgaaagagtgtttttaaggctttaaaaaaatattgccaacatggtgaaaacccgtttctacaaaaatacaaaaaggatccgggcatgacggcgagtgcctgtaatcccagctactcaggagactgaggcaggagaatcgcttgaacgtgggaggcagaggtggtagttagcggagatcgcgccactacactccaggctgggcaactgagggagacaccgtcttaaaaaaaaaaaagttcccaagtctaaaaaaaaaaaaatcatcaatctgctctcaaaaactgtcgcaacaatttacaatctcatcagcactgagtatccatttccttgcacccttctcagtagtattaccattaaacaaacaaaatttatatgcgtcagtttgttgggctcaaaggagcctctcgacaagtttcctattccccacgctgcctctcctctggacacaggaaggggtccttttccttatttattttgttatttcattttcgtcaacacggctcggcttggggacaggggtcgggggcaggccggttaccgcagaggtggaggccgcgcggcacctggcctggagagctcaccacacagcgacacagacttcttctcagctgggtccacctgcttgcctcggggcgacagagggcgccacggcgtccgcgacggaccccgcccccaggcagtgcgccgcgctcccgtgacgtatttccgcgtcatctgccgccgaggcttgcccccattggttgtctgcgaggcaataggggcggagccgagtgggagtgtggaaagcgccgcatcccgggtgggaggcgaggcttccccttccccgcccctcccccggcctccagtccctcccagggccgcttcgcagagcggctaggagcacggcggcggcggcactttccccggcaggagctggagctgggctctggtgcgcgcgcggctgtgccgcccgagccggagggactggttggttgagagagagagaggaagggaatcccgggctgccgaaccgcacgttcagcccgctccgctcctgcagggcagcctttcggctctctgcgcgcgaagccgagtcccgggcgggtggggcgggggtccactgagaccgctaccggcccctcggcgctgacgggaccgcgcggggcgcacccgctgaaggcagccccggggcccgcggcccggacttggtcctgcgcagcgggcgcggggcagcgcagcgggaggaagcgagaggtgctgccctccccccggagttggaagcgcgttacccgggtccaaaatgcccaagaagaagccgacgcccatccagctgaacccggcccccgacggctctgcagttaacgggaccagctctgcggagtaagtatggggcgggcggtgaacctcggggcccggctggggaggcccgagccggggagcaggagcgcgcgccaggctccgatctggtttgtcacgtacgtctggggctggcagggggcgagaaactcccggccgccgaggtatcggtgactaagcactgattgtgttcctgactcagaccagttagcggatcccgcgggtctccattcctctctgtaccccttttcccgaccgttttagtggttcctggccactgtacagtcttctcccaagaaaataaaagctagcacgtctcccctgcctcctcccagttctgttctaaatgtgatcatctgggagtctggcctgtaacggggagaggaggctaatgttttggaaagaattaagatcgcatctgtgcttttgagaccagctcagggtattaagtgtggagcatcatcctcaccttcatgcctgacacctgtggggcctgagtgccttgttgcaggccaactgcctggccagcgggggcgtgctggaagtccgtgtggacttcgtggcttttccttgctgactttggaggttcctggtacttggccttcctgggaaattgctcaagaaagcggctttcttcttcatcctactcttcattcattcattgaacaaaccattttctcactaatgatttcctagctttccgtacttcaccaggagcccctaaactcctgacctgaggcatgaacaccatgacctagaaaccacatgctaggtgctccatctctgcagcttccagcgttgcttacaaacgagcactttatttcattaaataatcatgagtctgtttcctgggggtttctgagctcccacaactctcttgggttctaggtaagggacaagactatgtgagggaaagctgcttagctagctagagaaatagccagaaaagattaggttattattatttttttgcctttttttggttgttgtttgcccaaccttcaataaggattgggttcttaatcttttacctgcacactgcagactttaggaagctaattgatgaaatcagaataggcttggaccttatgctctttggtgatttctgtaacctcccttcctttctctagatttttagaaaattttattttttaaacttttatacagatggggtcttgctatattgcttaggctggtcttgaactcctggactctagcgatcctcccaaagtgctgggattacaggcatgagccactatgcccagccaactttctctagattttaataacccggggacctgttggcttgatgacttgttccatccctgtaatgatcacaaggtcgatggtggacctgtggtgtgtgttcagctgtgtttttcagacctgctcccaacagactctcttctttagtcccctctcaatcctgtggggtctattttgcataatactgacttgtataggtagttggattgcattattgcattgcaaacatttgttctttttttttttttttttttgagtcggagtttcactcttgttgcccaggctggagtgcaatggtgcgatcttggctaactgcagcctctgcctcccgggttcaagcgactctcctgcctcagcctcccgagtagctgggattacaggcatgcgccaccatgcccggctaattttgtatttttagtagagatggggtttctccaagttgttcaggctggtggcaaactcccgtcctcaggtgatccacctgcctcggcctccgaaaatgctgggattacaggcatgagccaccgtgcccagcccatttgttcagttttagtatacagtgtttcaccctcttaaaatagactgaaagtcatgactgttgttaggacaagttttgaccacagtggattctggctgagtgttatggcctcattatcctttcctatttgatttggaagtggatactgagtagaagtacctgttatcattctgttgtaatcgtgataccacaactgtattctctcaaggaggaggaatttcattaaaacagtaaaagcaggatgagaagaaactaccccagatttggtggcagaaaaatttggatggtactgggagagtctaaacagtggttaaaaggtaagggctctggagtcaggctaagtttgaagcctagctctgttgtggttttttttttttttttttttttttgacagtctcgctctgttgcccaggccagagtgcagtggtgcgatctcggctcaccacaacctccacctcccggcttcaagcgattctcctgcctcagcctcctaactagctgagactacaggcacgtgcaaccgtgcctggctaatttttgtattttaatagagacagggttttaccctgttggtcaggctggtctcaaactcctgacctcgtgatcctcccacctcagcctcctaaagtgctgggattacagcccggcctctgttgtggttttgtgacctggttcaagtcttttagtctaaggcttaggtttagtttttttcatctgcaaaaatggggctaatgatagaacctacttagcatagttgtgaagattaaatgaggtagtacatagtaaacttccaaagctgttggctgctggtgcctttgttactgcctaagtgttggaccaaaggaaactggaaggtgattttcattcatggtggtagattatgtgttaaggtgcctttgcttctggacaatcaactctccctagtttggttttttgtaccatctgcatctacctctatgactcattgctgtgttacaataggaggcatctttgtgtaggctgcccaagacaaacagggactgtttccctgtgtttcatagcactaatgagagggaaagctgtacacatcttcatctttcacttctgagagtgttcctcaagcaaaatgttccctatcttgggctaccagcagaaagaattctgttgctttcatgatttctgtgattagaccagggcacaattttgaacgttatcagacaatgtgaactaaagaggaagaaaatccattttgacagtaaagaactcttggtaccaaattggcaaggttgcttttcccttggcacctgtgcttacctctaacatagcccttacccagttcagagatggagttgggtaatacgggacctgaagttgatgcaagttgtaggggtcctcaaagaaaaatcatgcaaaaatagctttctttcgtgtattttgcagaaacatgtgagcatattactagggtcttaagtgttagaatgagataatgagataatattgttcctctgtttaaaatgttcttctggttctattgcagttacacaaaatccaaactccttatattggactatgagactgagtgatctgcctgttgtccccaccaccccctcccaccaatctctttaaccacatttcctgccactcctttcttccaccacactagtcctctttcacttcctctatgggatggtctatatgcactgcaggcctctgtacatgctgttccctttgcctggaatgaatcactcctccttccctaggtaggcaggaagcagtcttcacctatttgcctaaatgtcacttcctctgagatgtttataagcatctcagaggaatgtggtccctctttgtcatgtcacctgagctgctgcttttttttttttttttggtatgggggtcttggtatgttgcccaggctggttcttgaactcctggactccagtgattctaccacctcagcctcttgagtagctgggactataggtgggtactactgtgcctggcgctcacctgagcttttaataagacttaatcattgtaatttttcattggggtgttcttaatatttatctctcctgtacactataaactttaagcacagcactgcctttttgttttttgagacggagtctcgctctatcgcccaggctggaatgcagtggcactacctcggctcactgcaagctccgcctcccaggttcatgccattctcctgcctcagcctcccaagtagctgggactacaggcgcccaccactgcgtccagctaattttttgtatttttagtagagatggggtttcaccatgttagccaggatggtctcgatctcctgatctcgtgatcccaaagtgctgggattacaggcgtgagccactgtgcccagcctgcactgcctttttttgactcaccactctgtaagtacacccaaaatagttctggcacataataggtccatagatgtttgttgagtcagtgagtgaatgaaatttctaatatttgcacaacgggtttaataaacctttttatgtcttttccttttcttttcccctttatgctcattccttttttccccattttcttttgttttagtcacccactcaaccattctaagatatttatatggttttataattccacctgttagtctggttatgtgtatacccttgggaagtagaaggatggttttgtatgtatctgcttaggattctaaaatgttattgtgctacaaatctgcatttcatagacaggatagaataggttatgttgaggtaacaaccacaaaatctcagtaatttaacacactttcaggtcagtgggaggctctgtagattggagtcctttagggatccaggctgatcgaggcatcgtctctcaagtatacctacatgaggagggaatcttgtgaagagctacattcaggctcttaaagttttgcctagaggtgagccttgtcatttttgctgccatttctttggccagagcaaatcatgtggccatgttgaccttcaaggagggcagtgacctttttggaagggggagaaccacgaatatttgtgtgttttttttggtttttttttttttttttaagaaagggtttcgctcccactgcccaggctggagtataatggtgcgtgccaccatgccctgctaagttttgattgttttgtagagatggggtttcaccatgttgctcaggctggtcttgaactcttgggctcaagcgatctgcccacctcatcctcccaaagtgctgaaattataggtatgagccactgtgctggtgcaccaggagtatttgaacagaagcaatgaccatccctaaattttatatcagtttcttctttgttttcttttcttttcttttttttttttttttgagatggagttttgctcttgttgcccaggctggagtgcaatggcatgatctcggctcaccgcaacctccgccccccaggttcaagctattctcctgcctcagcctcctgagtagctgggattacaggcatgtgccaccgtgcctggctaattttgtatttttagtagagacagggtttcaccatgttggtcaggctggtctcgaactcctgacctcagatgatccgcctgcctcagcctcccaaagtgttgggcttacaggcgtgagccaccatgcctggccttagtttctttttttaaccaattttgttttgagctctattcatgatgctatacaatatgtgtctagttcattatttctcttggttgtagagcagtcatgtttgcctgccacattttacttatttatttctctagaattagacatctttgttgtttcccaaccccttgctgcctcaaacagtcatgaccatgcccatccttgcacatccttgtctcctttggatgttgtgagagagtttcctgtggaatgtactcagaagtggaattgctgggtcttagggtacattgtctctccttccaggataaggcatgttatctctttctctctctcttttttttttttttgagaccgagtctcactctgttgcccaggctggagtgcagtgttgcaatcctggctcactgcaacccctccccacaaggttcaagcaattctcctgccttagcctcctgagtagctgggattacaggtgcctgacaccatgcccagctaatttttatatttttagtagagacagggtttcattatattgctcaggctggtctccaagtcctgaccttgtgatctgccctccttggcctcccaaagtgctgggattacaggtgtgaaccaccgcaccggctattaatctctttctttaaaacaataccgttaatccagttgcagtagtgaggcagggtacctctcaagatctcactttttctttgaccttgggcaagtcctttctactttctgactcttggtttccttaatctgtaaagtggaggtgataattgtttacaaaatctttaccatggtggcctacaaggccctacctgaccaggtccttagttttcttccagtgttctcttcactcatgcactctagccacactgtcctttgtgctgttgggttgtaggttgggcacattcttatcttagaatctttgcatttgccattcctgctgcctggaaagcttgtctctcaaataccgtatgacttgcttcctcacttccttcacccctctgttgaaatgtctcttcacagaggccatctttgatcactgtaatacagaactccctgtcattttctaccctttgattttgccttatttttctttgtagcgctgatcactaactgatgttacatcgtgtataagtatttatcttcttctgccaccccaagtgtaagcttcatgatggttggggctttgccttgttcattgctcagtgtgtagaacagattctggcacatagaaaatactcagtagatacctgttgattaaatgattgactagatcctacctcagaggaatacctttgaagatgtataaaatttctttgaaggctataaggtgccgaataaccttaggagggttcactgcttggccttagtagcgttcatgattttggattttgaattgtttctatgtaaccctgaaacactcagacttacttattgcattcagggtgtagttcatagcatcagcagttctgccaggtttgtaaggaacacacatctgttagagtgtgaaggccctggaggaagaaaggttgagacaggttgatgtgcttttttttgtctcttatggctctttctgaaggttgatgtgcttttttttgtctcttatggctctttctgagatgtgtaccatgatgataaccaggaactttttttttttttttttttttttgagagacaggatcttgctcagacactcaggctggagtgcattggtgctcactataaccttgaactcctgggttcagggaatcctcctgcttcagcctcctaagtagctagtactaccggcatgtaccaccatgcctggctaattttaaaatttagagatagggtcttactgtattgcccaggctgggctcaaactccttgcctcatgcaatcctccctccttggcctcccaaaagtgctgggtttacaggcatgagccaccatgtctggcctgataagtaggagcttttgaagtggtttcacactgattttgtagttttgaacttggatgcttcttttgggtagttgatgcagtaactaatactggtgctgtctttcagaacagcttcatgtgaaaaaggcctgcttaagcctgtgtctttgggaagaacatctctgctgctgttacagcagatacagtaatagcaaagaaagtcttaaagatgatttagcccatggcaaggaaatatatgggactcttgtttgaatataaacactcacagaattccagtttcacttatttatgcacctttcaaagaaaggaagaagatactgtggtagagtacagtagtcctcccttatctgagtggcatatgttccaagacccctagtggatgcctgaaaccacagatatcaatagtaccaaaccctgcatatactgtgttttttcctatgcagtatatgcctatgatgaagtttaatttataaattaggcatagtaagagattaacaataataaccaataaaaaagaattataacaatatattgtaatgacagttacatgaatgtggttactgtactcactgtgggtaactggaattgtcaaagcaaaactacatttaagtgggtactcctgtagctgttggccctgccttgcctatctagcttaattttcctctgtttttccgttcacctgctgtggtccacttaccactttctttactctcctcactgtgccaccagcatactgttgcttaccttcttacatctgtctggtcttgctgacatggtttttttttttgtctgaaatgccctcctccactttcttgcatgatttttttttttttttttttttttgagacggagtctcactctgtcacccaggctagagtgtgcagtcacatgatcttggctcactgcaacctctgcccactggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggtctttatgatatttttatctactaaaacttttaacccactcttacgtagttttgagagtcatatatattttttaatttggtggggttaaggaaaacttcagcaattttcgtggggtatctttccatttgttcatgtgttcctctttctcattttagggtattatagtttcttaataattctcttgcgtcctgagttaatatttcaaatacgtaacattttgatgctgttgttattgaacatttttaagtttgtattttccatctcgactatggtttgttttgtatgaactggttatatccagcagctttgttaaatccacttaatctatctagtaacgttttttgattgaatatatatgcatttgtagatttactagtgtcatctgcaaaacaactttttcttttcaatgtgatagatattttatagctgtctcatcttgcgttgctctcagtagcagttctggtgtctcagggaacactattaagtgtaacgaggtttctcaaggacctcctgggccagggacttttctgttctttccaaggagctgtgaaaaaaggaagcagctgcccagatttatagaagcagagcttattagggctggatgggacctaacaggttctctagacctgggccttcatttgagagatgaggaaaccagacctagagaggtgtgaatttgccagagttcacactgctgcagtggaaggaggtggttgagcttttactcttatttttttatggtacatattacatacagtacatgttttcatttgggaaagttacttggtttgacagttttccaagtttacccaacattaaattttggtaactatgcaatatccttaaaaaaattattttcaagtaattatctgaagctctagaaaaggttacccctctatatcctcactctcctaggtggttgagggaaaagagaataaagaaaagttgtggggttggggctgggacagggaggaaagggtattttagtccttgatccttagtaggagggcctatttttaagcttcataatgtcagttttaaaagcagtggttttcaaaataaccgcagacgaaagtccccttgaaatggatgcctttctggaattgacctattttgagtttagctgttaccagaagggttcagaatctcgaatgctcttaaatgcatttacttttcagacaaagtggaaattgagtgcataatccacgtgggttccagattcaggttaaatttagaaatttggggagttgtggagagaagacatgaaatgagtcaatcgttgttttacaggtttgtctgaatccaggttaattatgtttccttctttattgaattataatttgtatatccaggttagttttacaaattagatcagaccctcagtccatttgagagtagactcagagtcagaattatttgccccctttgctgctttcataccaccctttagtaaacagtcctcaagaatgtccttatgtcggggagggcagacctcagaagttagcaagaattccaagctcactgtaaaccttttgtttaatggtttactcaaatccagatagaaatgctaccaaaatgccagcctgtatttcagctcctctttcttggagtctttaggatggtgggaaaacaggcagaagaaagctgtttaacattccaataattattaataatagaaaatgtatcctgctaatcaggcactcatttgcgtccactgataaaactaggtcattggagccaaggaaaggtaccgttcactaaaggaaagaccagtagatagtcaggcatggtggcgtgtgtctgtagtcccagccactcgggggctgaggcaggagaatcacttgaaccagggaggtggtggttgcagtgagcggagatcgcgccactgcactccagcctgggtaacagagtgagtgagactctgtctcagaaaaaaacaaaacaaacaaaaacagtggaatattgggctcagctcttaacacattatatttagagattgcaacacttcaatatttactggaatactcctataaaacggtctcttttgccttgttttattttggtaactaagtgaatgctgggttagccataaaggtagcttgctgcatttctatttcttgtgttctaaatcactgaataattttttaaaaaagtagttctaaagcatttccagttaaaaaggaaggcgtaacatttattaggggaagtcaaggggagaggtagtgaggaaagtaccagaaaccaccaacaggtgtttcggttacgttgaacaaagaatcagcttgatatgcaatccctgggaagagtttgtaaattcctgaaggagggtgagagctggaggggacacggtgagcggaaatggtgagcggaaatcagtggttcctgaggcacagaggacttgggttaccggaggcttgccctcagctgaggacctgggaacaattcctgagcaagttgctttcttgatagacaaggatgcatctgtaggaccactgctgttaatctgtggggcaataagaattgatcctactgcaagaaagagagtaggataagtcagaagacatggaacttgtatccctagaggacatcgcaactggaaaaatagctaccatttatgaaggcctacctcatctctttgcattcattatcttgaatttgcactaaaattctgcaagaaaggtcatagtattctattttacaaataaggaaaattaagctcagggaagttatttcataaggttgcacaactagtaggtggtagagctaagtttagactcaggtctgtcctactctgataggcatgctttttccacacggccctctcagtactgtgtaaaatgccagagggctttctggatcttcacttcccaaaactgctaaatttaaattaattaaaattaaagttgaaaaatcagttcctaggttgcactgcccacatttcaagggctcagtgtccatgtgtggctagtggctactatactggaccagcacggattagaatgctttcttcattgcagaaagttctattagtgctggtctagaggtcattcagttttgcccctttatttaattttttcccccttttattccacaaaggagaaaatgagggacaaagaaaggaagtaacgttcagcatcagacagctaattaatccagttttttggactggttgcctgttagattttcccatgccccacattcttcccttaaaaaaatgaacagaatggaaatgtgagaaatggagtgactccgctactctcccagctttgcctggcctttaaactagattctttctcccaaagaatcctgcattttaccaagttcaaagggcatgtccggattagtttccccaaaggaaatgaaatatatttgttggaaaggaattccattcttaatgtatgaaataacacttggattccctctggttctttctctgacttcctaccaagcgctttgtaattgaacttgcagctgctaaccatttgtcttccaaaggagaccaacttcaaacagttcaaatgacagagggatgtatactttgaatgcaagcagctgcctattatttgccattgattcaaatggcatttatgttagagtcaaatagatttagattatggccaaaattacaacaatagatttctaacttgtatgttaagagtaagatgtattaacagtcattgaactgatgtttagtgtttaactcatacataccaggcactgggttgcaacatgaactaaaaggacttttgctgaaatggaaaaagatgtcttattatggacaagttgaatgcattttaaattcctgtctgaattatattgctggtatttgccatccatgtaccttcctgtttagccttgaaattcagtaaaagcctcagtgtggatcatacttcatagctctgaagtaaagtgaggagtcatgtgcaaatgtccttttagtagatgctattaaaaggcatttaaattatacactccagtgtctaaatgacagtctgaagtgtatgtgtgtttggaggatgggcaagtgggagcaaaaggaggcattgtgctggggcgattgatatttttaggaagcctaaatgtaatgtttgatttcggtataactaacagactcatggtttagaaaagttgtctatcaaaaactgagaaattgaggttttggtttcttcttaaagaaatgttcaagtcatgtgcatgagtatgctcagagagattaaaaatggagagaaattggaatggtggcaaggtatccaggaaagtacctgtcttctctgagagtccaagggcaggagcagaaaggactttaaagatggtggcaacaggctgggtgcggtggctcacacctgtaatcccagcactttgggaggctgaggcgggcggatcacctgagctccgcagtttgagaccagcctgaccaacatggagaaaccccatctctgctaaaaatacaaaaaattagccgggcgtggtggtgcatgcctataatcccagctacttgggaggctgaggcaggagaatcaattgtgccattgcagtccagcctaggcaacaagagtgaaactctgtctcaaaacaaaacaaaacaaaaaaaaagattgtggcaacagctggaaggggtccccaggagctctgacacagggttttccaactgcccaacatcacggggttggggagcagagcatccagagggctccgtgtattgttttgtagtatagggtctaacttctagaaagttgggaataggcttctgagagttttggagtcaacaggcctgaatgcagaatgatcaaaagaagatggctattcctctcagagtggtgctggttttgggggccagcagtgcagtgaaaagcccaatttcccaatcctattttgaatatttctgcccccacaagcgtttcatttgactccagagactaaccactcttccagagggtctagaagtcttcaggcttcagaatttttaggccatagtgctttggaataacagtcccttgtgtagaaaagtgtgagatctgagctcttttcctggtcaacctgtgaagtcactgcatgaccaactctgtgcctcaggttttttctctgcaaagtgggagtgatggtaatggcttcctacctttcagggtttgtatatgagctgcacatagtttcatgggttaccactcagcatgctttcaagcaagtagagattacattttattgttgaaagaaatcttggttgtcttctgttgtaatcttaccttgaatccagggctacaaagaagggttaaagctagatatggctcatgcctgtatttccagctacttagaaggctgaggcgggaggattacttgagcccagaaggttgaggctgcagcgagctgtggtagtgccactacaccccagcctggccaacagagcaagacttcgtctgttaaaaacaaaacaaaagaaaagaaaaaccaaagtaaggttaagagaagttggctatgtcacacagtatgttctatttggaattttgtgacttttgagtaacataacctaaaggccgtgtggcacagtggaaaggctttgtagccagcagactttgagtttgaattctgaccctgccttactatgtctgtggtcttgtgcaagtgcttttacatccttgggtctgttcccacatctgtaaaatgggcataacaacatttatccaacagaaaggattcatacactctgtgtgtaaactgctttttgtgattaacaagactaatgataacagccaagattagatccccagtgcaggttgccttactttctatcaggtgagaaggagagaaaattcttagttcccaaagaacttacagtgacggggctcttcagctgctctttatccaacagacttagaatagagacaacaccgggcatacttgcaattttttaggatgtgcaggaagcaaaagaattattttcagtgaaacaggagtctgcaaaaggtgccttaggaaacaactgccacacagtacatcccaatatagactcctcccagcttctctagggcagccatctgcctgacaggccccacccagataagcccagctttcttctcccaagagtttaaggaagatttcctgatgtatgtgtgcgtgtgtgtgggggtggtatggggttgtgttgggcgggggtcaagaggggtgttaatttgggatgggtagtcactggcttttggtggcataactggaaggtaacactccctgtggctgaatcctgatccctgtggggatcagcgcatggttcatccagacatcttcctcagtgggtcctggcctctgctcatactatgtcttctactggggattcccgtctccacctccaatatacgtatgttgaaatcttcatcttacgtcaaagctcaacttggaggtcatgtcttatgtaaatccatcacagacctctcctccaccccatccgggcagcggtcatctgctccaccctccggagcactctgtacatattccatcacacttcagttacttatgtaattgtctagtcagcagaagatactcctctccaaagggcaaggttctgctaaccgctgtgaagcctggctttgagtttatgaggggtgattcttttcagtttataatttcttggcacaggagggtcacagtgttgttggtaaccgtagcatctgtcctgggaggctctgtatgctcttcattgttcatacatccatttatttcttcactcagccacatgaggcatgtgggatgtatgttatctctgcttgatacatgaggaaactgattctggttaaaggacttgtgcctgtcatacaggcagctaagagtgcctatagtcctttgtattgccttttcagccaacagtcccatcccagcccaaaggaggaaacatttggggagcatatactggtgagaacatcttccctattctgtggcgttctcttagccttatgcctggcacagaggaaggctctgggaatgtttgggccggatggatctgggagcctcttttgcatgccaagctgcatacttatccctagcaaatgctggtctccttgatggatatgtgacatgggtggctgaatttacatggcacctggtggcttctcacactcctccgccacgcctctggggactaggataggacagatggccacagacaggattctcagctctgcaaatcacatttgggaaaaagttaagtttgtgcaataacacaattttggtaacatggtttcatgctgctggtaaattctataacactctctggataaatcacacttcagcagaactcacttgggaacagagtttaatttcactgtaggtggctgtgattcccacccaccagtcttcacacccccgctaatatatctaggctgataaggtgaatgctgtgctaagcaggctatttctgggcccaggatagaattacattgtggtttttaaagaatttttttctgtatatttttctattcacagaccctttgaaagaagaattacattatgttaatcatccgtttccccatcagcacctttaattccttctccccagagtataaccacttgtcattaaaatgacagaggtggaaaagatcttgatagttcagcctcctgtatgtatatatgaagaggttgaggcccagagagactgggcagcctactcagttgtcagatggctggtgaagacctgcatccggatccgttgacttctctcctgtgcagggcccttgttttttgccctgccctactgcttaaccttgtcttctgtcttacaactaggggagagtctatggcatgttcagtttgaaatgaataaaagtgaatacttgttcattgttaaaggaccccaacacagaactaatttcctgttaacccttacattttctcttgacatatctttggtgaggaccattaaaggcttaacacatttctgtacagtgacatgcagtcctaggggttaactgtgtgggtttgagcgataggatttaacttttaggaaaaaggggaaaaaagaaggttgataagtgtatttggagagagagaaaaaatagttaatttttctcttaacagttaatctgaaatgataacacaattgtgccttttggctctaaaatcaccatatttttgatatataatccaaaggcaggtatccagactgctgaaggcttattaaaatgtaacaataggtccaagtctagaacttgaaaaaacttctcatttgtcaaagaagttccagtattctacattctcttgctaatgaatttggggagccttggaagctcagcaactgggatgccatcgacaggtttgcggtcctctctagtctggggtaggtcttaaggggaaacttttgggagggacacacatacagtacagtgaaactgtacatgaactactcaggagacagatcacttggcagggatgtggcgatctttgtacatatttgttctgctttactagctacattgtaagcttctgcagatgaagagttcagccttgatgtcccatctcccgcccaggcctgccatgtactagttgatcagtaaaagtggaatgaatgaaagccagtgttagtttacagagcttctgtgggacagaagctttgttcagttgagtttccatcaatatcaaatgcaatgttatgtgcgttgagtttcttgataactgttcttgaggtttctttttttttttggtcctttttgactgattaagcaaggctggactggttggagaccccagatgggaccaagaaatgcgaatcctgcctggattgttgtaggtagagtgcttaatatggggcctggcatgaaggaagttgggagtattatctggtcaactggagtttagttattaggttgtaaatgactatggtaggtacagatgtcatgaatatactagggtctcagggtctgaaagagttaaagctcctctcagaatagcccaggcagttcccaggaagtagcttcttaggcaggatgtggcaaaccagtgggtaaatgagagcccttctcctttggaagaaaaggaagtaggtggggagaagtgaagaggaagagcttggtagacaaatctttttatctgcttcttttttaagtgccagacagaccctgcagatttttgatccaaagtgaccaaagtcctaagaatgccaataatattggttttgctattgtcttttccctgcagctaataactcaagtttaagatccactagagtgttgtttcaatagattttgttttctaattttgatcattggtgtattcttcagtgcgctttcaagattcacagtgaatgtggtgtcatccaaaatcacattcttttctaaccaaggataagtcagaagaaaagatatatatatgtatattagaaaagtgtctctttaatgtgtttacctatttatccattttaaaacacattcccacccattctctgtccaggtgctcataacagtccccttgtgatacaggacaagagtgtgcttccatttaaggcaggagagagatcttgcccatggttagatgaccagttaccagcagagttaatagagggctccagaccctctgacttcaagttcagggttgtttccacaattttggtcctttttgttaagaatatagtttatacattggagacaaattattgatggaggctgcaattttgcaaataaaaataaccctcaaaaatccagtaatgtgtatgtgaaatgaaataggtgaactgaatttggtgagctttagtgtcgctgtaaaagcaactatcctttgtaaacttactgcatagctaataatgtaaatcagtgttgtgtttaggaatcagctccaggactgtggtttgatatgtggaaacacctctgcgtttgctgtgggctggtagacagaatgggctggacctggctgtactgtgaaaggcttctttgagctggttctttgaccaggtaatgaaaacgttaagcatctaaaaacgaagtctttaggaggcttccaaggatctggaaagctgaactcagcaatttttagacttcagttttctggacaggacagctcttctagtcaaggaagccagtatctcctgcatttgtgtagctcttgactccatttctttgaaggtttcaaatgataatttttacacttacccagataatctactctgcctgagcacataattggtaatttggcccaaagactgcatacttagattgcatcctggtcacactgatatcttacatgcattttagatatttaaatattaaaacaaatattcttatggcaatttttgtttgttttgagatggggtcttgccgtattgcccaggctggagggcagtggctattcacaggtgcagtcatagtgcactgcagcctgaaactcctggcttcaagccatccttacatctcagcctcctgagtagctgggactacaggcgcatgccactgtgcctggcccttgtggaaattttatttatttatttattttattattttattattattattattttttgacacagtctctctctgtcgccctggctggagtacagtggcgtgatctcggctcactgcaacctccacctcccaggttcaagcaattctcgtgcctcagcctctaaagtagctgggactacaggtgctcgccaccacgcccagctaatttttgtatttttagtagagacagggtttcaccatgttggccaggctggcctcgaactcctgacctcaggtgatccacctgcctcggcctcccaaagtgctgggattacaggcatgagccaccacgcttggccccttgtgtcaatttttagaagctaggatgtcaggctgctctttactgaaccctaaatatcctgaagcattctgggctggtgtctaggaccatcttgatcctaagggaataagcttgactcttctcctcttggtgcttcagcactgcattttcctcagtgggattggaacaagcattaaagcaaaacaaaaagttgtaaatgagacttagggcaactaacctgctctagccagaatgaaaaatttgttgacgtttaaagttctctgacctccctgtgtctacctgttcataatactaaaacaaattatgaacttaagtaataagaaaaaagattatggcagatttcacacagctaaaataattacaagaattcagcaaccacaaaaatatttctcactgcaaattctcatccatttctgtattgtaggcattttttttttcttttggttttagtgtttattgtatacctcacactgggttagactcaagtttgggggatacttccagcttaattgagggtatgagcatgtaattgcaaggcattgtgacacatgctctaactctggtgtgtgatacagcacaggctatgggaactcaaagggtgagtgactaacgctgtcttgaggagtgaaggactgtatccccaaagcagggatctgggcctgtcttggggtttttgggtcttctgttttgttcttatttttttcttcttcttctttttttttttttttttttcctgtaaccttatttatggtgaagggacttttttttttttaattgtttacacttgcccttttgatatcctctgcattcgtggctcttatcatcatcttagacttgtgaacctgcctcaggtctctgttaggagtttctggcctatctggtcagccatatactgagtagctccacacgtagagcctgcaggttatctccaactcaccttttccaaaaaatagatttataatcctcttgtcacctgtgatgacctctcatgctaactacccagagtttgctagagcaattcacggaactcaggaatgcactgtacttctgattacaattttattatagcaaaaagggtacaaatcaggagcagccaaaagaagaggcatatagggtaaggcctgggagggtcccagatgtaaagcttctggtgtcttcacctcttggaatcagggcacagtcactctcctagtacattgatgtgtaacaatatgcacagagtattattaaccagggaagctcccctgagcttcagtgtccagagtttttactggggccccattacataggcatgattaattgaatcattggccatgtgattgaactgaatctctagcccttttactcactgcaggttaggctgtattacatggctcagagccccaaccttgtaatcacatgattggtctttctggtatggccagcccccatcctgtgtcttttttttttttttccccccagtcatcttttatttggaggttaattcccattaggatatgaaaggatttagcaacgatcgagactgtgttccttatggaggggctcgggccaagaaggtcatggcggggagtgcagagcatgccctcttcttcagtggtacttgcatagccacttgtgcttgagctccttgtaggaaaggcagtagctgaagagcacgtagcttgccagcaccatggtaacccctgagatgctccccttcttcatgtcaatgcactgcttgtagtaccagtaataacctcttcaaaatgctccggtagtgccactattgctgaagtcctgcatcaagctccagcttggcagctcccctagtttgacctccagaagtttcttgttcttcactggtatgactgatgccatcttggagtcctggtgtccactgtccctgtgtcatctttttaagcaaactgtgggcccacattgaatcaccttattggcgtaaactatcagggcccactgtgaataacaaagacactcctattacttgagaaattccaaagatttagaggttacctccagaaaccagggacaaaggccagccaaattctttattatacaacatcctcctaacccccaaagctgtctagtcctcatctttgtgatgtggtaagtcagatccctctggatgcccagccagaaacctggcatcaccctcaactcctccctccctccccccatatccagatcatcacccagtcttgccaactctgccttcagtttctgtcccagctctttattgcctggctgctgtggtgttcaaattctcatcttgtcttgttttccttgttgccttcaagctgactttcctggcttggctctcccatttctaagttgccagactcttggttccaaaatataaaactgatcttgtcactttctttagaatttgctgttgcagaacaatgtgtgtattataattccattttcgttaaacaaaacatactatatatattcactggaaatgtatttcaaagaaatctagaagtgtatatattctacagtgttaagagtagttatctgagggaaggtggaacatagagttttactttagactatatatttctagactagttggattttttcatactgagcacacattagtttttttaggcctggtaatattacagaagtcaaattacagaagtcaccctagctccccactcgccttctaaacctaattctttagcatggtgtgctgtgcccttcatggtctagctcagtttacctgcagccccatctcatcactcacctggatgcatccactctcaggatattctcaggattaaacttggggattacattttctgaccttcactttccctcccttatcttagatggaattagggagtttttctgtatgttcccatagctcccaatgcctaccttgcttttagcattttgacctaccctaccctgtagattgttgttacacttgtatagttgttgctgtacttcttcttagtatcctttcctatgtttggcttacattgtgatacacacccccctacaatcccccccaaacacacacacccacccacacacccacctttcagactgccttgtgaggacagggatcttgttgtcttcatagcctagcctctagtatacatagtgcttgtcatggagtagacgcttcatagtaaatctgcattgtattttcacagctgtaggcataaatggatgtaacccagagattcactcaagttacctatcccatgcccttttctagattggagcactccccgaggtttagattctcatcatcagttctgctgtgggactcacatttccctttctatgttttttctctttttgctctgttcttgaactagcttggaatttggctccttttccttggtttccactataacaacagtgagaacaaagtatacacaaagctatttgtgtgcacagcagattggacttggaaggtttggggtggggagggtatattatattacagcaatacaggtaacttaaaatctaatggtgttaggtgtctttggtcttaaatgacctttgctaccctgccatggtacctcctttccttctgctcttgctgctcttaacgagtccccaaacaagcttttctcattttattttgcaacgtaattcagctctccagctgcacctctacatgctgttcagggctgcttctgcccaccccaaggctgaggagcaggcccttctaaactatgggcaagctttctggttctctagtaggaccagatcccactgtgaacaggtattgttagcccaaagacttatttccccaccccacatcttttttcagaagacagaagcaagcactatcagttttggttttaattaagtttctttctgtgatattacttcttctaggtaggttttgactttactagaccaattgctgttaatttgatggtctaactagtaattttctacccctagtttaacatgttgaatgttgaccaggtgcagtgtcttacgcctgtaatccccgcactttgggaggcttaggtgggtggatcacctgagccctagaagtttgagaccaatctgggcaacatagtgaaaccctgtctctacagaaaattacaaaaattagccaggcatggtggcacgtgcctgtagtccagttacttgagaaactgaggtgggagggaggatcgcctgagcccaggagattgaggctgcagtgagccatgattgcaccactacaccccagtctgcgcaacaaaatgagaccctgtctcaaaaaaacaaaaaacctatgcttaagtgagcacctgcattgacttccagtcctgatcctgaaatcaggattccctgaaggttgttggaaagtgatctgggggtagggttttttcccagaggtgatacgtgctcagggatgagatttgctgaccctcctgtgtgtatttgggcagggagaagggtccagctgtaacaaacagctgttcttgtatataagggggaagcaagtctggagaattgacaatttctcctgtggactagaattggagacatattttgagtgctgtgtttcatctgactgtatcttcctgcccttgggtgtgcttctgggcactggctactgaccttttgccttggggacccgaccgtacttatggttctgttaaagttggagggtgtccaggttcttggcatcttcaacaaagaattggacaaaatgcacaaagcaaggaagggacgaagggatttattgaaaatgaaagtaccctccacaatgtgggagcggtcccaagcataggagctcaaaaggccccgttgcagagttttggggaatttaaataccccctagaggattccatttgttattttgggtacgctgtatgtaaatggagaggttgaagtaaagttacaaagtcatttgcggcctatgacctatggagaggatatttcctgttatagctgaagagtgaattggccttatgttccctacctccagacccaattttcctgcctcagttctgagttatgaggtttaactgattgggtcacattggatcctgtaccttctccctcattgaagagcaaactgcattcctgattgatagaccagcatgggccattattatacagggattttctaaaaagctctttttctttttttaaatttatttaaactattttttcctcattatgactggaaggataaaagatatttttctatatcagcttctcaagaacagggaatgggtaatgtccagtacgtcatctttctaaggccatagccagcttgtcttttcagtaacagccagccccactgtttagtggtcaccaccagacccagggctccctttgtttttctgatgctgaccacattttttttttttttgagacggagtctcgctctgtcgcccaggctggagtgcagtggcgggatctcagctcactgcaagctccgcctcccgggttcacgccattctcctgcctcagcctcccgagcacccgccaccacgcctggctaattttttgtgtttttagtagagagagggtttcaatgtgttagccaggatggtctcgatctcctgaccttgtgatccgcccacctcagcctctcaaagtgctgggattagaggtgtgatccactgtgcccggccttttttttttttttttttttttccttttttcttttttttgagacagagtttcactttgttgcccaggctggagtgcaatggcgcaatcttggctcactgcaacctctgcctcctgggttcaagcgattctcctgcctcatcctcccaagtagctgggattacaggcgtgcaccaccatgcctggcttcttttttgtcttataacttctgtttttttttcccccctctccctccaaactccatcacttttccttttgtacttctacagaagcctgatcctttaaaaattatctggctgggcgcggtggctcacacctgtaattctagcactttgggaggccgaggcggatggatcacctgaggtcagggattcaagaccagcctggccaacatggcaaaaccccgtctctactaaaaatacaaaaattagtcgggcgtggtggtgcatgcctgtaatcccagctactggggaggctgaggaaggagaattgcttgaacctgggaggtggaggttgcagtgagctgagattgtgccactgcactccagcctgtgtgacgggagcgagactccatctcaaaaaaaaaaaaatttcatatgcggctaatatgaaacacattttatatactgggacagaaggaaccataggctgtcacttgttttaagcaacaatatgacaccccctgtctgattcaggatgttattcaatatttgaggaaagtctttgtgagtgggtggtcctcatgactccagaggctcctctgtgtgtgtgtatgtgtgtgtttttcaacatgactgcagaaacatgttgtgggaaggtaatttatgtgatttcagaagactgtttgattcccagggggtgtttttgtttgtttgtttctttttaaaggataggaatatgtgattcttattctacctgggattctttttaatcaaacctgtttttatgacataaacaaaaaaaaaagtctgttggcttggaaactacctgatttacagtgaaattaaaaataaatgccttggccaggtgtggtggctcacacctgtagtcccagcactttgggaggtgaggtgggtggatcacctgaggtcaggagttcgagaccaccctggccaatgtggtgaaatcctgtctctactaaaaatacaaaaattagctgggcatggtggtgggcacctgtagtcccagctactcgggaggctgaggaatgagaatcacttgaaccggggaggcggaggttgtggtgagccgagatcacaccactgcacttcagcctgggtgacagagcaagactctgtcaaataaatgaatgaacgaatgaatgaatgaatgaatgcctttcagccgtgcacagtggctcacacctgtaatcccagcactttgggaggccaaggtgggtggaccacttgagcccaggagtttgagaccagcctgggcaacatggcgaaacccagtctctacaaaaagtacaaaaattaaccaggcatggtggcccagctaccccaaacgctgaggtgggaggatcacctgagcctgggagatcaaggctgcaatgagctgtgactgcactgctgcactccagcctgggtgacagagtaacaccctgtctcaaaaataaaataaaataaatgtctttcaacctggggaagccgattgaaaaggtaaataaatttaccttatttatttttcaaaataaatttacctgtcctttcattttcttatttttttattttaagctttattcccctaatacttactcttggcatatatatatatatatgtgtgtgtgtgtgtgtgtgtgtgtgtgtgtgtgtgtgtatgtgtgtatatatatgtgtatatatatgtgtgtatatatatgtgtatatatatgtgtatatatatatgtgtatatatatgtgtgtatatatatgtgtgtatatatatgtgtnnnnnnnnnnnnnnnnnnnncatacatacatacacacacatgcatacatatatatacacacatacatatatacatacacatacatatatacacacacatacatacacacacatacatacgtatatacacgtgcatatatatacttatataatttttatatgtacaattttatatatatgtacacacatagacacacacatatatacacatacacacacatacacacacacacacacacacacacacacacacacacatatatatatataaatttttttttctgaaacagggtctcactttatcacctagactggagtgcagtagtgtggtcttggctcactgcaaccttgacctcccgggttcaagcgatccttctgccttggccccccaagtagttgagactacaggtgcatgccactacacctggtgcatttttgtattttttgtagagatagggttttgccatgttgcccaggctggtctcaaactcctgagctcaagcgatccgctttggccttccaaagtgccaggattacaggtttgagccaccttgcctggcctggcttataatcttttttttttttccttaagtgctaactgcgagttaatggtttataatattcctaatcctaattctataccattgtcgctgggtgcagtggttcacgcctgtaatctcagcactttgggaggccgaggtgggcagatcacttgaggtcaggaattggggacgagcctagccaacatggtgaaatcctgtctctactaaaaaaaatacaaaaattagcctggcatagtggggcctgtaatcccagctacttgggaggctgaggtgggaggaacacttgaaccaggaggtggaggttgcagtgagctgagatcgtatcactgcacttcagcttgggtgacagagtgactccatctcaaaaaaaaaaaaccaacaaaaaacagcaacaaaccaattctataccattgttcacagattagcccctactagaatgccctctttctctttttttttttttgctatctcattattttatatcattctagaccagtttgagcctcatatccccacaaaacttactctagcatatcctcaactacacagctgcctgtgttctaggccctttgtgagaattaggcgaactgtggtacagtcattgccccagaatcacttttgaagttggtggtgaaaccataaaagcaataaaggtaattaactacattgtgcattttccccagattatttattgcatgaacaacatgaaaacgtggggattaaatcaccttctaccctgccacagcaactgatttcatttatctatgtttctttgcagtgcttgttcgtatacattcatttttcccccataggtaatacaatataattcatttgcacctgagagtgtttgtcaaaatttctgatacctataagtgtgtgtgactttggataagtcacttctcctgagacccagtttctccgtctaaaccaggggtttagactacatgtcctgtaaggcaataatcatgaaaatatcttctgttgtggagtatttcacagttgcttgaacatttgtattgttattctttaccataactacatgggattgagtggaatatgatattccttttttacggattgggaaactgaaactgaggtagccaaagaaaacactcttaggtgaaaatgaattatattgtagtacctatgacgggaaaaaaatgaacgtatatgaacaagcactggaaggaaacatagataaatgactttaaggttgactttttatctctggtttttagcagtttgactatgatgtgtctaggtgtgggatttttctttttttaagtattgcttagggtgccctgtgttttttcgatctggatgtttgttgttttttgttaattttgggaaattcttggcctttatctcttcaagtatttcttctgtcctgttccctcttgttcatccaagaccccaactacatatatgttagacgattggatcttgtcctacaactcttggatgctctgttctgatttcttttattctttttttttgctttagtttggttaatttcttttttgtttttttgtttttttgagacaagctggtcccaaagtctgggcctcaagtggtcaagctggtctcaaactctgggcctcaagtggtcctcctgccttggcctcccaaaatattggtattacaagcatgagccaccgtgcccagcctccatttaaaaagttctgtcgacctatcttcagggtcactgattgttccctcagctccatgtaatcggctaatgagcctgttgacctctgatgccacgtttttaaaatttctagcattttaatttgattctatttttagttttcacctttgctgaaattcctcatttgttcatacatgttgtcccctttaacatattaatcatagttattttaaggcctctgtctgatagttccaacatctgggtcatctgagtctggttctgtttatagcttatctcttgataaggttgttcccccccatcccacctcccaacccttcttgatttttgtgtttttctttccttttttttttttttgaaacagagtctcactcttttcacccaggctagagtacagtggtgcaatcttggttcactgcaacctccctcccggtattaagcaattcttctgccttagcctcctgagtagctgggattacaggtgcctgccaccatgccaggctaatttttttttttttttttttttgagatggagtttcactcttgttgaccaggctggagtgcaatggcgcaatctcggctcacggcaacctctgcctcccaggttcaagtgtttcttctgcctcagcctcccgagtaactgggattacaggcatgccaccaccatgcccggctaattttgtatttttagtagagatggggtttcaccatgttggtcaggctggtctcaaactcccaacctcaggtgatctgcccaccttgacctcccaaagtgctgggattacaggtgtgagccactgtgccccacccatgcctggctgattgttttatttttagcagagatggggtttcaccatgttagccaggctggtctggaactcctgacctcaggtgatccacctgccttggcctcccaaagtgctgagattatggatgtgagccaccgcacccagccatgtcttgtgcatttttttttttgaggtggagtttttcttttgttgcccaggctggagtgcaatggtactgtcttggctcactgcagcctctgcctcctgggttcaaatgactctcctgtctcagcctcctgagtagctgagattacaggcatatgccaccatgcccagctaatttttatattttcagtagaggtggggtttcgccatgttggccaggctgatgtcgaactcctgacctcaagtgatctgcctgcctcggcctcccaaagtgctgggattacaggcatgagccaccgtgtccagcccgtgtcttgtaatttttgattgaatgttggatattatgtggtagaacagagaattaggtaaattgtctttatcctcagaaatgggcatgcttttctgtcatgctgttagtttgtgttaggctgttagccagatttgagctgggtttgggctttctttttaatattaacttaaatgcatcacatgcttcaaatttctccagtaatgggtttttatcttgcacttagcggggagcctgagttgcatacatttattttttttctcagtctttctactgcttcttcagctctgaactgtcccttaatcctttgccacaaagggactctttctctacactcttgcccctttcctaggggtaagctgcagttgctttttagtggttcttggcttgaagtagaggtagggaggttctcattgtcttgatccaatctcaatctttttttttttttttttttttttgagatggaatttcactcttgttgctgaggctggagtgcagtggtgcaatctcggctcactacaacctctgcctcctgggttcaagcgattctcccgcctcagcctcccgagtagctgggattacaggatgtgccaccaagcccggctaattttgtatttttagtagagacagggtttctccatgttcgtcaggctgttctcaaactcccaaccttaggtgatctgcccgcctcggcctcctaaagtgctgggattacaggcatgagccactgtgcccagcctcccgtctccatctttagcagaccctgtgagtatagaccttgggtttggggttttcccagcattctttcccttcctgtgtatggcagccagactttgccttgtatctgcggcaggtcttgggcaggagaaagttttgtatacctccttcagcagttagtagacttttgctttctgttggtgttgagcacagctttaggcttagattcttcatcaactaggagaagctgtgcttcaatacagttattcgtttgcatggttcctaatgtgcttcactcaatttagcagaatttttttttttaacctcttccttgacgctagctgcttgtgcaaatcacatcttggccgcctactcttcttcacttgctgacagatgtgtaggtgagaaaagtctcatagtcattgttcctgaaagaagcttccagacccacttctagggccagtgacatatgcaggaaatcagctgcttctgggccaggacagagctggtcttttttttagtgggggatggcgggcagtggggcaggggacattcaaaatttattttccaacagacagatagcatcagcaggtacaactacaagggtatctacatagatcatacattcacaaggcattattagttcaacagtgagaaagccactcgtgggttttctgtaacaatatcccacttcatagtgtaaacaggtactattttgttcacttacaattccggaaggaagggcacaccttgcaggggggaagaaaaggggaatcctaaagtaaggtgcaacaattaagagacaacactttggctaacaatcttggatccacatttcagtcagggccttccacatagaggggaaagacttttctctcagaagttagaatctttcttcctcctttcttgttaaactgagagcagtgttttgtttgctcaatattacatgtacaaaaggagattagaagaaaatgcatcacaaaaccatcttgaacgttcagctcttcctgccaatacatcacaactcttaggttttagacggggcctgggaatacgtaagtgttttttctttttttttttttttaagtgaaagcaagtttattacgaaagcaaagggataaaagaatggctgctccataggcagagagcagcccagtaatcttaaaataggaaaatagacactatggctacaaaaaataaaaaataaatgaggtagataaaattttcacacccaggacttgcctgttccaacttcatagccttcatgaaatattcatcaagaagacaaaaaaaaaaaaaaaacctttataattacttggcataagtcgcaacaagaaaattcaacaaaaaaattagcatgtatacctgtgataggaaacacatccttccatgagtttcttctcaagaatgaaaacctagttcttcagtagagtaggcactggcaaactaagtcacctgagatttcctgctcaggtgccctcttcttctggggttcaggaagaggaaggcatctaagaagtgtgggaaaggacattggcactctcagggcagagctggtctttcacattgtggtgaaactactagaaagaagaaaaacatgcttgtggctactctgtgcctgcgaaataggtgtgaagcctttaggagtcagaagacctgggttcaactctaatagtcacttactctgtgaacttgtgcaagtcacttctctgtagtttttcttacagttaaaactttaaagttttgtccagtgctaaaattctctaatcctaacatatccttctgtagtgttacaaggatagaactctccaggtaaataccaaggctgtgcttttctgcaagcatagtggttagcttctcgtgttatatggtttgaagccctagttgttacttcttgcctgcatataaaccccattgacgatgatctcattttgtttttcctttgagaataaattgattgttttgtcttcccaggtctttgagaatgcgtaagttccggcactagaaggccctcagtaaagtaactaaaggagtatatacagctaagggcaatttaagtcaaaatgtgataataagtaaaaagtggttgtagaaattaaatgagagtgaaatatttttttaaaagttggaatcatctaaatgctaaatgcatatttaatattgttttgctactgtaatctaattagttaaaaagaataacatttgggctgggggtggtggctcatgcctgtaatcccagcactttaggaggccgaggcgggcagatcacgaggtcaggagatcgagaccatcctggccaacacagtgaaaccccgtctttactaaaaatacaaaaaattagccgggtgtggtggcgggcgcctgtagtcccagttgctcaggaggctgaggcaggagaattgtgtgaacccaggaggcggagcttgcagtgagccaagatgcaccactgcactccagcctgggtgacagagcaagactccatctccaaaaaaaaaaataataataataacatttgatagtatttattgagcacctactgtgagctagatgagtgtgggtgagctcctttagtctcctgacaaccccaagatgtgtttactactgttagccccattttactgatgaaaaacctgaagcttaaggcttttaagaaacctctctggccaggcatggtggctcacccctgtaatcccagcactttgggacgctgagcctggcggatcccaaagtcaggagttagagaccagcctggccaacatggtgaaaccctgtctctactaaaaatacaaaaattagccgggcgtggtggcaggcacccataaacccagctacttggaaagctgaggcaggagaatcgtttgaacccaggaggtgaaggttgcagtaaaccgagattgcgccattgcattccagcctaggcaacagggcaagactctgtctccaaaaaaaagaaacctctccaacttgacgtggctattcagtggccaaatagggcttcatacccagatagcctgactcccaggttcgggtcagggtacatttttatgtatcataaaagcatagttgatgaattctcagaaaccgaacacaccatataaccagccctcagatcaagaacagggcattactagcacccaggaattcccctccttccctatattagggttcaccagagaaacagaaccaacagcagttgtgcgtgtgtgtgtgtgtgtgtgtgtgtgtgtgtgtgtgtgtgtgtgtgtgtgtatgagagggttattgatgtttattttagggaattggctcatgtgattatggaggtctggtaagcctaaaatctgcagggataagccagcaagctgaagacccagggtagggttgcatgcggttcaagtccagaggcaggctaccagcagaattccttcttttgggcaggtcagtctttgttctcttaaggttttcaactgattggctgaggcccattcacattatggagagtaattcactttaagtttaccaatttaaatgttaatctcatccaaaaaacccccacaaaaaccaaaaacattttcacagaaacaccatggcccagccaagttgacacgtaaaattaaccatcacacaccccctcttagttacttccccctgaagggtaatcactttcctaatttataattgcaaagattagtgttgcccttttttgaattttctttccttttttttttttttttttttttttttgagacagggtctcattgtcacccaggctagagtgcagtgacgcgatcttggcttactgcgacctccgcctcccaggctctggtaattctctcacctcagcctcctgagtagctgtgattacaagcacacgccaccacgcctggctaatttttctattttttgtagagatggggtttcactatgttggccaggctggtctcaaacaactgggcttaagtgatcctcccgcctcggcctcccagagtactaggattacaggtgtgagccagcatgcctggccttgaatttttgacagatggaatgacatagtgtattagtctgttttcacactggtttataaagaactgcacaagactgggtaatttataaagtaaagaggtttaattgaattacggttctttatggctggggaggcctcagtaaacatacactcacggcataaggcaaaggggaagcaaggaccttcttcacatggtggcaagagagagaagtgccagtaggggaaatgccagacacttataaaaccatcagctctcatgagaattcactcagtcacaggaacaatgtggggaaaactgcccccatgactcaatcacctccctctctcaacacatggggattacaatttaagatgagatttgggtgggaacgcagagccaaaccatatcatatagtacatactcttttcgtgcctggcttctttcacagagcacatatacacattcctagaatttgatttcctataggtagttgaacagcctctcctagagtaacctgaaggattgaggtatgggaaggtatagaacgccttccccaagatgttgactggggctgtcccttgccactgggtctgcactgcggcgccccccccccgcccccccccaacacagatgggctagcctggggtggaatctggaagttggtaagctgtgcttttggcactctctgccttcctctttcaggtccattctcctttcctgtcttactactccttatacgcctaactctcaatcctcagccatccatggtttgactgttcagagacccatggtgccagttctttttgttctcatattgccccctgtccattgaagctcctcagcccctcaacttgaacacgcccccgttcttattctgtacctcctcagattactgtcacattgacggacttgaacctcagagatagacaacttttcccttccctcctctcctccttcccatatacttttcttatggatatggaactgaggaccagaaaggaaggtaacttacccaagatctcacagatgggtaaataggggtagaaggtgtggatcaagggattgtatgcagcctttatctctaggtgctggtctctcttaccttgggtctgtctcttttgcctctcctttcctctttccctgctacttgacttgtttcctaccctggtagcattcctgcttgccagatgccacaggggaaggagaactttacaactccctgggctctctggtaagaacacccacctgcacggggacccttcctctccttcctacagtgattggttgtcatcctcttcccttcctgcagtgtaccctcctggcagaggcaaggctgccatcgaggctagagcaaggctcagattgggtggcatgcagttgtggcctatttctgtttgctgtgtggcagtttggagatcccatttctttttctggatatcacccccctacctcctcctgtcattccttaggccagcctctaaattcagtgaccatcagggttgaaaagggcagtgtggggcctagaaaggagctctctcctaggagttaggagacctgccagcagtgaactgtgtgaacttgtccctttgggcctcagttttctcatctgtaaaatgagaattggataagttggtcttcaaggtccctccctgagatacattttatgctgctgcttgatttaaaccactgagccacaaatgaaaggttccagttgcaacagtgtaattaggcttagcagatgggtgagatgaaaggaaggacatgttcttgcccataggattatcctttcccacccatttccttgcacctcactggtgtttccaaaaagcaaatgacaacccttgtttttctctgcattcccattcaaacctttaatcttcttttatcttgatgaacttgtatttaccgttagacagccatgatgcagaattcacattacagtgtgtggttctaactctgccatggtgaatgtgatggaggttggagccgatcacagctggtccctggagagagggctgtgtgtgtcagatttattgtgctgcagctccagttttgttttggtttagtttttaaatccccagtgtcagttttgctgatttcagttaaaactaaagattgtgaagggagacagagacaggttcatgccctctgagttttagagattggtgatatagtcgttgggtgagggccctctgtcttatatcctttgcttaaaacatttcaccttggaaaggcagaaattagccttgttgaacttcaactccctctgcaagaggaagaaatactgaatactgtttcattattgatatctttttaatgagtactgaaagccactacaggatctttgtttcaccttcagataaaatgtttcatctttcattctctgaaaaaaaaaattgagtattttaagaataattaaaggaaaggcagtagtttctggatcctgccgttgctgccttggcctctcctgccttttctccacttccactcctctccctctatattagtgtagaaatgtgtcaaaaatttcttgcttcttccattagtttctattttgacccaccccagtgaatgaaataagcatagaattgttacttctattttacagaagagaaattcttatttttttgttgtttttatttttaagttcaggggcacatgtgcaggatgtgcagatttgttaacataggtggacctgtgccatggtagttttctgcacagatcatcccatcacctaggttttaaggccagcatctattagctattcttcctgatgctctctctcctcccccactgacaggccccagtgtgtgttgttcccgcccctgtgcccctgtgttctcaccattcagttcccacttactagtgagaacatgcggtatttggttttgtatacctgcgttagtttgctgagaataatgacctccagctccacccatgttcccgcaaaggacgtgatctcgttcctttttatgtctgcatagtattccatgatatatagaggagaaatctgaaatgtggcaaggttaagtgacttgtccatggtcacacagctggttgatgaacaatttgtgataagaatccaggactcttgaatactagtgatttgtcaacacgattccatctccagtcctcatccatacacacctgccattaggaaagtctttgccaccccagcctatagtctttgtcatttctctcactggccagcttctgaaagtacaggtcagaagccagttcattagctggtagggtgggtggttaaacggcaaggcataggaggtagaggagggagaaaggaagcacaaagctcaggcttagtttttcctccagaaggtgtaagaattacttatttcaaagagtcagaaaagtgaacagagtcagcattcccttttcctttgcaaattgattgaatttctatggcgagtattagctgcaaggcagtgttaatctgctccagcagatccatcatcagattgatgtgcaggggagacaggattgtctctggtgcaaaggcctttttgtgtagggcacaccatctttatgtatgattgaggcctggtgtgttaaatgcctcacactgggatcttacccatgtttgtcagttgcctcccttgaaagtattgagctttttgaagataatatagcatcatggttaaggtaagacattcgttctctctgcctgaatttgaaacgtggctgtgccacttaccagctctttgacctttgacatcttagttcacctgtctgtgcttgagtttgctcatctgttctaattaggggttgtggattaaatgacttaataaatgtaaagcactgaggagagttacacagtgttgtgaggaaagcagtttttcttccatgcagccctccttccattcccccatcatgcacagtgtgtgtgtgtgtgtgtgtgtgtgtgtgtgtgtgtgtgtgtgtgtgttgacaacttttcgaatctgcatttctagctggcctgctgagcctgtcaggcagctgtaacctcactcaggttttagctgtggggtccatctacatttgacatgtgtttctaaatgtggtcctcagtaagctcctttgtggggagaccttggagaaaggaaaccagagagtgtgcactgtgcacccccagccacacatgttctgggttcccacaccttagggactggggacactgcaagacatagccgaaccttggatgaaaatattgagtagctgcctcagtttgcttggactgctatgataacatatcatagactaagtagcttagacaacaatagtttattttcccactgttctggaggctgaaagtctaagagcagggtgccagcatggttgggttttggcaagagccctcttcctggcttgcagatagctgccttcctactgtgtgcttgcatggcctttctttgatgtgtgcagcaggtggggtggggggaaaatcagtgaggaaaatcagtaacctcggccttgcatcttctttggtcccatgcatgatgttatttgtaaggcagtgtcagatctcctcatacatggagaggcattaagtcttcatttccctgtcttctagaggtttgggatagagggtgtgaaggaagagcagattatgcttactctatcttttaagctcagaactggggtgtgtgtgttggcaggaacaccaacatgatgatgtataatgaaggcctatcttgtcacctgtgtcacttcagccaccccacacaattgtcactgacatgcttcacctcccgggacttcaatttgaaacccaatgaaatccagtgaaacacagtggaaactcttaccaccttcctgttaaccaactcacaggagtgatgaacacttttcagttccctggatgaaacactcttgagcaatgcccacagcatgctgaatgcactgcaggcaggctgctctctgccatacccactcgcttcagcacccactggctgaattatgtgcttaccaagagccagcttgttcccaaacccatttgttcagctgtagctggtattgtagttaagtaatgtatttaggtatcagataaactgatgaaatgtagctgcaaatgaagtgatttttttcccctatgaacactagttaaaagctgtggaaagactcataagtccaagtcactaaaacacattactgtcaaactagatgaacattaagattgggggaaatcataaaactctagaattttatattgtgattactctgcaagtaatcacaatataactttaaccagctttaacaaatcaggaataggaaattgtcgacaatgtattatgttctggtccatgtgcgaaggatgatgtggacctcttaaccagtgggtcctctttggacccttattcaaagagtcttgccctatgttaaagaatgggcgaatgaatgcagatttatatacattgagtaaaaataagaattttagatatgtaatttttatgattttttgctgtgacttttttgattaacctggttcctggacctgattacattgaaaatgaggatttctactgttgtgattcagtttaaagttggtttgatttcattttagtgaatttagggtattttattttgcgtatggtaaaaacaataaaaccaacagtagtggggctttttaaactggggttttaaagcaaattaaggtggctcattctggattttagtaggttcttttgttcctctcattgacttgcagcatactgagtgagaaagacctaattttttcactttataaatgaggaaattgaagccctgagaggtaaagcatgttggtgatagtcatcccgggtggctggagtgaagtgggcagagccacagtgggagggggcctcctctctagcctcccactttgattatctgtctggccccagacctggagctttctttccatgataggagtacttctttgggttgacttctctggtgacagtattgacttgtgctccccactttggaacaggaccaacttggaggccttgcagaagaagctggaggagctagagcttgatgagcagcagcgaaagcgccttgaggcctttcttacccagaagcagaaggtgggagaactgaaggatgacgactttgagaagatcagtgagctgggggctggcaatggcggtgtggtgttcaaggtctcccacaagccttctggcctggtcatggccagaaaggtgagtttgccttgattaacaggtaattggattatttctcagggtacttagaagcctggggaccagggtagaaggaagactgattttactcaatacctttttgtgctgtttgaatttttttttttttttttaagacggagtttcattcttgttgcccaggctggtgtgcaacctccatctcctgggttcaaacgattctcctgcctcagcctcctgagtagctgggattacaggcatgcgccaccatgcatggctaatttttttgtatttttagtagagacagggtttctccatgttggtcaagctgatctcgaactcctgacctcaggtgatacgcccgcctcagccccacaaagtgctgggattacaggtgtgagccaccgtgcccagccgtgctgtttgaattttgaatgcttgttatctatattagattatggataaacacactaatgactgtgttagtgtattaatccccatcccatctggaaaataataagtgactcttttttagccttctgtgtgctgtggaaggaatgccaggatacctgtttattacttatcaagtgctggagaagctgctttcattcacccagccccagcgatgcacaaaacaaggatttcaagttgtttccctcttgtgctccagccctgccagtgaatcccctttatcttcctgcattatagcatctgaactcctatcatagcatgtacttgtagagctggacttccctttcctatctacccttggtcctcttttggaatacagccccttgctccagagaggttgggctcttcaatgtttttttgcacatggtgttcactcctgtgcccataatttttttgtgtgctgttgcttctgtcttttcaaacagtgcccattttctaggtccacctcttgtctagcttttaccaggtgccccagcccacactggtaaccactgcatccatgttctctgacactcgctgtctgtgggatttttttagaagttcaaccttactacgtaactatttaatgtgactgtcacttgtctccccagctggaacaagggaaaatgttaggatgacataaggtagcaccttagactttggcttagtctcaaccacatcaggctcctgagctcaaggaagaatcttttgggcagcctaggttagcatacctgagttcctcatacccttctactttcacaactcttgagtgtgaaccaagtcctcaaggtcaatttcttttcatatctgagctccaaagcctctcttggagtaagccctcccttaactttgttcctgtctaggctcccaggagccgaggcacagctggaacagcctccagtgccaatgcctgccttagtacaatgacactcatttcttggttgagcagaaacttgtttgtaacaacttaacctgtttctcctccctctaccttaaagagcttaaacatttaacaagactatatctttcatcccttcctccctctttctttcataaaacctctctttcttccacctttctccagctaattcatctggagatcaaacccgcaatccggaaccagatcataagggagctgcaggttctgcatgagtgcaactctccgtacatcgtgggcttctatggtgcgttctacagcgatggcgagatcagtatctgcatggagcacatggtatgtgacaccctctcagcctctggagcaatggccttaagagttgggtggctctggcctaatctttggtctgggaggtgaccagctacctccctgctgctcctgggatccacatcactatctggggcatctgggaagtctaactgtagagcttgggatattcacaagatggcaggcctcctttctaggtccttgcctctcttgaaggaagtgggcagtattcctggtgggtgtacctagagcacctctcatagtttttttgattctgattaccctaagatgtgatgtaagtaaaatctggtaaatacagtttaaatccatttcttgtgtacaatgctgtatgctaggtgcaaggctctggagttaaaaagatgacataatctactgtaagggcagcctgaagggtttctctgggtttctgtatgatgcacgttagtggaaggagagggcaatggagagagagggcattcatgggctaattaatcatatgcatgttagctgccaatcattttaccactatgttcttggagtccctccttttcttcagatataagtcttccaacacactgtgcaacttagggaattctgcaagtattagtctttgctttattctccctgggctgatggcttagagatgagggctgacgtgagtctgcacacttggtggctgttgtgctttcagtccagtattgtgtctctcagctcctaccccattttattcctgatacttgagacctgccctgacctttagaatagggatcctggtgtgcagccttaatgaactttagaagaaccctcctgggaggattctctacttgtgcctccattattttgaacctctcttcattgtaatgatcacgaagtgctgcatccactgttataggcatctgctgacatttgtgggtgccatatggaacctaaatcctaaaaacgtcttctgcacatctaaaggttagagaaagtgcttgttccttctttcctcaatgagagcagagcattctctgtgggaagcatatgaacatttctggcttggtcctagtgcttggcctggggtgctgattattttctgcttgggtcttggcttcccctcagggagctgtttcttatcccttgggtctcttgtgttcttttttttttttttttaatttatttttattttttagggtgatgaagggtttttttcccctttctttttttttctttttgtttttttagacagagtctcgccctgtcacccaggctggagtgcagtggcgcgatgtcggctcactgcaacctccacctcccaggttcaagtgattcccctgcctcagcttccagagtagctgggattacaggtgcgcaccaccacgccccgctaatttttttctatcattactagagatggggtttcaccatgttggccaggctggtctcgaactcctgacctcatgatctgcccgcctcggcctcccaaagtgctgggattacaggcatgagccaccgtgcccaaccaatctttttatttttcttacattgacctcttttgagatactaggaggcttcttcatttacattgaccttttttgagatgctaggtggcatccttattctggaattctttattcactttgaacttacagatgttgatcacatctcttgtgcccttgccatgtcctccccttccttcaagccttcctcctccttcaggagaaaatgacactggaaatgactggagttggtttcccattctcttagcccatttccagtgactgcaggtcagtttttccccccatggatttggctctctggaaatagtgagatgttcctgcacaagtctctggagttatcgtggagagcatgagactgggaggggaaaatgtttcaagggccaagcacagtgtctggcacctgttaggtggtatgtgttgagtgactgaatgagagtggccaggatggggaagacctggtcaggcttgggactcgatgggggagggttaggccttggagcctgccataggaccttttggccctgggtgtacatagacccagagggcagctagaatagtcagtcagtggtagtgaagaggctcaggtgctgccggagcgtctagatgggaccatgtaggaagcagctgtggcctgaagaccaggcagccatgagagccagagtggctttctgcttcagctctgggcactctcagcccttccttattcctgagcaggtcctgttgcaggaaaggccctgccctggcttcctctggatggaaaattctgactgtgggctgctgcttcccttggaccttctgctttgcctcagcttcagtttttcaaaggtgttgtcaggtagagagacctctgttcgatagccacatcccagcttctgaaggtctttggtcctctctctgtcacagtctttgcatgagttttgtgtcatgaatattattttcccaacactttattatgaaaattttcacaggctgggcatggtggcttacgcctgtaattccagcactttgggaggctgaagtgagcgaatcacctgagttcaggagttcaagaccagcctggccaacatggtgaaaacccatctctattaaaaattacgaaaatggccagacacggtagctcacacctgtgattccagcactttgggaggctaaggcgggcagatcacctgaggtcaggagttcgagaccagcttgaccagcatggagaaacaccatctctactaaaaatgcaaaattagccaggcgtggtggcacatgcctgtaatcccagctacttgggaggctgaggcaggagaatcacttcaacccagaaggtggaggttgtggtgagctgagattgtgtcattgcactccagcctggacaacaaaggcaaaactcagtctcaaaaaaaaaaattacaaaaattagctggcgtggaggcaggtgcctataatcccagctactcaggaagctgaggcaggagaatcacttgaaaccaggaggcagaggttgcagtgagctgagaccacgccattgcactcctgcctgggtgacaagagcaaaactccatctcaaaaaaaaaaaaaaaaaattctagcatgcaggaaaacctgaaggaagtgtacactcgtacacccaccacctagattctacaacttatgttttgagatatttggtttaccatatatccatttctccgatcaattttggggggcgcgtggggttctgtttttgtttgtttgtttttgagacagggtcttgcactgttgcccatgctagagtacagtggtgcaatctcagctcactgcaacctctgcctcctgggcccaagtgatcttcccacctcagcctcctgagtagctgggactacaggcacatgccactatgcctggctcatttttgtgtttttagaagaaatggggtttcactatgttgcctgtgctggtcttgaactcttgggctcaagcaatctgcctgtctcggcctctcaaagtgctgggattagaggtgtgagccaccacgcctggccctgggaatgtgttttaaagtaaatttgtgtcatcagcattggttgagccctgtcttctaaagcactcagccaggggctgatctttcctagaaataagctctgtgtgcactgcccagtctgaattttgagacccaaggagggaaattgatgctctctgatcagaacaggaatgcttttatctttggggaagtagattgctgctcaggttggtagctgagccaaccggagaactagggacccagagttaatggttcttgtgcaggaataaaagcttttgaactgttattttcataaagcatttgtctcttccatagaaaaccttcacaaaagcaccattgacttagttaataattggcttctaaaaataagcacaatttcagcagcttaaggcaaggacttggcaacagtgaattagaattagaaagttgtatggttagttgcaggcaaccctggggaatcctgactggtgtatgccccttacattttgtaattccatcgttcacactatactctgcttgaagctctgtggaggttaaagggaagagagccaatgtttcctttttgttttaaaattaactgattaattttacagatacggtcttgctctgttgcccaggctggagtgtggtggcatgatcataggtcactataactttgagcttctgggctcaagcagtcctcccgccttagcctcccaagtagcaggaggacaacagatgtgcatcaccatgtccagctaatttttattttttgtagagatggagtctcactactacgtggcccaggctggtcttgaactcctggcctcaagcaatcctcctgccttggcctcccaaagatttgggattacaggcatgagccactgcacctggtttgttttttcctttttaatagagatatttctcttaccaacccccaggggaagtgtaaaccaagacagttatctgggctgccccctgtcctaggctgcatttagggtcagttgagaggtagtgctggctgagcacagtgactcacacttgtaatcccagcactttgggaggctgaggcaggagaattgcttgagcccatgagttcgagaccagcctgggcaacaaagtgagactccccatctacaaaaaaaatcaaaaatagctgggtggggtggcacgtacctgtggtcccaactacacggaaggctgaggcaggaggatcacttcctcctctgagcatcagtagcattgtctgttctcttcattcaactgtttgttccctgccttgtttcagaggaggatttaaaatgccttacctcttatgaatatattctgtctccctaaggagagagtgtgttctatctttatcttaaaggtttaaaaaaagacaaaaaaaaaaaaaacctagttcttacatatacagaggcatttgataaatgatagaagatgatgataactgctcaatatagacaggatactttagaaaatttgttttgagttttcaggaattaggtctacatctgagagtaattttaagttgcaagtggtaactggctacacctgaagccataggggaacttaacctatttctgccttgatacatcaggatccccttagtgaggcatttcttcaagatcgcaggttaaaatgtagaaccccttaacgggagcccctggtatgtgagccctgcagagcctggcttcacaccatacttgcatcctctcttgtgctctctttccactgcctctgtccggcaccccattcatgtcatctcatctccttaccagtctctctgcctccagagtcttgtttgtctccctcagctgctgtgattctcatctttaaacactcaggttggattcttttacttctgactccataaagtcaagtcccggttccttggtggggttctggtcacagccggccatttctagcttgcacctcttcatgcaccaacagtgaaatgaccacatcatcccaggagtactcagcaacgtgatgcgtccctgctttgatcttattgcagtgctctgttcttctctcccttttctcctccccttttccaggtatagaaatcatgttcatcctttgagtaatattcagctcaaatgccatcttttaagtgaagtcagaattacttctcccttcttctgcatgtctgtatcactttcttaggcagttatggtttcattgtaatgttgggaaaaactcccagaccgtgtttttcctttactgtcacaccacaacaatcaacacagaagacttatgtgaccaaaagtgtggagggattttctctacactctaagcagtggacaccagctgggtgtcctcctgtttaattctgacactaccagatgatcatgtcagatcccatgggttcagggctcagtccccaagactgcaccaccaccagttgccagtctgggcctccaaaatgtctgactgactggctttaagttgggactcccatgatcctatctttgagttcgattaatttgctggattggcacacagaactcagggaaacacttaattttactggtttattataaaggacattgcaaaggatacagatgaagagacacataggacaaggtatgggagtggggtacgaagcttccatgccttccctgggcgcaccaccctccaggaacctccatgtgttcagctgtcctgaagttctctgaacgcagccttctggggtttttttgtgtgtgtattttttttttttttttttttttttgagacagagtctcgctgtgtcgcccaggctgagtgcagtggtgtgatctcggctcactgcaagctccgcctcccaggttcatgccattctcctgcctcagccacagccgaaagttatcacttgaaagaatagttagaacattgtcactaactggtctggtattctcgatcttaggatggaggttctctggatcaagtcctgaagaaagctggaagaattcctgaacaaattttaggaaaagttagcattgctgtgagtatgttatgaagtttttcttctaagttcctcattgataagttaatgagtcggtaagaaatggacaagagaggaagatgggaagtcaatgaggggaaagtttataagaaaagtggtattttctcactagactcttccctgtctggagtctatatacactattctctctcacattagaatgagaaaagtgactttctttatattaaaatctgtgtgtcttgaaaaacaggggccaggcacagtggctcgcacctgtaatcccagcactttgcgaggccaaggcaggaggactgcttgagcccaggagttcaactccagcctgggcaacatgatgagacctcgcttctacaaaaaaataaaaataaatagctgggcgtggtggtgcacacgtgtagtcccagctacttgggaagctgaggtgggaagatcacttgagaggctgcagtaagccataatccatgattgtgccattgcactttagtctgggcgacagagtgagaccctgtctcaaaacaaaacaactctttataccatgtaaaaagatggttgcttgataaggcaggttaagaaaatgaaacaaaagagtaaaaaataaggggctgggcgcggtggctcatgcttgtcatcccagcactttgggaggcggaggcgggcagatcacctgaggtcgggagttcgagaccagcctgaccaacatggagaaacccccatctctattaaaaatacaaaattagccgggggtgttggtgcatgcctgtaatcccagctactcgggaggctgaggcaagagaatcgcttgaacccgggagggggtggttgtggtgagctgagatcacggcactgcactccagcctgggcaacaagagcaaaactctgtctcagaaaaaaaaaaagcccaggcacggtggcttacacctgtaatcccagcactttgggaggccaaggtgggtggatcacctgaggtcaggagttcgagactagcccgacaaacatggagaaaccccatctctactaaaaatacaaaattagccgggggtggtagcgcatgcccgtaatcccagctactcagggggctgaggcaggagaatcacttgaacccgggaggtggaggttgtggtgagccgagatcgcgccattgcattccagcctgggcaacaagagtgaaactgcgtctcaaaggaggaaggcaaatttgtgatgatgataaatgaagtattttcctagagtattttaaaatagattgagtatttttcttatcaccagtattttcttttcttttacattccctttcctctaggtaataaaaggcctgacatatctgagggagaagcacaagatcatgcacagaggtaagaagttatttgctagttattttgctttgaattttagatataatccaaaggctgttgcttcctcttttttctatgttttgttttcgtgtaaaagccttttaataacatgttaaatcttttattaaaagtctttgtttagtttggtggctgaggcagcaactcctaccctctttttggtcttgctacacctattgcctatagctgtgatggacaatagtcatagtcaccctggaagcccagctaagagcctcaaccagcacttagttacccagtctccggtgtcactattcactggaacagtgaacagtgcatgtgcatatgcctaaagccaggactggccagctgcatatgagttttactataaaagaaactgatttattgctgggtacagtggctcatgcctataatcccagcactttgggaggccgaggggcggcggggggaggtcgggggggtggatcatgaggtcaggagttcgaaaccagcctgacccaacatggtgaaacccccctctactaaaaatacaaaaattagccgccagccatggtggcgagcacctgtaatcccagctacttgggaggctgaggcaggagaattgcttgaacctgggaggcggaggctgtggtgagccgagattgcactgctgcactccagcctgggtggcacagcgagacacagtctcaaaacaacaacaacaagaagaacaaaacacattaaaaaaagaaagaaactgatttattttaataaaggtacacatacacttaaccatgtgaccataccatcttaggcatttgtccaagataaaatataacatgcatccacacaaatgtttaaagaagctgtatttcttgtagaaacaactgaaatgtccttcaacaggcaaagagagaaacaaattgtagtatatctatacaacagaatactcttcaacaataaaaatgaaaagactactgataacacctaactttgaatttcaggaacatttatgctgagtgaaagaaggcagatacaaaacagcccaagctgtttccatttatgtgaaattagagaataacaacaaatccatagtggcagaaagtagatcagtggttgccttgaggggtctagggagagattaaaggagcatgaaggaactttttggggtgacacaaatgttacatctttttttttttttcaagagcacacatccacttctatgtattgacttctcattagtttaaatccttgaagggggctgggcacggtggctcatgcctgtaatcccagcattttgggaggtcgaggcgggcagatcacctgaggtcaggagtttgagaccaccctggccaacatggtgaaaccttgtctctgctaaaagtaccgaaaattagccgggcgtggtggcgggtgcttgtaatcccagctaatcaggaagctgagggagaagcttgaacccgggaggcagaggtcgcagtgagccaagattgcgccactgcactccagcctgggtgacgagcaagactccgtctcaaaacaaacaaacaaacaaaaaacattctggctaacacgatgaaaccctatctctactaaaaatataaaaaatagctgggcgtagtggtgagtgcctgtagtcccagctactcaggaggctaaggcaggagaatggtgtcaacccaggaggcggagcttgcagcgagcagagactgcgcaccactgcactccagcctgggcgacagagtgagactccgtctcaaaaaaaaaaaaaaatccttgaggggtacagcatcacttggattctgtttccaatagccatagtaggaagagtgcttcagaatttggcacaaactatgccactggttctgtgggcccgagttacctttctccagattactccagtgttgtttggtttaccaccaggagtcactgtgttgttctttgctttgtatacataagcacatctcttgcccaaatagaattctgtttcatctcgggcataaacactttcaattttaggaagaactgcctgctcccattggttccggataccctgcttatagccagcaaaaatggccttgcaccacagccttccacatatttccttttagaagtcctgttcccagcaggcctccatggcatccaagatggcgggaagtgcaaatgttatatcttgacaatggtgatggatacatggctatatacattcgttgaaagtcagctgtccactaatgtgactgcattttatagtatgtaaattatacctcagtatagttgcttttaaagaagatgaagccagaggacaggaaattggtaaacatagtgctgtcggccatgtcccttcagccacagcactgccaacactgactggtgttgagaggagagctgaagcggagatgagtggactagggtgggctgttggaactgactggacagcttacaagccccgtagattaggtgatacatcactggtgagcaagctgagcactgagtggagccacctttgacatggctgactcctggatgcattttttttttttttgacgtcccccttctctcccctagtgttctttttgttagtctaacttcttccagatactgatctttcaggtcttcagttagaggtcacttaattatgacagtgtttgcaagtgttggagggtggttctgattcagtaggtctggggtagggcacagggacctgaaaatttagaaataggcaattagctgggcgtagtggctcatgcatagtaatcccagcactttgggaggccgaggcgggcggatcacttgaggtcaggagtttgaaaccagactggccaacatggtgaaaccccgtctccactaaaaacacaaaaattagctgcgtgtggtggcgtgtgcctgtaatcctggctactcaggaggcttaggcaagagaattgtttgaacctggggggcggaggttgcagtaagctgagatcatgccattgcactctagcctgggcgacagagactctgtctcaaaaaaaaaaaaaaagtttaattgtaaaaaatatatacataaaatttaccattttctcaagttttcagtgtatagttcagaggcattaagtacattcacattcttgtgcagccatcaccaccatccatctccagaacttttttcatcttacagacctcaagctgtgtccatgtaacaactctcaccgggcgtggtggctcacacctataatcccagcactttgggaggatgaggtgggcagatcacctgaggtcaggagttcgagaccagactggccaacatggtgaaaccccctatctctactaaaaatacaaaaattagccaggcgtggtggcacacgcctgtaatcccaggtacttgggaggccgaggcatgagaatcacttgaacctgggagacggaggttgcagtgagctgagattgtgccactgcactccagcctgggcagcagagcaagactccatctcaaaaaaaaaaaaaaaaaaaaaacccactatttccccctttccccatccactggaaaccaccaatctaccttctgtctctatgagtttgactactctaggtacctcatatgagtggaattacacagtatttgtcctttagggactggcttgttttagttagaataatgtcttcaaggttcatccatgttgtatgatgtgctagacactggttcttaagtaagtgctggttctaatgctgtggtccatagccacattttgggaaacactgcattgggggtagagtgagtagctaggtgggctgtgtagaaagaggagtaatggcagcttgtcctagtgggatttgtcgggagaaaagaaatagaaaatgaagcacaaagaagaatattgtgcaagtgttccctctcatttccagggaaaatttctcaaaatattgaaagatttctgtccatggcagacttgtagttggaatttgcatgaccagcttatagcttgtacatatggttcagttttgtgcatctattaatttcaacctgggccaccaaactgcattgttaagaactagagactattggctgggcacagtggctcacgcctgtaatcccaacacttggggaggccgaggtgggtgaatcacaaggtcaggagttcaagaccagcctggccaacatggtgaaacccccgtctctactaaaaatataaaaaattagctgggcgtggtggcggatgcctataatcccagctactagggaggctgaggcaagagaattgcttgaacctgggaggcagaagttgcagtgagctgagattgcgccactgcactctagcccaggcaacagtgtgagactctgtctcaaaaaaaaaaaaaaaaaaaaaaaaaccaacaacaaccaaaaacattcagagagaggacaaccattttggaaaacaggtattaaaatttcttgttaaattataccaccatgaactgcactccttggcatttacctaagataaatgaaaacatttgctcatgcaaggacttgttacacaaatattcatagcagctttatttataattgcccaaaattagaagcaacaaaaatattattatcagatgagtgggtacattttagtgtattcaaacaatggagtacaactcaggaataaaactattgatacatataacttcgatgaatctcaaaaacatgctaagtggaagaagccctgtacaaaagagtacatactgtgagagcctgctaatacgaaattttagaacagacaatccacagtaacatatagcagatgagtggctgcctgagggtttagaggtagggatagtttaacatcaaagtgcataagggaacttttttggagtaatagaaacactaaatcttgtttgtggtaataggttcacaggtgtgaacatttttgaaaatgcatgaaagtatacacttaaaatggtaactgtaggctgggtgcggtggctcacgcctgtaatcccagcacttcaggaggccgaggtgggtggatcacctgaggtcatgagtttgagaccagcctggccaacatggtgaaacccccgtctactaaaaatacaaaaattaagccgggtgtggtggtgggcgcctataatcccagctacttgggaggctgaggcaggagaatggcttgaacctgggaggcagaggttgcagtgagccaagatcatgccattgcactccagcctggacaacaagagcaaaactgtcaaaaatcctcaataaaatactggcaaaccgaatccagcagcacatcaaaaagcttatccaccatgatcaagtgggcttcatccctgggatgcaaggctggttcaatatacgcaaatcaataaatgtaatccagcatataaacagagccaaagacaaaaaccacatgattatctcaatagatgcagaaaaagcctttgacaaaattcaacacccttcatgctaaaaactctcaataaattaggtattgatgggacgtatttcacaataataagagctatctatgacatacccacagccaatatcataccggatggggcaaaactggaagcattccctttgaaaactggcacaagacagggatgccctctctcaccacctcctaattcaacatagtgttggaagttctggccagggcaatcaggcaggagaaggaaataaagggtattcaattaggaaaagaggaagtcaaattgtccctgtttgcagacgacatgattgtttatctagaaaaccccatcgtctcagcccaaaatctccttaagctgataagcaacttcagcaaagtctcaggatacaaaatcaatgtacaaaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggacacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataatgccacatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagatttaaacgttagacctaaaaccataaaaaccctagaagaaaacctaggcattaccattcaggacataggcgtgggcaaggacttcatgtccaaaacaccaaaagcaatggcaacaaaagccaaaattgacaaatgggatctaattaaactcaagagcttctgcacagcaaaagaaactaccatcagagtgaacaggcaacctacaacatgggagaaaattttcgcaacctactcatctgacaaagggctaatatccagaatctacaatgaactcaaacaaatttacaagaaaaaaacaaccccatcaaaaagtgggtgaaggacatgaacagacacttctcaaaagaagacatttatgcagccaaaaaacacatgaagaaatgctcatcatcactggccatcagagaaatgcaaatcaaaaccactatgagatatcatctcacaccagttagaatggcaataattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaaccatcattctcagtaaactatcgcaagaacaaaaaaccaaacaccgcatattctcactcataggtgggaattgaacaatgagatcacttggacacaggaaggggaatatcacactctggggactgtggtggggtcgggggaggggggagggatagcattgggagatatacccaatgctagatgacacgttagtgggtgcagcgcaccagcatggcacatgtatacatatgtaactaacctgcacaatgtgcacatgcaccctaaaacttagagtataataaaaaaaaagaaaaagaaaaaaaaaaaaaagctaaatatagaaagccacctgctttctaattgtactggctgccatcttgtcttctttctactgacaagaaagtatcaataagaggtagtgattggtttgagggggaaacagtttttctagcagtttagtccttaatctgtggcttcttaagacctctgagttccatgttagaatattttaatgtattagtttctaggaaataggagtagctgaaaggagaggaggagtgaacattcttaagcatggagttatgttctaggctgcgattgacatatgcagtctaccactatgcaaggacgaatgaggtcagtgttgtaggaacatctggtggagtaaaggcatcccatcatctgtgaagtggagtccgcctgcctactcagaggttgctgtgaggattaagaaattacatatggaaagcaactggcaaagtgttttgcttatagaaagctctaatatgctaattgccttccccgtttctttatataatttataaggaaactaaaaaccagcgattaaaaccttagctttggtttctatatgtgtaaaatatagttcttatgtttgtctctcattaacctgtaagtttcttcaaatctgggaacatgtctaattgctgtgtatatatcttcagtcctgaagatgatagtagaaaacagttcttctttgaaggtttgttacatggatggatggatgattaacttgtgccagaacacacaggagtcaacagtgaaactgggccaaggacccatgtctcttactcttaacacagtgtttctttctagtcctgtgtttttctgtactatgtacctactatggatcatgccctgtgttttgcaatgaagacctctaactttatttccattccaaggagagggaggtttcagcacactcctggaacaaccagctttcttttcccttccgcctagtgctgcccccacctgcttagggctttcttttttggcttcaccaattgttgctctttggcatgaagagatgctttgtgagccagatgggtctctgaacagatgtctttgatggagagtttaccacttgcacagccaagaaagggaagtcactagaaggacttctgtgtgggctggcctggctgctcagcatttcagactcctgttgtttacaagtcttctccagaagccctggaagaatgaactgtaaggcctggactatggaatggtacctgtgcaccagcaattcctgagcaagcagcacagtgagtagatgattcctggaaacctgagttcaggtgaaaatgagagagagcagtctccttgtccctgcctatgggcttcctcatggccagttctacctctgttctaaatatattcttcactgatgaaatttcaacttcatttattcttctgtccttgaggaaaagtggggaagagtaaagaggtcttttctctgcctcaaatttttatttgttcttatttgttgatacttatttgctggagatagcttagtggtttttttctctttctttttgagacagggtcttgctctggtgcccaggcttggagtacagtggtgcagtcatggctcactatagccttggcctcctaggctaaagcgattctcctgcctcagcctcctgaagtgctgagactacaggcatgagctgctaggcttgggttgattatttcaattaccatttgctatgtaacgaggctccaaaacttagtagtttaaaataataatttattaccttacacagtttattactttttctgtgggttggcaggtcctctttccccatcctctgtgaggctaaagccctggtttcttccagtagcaagagggggtaaaccctactacttaagtaccctttaagcctctgcttatgtcaagtttgttcatgtccatttggctaaagcgggtcatgtgtttcaagccaagatttaaaaagtagagtgaagtctccatctcttgttgggaggagctatgaaatatggtggcccgtttttttccactgtatcacagtgataaagttgaaggttcaaattgtgactgtgctacttgttgtgtaaccttggatgagtcatttaacttctccaaacctcaggaaaatggagaaaacagaacctacctaaagggttgtatgcagattaattaatacatacaaagcacttagaatagtacttaacatgtagtaggcacttaatacattttacctgttgcttagataaattggtagaggtttttatgattaccagcaacagaaaccagcctgacttggtttaagcttctaaaaatttattcattagaaggatctggctgggagcggtggctcatacctgtaatcccagcactttgggaggctgaggtgggcagatcacaaggtcagcagttttgagaccagcctggccaacatggtgaaaccccatctctactaaaaatacaaaattagctcggcgtggtgccgtgcgcctgtaatcccagctgctcgggaggctgaggtgaaagaattgcttgaacccaggaggcggaggttgcaatgagccgagatcgtgccactgcactccagcctaggtgacagagtgagactctgtctcgaaaaaaaaaaacaaaaaaagaaggatccaagggaagttcagagagtcctttgacaagctgatcctacaaaccacggtagggtgggaaccaaggctactctagttgggaggttggctcagtcaggcagagaaatagctccctggcgtacaactctaacagtgctattgctgctgggccaactgtcctctcctagccttatttagggggtaggcatgggctcagtgatctcccagaggggtccagagtcagtgcctctgaagaatccactctcaccacagtcatgcagatatcaaggggacagcatcctctcctgctcagtgttgggggctagttgatagtccattgcctagtccaggttgaaagtgatttctgagtgtgccctgctctaataaaaagtaacgtacaaaaatagtttataacacaaggtgctctgggtgcaatgttttgctctttcaaagcattcactctaggtaggattcttcaaatagaagttttcatagaatcttgaaaaaggcaagcaaattacatcaatttgattcatacatttcttcttaggaatatgtcagtgatttaaaggtaggtattcctgcacttaggaatttttaaatgagaagaagtgcctcgtggtattttgaggaagattagctgttttcaggtaccatttagttactgtttttccacctaggtggtagcctcttgaacatttttcagttatctttcttcagctgggtgagtatgtcctggtcctagtttggtacattgccttggttgtacacatggtagttttcctacatttctaatgtgtctgcaccaggtgggaacccaaaggcaagcatgttctcaccctcattcctgaagtgatttgtctctgccataatggagcaggacttcttgggcagaataagttcaactgacagtcccagtgccgaagctctggctagctcaactggtccactgtgatttgttctgttattatacagaacattgtattctatttcccctgggtgttcaaagggagaaacaatctgtgtggtttagcctgatgtatgtgatttgtgagctgttgatcagggggtgggtatagatctgtcacccctttggggagtgttaagtttctctaaaatctctgggtgacattctgacagtcatgggtaggtacaggtatatgctcctccgtgtctattcgcctacctcctcagtcttttcccccatcaaagagaagtaattcattttgtaaaatatttatagaatacctgccaagtgcaaggtattaggtgaattactcgttaggcataaagttggctcataaatgaattgtgtcctccaggagcttagagtctaatgggaaagggacatatctgtaaatgactcttgtatattgtggaacatagccaatatcatttttttgtgcgtgaatcactaccctgccaactttcagatagaatccgatgtgacatagtgacatagattattagtcagaattctttggtgtggcagaaacccacctcaagattacttaatcagaaaagagaatgtatggtttgggtcaccaggaggtcggaaggcagggatgaatatgaggttgaaatgatggcctcaggtcacctctcagctttgctcattcttgtgtgggcttccttttcagtcagattctcttcactggaggcaggatggacctcactagccccagacacatctagtccttagtgctccctatcccagagaaagtactccacccactctccccagcatccagatcagtgtttgaaccactgattggcagactgcctctgcttggagtgcttgcccatggctggaccattcactgtgtccaggggactagtgttgcctggtgggccaccctgggttatacactcacccctgtggtacaacagatggcgcctcttgatgaacaccctagcagaaacagttgatgctggggaggagtgtatcccaaatgaaaaggaggggctttgttaccaggagatggggagaatgaatgggtgctgaaagcaagcaaatttttaaaaagttttccgcttacaaattctgttaagcattgggtcagaaagacaaaacactaacataggatgaaaacaacaagcagttaacacaggtgtgagcaaactggtccatgggctaaatttggcctgctgcctgtttttgtatggcctgcaagctaagaatagttttcaaaattttgtgacatgtaacaattatacaaaattcaatttattattatttttattttttgagaccgagtctcgctctgtcacccaggctggagtgcagtggcgtaatcttggctcactgcaacctctgcctctcaggttcaagagattctcgtgcctcagcctcccaggtagcggggatcacaggcatgtgccactacgcctgctaatttttttatatttctagtagagacggggtttccctatgttgcccagcctgatctcaaactcctgggctcaagtgatccacctgccttggcttcccaaagtgctgggattacaggcatgagccactgtgccctgctggaaattcagattattgtgtccataaataaagttttattggatcacagccatgcttgtgtaaatgttgtctgtgcctgcttttgtgctataatggtaaatttgagtagttacttgtgaaagagatgactgtgtggccctcaaagccaaaaatatttactctctggtcctttttttatagaaaaatcttcctaaccaaaaggggaaggagaatcccttgacagaagctttagaatttaagcacaaaactgggcttttaagcacaaaactatggtggctgtagcctgtaatcccagcactttgggagatcaaggcgggtggatcacctcaggtcaggggttcgagaccagcctggccaatgtggtgaaaccccatctctactaaaaatacaaaaaattagccaggcatggtagcagacgcctgtaatcccagctactcaggagcctgaggcaggagaatcacttgaacccaggaggcagaggtttcagtgagccgagatcgtgtcactgcactccagcctgggtaacaagagcaagactgtctcagaaaaaaaaaaaaaaagaatttaaacacaaaactaaacttttaaatgtgtcagctttaagttctcaaggaaaacatgataagtgacgtgggtaggagacaggattatttttcctgatcctggagctctgaaaagaattagctgccaaaatttatgtcgagtcttttcatctgaagctgaaccaagtaggtagttgtgctgtgagttaaaaagggttggaggtgaagagggcgctaggatactgctctctttcattctatttaaagcaataatttgcattgccaccctgccgttcttaacctgctctaattatcaaggccttattttgactaagaccctgaaaaagcgttgtatgatttagatcaatacgcagttcatccaacttagccgtaaattatttctgccttggagttgttagctgataaagatcaataaatgttaacaacagttttaaattataactcaacttgtttttcttttccttctatctaatgaaaccatgtgtaacctagatttttaaattttacgtatttatgtgtgacatgtatgtgtgtatgtataaatgaacgaatgacaggtctcgctcactctgtcgcccaggctggaatgtggtggtgcgatcatggctcactgcatcctcaacctccccagctcaagcgatcctctcacctcagccttctgagtagctaggactacaaatatgtgctatcatgcctgactaattttaaaaattttcttttctagagatgcggtctctctctgttgcccaggttggtcttgaactcctggactcaagtaatccacttgtctgggtctccctaagtgtgggactactggtgtgatccactgtgcttagctgccagcttagatttttgaggggtacatagcccactgtaattggatacctctcttcagagccatagtagcttattataccttggggccatcctgcttggagtgtgcctcaaaagtgttcctttattccctaggttagagagttatgtaaaaacggggctctcaggtcagaatgagatttaaggcttctgcagagcctatatgaaagtgtttttgggccgggcacagtggctcatgcctgtaagcccagcactttgggaggttgaggagggcggatcatgaggtcaggagatcaagaccatgctggccaacacggtgaaaccccgtctctactaaaaatataaaaattagctgggtgtggtggcacacgcctgtaatcccagctactcgggaggctgaggcaggagaattgcttgaacccgggagtctgaggttgcagtgagccaaaatcgccactgcactccagcttggcaacagaacaagactctgtctcaaaaaaaaaaaaaaaatgtttttgggctgggcacagtggctcatgcctataatcccagcactttgggaggccaagatgggtggatcacttgaggtcaggagttcgaaaacagcttgaccaacatggtgaaaccccgtctctactaaaatacaaaaaaattagcctggcatggtggcgggtacctgtaatcccagttactcaggaggctgaggcaggagaatcacttgaacatgggaggtgggggttgcagtgagccaagatcacaccactgcactccagtctggatgacagagcaagacaccatctcaaaaaaaaaaaaaaaattttttttgtatccttttcctggggagagctgggagtctccaaagtgtctcacggtgtcccagtgacagcctccagcaaatggggtcttcagcaatggtcaggattacaacctctaaattcttcctctccattcagacttgttggcactgatagcaagatctgaagtggcttgtttggttttgttttgttgttttataagctgtttgtagcagactcacacgtaatgatttgagtggtttcttctgcaatttttgcaaggaactatgctgcctctgccaggcatcgctgagcagaagtcagagtggcccctgcctccaccagcctgaggctacacacaggattctgttctgagcatggttcctatctgtgtgtgactaaggactgttgtctgatccttgaaacacagaaggttgcccatggtatatacacaaggtgctcctggctacatctctctcccatcacagccatcccatagctgtgtggcttacacaggaagggattccttttgactgtgtcagactgccctgccttaaagatggagggagacagagtggctcattagtagtggaaaattcagtatgctggtctcttggttagaaatgtgagtctcgttttatctagaattatttcatctgctagattcacagtgatgattatagctccaggtgagtttgtctcttagctccttaagagaggcttagatctctttagggaagcatggaggagatggtatttgagctgagctttgaagcataggtagaagttatatatgtggcagggtcagggaaaggaattccaggtagagggaagcatgaatcatggcatagaggcaggaaaacacagacatgtttttacaggaaatagcaagtggttcaagttgtctacaacaaagggttcctgatggcaaggggtgagaattaaagtaagaaatagttgaagcagtgaggagggtcttcactgccatgttcaggaagtggattttatcatgggcaacaggaagcagtggaatgatcctgcacagagaagtgagatgtgctgtggtttaaggaagaggactctactgttacggctaaggtgagctggagaggggagaggtcaattaggaggccgttgctatgggccagtgagagataaggggggggtctgagttaggatagtggcagagtgaagggacaggatggggacagatgggagagagatggtgcaaagggcagggactggtgtgggaagatgggtaggggagtagcagggagacttggccttggcccttcctggggtggttgtggtgggaaggagcctgaggcccatggccgtgctccagggctgtacgtggagagctgtgttctcctcctcctcagatcacaaagcctcatttctaatggaaacctgaggctggggctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgggcaacagaagcgagactgcatctcaaaaaaacaaacaaattgttaaaacctgtcaatagctcaaaagaaaagtttccgtgactctgaaaaacaacacaaagaatcagcagcatttaagcaaaaaaataaaaaagattacttcagtctcctgtaagttcagttcatgcagttaattcctgttctgcttgatattcatgaacatttcagctctccatgagtcatgaaagtttttcctctgttttgatgtcacagtctttaaagttatcagaagcctgtattcaggagcacctgttagagttttatagttgattataaaaccaccttttaaagagaaactgcagggctgggcatggtggatcacctgaggtgaggagtttgagaccagcctggccaacgttgtgaaagcctgtctctacaaaaatacaagaaattagtctgggtggtgatgagcacctgtaatcccagttactcgagaggctgaggtaggagaatcacttgaacccaggaggcggaggctgcagtgagccaagattgtgtcattgcattccagcctggtcaacaagagcgaaactccgtctcaaaaagaaaaaaaagagaaaccatcattgcaaaattataactgagacagtgaaaaagatctgaccgaactgactccatgttgcttctaatctccaagctgtccttgttcattcctgggcatagacagaactaactttgggaggaacttagtttatagttgagctttgaaacaaagacgataacagccttttccccaaacccccttcctgcctggggactaggctgcctaaagccacatgattagaagttatggttattttactaaataattcaagacttagctattttcactaaaccaatgtcagtctctttcaatatttacagaagcaaagatcttttttttttaaacaaagtctggctctgtcacccaggctagagtgcagtgacatgatctcagctcactgcaacctgcgcctcctaggttccagtaattctcctgcctcagctttctcagtaactgggattacaggtgcctgccaccacgcccaactaatttttgtatttttagtagagatggggttttaccatgttggtcaggctggtcttgaacttctgacctcaagtgatctgcctgccttggcctcccaaagtgctgggattacaggcatgcgccaccgcgcccggtggctcacaagcaaagatcatcctgttttgggctgggtttatagttttgtaatccctatgccaaattttgacaccttataatatttggcagggatacatatgaaatttcttgatcaaaaaatgcaaacaaaaatgtaccctggctgttcttaaggcatttctaatagtactttaccaacaattttaaaggtagcttatctatcaaagattttacgtaaacttgagaaaacatttgactagtctttcattttctgataaggtatttgatttgtgcttttatttttccttaagccaattaattagagctgttttatattttttagtagtaaatcattgtgtacacaacacataaatacgtggacatattagacatactgatagaagtacatcttaaaggtaagacagacctcctttttttttccccccttctgtctaagacttgcaaactcttgataacctgtttcattatgcttggcagttgtcagctaaatagctcctaaatctgcgtattgaaggacacaactctttggtgaaaaatcagatagcaaaatttacatcataaagtacagagaggaaaagtctggtggtgctagaggaagattaaaggtggatgccaaatcaaacatacaattatagaaatctatcataggattgtataaggagaccaatttatttagataggtactacctatcttaactggatctctgagttctgagtagagcccacactgaattctgggtctccaaaaaggaggctagaccacatgatgcttttaaaaaaaatttttttttggctgggcgcggtggctcacacctgtaatcccaacactttgggaggccgaggtgggcggatcacgaggtcaggagttcaagaccagcctggccaacatggtgaaaccccatctctactaaaaatacaaaaattagctggacgtggtggtgcgtgcctgtaatcccaactacttgggaggcttaggcaggagaatcgcttgaacccaggaggcggaggttgcagtgagctgagtctgtgccactgcagtgagctgagtctgtgccactgcactccagcctggcaacagagcaagactccgtctcaaaaaaaaaaatttttttttttggctgagcacagtggctcatgcctgtaacctcagcactttgggaggccgaggcgggtggatcatgaggtcagcagttccagaccagcctggccaacatggtgaaaccccgtctctactaaaaatacaaaaattagcaaggcatggtggcaggcgcctgtaaccccagctactccggaggctgaggcaggagaatcgcttgaacccaggaggtggaggttgcagtgagccgagaccgtgccattgcactccagcctgggcgacagagcaagactccgtctcaaaataaaagttttttaaacaaagacatttctaagtgtctaaactacactcttcattaaaaacccaagagtagcctctgttgcaataactattttagtcagaaaatcaggtaacacaatacaaaagcagtttaatagctgagaggaacttgtttatactcttggggagacccataaggaaaaacaggtttctcccccaaagggagtctggtgcctccttttttttttttttttttttttttttggtgaggaactccaggctattataaactattttaggtttctcatgcagcagagggtgcaagagaaaggagagagagcagaagtaaatgaagaaaacagaattctgtcaactgagaagaagaaaaatttgtctcaaaaaaagacagggtcctagacagagaaaaaacaaacccaaaacataaaatccttttaaagacacacacacacacacacacacacacacacatatcggatgttagcttttaattaagctgacttttaaccattgagctcctttaaaaaaatctgtttaaatctcattgccgtatttctgcttggacaaattgctgctgtttcagaagtaccaaatatcaaacctttcagaaagggcttgatttaggaaccaaacctaggctgtcatgaaaaaaagaaggcagaaccttatgtatggaactgcagcctgaggtgatagctattgctccttcagtttggcctggctagcaaaaacgtggcattgttttgtgaataaagccccttaaggagtcaaataaaaaatctttcctttttttcttttgctggccgtttttctccctccaccatgccacttttttttcttggtttttttttttttttttttttttgtgggaatttagccacttcagaggcctcgttccccataatttggaactttccttcaaatttgatcaagttgcatagagttggtcaaacccaaggggaaaaagaccgaaacaacaacaaaaagaaacagtaaagcaaaacaaatgatcacacaacctatacaagtactgagagctctaatggtaaggagaaattaagaccagctggttgttaatcataactgtagccaagacaaaccctaattcagttacttagggatgggtttcatgctgaagactgccctctaccatcctagaagcaggaaaagactcaaacctgtcctccctgttggaagcaagctcaaaactccgtaaaggagttacttgccttccattgtcacggaagcaggaaaacttgccttccttgtgtcggaagcaagtaaaactcagaaacaaaaaaggagttgtacagcaaaataaactttagatcacctccaaattttgggagatcggggattctctggaggaggtgcttccaggcgtcagcaaattgtctgattggtttgaggcacaaagatagctcaagctggtaccagccaccaataggagatttgtcaaaggtcaggggcacctccactcagaatcccttggtggttaccaaaatgtgaaccctgaataactgagacaggtctcagttaatttagaaggtttattttgccaaggttgaggaccctgtgacacagcctcaggaggtcctgatgatatgtgcccaaggtggtccaagcacaggttggttttatacattttagggagacatgagacatcagtatatgtaagatgttccttggttctgttgggaacggcaggacaacttgaagcagggagggggcttcgaggtcccaggtaggtgagagacaaacacttggattcttttgagtttctgattagcctttccaaaggaggcaatcagatacgcatttatctcagtgagcggagggatggctttgaacagaatgagaggcaggtttgccctaagcagttcccagcttgacttttccctttagcttagtgatttctggggccccaagatttattttcctttcacaggggccatgttatgtagaagccaggctgagaaggaatctgattccttatattggttatatttttttctgaaataaatgttagcttttattttccctccaagctgcaagagccattgaactctgacttctgtgcttctcacatttaaagcctcctgatttgagtacttagtacctgccagacattagcaggtaggagttactattcccacctgacagtcaaggaaaggctcagagaggttctgtaactgggctggggccacagagctagtagatgatagagctaggattcaaacccagatctgcctaacttcagatcaaggttagtggtgctgtttccacaccaccctaaatggcctacttaataatgaaatttatgatgccagctgatgataagaatcactgggtgttaagattcttggttgctaatgaacttgaattagctcaaacaataaagatgatttttttttttgtatcagctaaccaaaccccaggaaggatagaaatacagctggcctgatggataattgtatccagggactcaaatgccattagctcttatactttgattaaaatatactttaaaaagatgctgttagtggccgggcatggtggctcaccctataatcccagcactttgggaggccaaggcgggcagttcgtgaggtcaagagattgagaccagcctggccaacatggtgaaaccccgtctctactaaaaatacaaaaattagctaggcgtggtggcaggtgcctgtagtcccagccactcaggaggctgaggcaggagaatcggttgaaccggggaggcggaggttgcagtgagctgagatcgcgccattgcactccagcctggcaacagagcaagactccatctcaaaaaaaaaaaaaaaaaagatgctgttagctagcctggccaacatggcgaaaccccatctctactaaaaaatacaaaaattacctggatgtggtggtgggtgcctgtagtcccagctatttgggaagctgaggcagggagaattgcttgaatctgggaggcagagttgtagtgagctgagatcgtgctactgcactccagcctgggcgacagtgtgagacttcgtctcaaaaaaaaaaaaaaaatgctgttagatctctccctctcacttgtttccctttcgatgttggctttcttctctcgggccagctgtctaccagatggaaccatggtttcctgctttacagttttgttattagaagagtttttctcacttcaattagaaagttctgagtgaggactcctgattggactgttaggggtcgtgtgcccagacctatgagatcaccgtggccaggtgacagggagctgtaagtggcccagcctgggtcagggggctgccctgtagccagggacaaggttctcattgtgtcagtctccaccttaagctgcatttgccccaaagaagtatgtgtgatgaggagacaaggaatgcctgacatctgtctttaaattgtcaaacacattcttctaagtctttccattacgggttatcccaagctaggaataactggtgagtagtttcttgaccttttttccagaccttttttggtgaattatgttaagctgtgacccaggcacaaatggggaggccatactttggtggagcctgggtcacataaatatggtgaccttactagaaattctttcctacttactcattgtttaataatgaacagaactctggcctatcttcttttgtcattgtttaacacccacctcactacctcccacctctcctgctaaacaaaattagccttcagcaggtcaaaacagatttttagctaacttccgtttcttgaatagcatatgataagaactcaagttagccaggtttgttctcctgcctgtaggtggttgattgggtttgtgatactgtgatacattgcatatctgctcctctgaggtagcccaaataatctggtgggggaaatatgctgttttaatgttattttgtgacctttggcaagagattttatcctccagcctcaacttccatatctgtaaactaggactattctgccaaatattacgaagggtcatgaaaaatgagagatcaggctgggcgtagtggctcacgattgtaatcccagcactttgggaggctgaggcagtaggcttgcttgagcccaagggtttgagaccagcctgggcaaagctgggagaccctgtctaccaaaaaaagaaaaagttacttgggcatggtggcgtgtgctgaagtgggaggatcgcttgagcctaggaggtcgaggctgcagtgagccatgatcatattactgcactccagccaaaaaaaagagtgctgtcagggaatctgggattcataagcatttcccttgactgctcttctttcctttcttttattatacctctcttctctctgtaccccctataccttttgctctggcttttgttacatcctgtattaaaattttagataatttatgttatttttcttttttgagacaaagtctcgctctgtcacccaggctggagtgcagtggtgcaatctcagctcactgcaacctctgcttcccgggttcaatgagttctcatgcctcagcctcctgagtagctgggactaccggtgcacaccaccatgcctggataattttttttggtatttttagtagagacagagttttgccacattgcccaggctgatcttgaactcctggcctctagcaattcacccgccctagcctcctgatgtgctgggattacaggcctgagccaccatgcccggcctaaaaatttagataatttattggaatgttgtgtgccaatgaaaagcaaatcctaagctcctgcaacatcatctcatgtttaattgtcagggtttgtgggccctctgggtcaggggatgagcagtgaattggcagagaggggtgtagggagggtagagaaggagagcatttcaaaactaatgaggcttggaagggaaggaagaaaagaaacttaaaatgcagtttctgggcttggttgtaaaaatcttgaaagtgagggagataaaaatagttgcttgttaggacctggcaggcatgctctggaggctccctgtttgaattcagttgctaatcaggaggtgggaaacaacctctggttcctgctgttagcacctttcttgcagttggccttgtcaagaaggataatgggctggagctgagaaagaagcatcgtgctcactcgctaaactggagtggagaactattctctccttactgaatttcagggatttcagcctgccccaagtcaaatccttgttcccagaaataaagctcattacatctgtaatgtgaatgattccttccccggccacagctcaataagggctcttgtgaaactttggagtacaacttattatgggttgcctttagtcctgttgtctgggccctgattttttagatcctggagagaacgctccctcaggggtctgagttctaacccttggccctatcgttaactccctgtgccaccctaacaggtgacgccttcctattctaggcctcagtgtttctcatctgtgtgcaatggtttataatgcttacctcacagtgttactgtaaggattaaagaagatagtatatttgaactggggaggcggaggttgcagtgagctgagatcatgccactgcacgctagcctgggtgacagagtaagacttgtctcaaaaaaaaaaaaaaaagtatatttaaaaggcctgacatagcaggtgttccataaatcagagctgttgtaggatcttcttaggtctgctaggctcgcctgcacctctcattctcccacctagtctctcagctgcatcctggcttttttttcccaatgctcttggggaaggaaatttgggtgggggaaaagagcttacaggtaatggctaattgaagagttggggattttctcagaattttaattatctctgctacttaattagctccttgaggccatggatagctggaggtggctctgtagagggtgcgatttgactcatccaggtcagctccctttctctctgtttcttcatctttagtggggagagttattaaggctttgccaaggatactaagaagaggttgtttgaagcctaaagtcgccattttaaaaaatcttcatttgcctttttttaaaatcctttaactgttgcttatctacttttggattcagcctttgtcacagatgagcaagaatccagcttccctgtgtcactctgcttgcttctcagcagccccttgctccttccttccacctcttctctttcttttgggctccccacttcacccctccactgcctttctcttcccccaagccccaccgtcttccatcttgccttagggaattcagctgcttttaatattagcctaaaccaaacaaaatgaaggtattaggatatagtggaaacacatagaaggccgagattcaccttggttcatctacctgccgggggccttgtcagctactcaggctatcatctgatgggtggcacccatcccacctggttggaagaatttagaacgagtccacggggccttgaccacatcttcatctttgcccttacacgtgcacatgttcttgtcatttgttggattctgtctcccctgatggtgacaatccctgtgtcctttttactcttagctcagtgcagatactctgtgtttctagaataaataaatgactccctaaattgttttatccaaacaccttattttagaggggtagaaaatacttaatagttaaacttcaaaatgtgtgctcttgagggaaaaatcaggaggctttgaatagtgttattcctgggacagaaaatatcggagaagaacatactttctgagtttttcataaaacctccttgttcatttttgaggaaggaggggttacccatactcattgtcacagaagctgagcagaattggggttattagatctcagcctcctgtgggattcctagggaagcttatgagcctgggagcctactgggtggttgatgcttcctccagaatgtagcctggccagccagctgctggggaccctctcagcatcacctttcagttatcaaaggatcagaaagagaacgcaaggcccagaggtggcctcaggaagtagagaaggactgggcctgtgatttgaatgtttgagggctctgctaggagaatgtgagaggaagcccagttaatcctcccaggactccaggagcagggcattatcccaagttgggaaggggattcagaagaactaggcatctaggagtagaggtgacagggtgatttgaaaggaagactttttagatgcaaggaccagcacaagagaaggcgagactcttacacaggggcagttagagaggcaggccagccccaaccaggaagaagtggatgtggagacgtgttgtggtgtgaagttggagaggaaaggaagaaacagtggagggcatggaaaggcgggcagaggggctggggactgtgctctgaggcagagggcagccatggcaggctctgtgcaggggctgtcccgctggaggagtgctggtttctgtgtaggcggggggagggagaagatgctggagacaggaacagtgtgtgaagggcctggctattgtgggaagcaagtgtggggtgctgagggagatcaagaaatgaattctctctggacttgtctgccatcatgtacctcttttctgtccccagagaagagctagacttgggtgtggcaggagcaggggcaagagggatgtcctagcctggcggctccagcagcatgctctggggttcagtgatctcatgtgcccaggtttccaggtggcttcttgtgaggccctccgggatctggctcccaggaccaatgtggtctagcagtgaaaagcccctcagaatttcccttctcctcctctccaaccccttccatctctgctgcctcctaggcagtgtttttccctggagcgggtgggagaagctggagctgacagccagggatggtggcaagctgtgttatgtaagtttgaaaaaaggaggcttgcttgccatgtgaatagagatcagatacaaggacagctagaggcagcacagccatgcctgagcagcagctgtagtctgaagagaggtgtctgagccagcagaggaagaagctgctggactgggtggaggagactgttcttgtggggaaggagaggtgtctggttctgtgaactgccgatcttggagggcagcctgtgaagcaatcattgtctattcctataacatggtgtgctgcttatatgccatgccttattacatcaatcctggtctgtaacttgtgatggtatgagagccgccattgtgactgtttcaatcatggcaaaccatggcccagaaaagtcaagtgacttgctcacggctgcatgtagagtaagtggcagggtcaggatttgacacagggcttctgtctcactagccagtgctgctcttttactctaaaacaggcttaacagatcatgcctaaacagcccatggggagagtgtgggccgggtgagggagcctggtgccgtgtggcctggcatggatgagaggcaatggcactgggtgggaggagtggaagagggcttgtgttggagccccttggtgtgccgccccagcaggcgctgtcacaccccttacccttctcagtctcgttccattttcagcatcattttccaaatcctgaacacctgacctccaggggccaggtacccaacaccggtcctctgaggggccatgggcatggtgggatgaggaggtacacctccaacaagcaactgctggactcatgcctcggctgaagtgtttgtgggctctgtcctaacactaggcccagggaaagaacagagctcgcccctctcctcccgaagttcagaatctccccatggttctctgagaggctgcatggctcgctccctctctctgttcacatcgttgctcaaatgtcctctcctcacagggccgttccttgccaccctgtcacaacagtacccccttactctctctgtcctcacagggttttattatatatatatataaaaatctgtgtatatatatttaacatatatatatacactatatatacctgtatatatatagtatatatatatgttatatatacacacatatatgttaaatatatatacacacatatgttaaatatatatacacagatatgtgtgtgtgtatatatatatatacacacaggtatatatatatacaggtgtatatatagaggtatatatatatatattttttttttgagacagagtgtcactctttgcccaggctggagtgcagtggcacgatctcggctcattgcaacttctacctcccgggttcaagcaattctcctgcctcagcctccctagtagctgggattacaggtgatgtgctaccatgcccagccaatttttgtatttttagtaaagacagggtttcaccatgctgacctcaaatgatctgcctacctcagcctcccaaagtgctggggttacagacgtgagccactgcgcctggctgggttttatatttttctttgtgccacttaagaccacctaatgttacatatttgttcattgatttgtctgtctcctcacaataaaatttaagcttcatgacagtgggggacttggtcagtttcttgactgcccacacagagcccacaggtaaggtagcaggtgttcagtggacagtaggtgatgaccgttagagcatggcagcagggtgggtagaagaggacaggtgtaagtgtcagagggcctgggatctgctttcagctttacccagtttttgctgtgtgactttgaacaagttgctggatctcttgggccttagccttctttttttttttttggagacagaggagtctcactctgtcacccaggctggggtgcagtggtgtgatcttggctcactgcaacctctgcttcccgggttcaaacgattctcctgcctcagccttctgagtagctggggattacaggcgtgtgccaccacacctggctaatttttgtatcttcactacagagaaggtttcaccatgttggccaggctggtcttgaactcctgacctctggtgatctgcccacctaggcctcccaaagtgctgggattacaggcgtgagccaccatatcctgctgggccttagactttttgttttcatcatgaaggggaggaactaggtgccctctaaggctgcttttggcacctctcttctgaaagtctatgtgtaggagacgagggtcgcagaggggtttgcaaagatttgtatcctgtgttcctttactgaagagcctgacttgggtctgcacactgtggggtaggggagtgacatgatgagggctgggtcttaggaggactacaccagtgatgcagtgtgtgcatgcatgtatccatggtgcatttagaaccattcattcaacaagggcttttggagcacctgccctctgtcagatacagtttgggctcagggcttagagtggtgaggcagacagccaacgtcctgccctcctgcagctgattggggcagagagaggctagagctggcctggaatggtgattacccccaggctgaagatgaagaggggccaagtggagttggggcactgggatattagagggtcatgatttttttttattatttttatttttatttatttttttgaggcagagtttcactcttgttgcccagactggagtgcaatggcgtggtctcagctcactgcaacctctgcctcccaggttcaagtgattctcctgcctcagcctcctgagtagctgggattacaagcatgcgccaccacgctaattttttatttttatttatttatttaataaatatattttttgagatggagtctggctctgtcacccaggctggagtgcaatggcatgatgtcggctcaccacaacctcctcctcccaggttcaagtgattcccctgcctcagcctcccaagtagatgggattacaggcgcccaccaccactcctggctaatttttgtatttttagtagagatgggagttacgccatgttggtcaggctggtctcaaactcctgacctcaggtgatcttcctgccttggcctcccaaagtgctgggattataggtgtgaggcatcgcccggcttttgtttttcaatttgtccttggaaagatacttaaatagacctgtttgaatctgtttaagaataaatagccagccatggtgactcacgcctatagtcccagctacttgggaggctgaagcaggtgtgttgcttgagcccaggagttcaactcagcctgggcaatgtagtgagactctgtgtctaaaaaaaaataataataaatgcattcatataacagtatcgaagagaaaaataatgaaacgttattagtggctctgctgggttgtattataggaggtttgggttttttctgtgattttctagatgtcctatatggtgtctatattatgactattaatatagacaccatataggtttgggatgtcatggtttagcatgtttcctagatatggtctgccctcaaagtgagtgtcattgtttgctgatgtctgctccacaaagccctgctccaggggccttcaccaagtcccagccttggtttgctcacctataaatgaggataattgaccctggtctatgcacattacaggacagttgtatgaatcagaggatacagcggaagaaaaaatgtttggaaatttaggtctctgcaaactaagggccaatgtactggtatttgtgacagtgaccggatgggtgggatggggtgataataagagtgcaaggaagggggatgggggcatcgttttgactctgaggagcagctttaaggcctctcacattccagctccaggtagcaaggggttccccttgactggcagggtagatgtacctgtgtaggctgttaggtgagtgactccagtggaatggaatggaatcatgactcagctcccaccctgccacacatatttgtaagaaaaagacccacatgctccatgcctggtgcagaagtctagaatgggaattcccgccaaaccctgtccccttctagcctgtgtagcctcagcaagcagataggtcttattacttgtttttttctgcctccttcatgatccagccatagatactatatcttaccagtaggggtggttgaagcaacagactttgaaatcctgactgttcatgataacggactccttcctgtggatcatctggccaagtctgcattcttagagagtggaaatcgactgtctttctgttctacttctacagcagctgctcatttcatctcctgacagttgcttcttgaactcagaacaaagggccttggtgtacagtgtttgcaagccaagggctgcctctgatggcggacgggggtgtggtcctgggactcgtggtcagggctggtctgtgtggaatgctgatccttctcttccccaatctacctgtgtcagttccctccttttctattttctcttccctgcagatgtcaagccctccaacatcctagtcaactcccgtggggagatcaagctctgtgactttggggtcagcgggcagctcatcgactccatggccaactccttcgtgggcacaaggtcctacatgtcggtatgaacagaagtttccattgcttgagcttcttgtacggtcagggagaggagcccagtgggtgcctttcctgtggagccagagtcttgtgctgggtaggggacaagaagtgagggaggaggcacagtgctctgccctgaggagatgaagttgaatgggaagatggtcttggtctttcttaggccttggagcataactgggatattggggccttgactcactgaaaggactgtccagctccagagtgtggctttctttctgaaggattgtgagctccagctcccctctgggcatctctacatgatagtcttcagatccacaaacccaggatgctcagatatgatccaccccaaactacctcaccttctccttttctcttagcagtaaatagacagcatcatctccctggtttcccaaggtagaaacctgagcattggctcttaacctgccttctcagcagcccgtcctttcagtatcttgtagctcccaactcctgagagtctgttcagaattgtccagcctcttttctccctcctcactatgtctgtcagacatgtacccctccttctaactgcagcatacctggacccctcgccagagtctctgctccacttcagccaacaccctgtgttgagggtatttcctcctgctcctggctctgctggctcacactgtcaccagagcattgtgtggggccatcctcacactatggcagcaccagcgtgttttcttccctcctccataccaccggttccttggggacagggacaaggtgtctctcttgtccctagtgcctggcatggggcctggcatgtggtaggtgttcagggaatgcttggcaagtgggtagatgtttagttggctgagtgggagggtacatggataaaacatttctgagaatgatttggaaaggtggaaacgtgagtctgggccagtgctgaagtgcggcaaagtggaggagcgttggagtgagtaggcagtctttacagaagtggcggggagtgcaggcccgcgtggagagggggacaggcgcagaggctcagatcttaacttgtacaaagcattttatgtgttctctgtcaaagcacatgtcatgtccctggaaggtctcatttgatccatgtggttgtcccaggaaataaagattattgttcccattttagaggtgaggaagtctagattcagggaggttaagcaacctgcctacttaaccttgctgagccaggattgaaagctagctgcccccttgccaggcagacgccctttgcacagcacaccctcatttgcctcttggggaggatttggcacctgtgcccagatcccagtgtgaacacatcctcattccttcttgctggcacctaccccccactgtgactccagccactgtcaacatcactcacctggcactgacccacatccccacccctcccctccagtgacccacagtggaactctctttctctgtcatctcctcattgcttcttccctaaatgtctaataactgagcagctggcatcctgggccatttgactgccaactctcaagttcaaaatccattaacaggccctgggagttactaatcaagggtttaatggttggggtttttgtggttatatggtcagttacgaaatagtccagtgttggagttagtgaaaaatgctactggagaagttaatgtctacgtgaatatactatgggcagaataaagattttttcggtagggttcttgaaatacatgtgctatttcaaataatgctcattaaaaataatgcttttgtatagcactgtatactttttttctctttggcttttcccaccaatatcaaccaatatttgtattgcattttacaacatttgacatacattttctttttttttttttttttgagacggagtctcactgtgtcacccaggctggagtgcagtggtgcaatctcggcttactgcaagccctgcctcccaggttcactccattctcctgcctcatcctcccgagtagctggaactacaggcgtgtgccaccacgcccggctaatttttttgtatttttagtagagacggggtttcaccgtgttagccaggatggtctcgatctcctgaccttgtgatccacccacctcggcctcccaaagtgctggggttacaggcatgagccaccgcgcctggctgtacattttcatttgatttgatcttcttagtaatcctaagtagagttttcttatgtcattgttactgtcattttcatcatcatcagccaccacccccccccacctttttttcttccgacatggagttttcgctcttcttgcccaggctggagtgcagtggtgcgatcttggctcactgcaacctctgcctcccgggttcaagtgattctcctgcctcagcctcccaagtagctgggattacagtcatgcaccaccatgtccagctaatttttgtatttttagtagagatggggtttcactatgttggccaggctggtctcgaactcctgatctcatgtgatccgcctgcctcagcctcccaaagtgctgggattacaggtgtgagccactgcgtcccggcccagcagcagccccattttatagatgaggctgatattcaggatcttttagcttctaagtcccggaattgggatttaagtctcaggcccactgaccccagatcttttgttctatgtatccacggcaccacctcactcccaacccgcattccacaagcttcatgtttcagattcagtgacaagatgagcctctcatgctgggcttcggacaggctgccctgcgtgtgcaagactgtggccaagctgggtaaagctggaaccacaggctgtagtggcagccagggcacagctgattacatgtggtctgtcaatttaggccagattataggagaaatagagcagggatgaggggttaaagccacagaagccagctaggatttggtaaacacagtgttgggggtaggcaggaggccaaattcaagaggttagtggagctcttgaaacaggatatgaactattgagaagggacagaagagaaaatgcattagcagacccaggggtccaagttaggttaggtgattatcactgtctgtctctcctgcagccagaaagactccaggggactcattactctgtgcagtcagacatctggagcatgggactgtctctggtagagatggcggttgggaggtatcccatccctcctccagatgccaaggagctggagctgatgtttgggtgccaggtggaaggagatgcggctgagaccccacccaggccaaggacccccgggaggccccttagctgtgagtagcctggtgtgtccccatcttggactgttggaggggagggtcccttactttcaggggtttctggagggctgattctctgtacattctgccaagactgattctctgtccctggatgccaggctagggccaggggaagcagcaagggtctccaggtgggtgttgttactaccaacaacttcctaccatttgttgagtacgtactatgttctaggtactgcacttaggactttatacattatctaaccttttgtatttattatttttattattaagggtcttgctatgtcgcccagtgcagtggctagtcacagtcttcaactcctgggctcaagcagtcttcctccctcagcctccagagtagctgggactacaggttataatttatttgcgggggttgggagggaaggggctcactctgtcacccaggctggagtgcaatggcatgatcacagctcactgcagcctcaacctcccaggcccaagtgatcttcctacctcagcgtcctgagtagctgggaccacagtcacatgccaccatgctcagctaggttgttgtttattttgtagagatatagtctccttatgttgctcaggttagtcttgaacttttgggctcaagcaatcctcccgcctcagcctcccaaaatgctgagattacaggcatgatccaccatgactggcttctaatttgtgggttttttttgttttgttttgtttttgatactgggtcttgctctgtcacccagggtggagtacagtggcgccatcatggcttactgcagccttgacctcttgggctcaagtgatcctcctgcctcagcctcctgagtagctgagaccacaggcatgcgccaccatgcctgactaatttttttaatttttttgtatagatgaggtctcactatgttgactaggctggtctggaactcctgggctcaagtgatcctcctgccttggcctcccaaagtggtgggattataggcatgagccactgcattctaattttttaatcatgacttttggtagatttattttttattgagatatagaattcacataagacaaaattcacattttaaagtatgtagttcagtggtttttagtgtattgttaccatgttgtgcagccatcaccactgtcttattctggaacattttcattaccccagcaagaaaccccatcccccactcccccctgcctgatccactgacaaccactaatctactttctgtgtccacggatttgcctagcattatataattttaatagcatttcatttgtgatcacgactataatctgaattttaaagatgaggaaactgaggcacagtgcacttgtcaaggccacataggcttgcaagtagccaagtctgactcccaagatgataaacactgtgcagtaccacctgcctctctgaatgtgaatactgggaagtaaacctggtactcagggaatagcctgacctagccaactgttttttatgtagctcctgtctggccagggatacctgccctgtacctccatgaggtccacatgagagagagcttgtataaaggggaaagcagagggggctagaggtagctgatggcaggtcattggaggggctggtggctgtggcctctgaggctcgccagtgactctaggagacaaaaggaagaaacgcaacttcatggagaattaaaactaagtcctttagttatttagttgctatctcatttgtgcctctctcaatagaaggaagggggaaaggacagacataattattatgtctctgctttacaaaactcagaactttgtttggctcagcagtgaactgatttgccaaaggttacgaacttaagatgtggcagagcccagacttgtaccctggcctttgctggtcccctctgtgttcaagccttatctgtggctgtttaatgtttattgtccatgaccctgttctggtcccagggatccatgcccaaccccttgcctcatattaacaagtaatctgtttctgagaagtattttttctttttataaaatttgtagcatacggaatggacagccgacctcccatggcaatttttgagttgttggattacatagtcaacgaggtaagtactgcctggtttccttcaccttggaatttacttgctcatcttaagaaaacacccaggtggccgggtgcagtggttcacgcctgtaatcccagcagtttgggaggctgaggcgggtggatcacacgaggtgaggagttcgagaccagcctggccaacaaggcaaaaccccatctctactaaaaatacaaaaattagctgggcatggtggtgcacgtctgtagtcccagctactcgggaggctgaggcatgagaattgcttgaacctgggaggcggaggttgactctgggaaaaacaaaacaaaacaaaaaaacaaaaaaacacatcgctgtcacaggttcagtctactagggagtttaatttaacctctctttactgtatgcacagctttatactaagcaccatgggctgtagaaaagcagtttcaggattagttcgtcgctgcttaaggatttgagggaggcagagcatgttgcatttgtaggagtcagaaaaaaagccatccatcctctactgctggggacctaggctaggtggttctgggtggtagtcatattaagggaagggatatctgaggttagatacgccattgcgtctcctagtgtgcactgctttcttccaaattttcacattaatttcccatgcaattctcccaagcattgctgaggtaggccaaattggttcctcttcaaacaggtgaggaaattgagcctccgagatgaaaagtagcccaggtccttcccacccagtgctctttcttccttgccacctcccacctcccattcttacctcctaggaggcttggctgcatggcagttgttctactgcagcctctgctggcacacagcccctctgctgcctagctctttcctgttcagaaggaatggatgctgcctctggaggccaagctgctggtctcctctcttccttgaatggtcccttgattccctcagcagtggggacagtctgcagaatggggcttgctctgggtcactgttctaagagctgagttctagtcctcacctaagatcagactgacatggccctcaaaggaagagcactaggttgggctttgtggtggggatcagtgtctcatttttagtcccaaattaaaaacgagattttgggctgtacatcagagcagtgacatcatggacattatgtctgtgggtcagcatgggtacacacagctcccagcccaggtacataagtgggcccacatttcctggactgcatggaacgccatgagcccagtgctccagagccttgtactgtatagtgctgcatgatcaccatgggaaaatctgaaaacagcctcatttctggaatgtacaggtaacattcttccagatccagccctctgtcagttaatgttttattaacttttcactgcttctctagggctcagaaaagggatttttaaaaaccggtttgcttctgcaggtgctgtcagacctgggctatgcctggtggtttgcacgtgcccctagctgttgctgccagtaaattgctggttacgttcccatgccgcactccaagatttaccattgtagagtgtcagagcttgaaagggtccctgagatcattaggcccaacctcttcatgtcatagaagagtaaactgaggctcatagaggaatagtgattagttcaaaatcacccgacaagtgagtggacttgacttggtcccaattctaaatgtgctatttgagatcagtggttccaacatggttacccaacaggcagcactggccttctacctgtgcctttccttgactggatgagagtagtactgcctttggactgcagagaagactttaaaaaaaagtagcactggctggtgggaggggtgggatggggagaggagatggctggagcaaggagccaggcatttttcttatctcaacatgtgtttgcagcctcctccaaaactgcccagtggagtgttcagtctggaatttcaagattttgtgaataaatggtaagttggctccttgttctctggaagcgtatactctggatttgtcaggctccccaccccatttctggaagcaccagcattgcttctgcaggcagagttttgccctttaccctcccgtctgatgattcttggctgctgccataagcccttttttagagtgccaagacttatgtggcatgtctaactacatcatggatgtagtagctgctccttttggtacttgctctccagggattggcacgttgctttttgaccttagtttaactcagcaagaatgtattaacttactgtgggcatgatactgtgcttagaacaggaggatgaatcaagcccaggcaatcctcggcctctagtgtgcagagaagacaggcatgcaaacatgttatttgagctagaaccagtgccaggcaacagctcttaccttgtctttcttcctttaagcttaataaaaaaccccgcagagagagcagatttgaagcaactcatggtgagtctatttattccggattcttacagtacctgtttattcatttgttcttctctgtcagtcatctgtgcagtacttccagagcccattcattccctgcccactgtggtccagctgagcctggggctgcagaataccaaacaccagtctcctttgctctcccatcagtttaagggaaagctggggtgacccccgcagcctgagtaagcatatgccagaggaaatgcctgagggggccatgggaaagaaaaggccagcccacccccttcatggggatgcggcctttccctaatactgactgcctcatcttacattcagcctccttccagagtcactctccgcctgctgtctcgtttggtggcagtggaaatagctaagtaatactgtaaatatctggacagccatagacggtgtatatagtatataatatgcactaagtccatcattttctttgtcccttctaacaagcctgtgaggcatttaaggcagagttactgtctccatactgcacgagtaggctccaagaggtgacttgcccaaggcctcacagctgctgtgactggtggagcaggtctttgggcctgcagctggccccactgttgctcaggggcaggtgccaggtgctctttccaagtgcagcacaagctctagacctgaaactcttggattttccttcctggtgggttttgtttttttgtttctttttaacaccacgtcctctcgtttccttacatgcaggttcatgcttttatcaagagatctgatgctgaggaagtggattttgcaggttggctctgctccaccatcggccttaaccagcccagcacaccaacccatgctgctggcgtctaagtgtttgggaagcaacaaagagcgagtcccctgcccggtggtttgccatgtcgcttttgggcctccttcccatgcctgtctctgtttagatgtgcatttcacctgtgacaaaggatgaagaacacagcatgtgccaagattatactcttgtcatttttaatattactgtctttattcttattactattattgttcccctaagtggattggctttgtgcttggggctatttgtgtgtatgctgatgatcaaaacctgtgccaggctgaattacagtgaaattttggtgaatgtgggtagtcattcttacaattgcactgctgttcttgctccatgactggctgtctgcctgtattttcgggattctttgacatttggtggtactttattcttgctgggcatactttctctctaggagggagccttgtgagatccttcacaggcagtgcatgtgaagcatgctttgctgctatgaaaatgagcatcagagagtgtacatcatgttattttattattattatttgcttttcatgtagaactcagcagttgacatccaaatctagccagagcccttcactgccatgatagctggggcttcaccagtctgtctactgtggtgatctgtagacttctggttgtatttctatatttattttcagtatactgtgtgggatacttagtggtatgtctctttaagttttgattaatgtttcttaaatggaattattttgaatgtcacaaattgatcaagatattaaaatgtcggatttatctttccccatatccaagtaccaatgctgttgtaaacaacgtgtatagtgcctaaaattgtatgaaaatccttttaaccattttaacctagatgtttaacaaatctaatctcttattctaataaatatactatgaaataaaaaaaaaaggatgaaagctacttttgcttttgtggtaagcttttcagtttctttagtacacaagaaatactggtttagccaagcaacactggtgagggggaaaggtgaagatgaggaggaggctggaaggcagaaacaggacaccgagttcagtgctttggactaatggggcttcctgtaatttcaatctctggactcagtccagctcttctcacccaacacccttatctgtgactcttccaaccaccttccttgtgggacctgtgaatagatcctgtatattcctttgatctcttttatacaagggaaaagcagctgatgggggactgggagcaaatctgagaaaaatgacaaaacatttcttatctcacagaacatttctcattttccatataccaatagttgagctgagggcctgcctgcacttttaggctgtcatgctcataggagggccttgctggtggccagcttgcctacctggtgtgggagctttctgcacaacataggacagtctgtctcctttgcgacattaagcaatggtttcccttctttcaccacttacacttaaccacaccttcctggaaaggaggaatgtgcctggcgctggctttgtcatgcctgtgaggtggcagtgatgtcacaaagccattgggaacttcttttaggtacatttgaggctgctggtcaatacctctccgctcattattttctttgaaagggcaggttacagaaactaaagccaacatatatatttataaataaaaggcccattcctttttagattaaaaacaaaacttgggtaaataatcttctaagtaggtagtccaatctagaggtaccagagcttgggatattgccaggattttaaaaaaatgttgtatatacattgttgtatatacagtgttgtatatactgctgcctaagctagtcaacttttttctctcactgtgaagtatagcttttctaagtcaacagtttaacttatacattttcaacatataaacatttaggctgggttttaacatttacactgtgtgtcttttacaaatgacaggataccatcactactgagaatgtttcattaaaatgagaatactacatccttagaagaaatgttataacctggtatctaaaacctagatctgaccactttcatgctcagtgtcttttgaggggtgtttagattttttttttttaatttttagccaagaattatgatccccgcatgaatcttgcagtgttttgagctcccaatgccagattcttactgagataccaatgatagttggatttttaaatgatctcattagcacctcatagcaacctgtgaaactgctagagcagatgtgagtatcttcaccttacagatgggaacgtgagttgcaaagaggtgagaagacaagtgaccagtttgtggtagagctggaattcatagtcaagttttccagcttttaaaactcatgctcatattttaaattagacccccaaaatttatgtaccttgatgctttttgttcccaaactgtcttcccattgtgtgttctaaggaacatgctcatttaaacttctggctgtttcctctaaaagcagtcaaaataacttcaatgaaatgtggattaacaaaaaaagtattctttgttttctttgggaactgttacataagttctgcttgacatgattctttgtgttttgtttggcttttactgttgcttgggcaggggaaattaattttataaaattaagcaactacttatttcatggtagtcagtggaaaagggacagtatgcagaaatgaacctcaacttcagatactaagtaaaaactcttattctgtaactgtcatctgttaacaaaaatccagtcttccggcctggtgtagtggctcacgtgtgtaatcccagcactttgggaggtcgaggcgggaggaaaacctgaggttgggagttcgagagcagcctgaccaacatggaaaaatcccatctttactaaaaatacaaaattagccgggtgtggtggtgcatgcctgtaatcctagctactctggaggctgaggcagaagaatcacttgaacccgagaaggggaggttgcagtgagccaaaatcgcgccattgcactccagcctgggcaataagagtgaaactccgtctcaaacaaaacaaaacaaaaaacaaaacaaaaaatccagtcttccaagcatggcacatctctcttaaggaccagaaatggatttcaaaccatcctgttgtatcttttcctcagagaaggaactgctgcttctctctgtcgctatctagaaaccagcaggctccatgatggctacttataatttatttataaaacattttaccagtgagtgatgtctcaagtgagaggtggtaacagatacacaaagcagtttatagcatgcaatatttcaatgcctctgagaggtagaaacagcttgtgctctcagatggccctcagtccttccccttgtcatctttctgtcctagactgtgtcctaactgctcacaagggttcagcggcatgcaaacagtctttaattggttttcttcaaagaggcattgttgactggaaagactggcttgtatttaaactctgctctttttgcaaatgacagactttctcaacagtatttcagaggaaattttgttctgaacagttaactgaatctgaccagattacagacagcaccacccatattactcaatgctaagacacagcatctttgattttctgtatgtcataacattctgaagcttgagttaccgatggagccatttttgcaactacacatcctccttatagttcttgctttcctttcaagcagatcacagggcccagggcaagatgatttccttgaggagaagtagcctgagccttagaaatgcaatttgtataactgaccagcctggctttccccctcctttaggaatctgattcttcttcctcttcctcctcctcctcttccgtcacatgactctttgtgctcagctccagggttgtttggttgattgatgcttcattgtctacatgcaccaacatctgtattggccaagggcatcacagattagcaggaaagatgctggcctcaaaacagcaaattcttaaaaatgacttaaaatcagatctcaattgcatatctatccccagtacttatgactaagaggtatggccactttccttttatacccccacctccattaccaaaatggggcaacagtaaatgccccagattcagtagaatgttacctcatttacaaacattattacacaaagctccataagatttgtgccaacttacatgtgctgctgtatcatggttttaaatgtcttaacacacaaaatctgggagaactgctcaaatattgtgtacttagattttgctgacttacttgagggcatttggtaagagatgagtatgatgagaactggagctcatcttttagcactgtgccttgtacttgaagccacactcttgaatctcaaggttacttattcacaaaaaatcaagagttttgacatcgtcctacaaaaatctccactctcccccgggttcatctgagtaactagacagaatggatgacgaggaggatggaggtaaaacattagtaactacttaattaattagtgtataactagctggtaggaaggtggttaatggagagttgccaccttattaaaccagaaaactgttatcagcacttctcagagccctttgggctaggtaatgtgatttacaacagttcttcaccacccaagcagcatgggagcagagcagactttgcattctctcctaggcctgcacttgattaagcttacatcatgtgactgttcaggtacagtgtgagaagacagcatctcatcccctcttctagaactgatcattgattggagggctaattcttcaacctagaaaagaagagttgaggacacttttccttactatttcactggactactgatgtgggtaaactgctgggcacactatgaaacatttgcatcaagagagggaatgaaaactatctctgtgttgctctagagggaaagttgagggggtaggctcttaggttttctctcttttaaggagatgagtaaagaaagactctagcccttctcccctgggctgaacaggtgttctggctgagtcatggcttccacttctacagacctagcaactcaaagtacaagtgtgtcattaaaacagccaggtgtcatctgattcctcagagagagagattccctggacctgaggctgttactcagtaatgagaacgtgaaggaaagaagaatagaaaacagaggtgtttgctgaagcataaggaaatctgggctttggaggtggtcatcaatacactcattaagtacttgtaagggtaccgtggcaatatagaaacacaaataagtggagggcattatgacttccctaaggaggccgggcgcggtggctcacgcctgtaatcccagcactttgggaggctgaggcgggcggatcatgaggtcaggagatcgagaacatcctggctaacactgtgaaaccccgtctctactaaaagtataacttccctaaggaaaaatgcttatgattttgatatgtcacaggtgtacaatacttttccttttacaaagggctttggtaatcctcacctcatatggacttaaagtttctgaaaaagggccgagcccagtggctcacgcctgtaatcccagcacttagggaggaagaggcaggtggatcacctgaggtcaggagttcgagaacaccttggccaacatggtgaaaccccgtctctactaaatacaaaaaattagcccggcgtggtggcacatgcctgtaatcccagctacttgggaggctgagacaggagaatcccttgaacccgggaggcggaggttgcagtgagccaagattgcgccactgcactctaggctgagcaacaagagcaaaactctgtctcaaaaaaaagattctgaaaagaatgctgagcagggattagcataataacctccctgggacttttttttttttttttaaggcagggtctccccatatagttgcatgctggagtgcagtggcacaatctgggctctctacagctttgaccacctggactttggccatcctcccacctcagtttcccaagtagctggactacaggcacgcaccaccacgctcagctaattttaatttttttttgtaaggccggccgcagtggctcacgcctgtaatctcagcactttggaaggccgaggcgggctgatcgcttgagctcaggagttcgaaaccagcctgggcaacatggtgaaaccccgtctctactaaaaatacaaaaattagccgggcgtggtggtgcacacctgtaatcccagctacttgggaaggtgaagcacgagaatcgcttgaacccagaaggcggaggttgcagtgagccgagatcatgtcactgcactccagcctgggcgatacagtgaggccctgtctcaattttttgtagagacgaggtctcactatattgcccgggctgaggggctgcattaagcacaggtttgggaagtggcccacgtgggcctaaatcccgactcctcctcaaggccatggcgtcagtaacaagagccaccggaagctccagacgttaggacaagtctcttctcccagggcctcagtttcttccttggtagcatgggaggatctaggagttccttctggcttggcaaaactagagcatttcaagcgccaaaacaaactagaaaacagcagctcaggaggaaggggtcggtggccagaggggtctaggcgagccttcgggagggagcacttcctcagcgtgctgtctgagggcgatgaacatttacaggaagcagcaggtaggactgcacttgccaaacacagatccctgagcctcaccctagacttgcgaggtcacgattctgaaagatagggcctaagaagcgcacagcaaactccccaggtgattcagatacctgtttgtttgtaaacctctaaattggcgccaccacagctagtgagtagcggagaactggccgcagcaggtggtcaccacagaggcccaggttggggggaaatggtcgctcgggaggaatggaggaggggcaggagagggccgcggggtcaccttgaggcggttcagctggtcgtgcagggctgccttcaaccgcagcagcgtctcctcctccttgcgcagttcctgaagccggctcagcatgttgcctggtcacatagccaacctccgggctgctgtcggcccggcactcggtgatgacgccatcgccgccgactcccggaaaccgagcggggaggcggggctgcccgacacattgaggaaaggcgaggagtgcgcccccttccggcgcccgccgtagcctggccactccgcgggggacgagctgcaggaaggggtacagcctgtgtcaaaacaccttgattcatgagtaatgatcaggattttgaaattagatccatggagctgtaaagaacctgaagaaatcttgggtttggctatcctttaatccgataggccatttgcgcaccaagtggtcaaacaccgtttcaaatgaccgggtgaacagcacttccaatgtggtgtgccaccaagtggctatctttaaccccacaaaacttgcacatgtgtttgaaggcaggcaccaaatcagtagcacatgaactctactgtgttaagaggccctgcagggtaggactcacagtggactttaaaggggtaaggctgcacaaaacagagaaataaagagcatgaaaataaagccgtgctaagaaacgacgtgcttaagaactgagatttggccctggaaatggggagggttaacagatcaccttggctgtgaactgagactgtcttgacagttcgagactgtcagagagaagctgacagtttaacagtccagatgcaaaacaagacttttgacacaggacaagaggttaattctagggtaatatttgtagtttagctttatgggtaaaaaaaaacacccttgtatctggaggcatttcatgggtacttcttttgaacacagttggttaacataatcaccaagacacacaggcagtcctgaaaaatgcttctggtacttttcagagagtcttgctctgacgcccaggctggagggcaatggtacaatcttggctcattgcaacctccacctcccaggttcaagtgattctcttgcctcagcctccaagtagctggggttacaggcatgcaccatgactggctattttttatattttcagtagagacgagatttcatcatgttgaccaggctggtcttgaactcattggctcaagtgctctgcccaccttagggtcccaaagtgttgggattacagatgtgggccagtgtggccttctggcactttttcaaaccatgggtgaaaatactcaactctattgttatagctggttaaaaagaacacttctcaagaggtaatcaattttactgcagtaccaaaaaaattgtgctctccagttgtgccctcttgtggttaaagttaaatctttacagaatttaacctattttccatctggtggggagctaaacttgaacagcctctgcgtttctgaccaagtcctgttacacctatttttcaagccacattatttagaaaaccacaactttttttaaatcattccccttccactgaactccatggacttagtataaatccatgccccattttataccacactatataaaatgtaacagtctaaattatggccaacaaaatgtcactttaaaaaaattctaaccaagctttacagagcacaccaagtcatgtttctcactgcctgtataatcaggtctttattcaaaagaagctgtccaaaatgatttgacctttatggaataatcaaatttaagagtttatgcagcaggcttcttctcctctgtagtaggtttcttctctgcaggcttcttttcaggggctggtttcttggtagctgctgccttttttcccaccagaggcttcttctgcttcttaacaccaacagcagccttctttcctttcttacctaccacaggcttcttgcctgcaaccgccgccttctcatctgatttggcttgtagtgccgctgctgcagcagctgccttatccacccggagcttgtgctgcaacaaattaggcagaaaacagtaagaatcaaatccctgtaagaacttaatgtatcaggaagagaaaaacaaaaacaaaacaaaccagccgggcacggtggctcacgcctgtaatcccagcactttgggaggccgaggcaggtgaatcacctgaggtcaggagtttgagaccagcctaacaatatagtgacaccccgtctctactgaaaatacaaaaattagccggacatggtggcgtgcgcctgtagtgccagctacttgggaggctgagacagaagaactgcttgaacttggtaggtggaggttgcagtgagctgagatcacgccattgcactccagcctgggtgacagagcgagattccgactcaaaaacaaacaaacaaacaaaaactccactcacattcctggcctggcgaagaatggtgttccggcgcatggtctttgcatatgggtttagcttcaacatgattctcaagtttttcagtgggttcttctttaggactctgcgatggatcttcttgctataaaaaagcagatactgtatcaacattttacttaacattatacacatacaaatttttgaaacaaccaatagtatagggttggggcgagaattacactctaagtatcactttaccgtggtgctcgaagggctctttggatctctgggcttttcaagattctgctaagatctgtattaatcatcttgtgcatgggaagactgaaagggaaaagattgacatgtacatgtaaaagtaatcaaccaaagaacaggaagctcaactgaagctttatttttagccactatgctctccaaaatatctactacactatcacttctcataaacatggaccaggccgggtgtggtggctcacccctataatcccagcacttggggaggccgaggcgggtggatcacctaaggtcaggagttccagaccagcctggccaacatggtaaaaccccaactctacaattagccgggtgtggtggcacaagcctgtagtcccaggtacttgggaggctgagacaggagaactgcttgaacccgggaggcggaggctgcagtaagccacgatcacaccactacactccagcgtgggtgagacagaacaactctgtctcaaaaacaaaacaaaaaaccaaaaatatagaccaggtgagtctcattttggcatactg

SEQ ID NO: 269 - DNA, 1455 bp, Homo sapiens
cccggagttggaagcgcgttacccgggtccaaaatgcccaagaagaagccgacgcccatccagctgaacccggcccccgacggctctgcagttaacgggaccagctctgcggagaccaacttggaggccttgcagaagaagctggaggagctagagcttgatgagcagcagcgaaagcgccttgaggcctttcttacccagaagcagaaggtgggagaactgaaggatgacgactttgagaagatcagtgagctgggggctggcaatggcggtgtggtgttcaaggtctcccacaagccttctggcctggtcatggccagaaagctaattcatctggagatcaaacccgcaatccggaaccagatcataagggagctgcaggttctgcatgagtgcaactctccgtacatcgtgggcttctatggtgcgttctacagcgatggcgagatcagtatctgcatggagcacatggatggaggttctctggatcaagtcctgaagaaagctggaagaattcctgaacaaattttaggaaaagttagcattgctgtaataaaaggcctgacatatctgagggagaagcacaagatcatgcacagagatgtcaagccctccaacatcctagtcaactcccgtggggagatcaagctctgtgactttggggtcagcgggcagctcatcgactccatggccaactccttcgtgggcacaaggtcctacatgtcgccagaaagactccaggggactcattactctgtgcagtcagacatctggagcatgggactgtctctggtagagatggcggttgggaggtatcccatccctcctccagatgccaaggagctggagctgatgtttgggtgccaggtggaaggagatgcggctgagaccccacccaggccaaggacccccgggaggccccttagctcatacggaatggacagccgacctcccatggcaatttttgagttgttggattacatagtcaacgagcctcctccaaaactgcccagtggagtgttcagtctggaatttcaagattttgtgaataaatgcttaataaaaaaccccgcagagagagcagatttgaagcaactcatggttcatgcttttatcaagagatctgatgctgaggaagtggattttgcaggttggctctgctccaccatcggccttaaccagcccagcacaccaacccatgctgctggcgtctaagtgtttgggaagcaacaaagagcgagtcccctgcccggtggtttgccatgtcgcttttgggcctccttcccatgcctgtctctgtttagatgtgcatttcacctgtgacaaaggatgaagaacacagcatgtgccaagattatactcttgtcatttttaatattactgtctttattcttattactattattgttcccctaagtggattggctttgtgcttggggctatttgtgtgtatgc

SEQ ID NO: 270 - protein, 404 aa, Homo sapiens
PGVGSALPGSKMPKKKPTPIQLNPAPDGSAVNGTSSAETNLEALQKKLEELELDEQQRKRLEAFLTQKQKVGELKDDDFEKISELGAGNGGVVFKVSHKPSGLVMARKLIHLEIKPAIRNQIIRELQVLHECNSPYIVGFYGAFYSDGEISICMEHMDGGSLDQVLKKAGRIPEQILGKVSIAVIKGLTYLREKHKIMHRDVKPSNILVNSRGEIKLCDFGVSGQLIDSMANSFVGTRSYMSPERLQGTHYSVQSDIWSMGLSLVEMAVGRYPIPPPDAKELELMFGCQVEGDAAETPPRPRTPGRPLSSYGMDSRPPMAIFELLDYIVNEPPPKLPSGVFSLEFQDFVNKCLIKNPAERADLKQLMVHAFIKRSDAEEVDFAGWLCSTIGLNQPSTPTHAAGV

SEQ ID NO: 271 - DNA, 63502 bp, Mus musculus
  misc_feature (1)...(63502): n = A,T,C or G
agtttttctggactataatatttggcataattttattgttgatttttctcctgttcttgatcctacagaaagtctttggaaagtatgaggacccttcatcagaggaagttctacagcaatttggaaaaagctgagggtaatacaatcagacagctttgtaattggacctaaccctttaagtattctgatagtcctttaaaagctggtgacaacagatagatattaaaatctgtatgtatgttttatgtttataaacttcatttcaaaattattactcaagactccaagctgtattttgaatttaaaaaaatgtggtcatgtccatttataaatcatcattaataagtccatttgaaaaatattgtccagaaaaagtttattgccactatttcaaagttcattacacatgtaaaaaactatgtgaaatctttacacaattcttatgtgaaaaatgggatttctatgtagctagtttcagcttttcagacatagattggagtacggggttcagataagctgagtgtagtgagcagagaggtgctgcagtgtgagaggtcaccatgttccggcctggggtttgctatgttctgttgtactagagtacaagctgaatccctttctaatagtaactaacacaccgcttaaagctgcatttgtacttttcagatgtttacattgtttctacccagtgcttcattgttgtttcttgattaagattacccattaagcatttctatttgatgcctttgtgtttaataaaagtggttagctcctctctcactccagtgctttctgtagtgggcattcccaaatgtaatccacctgccagtctttctatgaatatataaaaatgataactactggctatctgccaagagctagattccccagtgtgtgtatacctaaactcaaaagtaattgttttggtctacacatcaatttagtaaaattataaaatcctggagatttccctacaaataaaatcacttaacactttattaaaaggctacattgacaattgacccagaatagccttgtaatacaaactagacattatctttaatatatttggagagattagcaaacctgtagtcatttgtttctcaataaccaaatacctgatatatatgcttttacatatagacaaaattactgaatttcattcggaaaaaatatagaaaggccatttcaagtaatgttcaggagttttgagttagcaattcctttctttttttcttttctttttttcttttttttttttcttttttggtgggcaactatgtatgtattgtgtttgggaggcagagtgagggagaaaccccagcaagaagaagactgggtccagtctagagttcctggtgaagagcaggaaggtttctgctcaacccatcacagaacgagagaggggctcaatagatcattcccttggtttctccacggggcttcttgagcttctcaaagttcttcaggatgatgtcatataacacagcataagcatttcggatctccatgaccatcaaatggatctcctggtactcctcctcgtccagcacatgcaccagctgctgatagtcacccacatggggctacttggctgctttggccactgtgtcacccctctcggagaagtactccttccagcttggtatgaaggctggtcaccaactcaaacaccttttcctggacagccacgccaaaattattcccatcctctatccgaggtatctgtagcagcaaccaggtagtgaccagattgagttgctcgatggcatccttgatctcaggttttaggtgtttcaggaggaccacgatcttctcattgcagttcactgggccacagggaggacctttgtcatctttgtcccctttcttcttttcatccttctcatgatggtgcttctgctcctcctcctctttctccttgactggatcaggtgctgggatgcccaacagagccttcagattgctcaggttggcgtcattgagagctggcttctttaagaacacatccagctctgagatcttcttgggaaaatagctcccaagcaggttctctgtcttgctacacaggtcttcacggaacacatccaccttggcttggtttcaggatggaccctcagtgtggccatggccagagcagggggtagcaagtcctttctaatatctaaatgtaaagacctggcaacttctgtgttccaaaggcctctgaggagcacccagagtctcttcacgggttaaattagaaactcaagggctggagagagagagagagctgtcagtggttaagagctgctattgcggaggaccttggttcggttcctagcacctacatggggttcacaatcatccctaactccagttccatgggatcagctagcccttctgacctctgcaggcactatgcatacatgtggtgcacatacatacatgtaagcaaaacacatgaagaaaaatgaatacatcttgtaaatctttaaagtcattaattttaaaagtatccaaatgattctttatggattcttttggtatctcaagtgaaaaaatcaattttggggctggagagatggctccgtagttaagagcactgactgctcttccagaggtcatgagttcaattcccagcagccacatggtggctcacaaccatctgtaatgggatctgatgccctcttctggtgtatctgcagacagctacagtgtattcatcatgtatataaaataaataaatacaatcttttaaagaaaaagaaaaagcaatttttacttaagttctaaagtctctaatacataattattcttgttggatttttaaagactggccaagaagaaaaaatgagcagatgtttccaagtcacatcaaaggcaaaatttcacataactttagtgtatttcaggttgttcaaattggctttcctttgataatatcagaataacaaagaatacctagtaagttcagctaacagagttccctaactgtcgtcaaaagggattaaatctccatagtgactgtgcctggtaccggccttgattccggtcataggagattgtgagcagataggacatagttatattagaaagcccttcccagccaggattctgggaagtactgcattttcacggttgactattgtgtctcattatcaaatagaagcctggttcagaggaaagtattggagcttgtgggtagggccgctcagtggtggggtgcttgcctagcctgagtacaacaaccttggttcctagcccctgcactgttttatgcttcaaggagtgatagaagtccactgtgtaggcaggagaatggacttgtaagatgtcctatcaccattaccagaatggtgtgtcctttatgtaactgcaagaaagcctgctgataagttgacccagcaatggagaggttggcttggatggctcagtccttttatgagttgttaaaatagcagatgaaacaggagagaggccacaagggctagccttacacatgctacctttgcagctagaaaggccaggggtttggaactgcagtcacctccagtggctggaggggcctgagaacatactcttttggagcaccagaaggaagccctgtcagctccttggtttttagccaagtgacctgcaccaggcttctcaggtccacaagtgtaaacacacttgaattgcttaggccaccagtttatggtccatctttagactatagaaagaagtaagcatcttcccctggtgctatgatgaacctctgaagaaccagatgagggatgaagggccctttccagtttacaattggacagtccatctgcagtccctaagcagaacacagcaaaagccatcaaagtggcagctagcccttccttctcatcccagcctacaaccacagtgacactccccaccccagctgtcaaaatggtggcccctatcaaaaatggtgagatcctgtcaaaatggcagcaccacatctcctcagcctgcagccctcccaggagctacccacagtggcacatcagctttcccacatcagcaggaactgcccctcaagagctgtccatggaggtgatagctttcctgcctcagcctacagccttggtcagacagcactgcaggagccattcacagtggcagcctctcctctccggcctccctgagcatccccacagagatgataccttggcaaaaggcagctgcagccagaaaggacttcccaccctaacccatgggcccaacacagggaaacaagggtggaaaaaaaaagccacgaatccctaaaaaggaaaacccaccaatctctgagctccccaacctcaggacttgaaatctcaccaattctcaatccagaaaagctccgccccctcagatcctatgtaagccctaccctttatccaattccctgctgtctgctcctggaagcagagagcagccatccctggattcacccctccacacactagaccctccaataaatctcatttaatgagatttcctgcctggtatgactctagtcagaagaagacaagaagcaataaagagaagaagagaagcaaccgggctgaaacttctgagctatgtggttcctcaactcctgtgtctcaggatgcccttcccttggcacactgtcccacctcagagctgtgtagtttctgaacttgcgagtcccaagatgcccttccatccaagcagaaacataccattatggtgggggaagtggaggcaccaggagcttgaagcagccatatgacctctgcagtcagagagctgtgaacactccgattagtttactctctccattttacacactccaggatgttagcccaggggacacacacacacacacacacacacacacacacacacacacacacacacatgcaagttgtatgtggaactggagttacagctggttatggcctgccgtctgggtgccaggactcaatccaaagtcctcttatctggttatgcactggtgactatactcagaagcctgtctcctcagcccagcacatctgggatgtgtgccccatctctacagatgttatctttcccactcagctgtgaggactgcagtcagagcggttgtctttcttctgtagcggagggccttctttgacgctttacaaaaatctaaaatctctgctcaccaggtccagtacctgttgctgcattttgctggctccgtaccttgtctgtcatggagagtgactcactggtgcactcatggcactcactgctgttggatgtctgagactctcttaagccacagcgggtagctgagtgtctgctgggccatgtgccctctatttgttccatagttggaaccggcgttggcatcgtgtatgctttgcatgtctgtctcttctgtaaacgtggctcatcgctgccacttatctgtccagtcctcatctgtacacaagaccattgcagccttcaaaccattgtcttgggagaaacacgcaaataggcatacagtatttgaaaactctttcattgttagcctttcaaaacataaaagagcttctaaactgacatagattagtgtctcctgttccctaatttaattatgcattgatatatttatcatattgtcaagcatttgtttggtttgtttgagggtttgtttttctttgtaggaaacaaggtctcactagcctggaacttattatgtaaaacaggctggccttgacttgggaaagatccacctgcttctgcctcttgagctctgggattaaaggcacatgctgtcacataggcgtttgtttgtttgtttgtttgtttgttctggtttctgtttcggttttggtttttcaagagaagttttctctgtgtagctttggctgtcctgtaactcgctctgtagaccatctgaccttggactcacagagatacgcctgcctctgcctcccaagcactggcatgagaagtatgcccctatagtgtgatttatcctgtgtgcctggccctttcaaggatccccagttgctcgtaaactggccctttaagaattcttagctgtttgaactacttgaccctcatgaccttcagtgttggtggcttcttgaatttctgggaaggagaaagaatataaaaaagcaggccgaggctgagaaagagcattgggctagctgagtgagaagacagttgagccagagatgagattgttaggagacagttgagccaggaggagctgagctgagtagataggctacaacagttgttttggtttggaactgagagaaaggagtgtttaagcagactgctggggaactgagagaggaacaaaggattgggggaaacatttgaaggggctgggctagaaactggaaggagggcaggcagtgagttaagagaactgattactgttgataggaaatgaaacattaaaataaataaaaagcacacattttacatgtgccaccaccgcctggcccacatatgcaattgtaattgtaattgtgtgtgtgtgtgtgtgtgtgtgtgtgtagggtcccttccatcccatgtgtgaaacttcacttcgtcgtttgtgataggtctaggtagagctgacttttccctttttcagctccatggtttgtgggtgttggttttgtcttcatttctagatcattgagatgttaattctttagttctatttccatatctcccatacaccagcctcttgtctcctgtctcccagtctgtccctgttttctgccaagcatttagctggtttaaggtgggctggaccacaaagagccagagcttgcgattccctcctttcctttacagctcttgagttatcccagtgttgctgaacacatcatcttctgtcaaatggacagttcacttcttgagggctttttgcatgtttttcccttgggtgcatttgagggagtaaagttccaagatgctcgaaagccttgagtatttggattttaacagcagctcccttgagagacttgacaaactaatgcttaaagctgactgttccaaggtgccttctgttagtccttacctaacagctgtgctttagaacaactggcccagtgacagtggcctgagtctagcctcctattgtccagtggagaatggcaaactaaaaatagttggtgttcttgccagctgcacgtgaagatgtccccgtttgcctgtgccactttcctctggctacttactggtgaggactgtgttactgctgtgactggtgttagcagtgtaatacccaaaatgaattcaagaccacccagtaccttcccccttcaaaaaggactttccatactgaactagcaggcaaagtacagagccagataaggaagctggctgactaaacaaatgtaaaaacatagttttagtggtcaaaatgactaagcttacagctaccaaaacaatattagctgttctcagagaaataaccataacaagattagcaattctcttgcccccctaccccacatggaattccgacaaagaccacaaaccaccttttgttgcaagaattcccctgacgttaatagctgtgacgttaatgtactattactttgctgaccaaatcataataacccaccatggggggcaagcaaagtgagggactaggccaaagggttacttagttactatacaaaccaaccaatgcctgaaagggttacttgctacaccagtgagaaccctgttgctcaaatctgccccttacaaaggtataaaaagtgtgatctttctttgttctgggtctctcctctggcctacgtccctaacagaaagaaagaaagaaagaaagaaagaaagaaagaaagaaagaaagaaagaaagaaagaaagaaagaaagaaaggaaggaaggaaggaaggaaggaaggaagaaagaaaggaagaaagaaagaaagaaagaggggagtccctaacatgttggatcaataaaaatcctcatgcgttttgcagcgatggcggcggtctctgtggtccttgtgagtaaaggtcttttgacgaactccaacagcagttctcctgatcagtctttttctatctgggggttattgatattcttgggtttgtagccctgtgggtgtctttcacactcttcctccgggactacagttgcataagttaggcccctcaaagtggggtcatggttctagtattctttgtccttttgtttttatagccctgtgtggctgtggtggttacgtgttgccgtatgctgtgtggtctcgcttcttgctgtcccgctccttcaggctgccctgggacagcagcggttcttttcctctgatgcctaaggctagtcctgctcgctctcagctgctctgagcacagtttgtttccctctacggtagcggaagctgggctgctccagactgtgtgtgcacatgctctgctgctgctgctgtgcacttcagggagtgtccttacgtacagtgtgaagcctgccctctgcctctctcagatgtcttcccgaggcgttctctctgtttcttagattggtttctggactatggcttccctcatcctgctgaagtctggaaacttagtaggcagccccaggctaccttgatttcttgttctcagggctccctgaactgtctactgtggcaattgctgaggtctggttacttttccgtgtataaatgggaactgtatccactgaaggtgttgtacagaagtagacctgctgacttctaccttaatgcctctctccctctgacagtcttttaacgcagtgtcagcacatgcccatgtgagaggggatccaatgctgctgatgaccagttagaagtgagcaaatctcatagactgaagatgccaacctgcagtcctagggcagccacactaaggccgggtgtcaacgagttgcatcctttctgtgtgaattgggagaaactcagggcaattactggggagcctcacagcctagattctgagctgcagacatgaaaggaaggactgaatgaggcagggctcagctgctttccagccatgacttgcccgtactcccatgtctgtccatgaaaggaggctggcctcctggcagggcttcataaggttcaaaacgaagggctagccaagccaaaagaatgtgttcccttccccatgtccccttgactttaggacatgtggggtccccaagacataggtttatgaaccccaaatgtcggcttggcctgtgttcaggatgaataccaggttgctgttaagggtcctgagcgcttggccagaaggtggcagcagcctctagccttgttccccttgctgtgaggaacgctgctcacccaccagtattgtaaacctgagtgaagtctctgccagtgtatggggccagtgatagtctgctcacctgcagcgtgcagagtgcagacctgctcagttagtctgagctgctgcatccatgactctccaggtcaggcctagcctgtacttggggtatctgccccagggttctcagcttgccggtgttacatggcctttcttgctcatattcacacacccaagtctcccttaccactactggtccatcctgtgtagagtcatggccagtagccaaccccaacggaagtctcacctttttacctagcaattccttttgtccctaaattcggtattcatggactctgctaccctaccctggcttgtcaccacctgctgtcaagcacacctttgtccctccaaggagccttgttcccactgaccatctttcctgaggttccacttcttgtcctacagacgttggttgtcagggctggttttggccacaccactccagcaccccacggggaaaaggagatgggaccacggggtgtttgcagagcccacaggatagctgaggaacccagccgtcagagcgaggtgctgagtttggggacctggagaccctccaagcccatccggccctgcagacattccaggaggctcccctctagtcccagccgcgctccagcctcaggtgccgcccgccagcttccgccctcgacagccgcgggcgtgggagccgcagtgggccgggcgcggtctctccttagctcccgcccccggcgcgtctccagcgggcgcagagctcggcaaggcgctgggacggtggggctctgcttgccatggccccgggcctgcggggcctcccgcggtgcggcctctggctgctgctgggtgagtagcccgggctgcagcgttggtggtgacctggggccgggagggcagcacctgaacgcaccttactcagggcatggggtctgggcaagacagtagagtggtgatgggggcgggggagggggcgctgcaccaccttacgctgccacggagacgaggtggcttgggcacatcatccagcgggccatccgaaggcatcagcaacttttgatcatacaatgggcagcttgctttccgggagggatagggtcgcggggatcccctgtcggcacttcagttctccaaactgatgcaagctccctgagccagaagcatcttacagatgtgcagtcttcaaccagagccacagcttagggatcccgacactaaggacaactggaagcctgactctcacctacagcagttgctggttgagactattatttccacggagggtgggaggctaggggtgaagggtggttgttgttggcgtgtgtggctaataaatattagaggtggcagacttgcttgggattttgttttagattgatcagaaactgtagcccaggggtgactaacaagaaactgcccatctcagttccccttgtctgtaacgttctcaggacccggggctgtcatacctcttggacataattcaggtacatagctacattttaacgaaagcaaacaaagagtcggtccagtgtccctggaagggcctgtgacttgatgattcttgtggtcttttcccatacccatggtattggtcagaggcacctgctgcacaggctctggtggtggcaaaggctgcccactagtgctgtttatagccaaggaagcagcttggggcagtgtggcctgtccccggtgactgggcaggaacagcactggacacctaccgtttgcagggcagagctctcctgtttttaatccttgccagggagtgccagatctacacttaaaaaatctgtttctgtgtaatagaatctaaaggtggacttgccccttatacgtgttggctaaacttgcgtgaaaatcaaaaccttataataatgttgctgtctttggctatgttcagatcctttcggcttgatgtgaaattttagcttcagtttcctaagagatgaacattagcagcacagggagctggttgggcccctcccccacccccttttatttaagaataagcaaataaattaagtttctttactagtgcaccagagtctgcaccctggaaggcttgtgtaaatagaacacttatgcttgaccacatgtaaggaccgcctgtgtttaccaagaaaagggctctgctctcagtccaatgacctgtgctcttgacgtagccctgagcagtctggctgatgttatgtcttgggagaacaaacacaactctatgaggttatcggtgaattaatgacttgggaacccagctgtgatgagcggaatcactgagctcatagtgttcttcacgagccctgctactggccagatctccttggagatagactttgatatcttgcatggctatgtggaagaaagagttctgtttttctttaaagtatagtaatctgtaggatgtgagatcttgatctgggacgcttctataaaccagctggttcttctcttagtcaacctgctggctttattaagagttaccgaaatcccagcagatacgtctttttctcttcccgctgactctcctctgtgtgctgttgtgtttacaaagcatctcctgagagaccacgtgcactttaaaacattttcatgcataaccatcaaaaggactctgagctgtcaggaaaggcgagctgtgggtacgaggcaggccagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcagtgtgagcttggagacagagtgattctttggtgtttgtccagcttccctgcacacatgctgggtctgtgttcagactgtcagtccagcccagggctgcagaccagtttttctacccatgctgggttgcagtaacataggggaacattttagatgcaatcctcacttggggcaaatgactccttggaaaagtctcctgtgatttcctcacacatacccctgaactaaccagtttgatagtttctgttcaaatccaaactggcatctgggagagtgtgtgacagggacgccacatgtggtatgaatcccagtgaaagtgctgagccagggagtggctccccaaaggctcaccctgccgcacccctcctttctgagattccatgtgtcctgctaggctgtaccctcactagagctctggctgaagcctggtccctgggatgctcgcaggctgcacggtcagttttctgctggagccccggaaaaggtgggtcagtttttagggtgatctgagtgccagttgccagtgggcagcctgcaagccacaggctttctgtcctgtgagagaggagtgagagaaacagatgcgctcctcataactcttgagccccaattggaatccaccccaggaacccatcaagtttgagccaagtgtctaaccttctatgcgtcccatatctcggagatcaaatggtgtcaacacaaaagacagctagaagcctggtaaatacctctccttagctgtgccctacagcacaggacatgccccactcctgtgaagagcgacatgtccccaaatgcccatggtgcgaggtggagaaatgcccccattttaaccaggcagctgcccctcttcggtcgcctctgtatctgctacaaccagccacatagtcaaagtgttcttaacctgggcatggtggctcccatgtataatctcaacagtcaggagactgagatagacggattataaaacagacagcttggactacatagtacataaggagaccttgtctcaaaaaatatatcaaaactcaaaatgttaccaacaacaataatggcagaattggagggagaagctcagtgggtcaaggccagtcatattagaggactgagcttgaactcccagaacccacatgagatccagctccaaggcctgtccctccagcgctcctaagggcggattctaagagagacaagggagtcagggagctgtcaggcacacgtgtctggtggatgcagccgaaaagcagcaaagagtccctgcctcagtgcaggaagttggtaaaatgccactgcctgcggttgtcctctgctcgtacacatgtgtgatctcaaaagtgcatatgcacacctgccgctgcaactaaagtgtagccagaagacatgcagtctaacaactactcctatggcgcttatattgtgttatgcattctaagccacttggagatgattaagacaatagatgaccggatttgtggtttgtatgtaaaacaccactctgttttaggtacttgctgtggacaagctgaggcagctccatatcccatacctgggactcaaacaaacaaacaaacaaacaaaacggattcatgtaacggaactgggttgttaaagaaactaaaattctcactacagggttgtgcaaagaacctggtcctggaagccaaattgactgaagtggagtcagagcctgttgagctgaagctaaactttaggaaggccagatccgtggcacttagaggaccatgggagcttgaaggaaatggatgctgactgagccgtgccttataaaaaccccaggcttggggcagtgcatagttttaatcctagcacttgggagatagaagcaggcaggtctctgtgagttcaaggccagcttggtctacagaatgagtttcaggacagccagagctatacataaacccctatcgagagaggagagagagagagagagagcgccctgggctacatccaagcttgggctggtggtctacaggggctagagctggccagatttgggtggggaaggactctagggagccccaaggtaaaaggtgtaggacaggaaccttgggtaaagtggactttcagacaatttcagtataagcatatgttgtacaatatttagggacatcctcatctaagattctcttaaatttgaattgagtggagcattcctgacatttgcatgctgaatgataatttatccatgcagcctagggccaggtgcccttggacagtagggtgattgctggaagacagggatctatgtcaatcaagggttcacaagaaagaggcatggcaggaagatacttagggcaggagccttgtccgggtcagcgccaaagcctcaggcagaggggacagctgcaaagagaggctggagacagaccctggcttttgtgaaatcctggggaaggggaggccaagtccacgtgaaggccccggagaactgagtgtccacaggttctacttctgtcccagcagccatgcaaggatagactgaggcaatcccagttccactgggcgccttgacaagtcaggagggatcaaaacaggtaactgggtcacacgtggatgattctctagttatgccctcagttgtcagaccttttgggcggggggatggcagtgcagtgggaatccactgaacttaaacatcagcagtctggggttgagacctgctgctcaagaaaccatacttccattgaatcttcagccaagtctcattgaatgactcctctctgagggttacccctttggagtctcattgaatgactcctctctgagggttacccctttggagtcctgtggtttttgtctgctgctacaaatgaaatgcattccctcaactggttcctaactgtctgaactaaagctaaaaagcacacttttttagaaaatgtattcatttgcttgcatgtgtatgggtgtaggcaagtatatcatggctcacaggtggaggtagagggcaacttgcaggaaggcgctggtgctctcttgctgccacataggtcctggcaatgagctcctgtccacaggcttgctgataagtgcctttgcataccaagctatgtcctaaggcccaacagacactctgtgtgtcctggggtggggtggggggtgggtatctctcttctctttgtgtttcttgtttggtatttgagctcttttcctaagagctcttttcccaacaagtcactaggacagtttcggccaggaaggtcctcttggctttatggtttttcttttgttctcaccctggagtggggtgggggggctggcctcagcagccttcctcttctgtaaactgtggtagtaagtctgctaaatatctgccttactcttgtagtacgggactttcatctcattgtcttatagagatgagcacatgacggaaggatggaggatgctcggtctctccacggatgaaatgttttgtcacactaaggaagaaatagtaacacacacagagcagcttgccctgctggcctgccgagagtaataatagagacagccaccaggtgccttctcccttcctggatgaagcgcccaagaggcacctgtttgttctgcccaaactgcccgaaggggtctttctcattcatttttcctagttaggtcactcctccactttcccctgtggctttctctaggacagaggttcctttccacactaaccaccacagcaacatcacctctgtccctgagtaccaaggcaggatgacagttcttgcaggacctgagagtcctcacttctccctcgagtcaggactgtggctgactaccttgaaggggttttccttgcctgtcttgctgcttggaatcttgaatcgtctttgtagtgacatctgttgatttcctaggactgtgtccattccctcccatcatatttttcagggaattccgacattccatagtnnnnnnnnnnnnnnnnnnnnacaccatggagaggaaaggatgtgcttcgtcttacaccctgtagtccagtccatcatccatggaagtccaggaagaatctggaggcaggaactggttcaggggacagggaggagtgctgccttactgacttgctctccagggcttgcatgaactattttcttatgactcttaggatcaacaactcagggatggccttgcccacaataagctggcacttccacatcaattaggaaatcaggaaaatgccccacaggcttgtctgtaggtaaagactctggtaaagcattttctcacttgaggttccctcttctccagtgactccaacttgtgtcaagttgacatcaaactagccaacgccgccaacagttcacccctgggacaaaatacttgacaaaatcaagtgaacagagtaggggtttattctggctcaggttcttagaggttccagtctgtggttgcttggttgtcttatctctggactgaggtaggcagaggatggctacaggaaaacgtgattacacatagcttcccagctcatggcagaaaggaggccaaagggggtgtggaggaaaggagccagggacagaatctagcccctcaggatctactcccttcaacgttacaattacctcccaagagtctattaaaatacaaccccaagagccaaaagccccgccttggtactgtagtgctgggccttcagcatccatcatccggacattctgtgtccaaactgcagcacagagattaagggagcacctttgttctctatccgaggcgtttcaggatagcatgtcctttgtctgtaaagctataagtccattgcacggctaggagttccgtgtaggctatggtacatctctaactccttccatatttgtggggatcttctaggtccagtcttgtgagctggtgtttttatgattcaggaccaggacagagggacatcgcctggtgttctttgtgcctttccctctgaagagtcagtgctggtgagcagctggtcatttttctttgactgccgtatccacttgtgcgagtgagcgtgctcagtcctccacttggcagaattctgcaaggttttgtctgtcttgtgcctgctgttgatatctttagacttttctgtttgcggttttagttcctctttggcacagagagcagttggtaaatatattttaaagttccattggtgagggatcccagacagtcactactgctttttattacaccatggttgggacaacagatctgccatggctccccacatagaatgaccttcagatgactcctgagcctggcacattgacttttgtgactggccatgagccactcagtccacaacacagttttctgttaattctagccatttgactaaaactctcacccgccatctttaaaaagccgtttttctttccaaatgctttctatgtcaaagaggaaataggaaaccacaaacagaaaaattctgaagatactgacatcaggcacaagacagacaaaaacttaacaaaattcagccaagcagggactgagggagcaggctctctcacacaagtggataaggtgttccttgtgttaggctaaaaacccaagtcctctgtgtccttgttcatgtcacttgtgtagatctgtgcactttatagacctcacacttgggagatatccactctttctctccatagccttgtgtgcaggagacagataagccctgccagtcactgctgcagcctacttagagtactgcctcctcttcccacacgttgcttttgacattttattcttaattgtgcttgccttagtcacagctctctagaggagcagaacaggtagaatgaatacatactgtgaaaggggacttgctagattgatgtgctccatgtgggttgggtagtgcagcaacagctgactacatactgaagagactgggaacctgatagctacttagttcacaaggctgggtgcctcaacggtcccagtctggtactgaaggcctaggcaatccccagagagcccctggtcttcagtccacagtagaaagtcaaagaaactggaggctgatgtccatgagagatgtcgatcagggaggaggcagcagcagcagcagcagcagtgtagatgcgcacaccagcaagaagggaaggcaggtgagcaagaagtggctttcctgaggatctctttgtatctgggccacagctcgaaggcattgctcactctgaggggagacttttctttccacagtttatccctttcagaaaaaaaaaaatccccacacagacctgcctagaagcatgtctcttagtcgatttcacatccagtcaagttaccaaccaagttccctaaaggacatctggagttcactttcaagtgtacagttaagtgtgctaaggacattcatggagtctttagcctagctacatccagaatgcctagaactctgttctcattaaacactgatgccctcctccttcatctcccaacccctggcagccaccaccccatgctctatctagatgttagcttcagtggtgccttatggaatccgatcctgaccctgtggagtttactttccacatgtgtttgcgagattaatcgcattacagtgtgagtcaagttttccttcttgtgaaggtcaaagagacctccactgtatggacatatcacttctggattatttctccatccagggagatgtggagcagtttcttggttcccactggtcatgtggtgtgcaaacacctctttgggtccccgcctctttcagttccctatgatattcacttagaagggttgctgcatgctgcatcaccgcatggtgattctatcttggattcttttaggagccaccgtgctgtattccacacagcctcgccacctcacactcgtgcctacggagcacagaacctcctcctcaccagcaagcgttattttctgggttggctgctatgaacagcatcgcatccattactctgtgggtggaactgcactttgtcagggaccatgttatgatctatcacttttaagtcttagattgctggaactaagcactgctcattgttggggtgttcaggagtcccttgatggtggttctcttttgaatctctttgaaaggtttttcatgtttgtaattaaaatagaattatatcacattgccccttccctttcctccctccagtccctcccaggtctcctccttctaaccccttccaggtctatctcaaatccatagggtttttttctttattattgttacgtgtgtgtgtgtgtgtgtgtgtgtgtgtgtgtgtgtggtttatgttcaagtgcgcacaattatgtaagtacaacctactgagtttgatattgctgtttatgtgtgtatatggtttttgggaggaccactttgtattagagaaccaggaaggggctcatccctgggagaaggctaactctccttctcctggcagcattgagacccaggtagcatctgacgtttccaaggactgggaggactcattgcatttgcttgcctgggtctcgtgactttgggctggctactccctatcatctaggctcctcaccagaatgaaggtagcacagggtcacatcccttgggacagttgtgaggatgctgcccccatgcagagcctggtgggacctggggcactgtcagtggtctctgggaattgtttgcttttctggttttaagacatgtttgggagttggacgtggtggcacacactgttaatctcagcactcagaaggcaggggcaggtggatctcagtgagttcaaggacagcctggtctacagagtgagttccaggacagccagggctacacagagaaaccctgtctcagaaaaacaaacaaacaaacagacagacagacagacagaagaactgcatttggggttttgttttctgtttcccattgttcgctacttgtagagacatcctgtccatcctgtccatctgtcctccttttcttcctttcatttttcaaattttggcactttttgttttggtttggtttggttggttttggttttttgtatttattcctttctcttttttaattttctttctttttttgacacagggataggattttgattgttggtgtacagggaggctactgagttgtgtgttgcttttgtttcctggtgctttgctgaacggatgggtaagatctaggagttttcttggggagtcctctgagtctttaagtacgggtctatgtcagctgcaaatagggatgctcagacttctcctttcctgtttgtatctttgtttctttctcttatcgccctctctatgagagtaagtgctatagtgaacaggagcaacaggaagggcccctcaaggggcatttgtgttgtgtgcagtgtctggtcgttgggaagcatgccaagcatcctctgttctccatacacagccactgcatacatgaatacatctgcgtgtgtgtgtgtgtgtgcgcgcatgctttggacacatgcatcttcatgtgtcatgtgtatatacacacaggcagatacagaaaaaagaagagtgagcataatgctcacttgccttattctgatattggaggaaatgctttcgctttccctgtctatagttttctgtatacagccctttgtcacattannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctctggcacccctaagtgtgtttctatgttgtgttacagtccttggtttcatatgctggagcaactgtgtagcccctggttaccttgatcatgactcaccttggtcttggtgtgtgcttgaattctatatataggtatttgattgaccattttcatgtctatgctcaccagcgaaagtggactaatagtctttttttttttttttaattttgagcaggcctcactatgtagcctttgttggcctggagctcacagaaatccacctgcctctgcctccccaggtagtcagactagaggttgaacatgtcagctggtctacagggcaggtatgtaaaagtgtgttcttcagttcgaatgactgtgtagtttctgcgattggttttgttacttatttctagttttatttcactgtggtcccataagacactagaaaattcctgactcttttacctttgtctcttttacatttgttaaagcatgctttgtggcctagaaggtggtctaatcttgagacagacccttgggctgccaagatgtacattttacctcctctactaggtaaaaggttccagacagagcgtttcaaaaaaaaaaacaaaaatggggtgccaccattagtgtcaaacaatgaaagccctttgttctcctaggactgtgtaggatgagctgtagggatgtcagagccacccacacagacagaagatgccctgaagacctggtgtggggggaaagatggtgcagaggattgttctcagcttgccctcatgttctcgggatgtccttgctctcttcacctccagttcctttgtgggagccatctgtcactgatgtagtgtcgtgcaaatgctgctcccaggtgcctggttacttctgggcatcgttgtgatgtggcagggaccgtcatctgctaggactgccctagagtctcagagcctctgaggacagaggttcccctaggaaccccctgtgggttactgctacctgagaagtcctgagcccacatctccagagcgtctgtggtaagcacgctcaggatggcggccggcactagcactctgatgtcatccacgcgtgatggcttctctctgtgtgtgatgctatgtgtgctcagctgaggcacatatagtagtagagagaaggagcagaggagcgatgctgaattctgaagttatgcacagccgaggggcacgcctgtcctgacaggcagctgagagagcagcattgtctccgtctaggtttcagaaggcagcagtccccagtggttacatttgcctgcacatagagtcggccttttgactccaaagcttaaagtttgaggcagttttactgtttgttgttgcttgttctttatgagagattaggatgctcttccaattacaaaatgaaactactctctgcctgcggagctgcccgtggccccaatccacactctccaaggcaggaagggatgagtttatgagtctagcagaagaaagatggggctgagcatagcaagtctcccccttgggaggtggaggggtgatctgagaagaatgggaggtacaaggaccaggtcaggtagggtcagctctacagctagaccagggaggcccaaagactatccaggagatttttgtcttggcagaatgctgggggtggggtggggggaagcattctcctggaagtgtggaggggacatgattggtccttctgggcccccagcctccgagtgcccttttctgttggggaccatctctccacagaggcagcacagtctctcctgtgtactagctctgcaggacaggagtgcatctcctattcccctccctggccccttcacaggggacttggagacaccagatctctttagctgatccttggtgtcgacatcagcacacaccgggttctaatgcatggcacccagaaccttccctgaggcacccccttctctgccctaaaactgactcttccagaacaggaaggaaggccaagtcactcttgatcctctccattgcctggccagtaccttgcaccagcggtgaccccaggtaccctgccttcctttcctagctgtgtttcctggcagtggtgtgtgggtatctcaggcatttggtgaaaatgtatgtgccactctgctgcgtgccagggacgactgcccctgtgagtcagaaaggagtgggaggtgaaagcagggcaaatgtggtttaaaaaaaaaagtctttgccccctcaccctgagcaccccggatgtggctgtgtctatgtctgtggagggtgtgctggcttcctgcagctatgggcagctggaggaggacagcttggggcacggagttcatgaaagggggagtcatatgaggtacaaggcaggtctgggtgccaggagccataaagtataggggataaatggagagaggacccttgacactcacacgaggtctcatcccagcttctggagcttgctgtacatttgaggcttcctgactaccacaggaaggcttccacaggggatcctggtgggacagagatggtgttaccctttccccagcctccactgtggctgacatgatcctcaagtgtgcgctgctggctccgaggtccccaggtgtgctcactgtactcttgtggcctgagcatccatatactggctgcttcatgagctcaagtgcagttcaagtacttgctggggagtggtgccttgctgtcctctgtgtttcctagggctctaggttgggcccagaaaacttccagcagcccctccatggcccctcaagagcagaggtctctcactgaaggctgtggattgcctcccaagagcgatttccatctgtcagcctttcccttggacaggtctccactcacgacggctactccttagcttttcctaaaagtccccaggtctcagctttgttctcaggactctagtgtgtaccaacacctagctcctttcctcaccagccccatctcagagttgtgggcatctctgtgccaagcctaccatcctgacacaacctccttcaacctcttcctgagtggctagcctcccagggtatcctaccctatccagtctcgacctattgattagtgatgcctgtggggagtctcagactggctggcactagcctggtggcatgtctgcctgcagtgagagcaagctcagatttgcagagctctgccaccaggccacacgtggttccacatgctgctggggacagggctctggtgtgctatttggctttttatttttaattaaacgtagggcttcagtttcactgctttggcctcactgtcaagatacatgctccagagtctgttattaccatacaaggatggtcccacgcccaactcactgccagggaattcactgtgtgccactttgtgaagttttgctcggtgccataccaccctggcttcagaaacactgattctagccatgctgggcaccctgtccagactcaggcagtcctatgccagcccttttccctagaccatggtgggccaagcacatgagtgtggagatcactttctaggggatactccagtttctgctgcatagctgggcttcagccctcatggatatctcctgtcccctggggtccatctgtcctggtcaggcagctgatggctctgttcctatgatcagaactctttctcctcctgttctccgcccaacttgaaacatctcgctctctgtgagctactcagtgcctctgctgtgtccatggcctcagtatccggggctgggctggcagatgccagatctgtatccttccaatggtccacccattaatgtatccttcctggcagcactgtgggtgacactgggtggtaccctccagtccctttgttccccaccctctctgtgctcctcagctcttccttacctgccccaccatgacaacctcaaaggacaggccttgccctttgacttcactccaagcttctctagggtcttatctcaagccagcaccagagctacatcttgggctatgagagccaggaccaaattcagctctggtctgcaccacctctggcactgacacttcaactcttttctcatgtgaggcctcggttttctcatcagtaaatagatagttatgatagggccacccttcaatagaacatgatggagctaacagttctgaagagcccagctctggctcccctgtgctgtctggagcctacgggccttgcgtctccaacctctccagaccgtgttcctgagcctgggacctgggctcagtccttgggtcactctgcccattgctgcagtgggctccctggtccccagagcagtgaggaacaacttgatattctcatgagacaggatgttaaacaagactaggctttcccctatccctcttctaaggaccagcaaggctcccacagtgccctatgcagtactagatccctgtactgagcctcttccaggaataaggactaagctggtgaatagaactggaccccatcaggagaagatgcccagtgtggtctaggagagggatggatggggggtaagcagccagactctgagcaaaggatgtgatgactgtacccttagcttcctctcacagaggtgaggatggactttccacccaaagagatcaggcaacatgaggacagggaccagagaaagaagccctctctaccagctcacatcaaccacagctagcattccgctctggggaaataggtcaccttcgagtttgtgcaatgtggagcttcggggatgatttttgatctcgtattttcatcagacaaaagaggaaagacacagttcatattgcaattcgccagcttggtttagggtcgctaaacacccaggcacaggtaatatgcccagggctgggtaatgtggtacacctctaggtgctaaattaacaaggtgggccaggatggtctcctgcaatccaccctggagctgcagtggttcctcctgtcatgtttagatcactaactgactcaggtcagcccttgtttggaagtcggcaggcctaggctcaaccccagccagctgtgcctgaggcctgctgccttttcaaagcacagtggtagctagttttgattatcaacctgacacagcatagaattacctgagaaggggatctcttctacattgggttggcctgtgggcatgtctgtgggaggctgtcttaactgcactgtgggcagcaccattccctaggcagagggtcctcaactgtgtcagaatggagaaactgagtagagcacaagcaaatgaacacatatgcattcactgttccctgctcttgtctgtggatgccatgtgaccacctgtgttacgttccttcctcccggagttgcttttatcacaacaaaatgaaactcagacaggtgttatctcctgatcacacagacacacatttctgggaccctgggatgggctggaatggaggcggggagcaatggaagaggccaccagaggcaatgagagagagccagtaggtaacagcccttgtatgtttttttgtttttttgtttttgtttttgtttttttacagctcaccatctcttcatggtcactgcctgccgggaccctgactatgggactctcatccaggagctgtgcctcagccgcttcaaggagaacatggagactattgggaagacgctatggtgtgactggggaaagaccatacagtgagtcctatcaggagagaaggaggctgggagacatgtcctctcctttacattggggcatcaggccactgggtctggggaaagccagagtctaaagggacaggatggagcggaaagggagtctcagtcattggcagatgtttatgacatgtgggtgggaggagctgtgtcttcgatggctgtccaggtagccatgggtgccaggggagcaggagatgaagggttcagattagatatccatatagcaaccaagtgtaggcacctggggatggttgagccctattcagtgtctgaaccctgagtgactgtcttgtgacagaagccaggccttcagggatctccctgctggttccttccatcctgctgtcaagccagagctccttcccaactctctgcccagcccaccctgctcaggcctcagaactgcttgggcaggctgtcactgaaggggtggcccacagctccaccaagggtggcacccactggacctttctcccatgagacctagtctttcaacccaaaggccctcccttcttcctaaggcagtgttttcttactgactcttaggctctagggacccacaacaggcttggaggttctccctggtagagcccttccaccagcaggagcaaggctcaaagcttagcctgtccaagacaaatgttctaggctttgtttctacttcattgtgaggggttgggagcatcatggagctacagagagtgggtgggtaaacgtgtgtgtgtgcacatgaatgtttgtgtgtctgtatatgtgtgtgtgttcatgtatgtgtgcatatgtgtgaatgtgtgtgcaagtgtatgtatgagtgtgtgtatgagtgtgtgtgtgtgtgtgtgtgtgtgtgtgtgtgtgtgtgtgtttgtgtgctgtcagcttcatctgaggttagagtgttacagaactcaggtctagaagctcaggtctcagacaaaaattgttcaagagaagagcattagagatgaagagagtctttgactcttagccatggaacagaaaatcagggaccagctccttcagcccagggagtcaggaaaggaatgtcaacaaagagagagactgatatgataaggggtggggatgctcatgtcatttctggaaaccagcaagttgttctagaaactcagataaccctgatgctgatgctgcctccaccgctgccaccgccactgcctcctcctcctcctctttcttctttaccttgactttcctagcttctagtcagggtagcctcaaaagggcagtcaacagccaggcaaatctcggttaagttcacgctgtaccatggcctggacaaaatgcttttcaaatgatctgcataccatccatgtgtagagctaaggggaaactgacccagcgttggaggcagcaaaggagacagatgcaatatgaaggcagagaagccaagcctcctttccagacccagacccttgacatctacaggtcatgggaagtcagtgttgtcatcagaagcccctcgtgtccctgggaagtcacctaggcagcagttaccaccaacacagcagagcagccatctttagctgagctcaggggaattgtgtagtctccaaactgtacatctagccagttacaagccagggaagctcagaggtctatctagacttttctctgatagcacaaggaagagattcacagtgaatggactgtgacccagctctgatgagctgcctggtgtctgaatggattttaaggttgactgaggaacagttcacagaatgaggttttcctccatcaccacgcacagcacatagtaggtgtgcagacttgatgccctctgataaccggcactttcttctagtgccagagagaaatgagagggagtcctggggactcatggtggagaagaggaagaggacaggaaggttcccttgggaggatctccacagggcaaaggggaagccagtatcattcacaaagagcgtgcgtggtgatgttccaaggcacagggctcgcctgggctcctgctgaaggtcgggcgcgtcctgtgggacgataaagctctcgtgtgagcaccagaagctccctgggagagggtgaggcccacttttcctcgtgagcttgggttcagacttacctcacccctcaggcccctcttccccttctctcttgctaagtgaggtcagtggccttgtccttccctgccctctgggggaagagcctttgccacagcagagtctatggtccccacacacttgttggagacagtctttaaaatgaaaaaattatttttatttatttatttatttatttatttatttattgctgtgataaaataacctgacaaaaaagcaacttggggagagaggggcttattctgcttacagttccaggttacagggatcactacgggaagttaaggtaggaatgtcacatcttagccctgtcagatccagtcagagtggggagaaatggacacatccatgctcacttgcttgcttgtgctcgactcaattttttccactcatacaattcaggacctcctgcctagagaataatgccactcacagtgggcggggtcttcctgcatcaattaacaacctagataatgccccctgcccacccccacacacacttcatccaacttgatctggacaaggcctcagttaagactctgttcccaggtgattctaggttgtgtgaggctgacagttaaaaccaatcatcatgggggctggagagatggctcagcagttaagaagtcctgagttcagttcccagcaaccacatggtggctcacaaccgtctgtaatagggtctggtgccctcttctggtgtgtctgaagagagcaatggtggtgaacccatatgcataaaataaataaatcaacctttaaaaaaacaacaacaagcaatcatcacagtacaaaatgcctgaacccctgcacgcgcccccagacaaaccgcacagggtacagtggggccaggcggggttctcatccaacctctccttactctgccctaccgagctgctcggagacatctggcctcctctgctaagctgaggaatgaatcagaagttggaaaaggagaaggaacaggttgttaaaatcagaacagcctgttcttagggctaattggctttcagcctcagctgagcagtttgtatttaaatgcaagtttcatttattaggatccagggaagacacagtagggccctgagggaaagcacgcactgcctgcccccgtagctcagtgactgctcgcctgtgcagaatgacagcaaggtgacgattggcaggatggcaggcatggacagggcggcacaaggatgctctgaagaacaagagaccatgggctgtagatgtgaaaggaggaatggttagcatcaggccgaggagaggtgaccacggtcagagcctccgggttgcacagcagggagggtccacatcgtggcagcacctcagcaggtcatctccggcctacaagctccaggtctatgccctagtcacatcgctgccttcctctctgggtcctgtgagcctgctgcattccgtggtgatagggagttaaattgcaggtggaactgaagacacgagcctggcggccataatgtggagagcacatcctggattacccaagtggacaagattaatccagagctccccgagttcgttcaggtccttgcattgcaggactttcaaattggcctttgctctttgacacagttggtcctcatctgagcacttccttgacttcccacatttatcttttaagtcccaggctgggaatcagccacttcttcaatgaggccccattgcttctatcagggtaggaaatttaggaactcggatatgcatattagagtctagacatatacaaccccatattatgcacatgcatacatacatgtgtgtacacattcaggcactggattatatggaaccagtataaccacacagagttagaaaaaaaaaaacatgggtagcccctctttatagggactttaagaactggcttatgaggctggagagttggctcagtgggtaaaagcacttgctgggcaagtattaggacctgattttggatttccaggacctctctaacacacatacacatacacacacacacacacacacacacacacacagagagagagagagagagagagagagagagagatctgtacacacctataaccacagtggtgaaagaaacagagacagggaacttgctagggtttgctggctactggcttagctgttggaaaaagcaggctcagaactggagggcttgagagatggtatgtggttaaaagcacttgttcttcttgaggtttcagacgcaccacatccactcagagctgcctgtaatttaattccagcctcaggggatctgacaccttttttggcctcctcagagacccatacacatgtgtcacatgcacacatgaaagaattggccttcacagttggagaatttggcagactctgcgggacaggcagcagactgagaatctaatcaatagggcttgcatatcagtgaattcttaagtctcaggattgaatttcttcccatggacccggtaaggcccattcacctcccattctcttgatggtgtatgctacacactctctccaatttcccccaacagtatccagactaatgtttgattttctaaatgggtcccaggcctggctgtgtggatacactgggtgaagttagagctctctcctgccctccacccttttcctcattctctattcccactcacttcctctggtgaatgtctcattgcccagcaacatgcattaaaaaaaaaaaaacacacacaaaaacaaaaaaaacaaaaaaaaaaaccctcagatttgtcactcttcctcatgtctgagttcaacactagcttttctttgagcttctatagtcctgctgggttgcagctgcacccatgcaaggttggagcacatccctacatataggaagaaggaatcaaattgtatcttttccctgattgtttcacttattacgaagtctgtcctccaccctaaccctttcgaggacacagagactggactgggagaattgggataatttcaaaccagccagatttgatttttgcatgctcatggtatgcagcaattttgagttttgttttttgatattctgtaatccaagctgacatggaacatcctacataggcctggctggccttgaacttgtgcccatcctctcagctctgccctgagtgctgcaatggagtacctagcaaggtgtgtaacaaaggcacccgagagcctggtcctcacactggcccaggactccacagccgctctccatgttgactgtgaccccccacagctctgcttctcatctgttttctcctggggtggggatctgtcaggatgcttgttggaagagaggctcaagattacccagagtccttgagggcagcacagggcatctctgggtcagcagcacccagcaagaacctgcaaagtgcatgacctcgccgtgtgctgggctgaaacctgtcattactagagttatctcattaaaccacagtcctggtctgctaatggaaatataatgtcatctggtgtattaactaggaatctttatctaactgcggaaggtagaaagaacatggaaaaaagtgtcatgggaaactccctaccacctcactgcaggtattgggagagagagggaaggcaaaaaaccacagaaggatctggaagtttccagatccagctagaagtagattctttgtttcttttcagcctactttaaaatttttatttttcattagtattgtgtgtggagcaaatatgccacaacccatttatagaggtcagaggtcaactttctggagttggttctctctttctacctttcaggtcccagtaattgagctcaggtcatcaggcttggtagcaagtaccttcacccactgagccagcttgtcggccctaacctaatttttaaactagtacataaaaacatacagggattggacacaccagatgggcaccgtgtgacactggatatacatgcactttgtgtaaagtttaaagtcaggttaaacatcctgttacaaacatttatccttacagcttaccactcctccctctctttaaacagtactgtgggtactactctctctgtgtctctctctgtctctctgtctgtctgtctctgtctcttgtctctctctgcaacctcaggccagctttctttgtttctctcagttacttaaccccaacctctccccattcctccctgccctgtctgcccactattcgatcacgagcctctgttctcatctgtcttattggccagtatgtttgatcctatgtatgtgtgacgtcatgtgtttctctctctgtgcctggcttccctcacttaagaattcatttctgtccctgtcaaaaatgggcagtgcttacttcttcctgatggctgaatagcgtccagttgtgtgtgtgtgtgtgatgttgcatttatacagtcatccaatgatggacagttagcctctctctgcttctcatctgctgtgatcagtgtttcagagaatgcatgagcacaggtgaacctcatttctatataactaagaaatagaacaactggactgtatggtactgttgtcaattttttcaaagaaactggctggtttcccacttcacgagaaatactaagttggtgtcctattttgctttctattgctataataaagagcaaaaccaaaaacaacccagagaggaaagagtttatttcagtttatagcatacagtccatcatccagggaagttaggacaggaactcaaccaagtccaaaacctggaagcaggaactgaagcaagggccatggcagattggttggccctctcgtggctttctcagtttgctttcttatgcctcctaggtcctcctgcccaggttggcaccacccacgatggcctgggtcccctatcaatcactaatcaagagaattccccccacaggcttgcccatgggcagatctgatggagacgttttctcagttaaggttctgtcttcccagatgacctagtttcaaactgacaaaagagccaagcagcacagttggcttacagcttcaggctctgagatgtcaatttaggcaggagaaagatgttaaagacagacagacgccaatctagacacaggctccatctgcccctacctcctagtatcttacactgtcctgaattccaggggcccagtcctctaaggacttgtcaggatctgtgaggctgaggatccaaggctgcttcccagggctgtagctttaacttgctgacctcagtctgagccatgaagactctctgaggagctgtggagttataggtagggcttcctgggaccccaggagtaaaggtggccatgccattggttaaccaaaggacaaatgtctaagacctgccgtgcaaagttacccagaatcctgtgatccgagtaggaactaccatatctatttaaaataattgatttaggcagggtgcgatgacccctttgtcttgattaggcctaatggctgccctgctatggctggaacacacagcctcctttgtgtgtccagggcaagagttgaggcaagaaactctctcagcttctagtggtctggaggaggtgcctatgtttggaagttcaacaggaatcgagagcaaaagctgcttcttagatttccaaaggttctaaaatagtaggcaggcacaagcatctcccggtgcatatttgcttgcctgcttcacagaatagtggggtatactttccccctacactctatagggcagccatgttgccatgagcctggcacaggaggcaacctattggcctgtatccccctaccctgccactgtggggctacctcatttaccatgggggtgtacccacagaggcacccaccctggaacttgacatgtaccaagtgagtcctgaggtcacacttgtcgagagcctggtggctatggggctggtgacctcaagtgtgatggtaggaaactggaagggctttctggcctagtagggccaatggctgggtacccttggaggtcaagtgtttcaggttctaaagtaggcactgcatgggccaaggcaactccctgcccaccaccatacactcttacttccctttagcaagcaaaggtcatggaaaaacccttacctgcctccaaggtgacagctgtagaaatagctggtggcgtggtacagagcataaaccgctagtaccaagctgaggtacaactgctcacagtctgcccacccagagccatcttagcaactgctgctctctgtattccacacactgaaggaactgtcttcattttgagagtttgcaggaagcagtttcgggctgcaatggcatttcagttgggatcagctagctgcacactgaatgcctgccccaaggtgagtcccatcaaagattctcagagccaaaggtctgtggagccagcctgcttggataggtgggcaggggcaggggggagggggagtagagcgggctatttccttccttcacccccagggaggttattgaagggggtggtgacagccattcctttatgtccaatagccactgcatcgtttttttggttttttttgtttgtttgtttttgttttttgttttttttttactcccctttgtcccaattcctgggcatcttccttttgggggatacaggtaggggagcagcaccccaaggcatggtggccaaggcatggtggccattcccgtgggctgttgtcatttccacttgccttgttttaaaacctcagaggcaggatgctgccatagaatgtgttcaaaagtaaaagttcagacctgggacaccacaacagtccctaccacgtggaaggcaagcaggtggaatgtatccagtgatgtaactggataccacttccctgtggacacattgtttcctggccctggccctggccctggcccagaacgctcctgaaccatccaggctgtgcagactgaaacagccaggtgcccacactgggcttctgagagccttctccagggctgccttctgaggctctgtggtgagcgagacgaacacatacacctggtgccgcatcttgtgtgttgtgggggatagctgggtgggcggaggtcatagctagtgtccctccacgtgctctgtcactccaaccatcctcaggccagaattcaaaatcaactcaaatctccccacttcatccattacttggtgggcctttctcaggggcaggcagcatggagccttagtaatcctctgtgggcggtgctcagtgtggcaccacagagcaacaaccttccctgggtatattttgaagcttcatttttctcttaaggaacttttgggacctaagcacttcacccagtgagcgccggtccctgcgccgggcagctccattttctggacataacaatgggtattagagtctccaattctaatacatttaagaatcattttctgtcttacttttctatcagggatctgcatgcgcactcccgctctgttctgggcctgccacggtgtgacctggtattgtcaaggctaccgcctaactctcatcacagaatctcgttggcttcagcttctggtgatgcttagtctcctactgacattggcaggcgacatttcagctcggctgctggctgctggctctctgatggtcctctgtgttcctgttgtcagtatttctcctgcacgattgctgggattcacctccatggtggatggcaatgggtctcctttcaaaggcacctatggggaaagggatgcattctttgctccctcagacactccaccttttgtcttcttaggtgttccccctctttctatactgtttccccctattgttgagatataatatgttttctcttcttaagtgagactgtaatattggtaagctatttttcacccagccaacccagatgtgtgaaacacacacatttgtatccttgtgtttattttcttgacaatccatacaagttgtgtccctctccacaaaagcagcaatttctgattccaacccttctccctcccttcctctctccctacatctctcttcccctcccactcactcctcaccacctgcagttttatgttttaaaatccgcccctccctcagtcttctctatttggtttgactgttttactgtgtctctcttggacagtcatatcatcgagttggcagctcatcctagcaaccctggctctgatctggcttttgttcgctttgcagatgggttgttaatttacaagtgtcttattatttttttaacaccctcattcccttcagtacagattctaaaaattcaatctattattagaaataagctgtgcatttaagacattcacagaattcagattgcctaaggtgcttcctgccaccttcacgtgacagcttggcagggtaacaagtttgcatgttccctgaagttccactccctgggttccattgtttttggtgtcaatgttaggtgagaagatggagcaattacagttgattgactggctggttgatggatatgtggctggaagtctgactttcagcttaaagtgttgatgaaaccttatgatggtggcttcccttcaactatgtggacatcagcctgtgtagcaactcttaggtctggtctttgaaggatggatagtgtcctcacactgtcagtcatggactctgcaaatctaacaccttcttccacctcttgctctttgcaaggactgtgtcccacccatcctttgaccacatttacacccttttttactcctggccgctacaccctctctctggctgcattcttctagaaggtctgtttttacttctggcctttcactttgtaaaaaacatttcctggttggatgttgcagtgactgtcagctgacaccatggtgccaggagctaacctttgccactccctaggtctgaggataatttccctcagcagaccagagtgctaccattgctgtcacatggaaccaggcctggccacctggagcactgacacagtggaagttctgcctggcctttatgactccacgatccaaggggtggcagcatttcaaaagactccttcctgagacacagccaagtggaaggtgcaagcagagcctggtgcctgcatcgaggccaattgtggataaagaacatggatgggcacctgagtccccttctgcagctggccctgggtgggagtaaaccccccaagccagatgagtctgaggctctgtaggttttggtatatagcagctcttctatgacccaggcttacaaccaggatggttttgaataaaggagatattccttgaagctgttggcttctcccttccagtggggacagtagctgccacaccgtgcctaacatgttcaaagactgaacagacctttgcaggagctgaggtcccagtgtggcatggctattatcccgtttggagagggtatccgttgacaagttagttaagggtctaagtatttgagagaaggctttaagacaagtgattgactctgctcagtagttatttgctgggaatgtgacaggcacgaggccagtggtgctgaccaccaaggactaagcaggacagggccttctttgccctcctagagctgtatccccttaaaggaacccatgttcttccttggggtctaacccaatagcaggtaggaatggacatcactcctaaccagcatccagcatgccaccagcctcctgcctggaacaatgtcaagacaggaagttaaagtacacagagaagccatggccactgtcccttcttcagggagcttcaacttcaagtcccttcctatttctctcaggcataacttcctccctgtctcatgtcccagatttcaaccagagtcaaggacagtccctccatccatccagttagtaaggcttcctgcagtgacagcgagcaccgggaggttcctgcctcaatgcttcccattctcgctatagatcgacaactcttgatgcacatcctgtcccatgtccttcacactggtctggcatcttacacacctgacaatggtcgcttcttacatctgtggtggccaattcggtgccaagtcctgggacaaatgatctcacctgctggcatgtctcagtgaccctcgaattagcaagaggcagaaggctgcgtcacaagtagcattcaggggcattcccaggaagcagggatcctcagtggaggttgtcagtacaagctgctggcaaccacctggacccacttaaagctgcaaatatggaggctttgtgaacagtaacttgctattgcaaagtcgcattgagagtggacattacaggagtagaatgttccagatccttcccttctctagtcccttgaaagaggttgggctaggacaggagggccatatgtggtacagtgagttggtaacctgtgtgatgagttgtcccatgcaggggtacagcagggaggacagctcaaggacacattcaggaagcccggcagataggccctgtaagtctgctggctgctattagagtcacagtttcttgggaagaaagggatggggagaggcaagctttggatagctgcctggaagctggggtggagggtagactggaggagacagccccctccttccagctaccatcgcgtgctttgtaaggacaacagcaaccctgggatggcagcatccaaatatagcatcccggctgtcatgcctaatcccaggcttggacaaaggcatgtccccaagagtgtgggagcggttgggccttaccctgtctgcgtataccctaccctcactaagctggagtcaaggtcagcgtctcttggctacacagagggtccccatgagagggtccctggagatctctggtagatcacaatccacatgttccctgtgcctcagtagtcagccactgtgccctgtgtcctcagcccccagggctgggctcactgacatagaacaagcccccgtccagaccctgatgccagcactagcaaaaaattctgtgactttgcctcggatgcttgctgaatgttaacactgcctcatctcaaagccccaggagctggtgcctgaccaggcctgttctcagaagtggcattgtgcccaccctcctggtggggcctctccgtggggagctggcttggcagcgatgggttgcatctgtgccagagccagctgcatgtggggccagtgatggatttagaaacttctcttcctcccagcctggcagaggtgcccagacttctctctggcccggaacctgaagagtgggaatggtggagaaaggaggacagagggacacagtgccaggacagaggagacttctcaggagagagaggaaggagctgcagggatgggagatgaaaagtcttctggctcatccagctctgcactcgccctctgtgatctctctataggattcctcaccaagtaccctggtctgtggagggaacacatatgcccactgtcacaaggctagcccactgtgatagcagggtaccatggtttcctgccctctgaaaagcaagcaagccttcagccatcttaggcttatcatgcgtgcacaagccagccataagagactgtaacctaaagcctcatttcatatgcctttagttaacatgagatgtctatggattccaagtggtggggacttggcctgacctgtcttggtctcagtagcccccctggatcctgacatctgccttgttccacattcccccattgccatggaacctgcttctctgcaggctggtcttagctatggaagtctgagaggtcatcaaggttcaggagaggagcaaatatttaagctacgaccagccattagccagaggagccccaggcctgggtttgggctggagtgtgtggcattattgtaccccactctcctacaagctcggtctcaatccccagaaatgttaagaacaaattgcaggctctctggactgtagcagtccccttggctgggcatttctctctctgggagcagtggaggctgtcctgggctctgctcggtggcactccctcttagctctgggaccattatcccagatggccatgtaggagtggggattccatcacagctcagcagtcatgcagatgacatcacttgtggagatggataacagcaaactctgttaaccgagcaagaccagggccctgtgaagaagagggatacccttctccaagcaatgtggcccacagatgtgtcaaactacccctctgagaaacacattcccgatgtctcctcacctccaccccccaccctcagatcttccttctcctgggatcaaagagagagtcccagctctgactgtacagggtgtggactgcatttcccataggttggtgagttgaggactcaccactgcagaccaggtgctcacacagaaaccaggcttccccagggatcctctgcctaggtctgaaggctgtagtgagtggtgccctctggtgggcactggaatctcagctgccatttttatcattgttctctgggcctctgagtgcttgcatgcattgggcatccacaatgcagcagggagtctccttcttgccacccagatcctcccagaattccttctcccatctttgttccaatttttggctttgagaagagagaagagatgcccagtggtggtcagcgagtgtcgtgtgtgcacacgagtgagggaagtgacttgagactgcagaggtactataccaggcctgtagtgctgtcgctggttgctgaccccagggtcttggcaacctcacccgtgctgccatgtcttgaacaacacccttgtactgcctgggaaatggctttgctccaaagtcaggagctctggacaacatcatcttaaaatactcatttgccagccacatggttaatggaagtcgcaggctggcagagtatagagacttcttaacactcagctcccctctgcatggcacagcacagccagggatcacttgtggagtgtccttcttttccctccccccactgcacatcccacaccactccgtgcgactatcagagagacacagctggctcagatcccactggcgctgcccacgcttccctagcctaggaaagtgtcaaagtgctttagtccaacaactagcaaggctccctcatacatctcccagaacccagggaaaggtgccctggtgtctgctgcctcctacagcactgggcatctccctggcttgtctgaataccaccaataagctgggtgggctgctttttcctgcactggagtggagaccttctgtgcagactgactgcccgggtagccctagctgttcactcaatgtctgactgtgctggactgagcaagactttctgcagtccaggcagcagcctctgcccatggcagaaagtccctgccatctgttttggggatcttgagttctgccaccaaaggcagcaatcactgccctgaaggccccttcctggctgatgggatggtttcaggccccacaaggaatggaagcatgtgcttgctgagggaaagggcctcttcatgagagaggaggtttcagaactagctgtgtgctaggatggtgtacatgcccaggagggaggattgtgagtttgatgccagcctggactacataataagactctgtctcagaataatgataagtaggggaagaaggaggaggagggaaagaagtgactttttatcaaaagcttttcaatatcaaatggtattttctcccttgacaggttgaagtgtggttttatgacagactttaatgtgttctgtacagctagatgaagcttgtgggcactttgcggaggccttctgtgcctctccttcctacctaccttccttctctttctctctttctctctctctttctttctttctttctttctttctttctttctttctttctttctttcttccttcctttcctttcctttcctttcctctctctttctctctctctctctctctctctctttctttctttctttctttctttcttaggcaaggtctcataaagaagactgacttgcagagatatatttgccctgtatctggacgctgggattaaaggcgtgcagccctatgcacagggcactgtatattatttacatgttaatttgctgctctaacttacttactggttttatagttgatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccaacccccaacacacacacatacaccacacacacatacaccacacacacacacacaccacacacatacacacataccacacacatataaacacacacacatacacaccacacacatacacacaccacacacacatacacacacaccacatacatacacaccacacacacacatacacacacaccacacacatacacaactcacatacacacatacacaccacacacacatacacacacacacacacacacacacacagggatttctgggccatggtgctataaatgcccttctgcctgtgtttgttccgcactgcattgtgctgccctgcagcagcctccaggcctgctcgcctgcatgccaggacctctgctttccctcccctctgctttgatggtgactgttctgaacaggctaactaggatcaggtcccagcagtacaacagggaaaggagagctaagatatccaaagtggatcagagcccatttgtaagtgagggtcagagcggtccacctcctacctacaggaccctgccatgccccatcccagacagccctagtccctacaatgcccaagaggccacagtgacctccaggaaataggaaggcggctgtcccatgtggtatgccactgcccactttctgctgtcccagaaatgaggcactgattagaaatacagtggcctctgctgtagttttcttcctaaaataaacttccacgcaaccatgaaaataatgtatattaagtgcagagaagcacagcctactgtccctgcattgggaacagcccctgaaggatggctctcctacaggggcactccaccagatctgcaggctttaggctgccatgtggaccaacccacttgctttgttcagcatcttcatggaaagatgtgcctgcctgcacctgcaccctagaattctttctgaaagttgacttcttagtagaggtccctccaagtgcctttcccatgtgctggtttctgactttcatcatcttgacctcagtgtgcacctcctcttgctgcctttgtccacatttcatacattttgttttgttgtgagatagagtctcaggtaggccaagctggcctcaaactcagtacgtagccaaggatgactttgaactcatgatcctcctgtctgcgtcccaagtgctgggattacaggcatggaccacacagatcggtttatgcaatactgggagtggaacccatgccttgtgacttttttttttttttttttttttgaaggcaggctattcctaggtagtatagtatggctttgaacttgtgatcctccttccttggcctcttgagtattgggattgcaggcaaccctccatacctagcttcctttgtttctgcataagtttctgcccaagagcatttctgatgtgctcaccaattatttctatttgcagaagaaatacatagttggccagccacagacctctctgtctgcatgtttgtttgctggcttccccacccactccatcaacccgtgtcagctggcatctcaccaggatcttgaggctagccccaagtgggtcagctgggggtgggacagcatcctgtctcaacagtgttagaagctgctagagcttccaagctgtgaccatgctggggatgggaggcaaaggcaaatgccaaggcagtgaaccaaaccccagggtttctccttggagtttctgaggaattagatgccccttgttagtcagacttgacagaagtttataggacacaaagcacacagtgagcctcacactagtggtcgtcagagaagaggcaaggagaaaatttgtggctttgaggggcccgttccgtctgtccctttacttcatttaattagtctgtccagtcatttggggagggggccgatcctctttctaagatgaggttaccaacacatggccatgtgagatgaagtccttatggttgcttgagagaagagaggaagctgggactcaaacccagatgatgtgtgccaggacacaggctcagatactcgttgttaggggaagttggggccagaagggggaacaactgcaacctcaagttatccccagaggagcagcctcactgtgtgcatcagtgcgctgccacgtaccgaggagcccagagccatgcatgactcgagatccaggcgtttggaaaactcccactgaagtgttctgggacattccaagcaaagtttgcttagaaacccagaatagcaagtcctaacctaaaaaggataattattcagttacatgagaactgaaaattagtgagttagagccagggcacgctttctaactattttgggtcctctggctatctctgtgttcttttagcagaggcatgtccaacctctaaggggaatccttttatctcatccgaactgacagagcatgcacaattgttactgaaaacctcagctgtcacttctgcctaaacaaacgggatccagtgggcagccatccctgcaccacagatatttttaggcataggtggcttcaatcaaaaatagagtcctggtcccagaatagcaggctacacactcagccccagacagccgtagagtgtaatctgtggtgacctggcttccagaatcagggactctgaactgttctggttatctgagagagagagaaggcatcttctgccagagacattcccaggctacagaagacattgttctgggtgctctgtcatcaaaaccatctctgggtttgggttgagaaggatagtctacaccaccagtgctcagttaaccagtgtcaactgcaaatgtggcctttgactttaaagaacacatttagtccttgctgtgttggatctcatgatgagatccaggctgtctcaacttcttacagcttttcccacgtgtgttttctaacggaaccttggatcttttgcttactcagaccatgcaccccagggccagtgagcgggggagagggttgtccactctctccttccctgtgtctcatccgaattaccactgatgtgggctgaaagatctggacagggtgcctgacacaaaggcagctgagggtgggggaggcctgtggcaaactggactagcaatttaaagatctcatgatacacttgggcggaggaatgcctggatttggaaagcctccacttttgaccaaaaaaaaaaaaaaaaaaaaaaaaagccttttagatgccctgagggtctcctcagggctgatatctggcctttgctccattgatagactttctagattaaagtaagaaaagatagttttaatctcttcgccaccattttggggcttttcccttttctgtatggatccagagtcctccttggtctatcttctgattgaagaactttctttaaccttctttaaagtgcaggcctgctgactctctgagctgcttttgttgtttaaaatgaaaatgaagaagcccctatttttatccccatatttaaaggatgttgagtgctggcttctaggctgccagcagtgggacttccttggcctgtggtctctggcttgcccaaccttggagggaagtcagcactagttcccatgggcatcctgagccctctgtgtgtttttatgactgagactctccattatttaggctttaatgtgtgtttggtagtctctgtgtatttgttggttgctgctgctttgtttctaatccttcttggggttctctgaccctgagtgtttttatttaacgtctttcattaaattggggcaagtctcaggccattatcttttcaaatatctcttctgctgcatccctctcccgcttctgggagtgatggataagttggagtttattgcacgtgatggtagaacgtgcccacagctctcagagccctctgcaatgccttcctttcatttcctcggtctttcagtttgtgtaagttctcctatcttgacctccacctcaccgacccctccacctgccatgcagtgcagcaaaagaatggccttttaaagatgagatttgtttattttattttatatgactgttttccctgcgtgcatgcatgcatgcatgcatatgtatgcctggtgccccaatcaataaggatactgagctaccatgtgggtgatgggaattgaatcccagtcctctgaaaatgcaacgagggctcaaaagtatgctctttgatgctttctaatcccagtagcctctcttgctatagcttcctcttccacctcctgccgtcctcctcctgtttctccccccatcctgttttaaggcaggccctccctttgtgttctaggctgagctgagactctagattctcctttctttgctttgtaagttctgggatgacaaggctgtgcgccacacccagacccttttgactctctaggcttcgagccccattgaagcccccccatctgtttatgtataatcctttcctttcttggtagaccggacattgtcattttaaagcccccgtctagccttaccacgacgaaaccctaaggtaggctagttaccccatagtttcagaggttgtgacaaggaaccagtggcacacagcaatggtagggtatgttcagaagcacgagctgccatcgccagagagaaagccagagaggctgggggaccagttcaggctctcaggagaccaccctgatccctgacctgagccgacgccacaggttagctccccacctcccagaggttagttccagctctaaatagctctataccccatcatgacctgatagtcacagactaggtcatcatcttttggttcttgctgttttcgggcagagttttactattttcaactcactaatgggctttcaggtgtgtcagaggccaactaaaaagaatctgcatatagaagcaggcaggcctcctctggcagtcggctaggtggggttccagtcaatctgtcaagagttgagatgggttaaggattttctgttgctgtggtcagtgtcccacagactttagattccccctgcagacaactgtcattgctgtgttcaggaaacaggcccagaaagacagtcccccagtctccaactatcccctattgtcctgtggagatgctacacaaacatctactcaccccagataggaaaacaacagaccaaagtagggctctctccaaactccagtgatggtggtggggagtttactggggttacatgcaggaatccgggagaagggtcacttcatgagcgtagatgactcagaggcagctgcattacccaaagcccacccagagtcggcgctgactcacgaaggctgcaccttggagcatgactcagaagcagcctgacaggtcagggagagacttctagacaggctagatgatctaagcctgagctaagtgtcctcagcggctttatagtgtatgtaagctaggggacagagggacctagtgtgtctggacggtttcaaggacttcctgagtcctaattagcctgtctttagaacttcctctatctatctatctatctatctatctatctatctatctacctatccatccatctatatcttatctatatcatctatatctacatgtacatctacatctatagctctatctatctatctatctatctatctatctcttttgagaaagagtctcactgtgttgctggccctggctggcctcaaacttgcttttgaagaccaggctggccttgaactcacaaagatccacctgccttcctttttgcaaacttttctgctctttttttttttagatttattttatgtgtatgagtatttgccttcatgtgtgttggtgtaccatgtacatgcagtgctcatggaggtcagaaagggacataaggtcctctggaactatagttacgaatggctgtgagccacctcatgggtactgagacatgaacctgggtccctgacaagagcaacaagtactcttaaccgctgagccatcactccagccctgaacttcctgtgtctaatgggcttctagctttagaggaaattgttacgtaacacctgattgcctgtgtcaaggtgagaagttccccagctgtccatagcagctcagctgctgccagagtcactagggaatggggaaatctctgtccccatccagcctcagtttaaatgaacctgtgccctcagtcatggtatctccaacagtggttctctacacctcatgtctggggccaagaaactgaggtacagcagggtggctggcctttgcagagtttcctgaccactcatatgagaaaagcttctactaggcgtggtgcagggtgctatgcccataacaagagggcaatgccttcttagaattggaaacaatcatccatggaaggagttacagagacaaagtttggagctgagacaaaaggatggaccatctagagactgccatatccagggatccatcccataattagcctccaaacgatgacaccattgcatacactagcaagcgtttgttgcaaggaccgtaatatagctgtctcttgtgagactaggctggggcctagcaaacacataagtggatgctcacagtcaactattggatggatcacagggcccccaatggaggagctagagaaagtatccaaggagctaaagagatctgcaaccttgtaggtgcaacattatgaactaaccagtaccccggagctcttgactctagctgcatatgtatcaaaagatggcctagtcggccatcactggaaagagaggcccattggacaggcaaactttatatgccccagtacaggggaacgccagggccaaaaaaatgggaatgggtgggtagggaagtggggggtgnnnnnnnnnnnnnnnnnnnnattggaaatgtaattgaggaaaatacgtaattttaaaaaaaagagggcaatggctgctgctgctccaagaggacttgggaactgtgtggtgtggcgtgcctgtgccctgccctccccatccttatccagcatccagtggaacctttctcatgggaaactagcaagtcagcagccctgccagagttgcaggccccagcaatgccacacaggcacaaacttgggtgctatcagttgctacctggagctggtccccactttctctaagtagtcttctcttccttcacttggtctcagctctgtgctcactcatgaaattcaagtgacctggagctctatagcccaactccgatggatcccagcaagtgtgaggttttatggttgttcagtgagaaccggatgcttgcacttgtacacacactctctctctctctctctctctctctctgtgtgtgtgtgtgtgtgtgtgtgtgtgtgtttggtatatgcatgtgtacacatgtgaatacaggtacacttgcctgtgtttgcacatatggaggtcagaggtcaatagcacgtgtttttctctctcattctccacttcctagggtttctattgtggtgataaaaatactatgaccaaaagcaatttggagaggaaagggtttctttcagcttacagctcctcaggtcacacactcaggccatcactgagggaagtcagagccggcatttaaggcaggaactgaagcagagactgtggaggaatatctcttactggtgtaccctccatgcctgcacagcctgtttccttatacaagcgaggagcacctgcccagggctggcatctctctccacccgctgtggactgagcccacccatatcaaccatcaagaagatgtcctacagactttccaacaggggaatcttgatgacggcattttctcaattgaggttcctcttcccagataactctagcctgtgtcaagttgacaagaaaaagccaccaaccatgacagcacctaccaaaactagattagagtcctgtgtatacagtcactgacacacaaacagggtcccacagagccagtgagaataacacacacataaagtctatacacagctacagacaaggagtctcatacacttatggatgaagcgtgaggatcagctgcgccccaagccccactgggagccatgggttccattgctctctgtggactgtctccacagaagccacatgatatctctcacacactcactaaaccaaccaaccaaccaaccaaccaaccaatcaatcaatatgaaagaactccaaggactttgcctaagcaagcaggtctcccttagatcctggctcataacatctgcttcccccacatcccactgtcattgagtcctgtaggtgaccagctcatggggacctttaggtaagctgttaacaggagcatgaatggccacagggcttgtcagcttggtcctcagtcttatggcctaaggctctagctggcactgggcacctcaccttctgacagctggatttctgggactggtgtgagctatctagggtcctcacctgccagagccagaactctgccttgaggcctgagcttttagagtgggggagggaaaggactgctttgcctctgtccagacaaagctgagtcccagctgggtctcctgacaacctctctttgtatccacaggagctatggggagctcacttactgcaccaagcacgtggcgcacacgattggctgtttctggcccaatccggaagtggacagattcttcatcgctgtccaccatcgatacttcagcaagtgccccatctcgggcagggccctgcgggaccctcccaacagcatcctctgccctttcattgcgctccccattacggtcacgctgctcatgactgcactggtggtctggaggagcaagcgcacagagggcatcgtgtaggtatcccaggtgatgagggattggggaaccatgggcctagcccagcaacagcatcaggagcaggtcccaccttgcatcctgctctagcctagttagcacaggacttgagagtggctctgcattaagctgaatatgccctagccagaggcttctagcaggggagcaggggcctgcctctgcttacctctgagattgttctaagcaccaggtctctggtacacttcatcaccactgtgggcattctgaactccaaggaagactgcacagatgtgtttgtagatgcacagtttgtgattaaaagagtattcttaaacctgggaagtgttctgtctgggtacaaataacctatacaggaaatcaagccactcgtggagatctgtcttttgctgattggagtttatcgcagggtctctaaccagatgacacccagtcaaagatcccctgagtttgttgaggggttcccaaatgattctgatgcccttggcctctactgcatggtccctgctttctttttgcctttcttgggttttttgagacagggtttctccatgtagctctggctgtcctggaacctgctctgtaaaccaaactggacttggactcagagatcctcctgcctctgtctctcaggtgtgcaccaccactgactggcacagcccctgctcttagtacttggaaatagtcatgaattaacaactagcgagagagaatgcctaccgtgagccagaagcttcggctgagtagcacgtgaagagggtgctgtctctgtgtcccttccctaaaggtcaccctgtcttctctgagaaaccctagtgtataggacaagtgaaggccaagaggtgccagggatgtgacctcctcctccactcagcactgtcccttctgtccctgggaagccatggacagtagtgacagcattaatctgaaaaatagggttgagctatggcagcgtgtgcctggaatcaaagcactttggggtgttgaggtagaaggattgctgtgagtttgacgtcaacctgggatttataagcctgtttataaaaaaaagaaaatgagggggaagggtggggaagaatgaagaagagacagaggaaaaatgcaaaagaaaataagactgggctcatttgtgacctgaactggagaccagagaccagcctgccttcccggactttgacatggaaatccaaaggatgggaaaacaagacatgcataagtcacagaatccaaaagctgcaagagaaccagggagctgacttgggagatgaagctgacccagtgcctcgttcccggaactgcgcatactaacaagttctcagggtttccagtaaaccaagaaggctggggtttgaggtcatctgcagagcgtggccatcctgtgctcagctaagcagggggacaggcaagggagcagtgagcccaagacccctcacacatgacccctctcacaggatgactgcttgtacaccagccttccagggaagcctggtccgctgggagtggatctccatccattcctcaaaaatgagcattagcggtatcctcctgaaaacaagtcagaagtgtggagcagaagtcttgagtgtctgtttgcagtcatttctcttgtaggaactcatcccaagtacataattaccatgtgcacaagggcccgtggggaccaggagcggaagagaggagacaccctcgatggtccaactggaggactgctccatcagattaactccagatgatggaaggcaatggtttccttaatggcgtccttgagggtggggggggggttcccagtgtgtgcagttcattgaaaatgcagattttaaaacaggaaatcaaggtgacctttatgctgtgtttgtttacacacaaagttcctttccccaggccacattatattggggggacgtcctgtaatagggctctcagaagacagaacaacactctcagttctgcatctggctgccaccgtcccagtggatgggcatcacttcccggtgaagggtgatatggtcagaccccaactggctgttctagctgtgtgtacttgaacaactaattcagctctggtagccatgggggagatgacctggcatatgcaagccctctgccttatcccaaggatggtgtttgatctcctgaaagaccaagtggccagtcagaggagcctcatccttagggcaaggcaggaagcatgttcccaaggaaaaactagcagtgaccctctccctctttcccacctcaaggcagggctgctttgtgtagccctggctatcctggaactatcacacacacacacacacacacacacacacacacaccctttttttctcaagatagggtttcttagtcctgactgtcctagaactagctctgtggactaggctggccttgagctcacagagagatctgcctgcctctgtctcctgcatgtgaaacacatttaaaaaaaattcagaacttatgtgtttatgtgtttgagcatttggcctacacatatgtatgtgcaccataggccattggaggtcagagtaggtatcagatgttacagatggctgggagctgccatgtgggtgctgggaacttaacccaggttctctgcaggagcagtgagagtgtttaactgagccatctctctagctcggagaagcttttcttggggggttcacctgtgtggtgaacataagaagacctgcagcccatcatttttaaaactattcaaaacagcaaattccttatgggactaagcctagacgggctaaggggttgccgactttactctgtctattcacacgttagagacagaaagttccggagacaggcagctcgaaaagtgatcactcttcttgaacccacaccagccacacttcgtgcctagccacccaccgtgcaggactttctccaacacgctgtcaagagtctggggaaacttgttctccggtcacccctggcgttagggcaggaagtgggcagggtagctggatgtcaagggcaggtggcaactactgttcgtgttcagtacaggctgttatgatcatgtctgcattctacacatgcccatcccatctaaggcacagagacacgtggaactccatgtttaaaagggagaacaaggagatggctcagttagtcaagtgtcatgcaggcgtagagacctcagttcaaacccctgattccataataaaaacaaaacaaaacacaaagaggctgggaggtgcccactggtaatccctgtgcaggaaagaaagagacaggtgactctcttgggctcactggccagtgagccaacccaaaccaatgagacttccatgtgcatatctgtggcgtgtacaaaggcttctagcaaacagcctggatcgaatcagacgccagctgcagtgaggaggcaagccaatcaaatcagaggccagctcaccaggggagaagcaaaccaatcaaatcagaggccagctcacttctgccagtgggacagcaaaccagtggctccctgccccttggtttcctacctaccaagggatgactatgggccttacttcagtatttgcaaggagagcccttgacttgccccagcacttcacaaacgttctgttcactttggccacagggactcaactaggcacagggacctgtgaatggacaactgcaactgtgactgacaatgccccacgaccaccatacacgcacacacaaacacacacacacacacacacacaaacacacacacacacacacttctgcctctcgatatgtccttttctgttatccacaggctaagcggtgagtggctagagaacacttactggcggtaacagtaggaactaccaagtggacactttcttcccttctgcataagaccggaaacactccctggagctgcatcacctcacaggccccagcttgggagaaacttgctttctctcagttctccaggctggaagcctgacctccaggtgtcagaaggcttggctctccctctctgggcttgcagattccagtcatgggttagggcccacccagtgacattgcctggccataattacctctttaaagaccctccctttaagtggggatctgagatcctgggacttagggtctcagcatatgaatttgggttggggagtaggggggcggacaatttacccatggcaaaaccctgtctccccaacggccagctggctcactgcagccagttaaatcggttatgggccggtgtcacaaatctccatgaaaactaggggtaaacaactgtggccagaagtgctgcagagacatcattgcaagagggaacaaaaacctgcttctcatcaaagcccatcagcacacattcttgttaggaaacgccaggctcaattaggaaggcgggtggtggggagggtctccggggagactcctcggaaaattccagaacccgtcttcctggctttcattttgtctcattttcagaaaaacaggcagtgttcctctcctgctgccctgttcctgactagataacgtttcttgttcctgagctgataatgtttcttccctgccctccacgtagacacaaaacaacaacaaccacaaaaatacgagatgagggtgtagggaaaaaagagaaaattctttttctttacttaactgggtcagctgtcgggaaagcaggggttgggggcggagattgttcaggaatgtggagggggtctgtggatctggagcgggttggaggagacctgcaggcatgctattaggaagaaaagtggtctgtgggtcagcagtgaagaaggcacagtttcgattatccagggagagctgtggcctctgacccctctgctctgtcatcctcactcagaggccatatcggactcaataggatgactgaggcacagatgggcctgaagcacaggcttgggtgtcccggatcatgatggcagggtctggctctgaagcctgaactctccagccccaaaacaccattccttcgtgaacctgtgctgtgccttcctcttgggctcggcagggagtgaaggtgacatgtctggctgccccagctagggtgtctctaggggaccacagctgttaaagttttataaagcaggatgccttagcggggcccaagctgaggcatcacagccccccccccaaacgaggtatcagatctagtatataaggaagtttatttgggatgtgagaagggggtctggggaagggaggagagggagagaaagaaaggggagagagaaggacagaaagagagaggagaaagaaagaaggaaagaggccaatttagaatctcccattttgttgggagagagggtggagaggaagaggagaggggagagaaagggggaggggaagagacaagaaggaggcctaaaccttttatttatgagctagactcatacctaactgttgggcagatcctagaggaaatgctaacagcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttgaagccttgacccatagggaatggcactgttaggaggtgtggccttgtttaagtaggtgtggccttgttggagaaagtatgtcactgtgagggcaggctttgaggtctcctatgctcaagctgtgcccagtgtggtacacagtctctgtctgccttcagatcaagttgtagaactctcagctcctccagcaccatgtctgcctgcatgctgctatgcttcctgccacaatgataatggactaaacctctgaaactgtaaaccagacccagtgaagtgttttcatttttaagagcttccctggtcgtggtgtctcttccgtgcaatagaaaccctaaacgaagacagtcacaatgctccccaacaccgtgtaaagctggatgcaacgacgcccatctttaatcccagcagaaacaggaagagcctgaatgccagccagattagtgtacacagcatgaaacctgacctcaaacaaagtggaaggaaattgttctctgatgccacatgcaagctgttggacacacacacacacacacacatacatatacacacacacttaaagaaacccttttatttacaatggaaatattctacaaatggagcaaaagacaggtaaacaaacaacaaaacagaattcctagccttaattttcagcactcagataacgtttagcattcattttgatatatcaaggggagcagtggtggtatattcctttaatcccagcacttcggagacagaagcaggtggatctccgagtttgaggccagcctggtctagtgagtgagttccaggacagccagggctacacagagaaaccctgtcttggaaaaaaaattaaaaatatatatcattttttttcaaaggtgaccacagagtttttagaagttccagaagcaagggttttatcctttttgtttatattctgctatgatgggtatatatcattttttccagaagtgagcacagagcttttagaagccccagaggaagggttttaccctttttgtttatataatactccgatgagtacttccttatttgtgtccttaaaatgaatgtttagaaatagactggtgggtcaaggggatccttgccctctgagtaaacactgccaggtcccttaaaagtgcttgcatcacccacacgtcaccaatgtcaactagaactcctacttaacttaagcttttgcctaaaagggacaatggtttcttttctctagcaaacgagacaattaggtgagggaagacattctcagctgctgttctcatgcacatctggtggctgagtggtcaatctgtctcctgtggctactgaccataggaagtctcagtgaattactacatagattcttagcacaaacaagcccgtcttctctttaggagagggctccactcaccagctgaccgtgttcatgttatactcaaaattcagctttctttatattttgttgttgttgttgttgttgttgttgtttttaagaaggatttatttatttcattatatgtgagtacagtcactgtcttcagacatcccagaaaagagcattagatcccattacagatggttgagagccaccatatggttgctgggaattgaactcaggacctctggaagagcagccttaattgctaagccatctctccagcctgggtagttcgtttaaagaattttgcttttcttggaatttcatgagctatcctgttatgtaattttggtaagggtttactcagcttacacttccatgttgctgttcatcaccaaaggaagtcaggaatggaactcaagctggttaggaagcaggagctgatacagaggccaaggtgagatgttacttactggcttgcttcctctggcttgctcagcttgctttcttatagaacccaggactaccagcccagggataacaccatgcacaatgggcactctccacttgatcactaattgagaaaatgccttccaactggatctcatggaggcatttccttaagggaggctcctttctctgtaataactccagcctgtgtcaaattgacacacaaaaccagacagtacaactgaccccttgtcaacttgacacacaaacacgtcact

SEQ ID NO: 272 - DNA, 818 bp, Mus musculus
agcgggcgcagagctcggcaaggcgctgggacggtggggctctgcttgccatggccccgggcctgcggggcctcccgcggtgcggcctctggctgctgctggctcaccatctcttcatggtcactgcctgccgggaccctgactatgggactctcatccaggagctgtgcctcagccgcttcaaggagaacatggagactattgggaagacgctatggtgtgactggggaaagaccatacagagctatggggagctcacttactgcaccaagcacgtggcgcacacgattggctgtttctggcccaatccggaagtggacagattcttcatcgctgtccaccatcgatacttcagcaagtgccccatctcgggcagggccctgcgggaccctcccaacagcatcctctgccctttcattgcgctccccattacggtcacgctgctcatgactgcactggtggtctggaggagcaagcgcacagagggcatcgtgtaggtatcccaggtgatgagggattggggaaccatgggcctagcccagcaacagcatcaggagcaggtcccaccttgcatcctgctctagcctagttagcacaggacttgagagtggctctgcattaagctgaatatgccctagccagaggcttctagcaggggagcaggggcctgcctctgcttacctctgagattgttctaagcaccaggtctctggtacacttcatcaccactgtgggcattctgaactccaaggaagactgcacagatgtgtttgtagatgcacagtttgtgattaaaagagtattcttaaacctgggaa

SEQ ID NO: 273 - protein, 164 aa, Mus musculus
RAQSSARRWDGGALLAMAPGLRGLPRCGLWLLLAHHLFMVTACRDPDYGTLIQELCLSRFKENMETIGKTLWCDWGKTIQSYGELTYCTKHVAHTIGCFWPNPEVDRFFIAVHHRYFSKCPISGRALRDPPNSILCPFIALPITVTLLMTALVVWRSKRTEGIV

SEQ ID NO: 274 - DNA, 73145 bp, Homo sapiens
  misc_feature (1)...(73145): n = A,T,C or G
tcctattcagccatcttggaacctccatctggcattttccaagtataatttagcctaccagtgttgacatggaatatacatgaatggtaaggcaatatatcaaatgactggatttcaaatgtttcctcttttatgggatttataaaagaattgaatatatttgagaataaggttttatttcatatattaatttgtctccagttattatcagatccactcaaaatgtccaccaggaattgggttccaaaaagtaataataataataataataataataataataataatttaaaaggactatatttgatgaaacacaaaaatcattggctttagccatatatcaaattagtaaaatcctaattttactaattaaattactaattaaattttactaaaattatggatatttttcctgtatgttaattttatggttatttatattaaaaggctacattcagagcattgaataaagtagcaacatggaataggtgttattttcaacatacccatagaaataagaagcatacctctaatcatttgtttcccagaggaatgatgaagtggaattccattctagaatacatagagacaaaattactgcctttgatttggggaaaatatagaaagagtcacttgaaattctaattttcagcaccgggcatggtggctcacacctgtaatcccagcactttggggaggccgaggcaggtggatcacgaggtcaggaattcgagaccagcctggccaacatggtgaaacctcctctctactgaaaatacaaaaattagccgggcatggtggcatgcacctgtaatcccagctactttggagcctgaggcaggagaatcgcttgaacccgggaggcggaggttgcagtgagccgagatcttgccactgaactccagcctgggcaacagagtgagaccccatctcagcgtggtggaggtggggaggaaagtaattctaactgtctcacgtgtccgtgtgaagaggccaccaaataggctttgtgtgagcaacatggctgtttatttcacctgggtgcaggtgggctgagtctgaaaagagagtcagcaaagtgtggtggattatcattagttcttaaggttttgggataggtggtggagttaagagcaatgttttgtgggcaggtggtggatctcacaaagtacattctcaagggtggggagaattacaaagaaccttcttaaaggtgggggagattacaaagtacattgatcagttagcttggggcagaaataaatcacaatgctggaacgtcatcagttaaggctattttcacttcttttgtggatcttcagttgcttcaggccatctggatgtatacgtacaggtcactgggaatatgatggcttagcttgggctcagaggcctgacactaactttcaggttttttgaagtaaagtcctatccaaaagctaaaggtaaagatcaggcagctttcgtaaattaaagggctttcagctgtgaccagtaaattgctagctgttacgaagcttcccaagttaaatttagaaactagagttatttttcatgaatcttttggaacctcaagtgaaaaatctctgtttatcttattctgtaaaatctctaacttgatattagataattggataaaattattgtagaattttaaaagactggtcaaattgtcccaagttttcatagatcttcactagcaaaaatttagataatttaacatacattagtgctcaaaatcaattttctttcacactgttgtattagataccaaagagcacttagctatatcaactagaatatatagataattaatatgtttggagataaccagagatttggaaaattgtaaataccataagacaatcagcaaaaacagtggaactaaaaattcccaattggctctgcctgatgccaatctatactggtcagaggagatactatgtgtgactcagaagctcaatgtaacaggtaatttctcttttaaaaaatagatctcaaccagtaatctctatacatgggcttaagtactgctttttcagtattgacattgttatgtattatcaaatacatatgtggcacgtagtagtaacatattttaacgtgggcaggacagtgaccttctaaaatgtcctgttgtcatctggatcctgtgatgtgttgtacatgacaaagagaattaaggttgcagatgcaagtaagattgttaattagccgacttttgagattaggagcttatcctggattatctggccggactcaatctaattacatgagtccttaaaagtggtagaggaggcagaagagagaaccagagaaatggcattgtgagaactcaacacgctcctgctggctttgaagacagaatgaggggccgagagccagtggacagcccccggaagctggaaaaggtgggaaacaggggctccctagagcttccagaaggaatgcagctttgctgaaaccctgattttagtctagtgagatctgtgtcagacttctttttttgagacagagtcttgctctgtcactcaagctcgagtgcagtggcgcaatcttgcctcactgcaacctccacctcctgggttcaagcaattctcctgcctcagcctcctaagtagctgggattacaggcatccgccaccatactcggctaatttttttttgtattattattatttttgtttgagatggagtctcactctgatgcccaggctggagtgcagtggcacaatcttggctcactgcaacctccgcctcccgggctcaagcgattctcctgcctcagcctcccgagtagctaggactacaggcatgcaccaccacacccatttaatttttgtatttttagtagagatggggttttgccatgttggccaggctggtcttgaactcctgaggtgatccacctgccttggcctcccaaagtgctaggattacaggcatgaggcttttttttttttgtattttttagtacaaaaatacaaaacggggtttcaccacattggccaggctggtttcaaactcctgacctcaagtgatccgcctgcctcagcctcccaaagtgctaggattacaggcatgagccaccatgcccggcttggttcatctttaatatcagctatttaagagggtctgaagggctttctttaaagctttactgcacaggcctagagtgaagcatttaccacggtgtatggcgcagtcaaggtttgctgctgctgctggtggtagtgctgtcatctagcagtgtgtcatggtgcatctttgttagtaaccttaccctgactttgttgtaataatctgttgttttacttcattctttcttaatttatttttattcctcttctattaatgtctgtaacctgcttcagtatttattagaataaggcagaccataggttggcttgctagtcaggggacacgtgattgcaaataatagaaacataaactagcaaaagtacaagaaaatggaaatgaacgtacatagttgaatactccagaaatgaattcaggtgaagctggatatgctttcttctgggttggcatcaggctccgcacacataagggcaaagatggtcgctaacaggtttatctaatttatgtaattctctgagttactaattcgaggaaaaaaatcgtgtaactccagcaaaaccccggggaagactctgatgataggcctgggctccacaaacacccatgaagtgaagagtggccagagaacaggaaacctgattctccagtgagaagcagaataagcaggaggcatttttccctcattttataatacaaaggctttgttatacagactttaattatgtttgtatacataaacatatgccgatatatatgtatacctacattcacagtaaagtcactagctttggctttctaaatgcttccaacactgtcagatgcttcagatgtgaaggatttgtttatgcctctctcaaacactcacattaccctgagtaattaggaatggttccagtgttcactaagaattactgggaagtaggaacacaggcaatgttaagagttgggtatatgactgcttatttgaccttttaatttaggagtagttttattgctaatatattaggtatatacgatctttttatttagtctaaaatatagtctatataagtcttatataagtctaaaatagttttagacttacagaaaagttgcaaaaaataccataggaagttaatgtctgccattcattccacttcccctaatgttaacaactcctgtaaccatagtaaaattatcaaaactaagaaattaacactggtgcaatgctattaaccacaaatcttactcatttttaccaattttcttcctaatgttctttttctgttttaggatccgatccagtagcccacactgcatttagttattgtgctttcttcatcctccatccttcatctgtgacagttcctcagtattttcttgagtttcatgactattgtcatggtagtgaattgttttatcttgacatttgatgagtattaattggttattttgtagattacctcttaatttggatgtatctgatgttttctcatgattagattgagctatacgtttttatgagtaccacagaaataacgtctctttcttagcacatcatacctggggataatatcttttacaggtgatgttatccttgatcacttggttcaggtggcttctgctgggttcctgcactatgaggttaatggttttcctttgtaattgaaggagctctttgagagtacacaaatatgctgctcctgaaacatttggtcactggttctagtattcgtcaaatcttggctgaaacagttattcttgtggtgtttgcttaatgatgattttgtgtgtctctcatcccttctatatttattacttggaatttttctgtaaggaggagccacaccttgtcccctgtttattcagtgttttatatcagtatgcactcgatgtttattttgttctgtgcattacaatagtgttcttttcttacttcgttgctcacattattccagcattagccattaggagcttcttcaggttggggtctgtgtccttttgaaaaacccattcttttttaagtacttattttctggcatcacaggatatttttggctcatcttgtacattccctgccccagcactggactccaccacttcaacaagctgtttccttttattggagaatagtatttagaaacgaagacctggtcaggaggtttgcttgttgctgttggagttggtcttaggctctctcggtagatatagctgggaaatatgtgcgtgtgtattaatccaagcaaacagacacacttgtattttgtccctgtatttacagctagtcatcagcaccatatatctgtgtgtgttcatactgatactttgaatttctgtcccttatttctaccttataccaatagtgagaaaactggctcacgttattcacaatttatttatgtatttatttgctcaatcctactatacacgtaaagtcattacagcgttgctaaaccatggccctgtaagaaacagatttactaactggagtacgtcatttgtgtacagttcttttgtcttttgctcttttgtctaaatgtgcttaggttatgtcttttattcctgatccacccagggtggctatgttacacatttgtaatatagtctcctagaggttaggggttccttcagtttgtatgtctgacatttcatgtcccggttttctgcagtagctctagatggacttgtctcttgtttgtctctatggtattggggtattttaaatttttcacgtctagagtgttaagagttcgtctttctggagattgtttcatatcacccgtaggcctgttcatcagcctccctcttggctccacgatttttctcagtctgcctttgctcacactaagcatgtggctggctgagggtagtataggagtgtgagttgtgtagtgggatttggtgggaattttttccctgttactcagctcctttgcagttggaaaattctccaagtaatgctgaggacagttttatatagaatttatttttcacttcttgttttttgtttgttttgtttcttgggggaataggggagataggcaacttctgttctcagctacttgcaagtgttttggttttaacagtgggacttcctgcaggacttgaaaaattgatagttgatgaacctgagttccctgagatactgctgtttttgttagtgtttatccagcaattgcacgatttaaacaactcacagaactaagttgttattgcttataagcatgttatcttcagaaccactgattcattattgataatgattgaagttcagcctttaaattgcaggcctgatagtgaggacaccagtggagtcttccccttcatatcagcaagttattgaaaaactatctgtagaatatttgatgcttttttccttccagtacttaaaaacgttccattgtattctggtggcattatatcccatgagaactcttctgtcacccttacctgtgttttgtacatcagcagtccctagcctttttggcaccagggactggttttgtggaagacaatttttccatggggtgagagggggatggtttagggatgaaacggttccacctcagatcatcattctcataagaagtgcaacctagatcccttgcatgaacagttcacggtagggttagatcagctactgctgatctaacaagatgcggacctcagcttcactagctcacccgctgctcacctcctgctgtgaggccaggttcctaacaggccatgatctggtactcctgtggggttgggggacccctgctatacgtaatgtcttctctctctggctgcttttaaggttttctctttattactggctttaggcaatttgatcgtgatgtgctttcacatatttttctaaatgatttttgtgcttggagtttggggatgttcttggctcatgggttaatagaaaatgttccacatagtggtttttcacatatttcccacccatcttcctccaggggctccagttacaccttagagttgccacctggagttgcctcatggctctctgatgctttgttcttttattgtttttaagttacgggatgtaatagctacttggaaatcatttgctcctgttagttcttgcttttaagttttgttaggcagcaccagaatagcctttgtaatttttactgactacagagagggacttgcccttctaattatgctctgatgttctgtgtatttcaagatttttccactatggttggtgggaactggaactattcccagctgggtgtgggctcttaggctcttttcccttgggtagtgtccttagatgtgtgggctgagactcaagtgggaccctctgtgatctcgcaagcgcattctttgcgcagctctttcctctctggtactatgccctgccagcgttaactgcctggcttccccagactctctttgggtttcctttctccatctgtggtctgcaaactccaggcagtgagcagttgtagcactcaccttatttgtttccctgctctcaggggtccctgcacttcttgtggtccactgtgacaactgttgtttcatacattttgtccagttttttagtttaagatgggaaggtgagtccagtccctgtaacttcatctcggctggaagcaggaatcttatgttaatagtgaatttttagcagtgttgaccaggctttgattgtatctttagccctactgtgtatgcagtaaagcacttggccattttctaatctcttctattgtttaacctaatgcccctctagattgaggtaccctgggagaggaatgattttccatgctacctatgaccaattagaaatacagatacatcagactacaacttttgaagacgggaagcccatagtagttgctaaggaatgtcttacttagacccaaggtacagacaggaaaatcattaggagagaacatgcctctaggtgtgtgccttacttcagcattctccagagaactgtgaatttctaaagcatgtgaacttgagaaataggctttgtcttcttaggaaaatgtatcctttagggggtgttgagaaaacagcagtgacaggggcctctggccttgcctccttgcagtcaagcttcaaagagaaaacgttgggaagaaagactcctgctgagcctgatgaaagaggagtcccagttgccaaccaaaaacatgcagccaaagtccacaagctacaagtagaaagggtggctcaagccagagtccctggatatggagggcgagtgatggctgcagaaagatgcaggttcttctcccccactatgactggccatcgcctagtgcaggatgtacggtggccctgtcccagggctgtgctggcagccacccttccccactagctgtgctgctctcacatggcacggcctctggctgccaggcctgtgctcgggcctgcatttcccttgtgcccttctctccacccagccctcaggactgcctgggctgcattttgtccagaatcctttgtctccttacttgcactgcagctgaggcgagtgtcccttgttccgggtggctcctgtattgtggcgctcatgttattgagagtcttagaggtcaccccctagattcaccaattgaagggcagggcttgtcgatctaacagtgtcttgcacatagggacacaaatgtctgttaaatgaagaaagtagggatgccaggccacccaatggggtgtatctcctagggttcaagaacaagggctaatcaagtcaagagaatgtgtgccctcccccaccatctcacccctcactctcagaacacttggggcccctgcacaggtggtaggcatgctggccctgagtgccctcccagcctgtgttagaagaaccagtggatgacctcgctgtcagctgtctccccttctctgagcttactgcaggtggcagcagcctctcagccacagactgttccctttcctaggagaaaacgatggtcactcagcaatgctgtgcgcttgcagcttccaccacaaaagagacagctgtggccgcagcaccagggtggtgattcttccccctccaagggcagtggtgcattccttagcacaagtataaatttactgttgctaagagttctcggaacaggataatacaagaaggaaccactgcaagtgaaatccagccaccagtaatgccgagaggccaggcctgtgcctcccaaaacctgctcctccgcaggcttccccggcccatctccagagcgccctcctctcaccactttacataaacgaatgtacccaagatcccccatcagttttccatgcagctgccagagtgccaccaaagcaaacctcatctcaagactctgtggccaggccctcacaacctcctgccaggctctcgctacctacccatcaacagcaagactcccaggccatctcaatccccccaaagagccctgttcctccagccccacggcttctgttcacctgccgtgctgtccccgcctctgcccacccactcatcctgcagatctggagcagcattccagggcctggtaagtgtgcgccattttgggttactacgggtctcgccaggcgcggtggcgagttttgccccccacgctccccagcgcctgcacctgggcggagaggtagataaggctgggagatcttagccttttgcaaggcaaacaccaggcaggaacgcccagaacctcggaggaggaggaggggaagatccccaggtggagaccaaggtgcccctcacgctgagtcgtctaggagaccctccctagtttaaaaagtgtttatttgctcggagaacatttcaggaggccttcctgggaccccaagtgtgccgccccccgggaggggcctggagacgcccgcgcggcccccctgcaaagttttaccggccctgggcgcccccggccctggcacccacgcggggagccgcagtgggccgggccgcgcggccgccgcctcccaccgctcccgcgcccgctcccgcccccggcgcgtctcctccgggcccgcgccgcggcgggctcagtcctcagcggggcgcgtggcgagcggactcgactcggcaccgctgtgcaccatggcccgggccctgtgccgcctcccgcggcgcggcctctggctgctcctgggtgagtaggtccaggggtcccggccgagctcccttcccctggccagccggtgtcctctaggggagaggaggggagcgggtgggagcgggtgggagcgggtgggggcgggcgccgcgggcgcacagatccgctgcccttgaacgcgggccgccccggttccaggcgggaggccccagggcacaggggaggcggagggcgcggaccggtgttgcgcttctcgccggggaagggacggctttggggacgtcggagagcgggcattctggaaagcgtggggtgagtcagccctgcacactggagaactagttttcagaaggaaaaacaggacgcggggttccccagccccgcacctcgtttctcaggctgtgcgccgcggtgactgccagcgcaggctcccttccctaggccgtcccgcgttgcaaaacctgcagacgggcaccttgcagaagacgcagtgttcgggaatcagaaccacagccggtttgtatggaaattagtcaacactgacaatctgtcgcctgcagcagttgcttgtttgcaaatcacgtcttttgcagaaatgaggccagcccttttcgggacacttccatcgctttttttcttttttcttttggtttgcttgttaacttggcacttttggctaatagaaatttaaagaaggacgggtcccttggtgaagtggtggaacacgtttggctttccacttggagggagaagtggagattagcggcagcctcatggccacaggaactggccacacactcggcaagaaacggtgctgttcacttcccttgtctgtaatgtgttcctaaaatgctaactcaagccccttctaaaccgctttggctattgcattattccgtgtatttagctaccttttaacggaaactgtgaataggttactggcgtgggagaacccagtgtccctgggaaggccggagcagttgtttctggtatgtgtggcctttccccggaaacagtgatgttggtcagaggcacctgccgcacaagacctctttggcgctggcactgggcaagcagggaccaccggcgctgttgtagctgggggagtggttcgtggcccagcgaggagaggggccagggcttcttgggagccatggatttctgttccctatttgtaaacctctccaaggggtggcagatctgcatagaatcctcagaggccgatataatataatctgaaagcggatcttgccactttagagttttggctgaagttacgtggaaagcagaatctcgcagtaattttattctctccatttggcttgacatggccttcactgttttcatttactaagaaacaaacatttctttgttagcaaggcagagagctgggttgtggaatattttttacataaataaccaaataaataaacgttctttactagtgtccagaggctgaaccctctaaagcttgtgtaaataaaacactatgtcacgatcacatataaagaccttccttgtttaccgagaaaactattcatgttctgccgaaagtccaaagtcctgtaattttaacgttattttgagtggcctggctaatgttatctcttggaagaacaaacaaaactttatgaggttatcagtaaattaatgtcattggagcccagctgtaattagtagaattactgagcacaggctgtttccttcccaagctgtagcactagccaggtctccttggtgatgaagattttgctaccaagaatggcaatgtggaatttttttaagtactctagtttacaggtttaagaacttatctgtgacaattttacaatcaagctatttgtcttaggtagttattaagaatctcataatccggccaggcatggtgactcacgcctgtaatcccagcactttgggaggctgaggtgggtgaatcgcctgaggtgaggaattcaagaccagcctggccaacatggtgaaaccccgtctctactaaaaatacaaaaaaaattaggcaggcatggtggcaggcacctataatcccggctacttgggaggctgaggcaggagaatcgcttgaactcagaaggcagaggttgcagtgagctgagatcatgccactgcactccagcctgggtgataagagtgaaactccgtctcaaaaaaaaaaaaaacttaggatccatatatagttcttttccctctgagcatcctgtgtactcttctgtttactggagactctacatgcattctgaaaagtttgtgtatagacaccgaaaagctgttcgttaaccaggaaagaaggatgcgttagaagcccctggtttttcgagtccatcttcactcagggaatgctggctggtgctgtcacacatgaactcagtcacctgtcctaggaaacgcatgccttccttggctgtcacgtgggagccaggggtttttttaatggctgcaacattaattgaaatgtatgactttatataaatacaagtagaattggaatgacagggacatcacaggaaatgctatgtgactgcttcagattgccatgcggttttaaatctggacacagttctcatgccaaagtccaaatctgaaggattcttatttgttaatcaactcagtgtgtttgtttaccctctctgtgtgtctagctgcaggaagaaatttctggatttttgtcttccttccacaggcgcatgcctgtcagcgtgcttattaccagtccgaggccagggctgttgagaaacatttatatccacagtgcaaatggtagattcagctccgggaaatgttttaggtggaatctttagttaaggctagttggaaaagtctgtcctgatttttttccccagaatgcgcccatttcatagcttctaatcagttacaactggcgtctggctgactgtgtgatgcaggtgccatgtgtagtgtgaattccagcggaaatgctgagcccagagagtgaagcccctcgggcttgcctgccagtgcccctgccagtgcccccacccccaactcaggcctagaacccctctttcctgacggtctttgtggtatggtgggctggccctcagtggtctctgagccaggcctggccatccagatggtcccagggaggagactggccgcaggctggacagtcagtgttctgctggaaccacggggaaaagctgcgtctttcctccaggctggatctgagtggggctgccacagtctaccctgtgagccatgggggagtacctgtccatgacatagagcactcctgaagccttttgagcccctagatcgagctcatggggtacacatttccatcatgtgacccataacgtttgagatgggtgtctgtcccttgcagggacggcaggctcagggggctccgagaatggcgtacctgggggactgtgggaatcctgcccaagagcctcctcctccactggggacccagggaggcctcctgaaagaagaggtgctgcagccaggaagacagtgggagctgggaaggggacaggggagcccgggctacagtggccctggtggctccagcacttgctggaccatgtgcccactgccccagcccaccagtttcttggtggcaaatgaagaggcagagacggtgctgccagggcactgttcagttcccagcctgccataccccctgcctacctctgacacatcccacagcagacatatgaagccctggagggatgtccttgtccccagtcctctctgctccagaacaggaggactctcagctgggtgatgttcctggaggacctgtttctccttagtgaggaggatgcgtcaacacggccaccataggagggctcccagcccaaacaaaatcgtactcacttcaccgaatgatgttattctgttcaggaaaaatatttttttcctaagatggtttatttcagtaatttctggggcatccgaaaggcatcactttaaccatcttttaaatcacggcttctgggtggctttgttggagcagggtccagggggacacactagccagatgtggcaggagtgcagggctatgggcctgagtcacaggccccccgactctacgttctcagctctctcggtgactcctccccgtgctccgagagtgcttcactccctcccatgtgcagtcacatggtggattctctgggaccgagaaccagaatcccaaaaccccaggccccggctgtccactgtgccctccgccagggtcagcaccacctccacccctcacggggacaactgcccagcctcccagaacccccaccccacccaccaccccagggacagggggtcttcctctgtgcccccagcagaccctcagggtacgttagtgtcacccccacacatgccatgttcaggcccccaggccttggctccggggaagcagctcctgaattagctgagagttctgggaaaccacgggggcaggaggggaggcagagtgacctggcccgtggcctgggccagctcactccagggggtggggtacagcttgcccaggaagccctgccccctgttctcccggaccacgtatccccacacgagtctcaggaaggactgtcttgagtctgacaccacctgggaggagaaaagtcagtgatttgcccaaccatgcgcgtgtttgcttcgtaaggcctgccgctgtcaggtaccctggccccaggccgggaggggaagaagcctagaaagcattgcctcttcaatggacacttggtgactgacacccggggtggctctctctgcagggattttcttgcctctggaggagacagttgtgagagggaagcgggggaggtggatggatgagggaatgccgggaaagcgctgcaccgtttctcctggaaacacccatctgccacctcacacacgggacacacagggtcaggactctcacacacgtgggacacccagggtcaggactcggagggggcaaaggacaggggtgcagagcagcctgctacagtagggtgtcctacacaacccagggcagctcccccagaggatgatcccacaccaaatgtccatagtgccagggtggggcagccctgctgcatgtcaaccatgtagacatgtggtgctacttaaatgcagcaggaaataaacaggagaccacggagcacagccctgaggagcagcggcagcacagtccagagggcagagggcaaggacggttgtgcaaaggccctgctttggaagttcctggaagcctttttgactgaagcatggtggggaagagggctttgagccgaagctggtgctggaggaaagacccattctctaagcattcagatctcattcctagggcagtgggaaaaccttgaaggacattaaagggggtgacaggacagaaggtgtggtttaaaggagccctcagctgtggcccccagcatgggcaggaggccaggcaaggataggagtgggagggttccagggagtcctggaggcgaaagtgatggactccagtccctgggcctggatgcaggaagtgaggcagcgctgaggaatgaagaacagcacctggcagagctcctgggggagtagggagggcagggcaggggagaagagaggagaggaggggaggggagagcaggggagaggagaggaggggagggcaggggagaagagaggaggggaggggagggcaggggagtagagaggagagtgcaggggaggggagatgacaccccaggccacagccagggctgccaggaaacatgggagccccaggcaaactggaatttcagataaacaagaagcataagcctgtctcatacagtatcgggaacatgcctcaaaaaccaccgtttctctgagatgcagatttcgcagggcctcctgtcatttgctgcacctggcagccccgtcctcagcagccacatggggttcagcgttccccttggattctgaggggtgatggtacgtagacaggagtctatgcaaatcaagggttcagaaagaggtatggccaagagaggtgtttctggcggcagcagggcctggcctatgtcaaatccttgcttggaggggtgaccggtgagagtgggtagaaacaggcccaggctccttgtgagaggccagagaggacggccagggaggacagagaaggaaacgggccccaggcaccactgggcaccttgacatgattggtggtggagggaggcagatggcagggtcctttgcaggagaggcagcggcgaaagctgcccttaggaggcagcgaggaggtgaaaccagagagcatgcctgtgtaggtttcctccagtgccttatggttctaaacacacaaacctttgatgcatctggaatttaccttaatttcctagcaatttttatcaatggctcaatatttgggggattttcatggtaattgcactgaatgtattaactggtcagggaggattacatcaagaccaccggctcgagaaacagcagtctgttcctccacccccacgtctgcatccaggcccttccacagagatctcatttctcctgcagatgactcattcagtgtctaggaatccggtgctctgtggccactaccgagagtgggatattttcccccattttattttctagctggtcatcgctgggctaagaggaagctcctcttctgtgtgtttcttttgtgactgttgtcaccctgtgcctgttttttattttagtttttttgcttcctgcttggttcttcaggccagtcataaggtcacccgtaacctagggtggtcctaccacctcttaacaattttccctgttttgttctccagtcgtactgtgttggagagtgactcactgctgagtaggggagtgacagcagctgccttcctttgctgctggcgatggcaatacaagtgacccttgaacaacgcaggggtggggcgccgaacccccacatggtcagaaattcgagtgtagctcttgactcccccaaagcttaacgacagcctactattgagcagaggccttactgataacattatctgtgagttaacccatattttgtatgttacatgtatgtatactgtattcttttttttttttctttttttgagactgagtctccctcttttgcccaggctgtagtacagtggtgcgatcttggctcaccacaacctccaactcccgggttcaagtgtttctcctgcctcagcctccccagtagctcagattataggtgcccgctaccatgcccggcaaatttttgtatttttggtagagacggggtttcactatcttggccaggctggtctcaaactcccaacctcaagtgatccatgcatcttggcttcccgaagtgctgggattacaggcgtgagccactgtgcccagcctatactgtattcttataatgaagtaagctagagaaaagaaagtgttattaagaaaattagacccagcatggtatctcacgcctgtaatccttgcattttgggaggccaaggtgggaggatcgcttgagtccagggggtggaggttgcaatgaaccaagatcacaccactgcaatccagcgtgggcaatagagtgagatcccatctcaaaaaaacccacagaaaatatatatacttttcattaagtgtaagtggatcatcctaaggtcttcatgttgaggaggccaagaaggaggagcaagaggaggggttggtcttgctgtctcagtggcggcagcggcagaagaaaagcttcatgtaggtgatccacacagttcagagccatgtggtcaagagttaacaccttaaaccttctgtctttctcctttggggccagatgcttttttattgtatttttgtgggggtgggggtgggagagggatggagaatgcatcttcttcccgtgtgtaaagtaagcttttgtcctgtgaaggaagaaccgttcgatgtgacacaacaacctgcccagctggacattgtctcagtgctggcaggccgctggcactggcgaggctgtgacacaggagaagtggtcagaggctgcgaacctaccgtgtttctgggatgaatggagcgtttcctcattcctgtgcagcctttcggcagtctcaggtgtctgttggccactgtttgttctgagtgtggcttcgttcttcctgagtgagcttgctctgtactttaccttgggagttttattaccagcattgggttttcttcccaagatacaggttgtggacccttattctttccctgtgtgctaggatagtcaggatgatggaaataagcagttccttgaagatctagagggtcttcattttcacctgcaaaaccaccggggccaggctccttttcatggtgtagaaaattggcaaccttttcagtatctttctggtgttaattggtccccttgggttttctgtcttttttttttttttttggatggagtcttgctctgtcgcccaggctggagtgcagtggagcgatgtcagctcactgcaacctccacctcccaagttcaagtgattctcctgcctcagtctctcaggtagctgggattactggtgcctgccaccatgtccagctaatttttgtatttttagtagagatagggtttcaccatgttggccaggctgctctcgaactcctggccttcggtgatccacccacctcagcctctcaaagtgctgggattacaggcatgagccactgtgcctggctggggttttctgtgtcttgtagcagtgatgttgttttacattttcctctgaagttgttcattttatccacatatcattatgtgaacaattatttttctaattccctctacatctgtgaacatctgtcctttttagtgcaattttgtgaatttgtattttcatgttatttcttgatcagaatggacagtggttaatctgtgattggtctcttccccactgattccctccccccaccaaaaaaaaaaaacaaaaaaaaaaaaacagttcctgagtttacttactctacactttttcttgaatgcctaacgcatttctttttgttctttgctggcgtgggaatgaaacgtcatcggttctctgcttggcagcttggctggatcccctgagtttgcctctgccttgtgctcatggttgatattttctggattctctgtatttgtggtttctgtttcctctttagcacgtgaattgtttggaagcaagtttttacaaatctcaggggctccggctttttggtttctctcccgatactcattgctagttttattgcactgtggtcgggggcagagcgggaaccacaaccatgacttagtgtgcattgcgggttctttcttggtcttacaaatttttcgtgttgtaaatggcccgtaagcccgtgggaggagtgtggcgtttttatgtatccatcccggtcatcatattaaatttaatacttagggcctccgtatccctattttcatcttctccatccatgcgcattgtgtgaaaaccctgcactgcgtttgtgatcctgcctgctttccctgggcacgtgttgctgcgtgttcacgcaggggagaggatggggaattccatatgtgaccctgccagtcacagctgcatggtgacttcttatagctctgtcccagtcattgcttttttaattttaattgcggtaaagtatacaccacataaaatgtaccatcttacctatttttaagtgtacagttctatgccactaagcacactcacgctgctgtacaaccatcgccactatccatccctagaagttttttcattttgcaaaactgaaactctgtcccagttaaacactaaccccctgctgatttaccacctcccccagcccctgggacccacgattctactttctgtctctgactactctaggaacctgtattagtggaatcatacagcatttgtgactggctcatttcacttaaggttcttccatgtcgtagtgtgaatcagaatttccttccttttgaaggccaaataatattccactgttatggatagaccacactgtgtttatccattcatccatggacacgtgggttgcttccacttctggctgttgtgaatcaggctgctgtgaacatgggtgttcagatatctctgtgagaccctgcttccagttcctttgggcatatacccagggcatataccccggatcattaggtggttctgtgtttaatgttttgaggagccgccacagcgtttccgcagtggctgtggcatcgtgcgttcccaccagcagtgcacaaggctctggttctcaggggccgtgtgaggccacctctgccatgctgcaggctccccagcacgcagtggggaacccaaccttggagagccgagccggggaagaaaaagcgtctccacagccttggcaacacttgtgattttgttttcgatggtagccgttctaacgggattgaggagccattcgttacttcacaggtggacagcagcagctttgtcggggacaacattgtggtttctcgttgtctagtcttttgtctgtgtcatgtcccgccacccaccttttggatgttccccggagtcacttagctctttgacctggtttaacatctggttttcttgtggattttaatgttgtttaccaaatcccagggcctgccccgagggcctggtgaccctgggcaggccatttcccgtcctgtgcaactctgatctgcaggatggggtggtgtgggagcacccatgtccctgcctgaggactctccaggcctccgtgggggcggtagcagggcctggcccatgcggcgcgctggtgctgctcacccgcctttctggctttaagaagtatgcttggagctcatctaacatcttattttccattttctgtttcttaatacttacagaggcttccgactttttctccaggtctgtattttccttgttcttctctggtaatttggaaggtagacagtcagtttttagttcaacctgtgttttattttatgacttaaaaaaatgaggatttcttggcttgtcaacttcagaaatgaagagtgccggttgacaatgtgtagagttttactgaatggcagtcgggggcaggaccaaggctggggaggaggatggagggtactgtgtgcagtcaggggtctcccaccaggttcctaaggttggaggtgaggctggaggctgccacagttatccaagtgaggactcggaagggcctgggcatttccagtaagagtgagcaacacggatgcaagagagggacaaagaactgtgcacagcaaccccatccagcacaaagcaggcacttcgtgggggtagaggctctgagcccgagagaggggacagtgggctggaatgcagtgctttgctgtctttgaggaccaaaatcagatgacaggtggaggagaatctacttggtggaggctttggcggggtaagcggctgtgtgggtgggagaggaacaacccggccctggcccacggccccgaggacctttcctcttctcgcaaccgcccctgcactggctgctcagaggtgtcagtggatggcgggagtttctcagcctggacttgagaagttggaatgagagggtcttgccagagaaaggagagcaccttggggcttcagccagctgacccctagagagacaggactttagacagagcaggggcagggagaggaggagctcagacagctgagtgctttcactctagaggatgtcaagtttgacctggagggaagcaatggggagatatcccagccacacaggaaacgccaggccatggttgacacctcacgcaggcactcgcatgcctgaaacggaccaggccatgcagggagcagatgctcaccggggacagaggcctcgcaacccaccagggacagatcgtggcaactgaaggggccctgttcaggagagctagatgtcagggaggcagcagcaggcgttcctatgggctggggagctctgggttcctccaccgccccccgaccccaactcccttgggccctgggcacttctaccctctgggacagtcgtccccaactctcttggtcctgcccccgccagtaaaataatctggacacgctcctccaggatttgcttataaattagacccctgtgccactgcgctatgtgttctaaaatgtatgcaaaaataggcttctttaagcccaggaagtcaaggctgcagcgagccaagagagcgccagtgcactccaacctaggcagcagagtgagaccctgtctccaaaaaaggaagaaagaaaaccactagatacggtgatggttgtacaccttagtgaatttactaacaatcattgaattgtctatgtaaaatgggtgaatttgtggtatataaattatacttcaataaaggcgtgttttagaagagaaaaaatataggcttctttgaaaggagggatgctgagaatagtttactacagtcacgaccatctttccaccctcctgcgatggtatcgtccatgccttaaggatgttaggggttcttagcgggggcttcaggattgagtatggatcgagcctgcgcttagatggacgatgccagcccctcagccaaggagggcctggcacgggaaggagaggcggctcggcagcctattctcggcctgccctggtgctgccgggggcacctcgtgctctatccagtccatgcccctttgccaaagtcgtccactcagtgacggtgatgatggccacacatccactctcccagggcccctgtgctcttgggcattagtgtggggtggccaggtgactgcccaggtcgtgggactcacgcgtgcccagtgagagcccccgaagcctctcctgggaagcctgagggaggcagacaccctgaggaagcccatctgcagccggggctcctggccaagggtctcagagcctccacagacatgggtcacccacagcctttggggcaggtgttggggtctccacaagaggtctctgacctcaccatgcctcctacgtgttctgagatgagcgtgccagggattgcatccaggctgtaccactcctgggctgtgtgactctaggcaggctacttaacctgtctgagcccctctgtccctgccatgatggttatttgcaaggattaaataggctaatggtggccaggcactgtggctcacgcctgtaatcccagcactgtgggacgctgaggtgggacgatgcccaggagttcaagaccagcctggacaacgtggggaaaccccatctctacaaaaaatagaaaaattagctgggtgtggtggcatgtgcctctggtcccagctacttgggaggctgaggtggaaggattgcctaagcctaaggaggtcaagactctgcagtaagccatgattgtgctgctgcactccagcctgggcaacagaccaagaccccgtctcaaaatcaaataaaataaacaggctaatgggtgtaaggggcttaagcctggacttggcctgtgagctgcagctactagcatcctggactggctggtgggaggggagcagggaggcttcaggaatttgcatgaacttgacctagaacctgacctgcactctctgtttagccaccactccagctgggaggaggacagtgatggggtctgagattctctctctacaaacctaaaatacacagctacagaactggcctttcctgccccatgtggcacagaccaaacatgggcatcaagtgcatttgctgagtttgagacccattagctctgtgcctcttgtctccttagaaagcccaaacacctgatgagcagtgtccaggggtcccctgtggggggcccggctgccccgtccttctgtccccaccctgtcactttgcttgaggggccctccacctttggggtgcctgctatgcatgctcatttcaggggcgctgtcctgctgtggagaaggaagccgttgctctgaaccccctcaagcaacactgagttcctaacttacgcacagctcgagggaagtttcctgtcttaacacgccgagggctgagtgaggagcgcagccgtctacccagcaacctctgcacgtggcttttgaaagacatgagttatgaatgattacatttgcagtcacacagaggaatggaacccatttggccctgaatggcttgttttaaaactttggcaattttatcctattttaaaactttgatgttacctctctctgcaaggaaagaaaccacatcaggctcgtttaagaaaaacccaagcattcttcgcctgtacctaaaaaatgaaactggtttccagatttgcctgaacagctgcccctggcctcatcccagctgtgggactctgggctcccatagggcgggaaagaaagggcagcactggtcagggagggctctgtccctaaggagcaagggacaatgggctgggtatggcagtcccgccccttgggaggcagaatggctctaagagaggtgggggatgcagcatccaggagggaccagcccagagccaggccagggtcaaggccaccggaccagccctgcagccagacccggacaggggattgcatgggtggtggaagctagaactggctgggctgcaggagaggaaggcccagtaggctgggggcaggccgctgctctggacagcccaggggacagcaggagattgacctgaatttgacagggagggccaccctgtggcctggggtgaaaggaccgctgtcattgtttctggcccctgcacctgcattcgcttcacttgttggagaccccaccagaaggagcagctcggcctccgcacggggactggctctgcagggcggttgtgcagaccccgcttcccagaccctcctggggacttgggagccaccagggtccctttaccagatcctccactgctcacaccagccccagttggtttctgttgcgtgcagccaaggatcccgactgaggcacagacatgcctgttcatcttcatttgtcctagaagcggctcttccaaagcaggaggggagtctgcagtggttcatgaccctgacacccaatctttccactccaggcaggatagcctgaggcacgcttgcttcactcccaggcagaatggccactgagaaatccgggtatggccatcttatttgctggctcatttgacaaatatgaatgtgcaaagctgctgggtgccagcgtgagtcagaaaggagtaggagatgagagggcagccaagagggttctgagaaaagaaagagaccctccaccagccctgagtgaggctctgaggaaatgggctgggggacagggtaagggggcaggcttcccataggtaggatcagccgggggcctcttggaggacagggcagcggaggagggcaggtgggactgggacccaggattcaccagagaaaggcagtggggggcgggatgccaggagcagtgagggataaacagagggacgattctccaattgcagctggacaggcagcctggaattccttccctgagttgacaagtcagtgtctgagccctcctgagcccctgggagctcctggggcatcactgtccacagtaggtgggctttcctagggggcatcttgatggggcaggtgtcagaaatagccccttccccaaggctgccctgactgggggtgaaagaagcccccagggtggggggtgcatccacagcgggcccagccagccccaaggtgcactcacagtgctggtatggacatggtggggacacacctgtgctgtcgggaagcagcatggactcaggtgggtacagagcctcctgaggtgtccccggggtgcccggaggaggctgttctgccctcagccttcccagaggcagatgcagctccctctgtggccacaaactccaatgctgggcactcatgccaggggtcgagggtgggtgacccactggagtgaggtggggggactctgtctcgcttgctagcaggtcctgtcctgagctcctccgtggggctttttccaactcccagccttccatgcaggcccgactgcacccacatcactccctggcttcttgggctaaacatccctgattcaacacacctggctctttgggacccactcatggcctcagccccgtgcagggctcagcctctctggtcagcactcagctctctctagcagctgtgggctgggccagtgcccaggtgtgcagtgtgtgggatccgttcaccctgacacaccagccattgggcctggagtggtgctctgcaacagcacccccaccccacccctgcatggccacctgctcgccctcccccaggtgcacctccagggacatcaggccattccctgtacttcctgcctcccatctggtgcccagccccacagccccagaagcggccaagtgctctctggtccataccacttccggccatgggacctggggccgagttctgaaccctgaagcctcagttcccccatccgtaaattgctgatcgcagtcagatccactttgaggcggctgtgtgtgaagagctccagggtgcccggcgcatcggggcagctccagttcctctgcgttttactcagcagtccgaggggcccctcgagctcacacccaccccaggccacgtgccggagactggtactccagaacccctcgcccaatctgcctgcccaagggcagccacctctccttgggtgggctccctgggcccgaggctgcaaggggcaacttgatgtcctcactcatgaggcccagggggccaggcggtgggctgcaggggctgggtgcccccagcgtctcccagggcagctctggcctcccagtgccaagctccttccaggaatttgaaagggccaggccggtaggggtggggctgggggtcccccctgggcagaggatgtggcctggggggaaaaggagggggacctggggacagtgggagggccaggagccaagccctaaacagggaatgcaaagcttctgcccccagctgccctacgaggtggccaagaaagagaggctcagcctgaggaggaagaagaagcctggtgggtgggggaccaagggccatgctctccccgccacccccgcccccacccagccagcagtgagctacgggggaaattagtcaatcctgattctgtgcggggcatcgctgggcaggtcactgttgctctggtgtatggctcgaggcaggaggagggagcacagttcatgcttccgtttgtcagctcggttcatagcccgcagatagtcagacaggagatgtgcctgcagctcctgggctggggggcacagcccagcccagcccatccccaggtacccgtggaacaggggcagccagagactgtctccgggcccctctcatgctgcccatgcctggggcagcccgatggcataattgtgggatggaatgtgccctggcccaagctggcacgggcactgagggccaagccacccttagcaggcagggagggcctttgccaggtcacagaacaattgatgaagagcgtccacttggagccacagtcgccctctccaggggttgcttagaggccccgttctcgtggagtccgggctgcaggggcgcgcgggctggcggtgatacccctaggcctctgctgccgcccgccatctcttcatggccgtgtctatttcagcccatcacctcttcatgaccactgcctgccaggaggctaactacggtgccctcctccgggagctctgcctcacccagttccaggtagacatggaggccgtcggggagacgctgtggtgtgactggggcaggaccatcaggtgagtcccatggcccctggtgggcaggacacggttggggagggagagggggcaagcggaggaggagtggaccacgtgggagctgtggaagatcctttctagaccccggaagggttcttcccccagttgggggggccgggatgaagacagaggagggagccagtagcaggtggacgtgaagagtgacggtgggaggaggccacgtcctcaataatctggtctggggatggagggttcagactgggccatgtccagccagagatgcccgcggcctctccaagggcaggcgcctggggaatgactgagagtagggtctcatgcccagggtggccgggtctctgactggagcctggcttcagggacgtccctgctgattccctctgtccctgtggtcaggccaaagctgtccttcctggccccaccctgtccagggctcagagcttctggtaatggagcaggctgtcaccacccacagcccccagcaggacggcttcagccgaacccttccccacctggcccgatcctcctgcccaagggcccttcttcccgcttgaggggctccctcattgcctccctcagcctcctgggtgctgggcccccatcagcaggccggggggttctccccagcaggcccaggctcctctgcctccagagcggcgatcagaactcggcatgtccgcaatcgactttcaagtccttgtttctgcctccgtgggaggcgctggggtgtcctggggctgcagtgggtgagtagcggggtcagcagtgcatgcgtggagctgaaggccaccgcctccctgccatgcaaacttcgcacagagatctgtctgtgggttcacagcgcagcgcaagtcctggtgccccaccgatgacaagcgctttccccagtgcctgagagaaagggagccctggggactggtggggagggccaggggcagggaggagggcctcgggagggtcttcacggaggaaaggttgcaccaaggtcacacacgaagagtacctgtggctgtggtgtcccctgagggtccagacacacccgggcacaattctgtggggttgaagacccctagttggactcgtcacccctcccctgtgggttgcaggctggcgtgagcacagggagaaagcccacggctgggaggccctgaggctgggtggctcccactgcccctctgagcctgggtttgggcctccctctaccctcagagccccgctggccacagcctgccctcttcagtcctactgagattggcagatgagtggcctctgttttctcctcccaccggccatgtgctctctgcccacttcgtccaccccagggaactccctcaggcccagagtccgtgctcagtgcactgttgttgaggcgactctgtaccttgggagcccaaactttttaaaaagtaggaaagcatggggtatatgcaggtgtgcatgctgggatttaaaacaacagaaactccgtaccctctgctccagttcaggtgggagagttggtgctcccgaaggtgggagggccaaagtcacggctccagcctcaaaggcccctgataagacacagtgaaccagggagcccaccccaaccctctggggtctccaggggccctgtgccctcagcagggtctcctcactctactgtactgaaggtctctccaagatttcagggcctccttttctaagctgaaaaatgagttgagtgggaagaggttgttaaaaatcagaacagcctgttctttaggctaattggccttctgccacagctgagtcatttgtatttaaattaagattgcattttattatgatccagggaagacacaatggggggcccctggagaaaagcactctcccccgcctgctttgtggaagtgatggttaatttgtgtagattgattgtgaacgggaggcctggcagaagacagcagggtaatgcacacagtgttctacaagcagccatggtggagtgtccttagaaatggaagccaccacagatggcttcctgcagtgccagagcacaaagaggaataactagcgctgaggccagagagagttcgccatcctcggagccgagtggccatagctggaactagaaggagggggagttgctgggaattttcgtttttttattattattattattatgatactttaagttctagggcacatgtgcacaacgtgcaggtttgttacgtatgtatacatgtgccatattggtgtgctgcacccattaactcgtcatttaatgggttcagcacaccaatatagggcacatgtatacatacgtaacaaacctgcacgttgtgcacatgtgccctagaacttaaagtattaaaaaaaaaaaaaatctgaccgggcactgtggctcacacctgtgatcccaacgctttgggaggtcaaggcgggtggatcaactgaggtcaggagttccagaccagcctagccaacatggtgaaaccccatctctactaaaaatataaaaattagccgggcgtggtagcacacgcctgtaatcccagctactcgggaggctgaggcaggagaattgcttgaacccaggaggcggaggttgccgtgagccgagatggcgccactgcactccagcctgagggacagagtgagactttgtctcaaaaaaaaaaaaaaaaaaaaaatcaagataatttaggaaccaagaaggaaaagtccacatcacaacagcatctcagcacgtcagcccaggcctgccagcccctggggtctgcgtttggcagaatgatgccccccagagatgtccatgcgtaattcctggaactgtcgatgtgtcacacggcaaaggggataaagtcacagacagaattggtgacactaatcaggtggctttgagatgggagatgcgggatcatcccggggcccggtgctatcacaaggtcccttaggttggtcccagctttggctactggagagccttcacactggcttctgtgtcctttcgacattgcccctggctgtttttgagcactttctttctttctggtaccacgagatgttccaggcttatcttatacattttgtgccccagccctgaagtcagccatttctccaaggaacactggttccttttgttagagaatggtatctagaaaccaagatatatgtgcgtatgtgtgggtgtacacacatcccagggatttagatggaacccacggaaccatacaggtgctagaagaaaacatgggtgaatccctatttaagccatggtatcgagaaaggctgggtaaaacaatattgtttcaaaaaattggcttgcccaatcccagggcccagcaggccagcaggctggaaactcttgggagccgacgcagcattcttgaggcagaatttccgaacgtgctggtaaggccttaccattggctgggtgaggccccacccccagcatcaaggattatcccctttacttaaagacaactgatgatagatgttaaccacatctcccaaatacccccacagtgacccctagactagtgtttgactgagtaactgggcactgtagcctggccaagttggctcataaagctataatcatcacactggttccaggggcagaggtctctgcgcaaaggtgtgttcagacaactggcattgtccctcctcctcctgcccctgcccatttctctcattcctttcaccctgttcccacccaattcctgtgggcaacttacctcatcagtttctggtctttctttcctgtatatcttttgcataaatgagcagatgcctgcattttcttacatccccttctttcttatataaagggttgtatactagtgacactcctttgtactttggtttttcttcacttaacaacataacctggaactctctccttgtcagtgcagagggagcctcctccttcatttttacagctgtatagtactccgccgtgcagagtctttcagccattttcctttcagccagggcagaagccaagcgagcagaggcacttaggttgtggccagtattttcccatttcagcatcgacgtggatggcctcacgcatccgtgttttcccagcactggagctgactcttcagaatagatacccagaagtggggtcgcaggaccaaaggtgagagcaggaggaatgtgttaggttttgcaacgtccctccagaaggctgatgccagtttgcattcccaccagcagcgtatggggtgcccgtttccccagacccaccaacagactgtgttgtcgtccattagagttgttactgtctgataagtgagaagtgatgtctcagcagcatgtgagtttgcatttctgtacttaggagtgaatccgaacatctttcgtatgtttacaggccgttcttttatctttttggcaaattgtgtcttttcctattttctatcaggtcgtttttaaagagttctttgtatgttagatgggttaggcctttgtctctcgtgtacattagagattttctcctagtttgttggttgtctttcaactttgttttttttttcttttggtgtttttgttgccacacaatttttttaatgtggtcaaaaccatccatctttgatcgcctctggattggagtcctagtggaaagcccctccccacatgaagggaaaagagggatttgccacgttttcctctagcctgtgtggtcccactggttccatcgaaatccttggcccatcggagtttattccagtttattcttgtgtatggtgtgaactatgaatcaaatgttatctttttctggatgcgctacccacttgtcccatttatgcaaacgtccatctctgctccccgtgacctgagatgccacctttgtcatgcactaagcttccctgtgcacttggcccgtgccttcttaaatcgtccctttcccaaaccttcctcatctcacctgaatctcatattgatctattctccagaactatcaatgggtcctcaccgcctgctgaatgtttacctaattatcccttaacttagtccaagaaacgcgtttactgtagctggcgtttattaccgcgtgctgggctttgtgtcgagcacgtaacgtacattggctttttgaggtcagcagcagcctggcggaggtggggctgttgtgattgctgcttcacctgcccaggctcgcacagctggtacccatggctccctcctggttcccggcggaggtggagggatgccctgcctccatataactgtggcctcctgagatggggatgcaagccttcaggtgctgcctccgtcctggcgatgtccctaccaacctggtgaggtccatcgcattgagacaccaagcctggcagtgggccaagggcagccttccaagggtctccagtagcagcgagggcctggggttctagggtgggcaagtttgtccaagtaactagtggaggagaagagggccctggagagaacacgaaggcacaaatagggtgagaggcgctaggctgcctgcaggcaggccatcaccaggtgtgggcaggtggcactgtgtctgttggatgagcgggaccccaaagtgaggctgaccggcaggcagccagacagccaggtggctggcctcagggaatgctcccagcccaagcagggtcccagctggtctcaaggactgtgagccaggcaggtgacctgatgggggacacaggctctgggaaaggcccgtctctgagccaagtgcagttgaggcttggcagctggggcagaagccaagcaagcagaaccaggcaattattggggtctggtatccaaaaccaggctggcatggaggccaggggattctgaaggcaggagcctctgggccagagctgccacatgcctgctgccgcccaaggtcatagctgtcccagggccctgggctgggcctgcaggtatcttggtatatggcagagggaagcttccagactcttctgaaatcagaggtctcatttaacaacagctgcgtgtcaaaggggactcaccttcctatgagcgacgtagacaaaggcggccggccagccttttatgggatacacacacaggagtaagtgggggctgagacatgctcgtgccagctcctagtgccggcccagaagtcttgcttcctctatcaaagcagatgggaaggaggccccccgtgatccctgctttactcaggacgttgaatagaagtaaaaagtgaatggaagactcctcatggcctggtgcagtggctttcgcctgtaatcccaacactttgggaggccaaggcagaagaattacttaagcccaggagtgtgagaacagcctggacaacaaagtgagactccatctctacaaaaattttaaaaattagctgtacatggtgttggacacctgtagacccaggtgcttgggaggctgaggcgggaggatcactcaagcctgagaggtcaaggctgcagtgagccatgatggtaccacttgcactccagcctgggtgatagaaccagaccctacctcaaaaaaaaaaaaaagaaaagaaaagaaaaaaaaaaaagaggctcctcctctgcacaggggtcattcctgggtccctgccctggcctgtaggtccacttttttttttttttttttttttttgcgcattcagggtttgtagccactgcgcttgccctgggaccttggctgcccggcatggatctgcacgcaggtgcttgctgggttccgacagcccttgccctgaccgtgaccccactcctccgctcatcctgttgctttgttacctggttggtggattttgtcaggttgtctgttgtgagcaaggcttgggggtgattcctgagccctttctaacacgtgttgggtgtcttccactcagctacatggaacaggtccctgaaaagtggctgaatgagctcagcggggccaggctcccctgcaagctggctgggccgtcatttaccaggggttatcatctcattaagctgcagccttggtttgctgatggaggcataatgtgatttaatgtattaactggagctacaatctaatttgaggaggtatagaaaacctggcaaatgtgtcatcgggaactctcatttccagagaccttcctatgggtgtaggggagggagagagaaggcagaacagagaagagaagaatctggaacgtgctggactcggctataaaacatgggtttttaaaagcctcacgtcagatttcctcacctaaataagaaatgctcggttgatttaagagggaaggggacacgcctattccaccccaccctgtatggcttcagggtctgagtgccatcttgggcaggggaaaggtgtcctcggggaagatgccagaggatggggccacagccttcccagcatctgaggtcactgggccccagagaaccagacttcacttccataccagctgggatgcctccgtccctctgccctaaagcttccaggtttgtaaatactgaccatggtagcctcaggtcacctcagctttggttacccgaggctgtcactgcggaccctgccctgccctgccgaccccatgctgggcaatcatgggccctcccccagcccaaggagctgctcagaggacggggctccaggccccagggagtggggctgcagcccagcgtggtagttgggggacgcaagacaaatgtctgcagtgcctgctgtggtacggcggctcagcatggccagcgccaggcatgacgctctgggtccacacgacgttgggcagggtgcaccaacactttggggtccttcccagcctgctgcatttccctcctgctgccttctttgtgtctcctgctaaaagagtcaagtcaggaaattcttcagaactcagcagcaacatgggaacagctgcttgtattttgaatttcagcaggaactgagagggaggcttcttctgaaatcacgagggctgtctgggccaagggcagggtgtcctcctggatttctgctgagctcgacccccacgaggtctcgggatgggctgttcacagagccctgcccgccgcctgcccctgcccggaggcctggccctggagcccacccacctccctgaggcctgtcgtgagcatcaggagctcccagtacagcatctggggctgcctcggtgccctcgtgggtttgttcatggcggtgtccgccctggaacttgccacatgcccacgagcactgggacccctctgtgctctccctggtggctgtggtgctgtcatctctgtgtgtgctggtggaatagcgtgggctccacggaaaggccctcaggcgtggacaggacagatggcagtgcccagcacagccaggtctcagaggatccaaaggcgagcattgcccaggccgaggccgccctccctgcctactgacctccctgcccaccgccacaccatcgctcctgccgtgcccctctctgtgtgtctgcaccaggcgtgaagccagttcttgtgaggaaagccctggctagatgtctgttcccccaccctctgccccccctgggtgggagaatctttccaggcatctccagagcacaccccaggggcacggaaacccggctgctgacccctgacctcctggggccttcagcactaatggccagccccgcgggaggcagaggagcaggaagagcccctgggagccgggtcctcgaagactccaggctatggcttacagaggagaagggggcagaggaggagagaaggaggtggctgtgccaggaaagacatgcagctcgcgcagtgacaccggtctggctcccctgaggacgccactcctgtggcctgcgcaggcatcagccggggtgccgggtccccatggggacgagctgtagacacagctgtccagggctgggcagagtggggcagtggctggggatatgccggccctgcccaggccgccccacgggggtgtcgttccaccttcctgtagtctccttggcgcgcgtgaccgtggttgtgcagggagcgccttctgctggttttcagcactggagaaataaaccagggctcagagtccttggcagccgcccctggaatgtgttcaggtcaggggttgcctcacttaacgtgcgcgccatggtgggttctgatgaggatccccagaggatctgatgacacctgcctgctgggctggggggctctggaatggggaggaggagccccatttcccttctcagaaagctccaggagaaatgcatctgtgaggacccacagagaggagccctcgtgttgggggagcttggaggctggggctggagcgggcgactgctggcctcacccctccacacccagggaccaccttgtcatcctcagcacatctttttcggaagtcttctggccctgggggaaggcacagatggagagaccttccccagaccctgtggtgacttagcgcggagcgtggcactgagcccaccatggcgtctttcccatcaggtgattaactgcctggtttcacatcctcctgagtatggggatgaaatcaggcctgtgcgtcaacgcgaaaggtcagacatgcggtgacgctaaccagatcccggcagtgagtgaaagggtgggcaggtggaacacgtctggtggcgggggctcgtcgtagctcagcatccacccccgcctcccctgtggacactcgactacagcagccacgcccccagaaagccctagaaccatccaggctgtgcagacgggacttggctgtcctgggacacaggccagtttgtgcacacagggcttcactgagccccgaaggcggcctcctgggctgcccatggggaaggggtgggggtggggtgggggagagaggatgaagatgtgcccttgtgtgtgacacctctggctgtgggtcctgtgtggggagggcagtgggtagaggacagagcagatgtcccctcctaatgctgaccttcactccagcccccaggctgggccatggcatctcccaggatctatccattcatcactcagatggtagacatctcccaggcacaggcagggccagcagcattctcagtcccctgtgggagggcctccagggagcagtggcacctcacagccttccctgtgcatagttcgaggacaccgagtatcttgcgggacctaagcacagggtgccctttgggatgcgtcttgggacaggccttgggtctgagtccactcttgtttcagcttcttgtctcaatcaaaaaatggagaatgcactttctgaaaaagagactgagtttaccctcactgcccaggcagtggaggccgcctcactctagggcaggccacactggcacgctgtggttccctactcctgctcgagttaaagccatttcctggtttttgctattataaatgatggagctgggcacagtggctcacacctgcaatcccagcactttgggagaccaaggcatgtggatcacttgagcccaggagttcgagaccagcctgggcaacatggcgaaaccaggtatctacaaaaaatgtaaacattagctgagtgtaatgggcgcacctgtagtcctagggaggctgaagtgggaggatcgcctcggcccaggaggttgaggttgtgccactccattccagcccaggtgacagagtgagaccttgtctgaaataaatgacaacactataagaacttgtgtacatatatcctttgtttttttaaaaaagattttgttgttagacattcctgggagaaataattcatacaagtaggcttactgtagcatgtaccatgaacattctgtggttctcgggggtttttttttgagacagaatcctgctgtgtcgcccaggctggagtgcagtggcacaatctcggctcactgcaacttctggcttctgggttcaagcgattctcctgcctcagcctcccgagtagctgggattacaggtgcctgccaccatgcctagctaattttttgtatttttagtagagacagggtttcactatgttggccaggctggtctcaaactcctgatctcaggtgatccacctccgcctctcaaagtgctggaattacaggcgtgagccaccacgcccggcccattctgtggttcttgatagatttttgccagttgttcctctaaagaattttactaatttataattctatcagcaacatatgaaaatgcctagttcctcataggctcgtgagtattgagtttgtagggattttatttttgcaggtcaaaggagatttcctctgtagttttagtttgcatgtctttggcaattaggaaagttgaactggtctctgacagttatttggaatttgttttttctcaagtgcaagttacgtcaccatgacctttcctatttgtcctgtgagtcattgcccttttttcctttttttaagactttattttttagagcagttttaggttcacagcaaaattgagaggaaggtacagagatttcccatatgcccattggaggtatttttaatcttcttttacaaattcttttttttgtttgtttgttttgagacggagtctccctctcttgcccaggctggagtgcagcggcacaatcttggctcactgcaacccctgcctcccgggttcaagtgattctcctacctcagcctcctgagtagctggaactacaggcacccgccaccacgcccagctaattttttgtatttttaatagagacggggtttcaccatgttggccaggctggtctcgaactcctgacctcaagtgatccatccgcctcggcctcccaagattacaggcatgagccactttgcccggccatagattcttgaagaatatatatattaactatttgccattgtgctctaaatattttcttgtttcgtttgtgtgtcttttgatgttcattttccacactgtcgttcattagctaatctgtgaacacatggatgctcccattcacccctcatcagtcagtgaccgtgtgacctccgcacagctgtaactgtccacagactctgtcgtctcaattgtgagagtcatatgcccacaagattatgttctgtgtctttgtagttgttctgtgttttgaaatgatatgtatcttcttaacacagtggatggacagaaatgtatttccttcccacctcaattatcctaacagaatttgttaaataatgtcgccaacctccattgttttgtgttgcttaatttaacacataatagcttcctatgtgcattagagtctatttgaaataatttttacttatattctggggtcgtaccacgccatttaaattaccacaactttacaatatttcctacaatttagaaggcctctcctaccatgtttcattttcattatattttacattatgttttgcatgctttgatatattttctgcctatttttccaaaagaacttaagaatcatgttgctaaattccataaaaagtcattgcagccccgacctcctgggctcaagcaatcctcccacctcagcctcccaaatagctggaactacaggcatgtgccaccacacccagctaatttttatttttttgtagagatgaggtctccctatgttacccaggcaggtcttgaattctgggctaacgcaatcctcctgcctgagcctcccaaagtgctgggattacagtttgatgggttgttacctgatactgctttttagcgaatagtaggaaaactaccatggaccttggggaccaagcatgcagtgccaagtggggcccgcctgcagaaaccccgccggctgcgtccctccttcagcgctgtgagcctctgcggcctccccagtaaaatgggtatagaaagtgatgaataaggaagctccggattttcctctttgtgtttccttaatcaggttttagggttaggaccacgtttgcctaatgggatagacatgctagcccaccattagaatcaagggtgggaaataatttttttttttttttgagacagagtctcactgtgtcacccaggctggagtccagtggtgtgatcttggctcactgcaacctccacctcctgggttcaagtgatcctcctgcctcagcctcctgagtagctgggactacaggcactcaccaccacgcctggctaatttttgtatttttggtagaaatggggtttcactgtgtttcccaggctggtctcaaactcctgggctcaagtgatccacccgcctcggcctcccaaagtgctgggattacaggcatgagccactgcaccgagccagaaataatttgtgatgtgagaattacttatttcttagaagtttgaatgaattcatcactaagaccatcaaacctcagtaatttgggggatttccttctccagttacttcctccactattgatttattttgactttctagctcttgttttaacggttatcttcatctgtgtttatttggtctatgtccttcagatttctcagttaactgaaacatgctgcatagtattcctttacgtgtttaatatcccttagactcaagcttatgcctccacttttgtttttgctgtgtttcttctttcccctttttttctttgtttagatgctatttcattcatcaaaaggaactgagaggccactgtttaatgaaccgcacatgcccagttttgtagtctttagaaaataggccacactttgcatcaccgtgtcttttctcagtttttttgctttaacttttaccactcacttccccccttttccctttcttaaaattgtttctttcctaagatatgatttcaatccttagttcatcatttttctcacttttcttgaaaataataaagacatttaaggctgtgatgtgtttctctaaggactttcctcattcatcactttctataggttttgatatgtcagtttttttcattgtattctctttttttttttttgagacggagtctcactctgtcacccagagtgagggtgcagtggcatggtctcggctcactgcaagctccgcctcccgggttcacgccattcttctgcctcagactcctgagtagctgggactacaggcgcccgccaccacgcccggctgattttttgtatttttagtagagacagggtttcaccgtgttagccaggatggtctcgatctcctgacctcgtgatccgcctgcctcggcctcccaaagtgctgggattacaggcgtgagccaccgcgcccagcccattgtattttcttaacagacagatattgtcttcttgactttcttctcaagacaattttttccttaggtaagtatattttaaaatatactatttctatttctgtttgttcttaatctctttttttgccgtagggaggaaatgtagcctgaatcatttctgcttttgtatttttatggagatttgatttgagactagtatatgatgactttttgtgaacatacaatgaatacttgaaaaagaagaaattatctgtttgttctatttaatccccaccaaaacaaccattaatgttaccttgttttgatcttcagctcctttatgtgttgctgaatttcttatgtagttgataatgaagtattttaattttataatcatatttttatcatttctacttcttttttctcagagatatttgcatatatgttttgctctgtctttatggcatttagattccatgtaattatgctgccaccacccatgcctctcatcctgatacctctccttatcacatgtaatcatttttgctctaaattattttttgctatatattaacattggaatcccagcctttcaactacttgaagtttactggtaactctttttagtcttcctattttgttttaatgacctctcttgcccacagcttattgctggatttcattttttcttctggagagtggcaagccttttaacacaggaaattaagttgtattttttcaatcttcaggcactccaatttttgtcttaattgtttatctttccatgctgattacttttcttttccctcaattgttgaaacaccatgtgttttttctttctttctttcttttttttttttttttttttgagacaagctggagtgcagtggtgtgatcatggctcactgcagcctcaacctcctgggcccaagagatcctcccacctcagcctcccaagtagctggaactacaggcatgcaccacatcatctgcctaattgtttctattttttgtagagatggggtctcactgtgttgcccaggctggtcttgaactcctgggctcaagcaatcctcccatgttggcctctcaaagtgttgggattgcaggtgtgagccaccgtgcccagcctgtgttttctcttctattattactgaaatattggcaagctgtttttcattcaaccagccatgaaatgtgaagcaaacagatgttcttatcttgtatttattatcttacattgtccaaccacacactttggcctcccctgtgtgagatgacaggaatctgggttttgggcttcctctctctctctctctctctctctctcttctccatccttctctccctcccccacttcttccttctcctcaatgattgcaattaatgttctaaaacctactttttcctttctgtcttctatgtaatttggtttttaatttttacgctgtttttctgacagttgcactatttgcatacttttatcagtaataacccttgctctgatagggctcttgtttacttatctttgcaaataggttgttaattcaagcgtgtcttatttctagcatcattcccttttacatgttaccttttaaattcaggagattatttcaagtaggtcctagaaataagccatgtgattaatacattctcagaattcaacaatttctaaggagctctctgccgtctttgcaacgtgagtgacagcttggcaagataataaatctccaaggagcaaccttgttctgtgaagttcctgtagctgttgttccattgtctctgggtgtttgggatgtcatcagagaaggcagaagggattgtgatttatgtatatttttaaaatctgacctcctccttcctggcgtggttgcttgcagtattctttttggtttaaacattttgtgagaacttgttttgctgatggcctcgttaagcctgcagaagctttggtgtgcagtgcagtttcctcctcggactcctttctccaggaccggacactgacattccccgatagctgaggtttccggacatggttcctccggcaccctcctctgtcccctctgtgctccagtggaattatttttgccttctttcacttctttgtcatatcttgcactgtttccacctgtacatgttacatcctttttccagatacatttttccagataatctgtttttacttcctgtaatacaaattctgctttttactctttctaaagtagtttcggccgggtatggtggctcacacctgtaatcccagcactttgggaggccaaggcaggtggatcacttgaggtcaggagttcgagaccagtgtgagcaacatggcgaaaccctgtctctactaaaaatacaaaaatcagttgggcgtggtggcacgcacctgcagtcccagctactcggaggctgaggaaagagaattgctctcgaacccaggaggtggaggttgcagtgagccaagattgtgccannnnnnnnnnnnnnnnnnnntctgatccgcgcgtaaacctcaaaaagcattggtatctagcgcagctacttctacgactcctttcctcagaagccgatgctgacatgatccgacatgcagagttggaggaacatggacgtcggccagctacgacatgtcacttaagtgagacagtgtgaattagttttgctatattcaaactctttgggaagaatgaggtgttcccacctgcaagttgaacgacttatagccggtgaatgtcacccagacactgtgcttgagttgcaaggaagcaaagttttgcttgtctgctttaagaaagcataccagccgtgaggtggggacgtactcttagaatccggggctctgagatgactcaaccattggccacatgtaaagcacagggatcaggacctgctgaggcagacgatgtgagcctggcgtcgaggtagaacagcaaaagccaggggcgctgggtggctctgatcttcagtcccagctactcggaggtggaggaaagagaatttctctcgaacccaggaggtgggggtgtagtgagccaagatttgccactgcactccagcctgggcaacaagcacaaaactttgtctcaaaaaaataagtaaaaataaaaatactttctttttttttttttttttttgagacagtctcactctgtcacccaggctggagtgcagtggcgtgatctcagctcactgcaacctccgcctcccaagttcacgtgattcttgtgcctcagcctccctagaagctgggactacaggtgcatgccatgatgcccagctaattttgtgtatttttagtagagacaggatttcgccatgttgcccaggctggtcttgaactcctgacctcaagtgatcagcccaccttggccctccaaagtcttgggattacaggcgtgagccacttcacccggcctaaagtagtttttaattaggatattgtaattgaaactaattatactgcagtgaattaaagtttcctttatccccaagcctaatggacacattaactcacctctttacagggaggccagatttctgccattgtgggaaggaggcaggaggagccgggggcagtgctggggtgggagctaggccagggcgaggctggctgtggaagggccctttgggcagccgcaggccatacgtcctcagacctggggcagccaggaccaccagggaatgttgctgacaggcagcaccagcgcctgaatcccccgccccagatggacctggctagggggtgagacccccctgccacccctccatcccagaagccaggcggggctgaggctctatgggtccccaccacacttatttattggcaccttcatcctcctggtgcactgtggcagttccaaggcccaggctgtccaggtggcttttgaagtgtggagaggcccctggacggctggaaccttctcccttgctcgggtgaatgtggctccccgtggtgcacaaacacgttcaaagacggaacagagggacacgtgttcataggaggtgagacaaagcgttgccagccctggggaacaggagtggcctgttcctactcctatctggttgtggttctccttcgacaagttaggtgaaggcaccttggtagcagggtacccttcagaatccagatacctgattcagctcagcagccatttgctgagcacttagcaggcacctagccaatggtgccagccaccaagggcccagcagggcaggacctccccctccctcctggagccacggccccccagcaccatggcctctggagcccctcaccctcccttgaggtcagccctatggtggcgattgtagagcgagtcaggagcgagacaggaggccacgtgttgcctgcctgtgtggggctcccatccaaaggcagggcagcgcgagtcacatgcccaccccctgctgtgcaaaggggtcctgtgggggggtcatgggctcccatcagagaatggcatggtggtggccctctgagggagttctcaccacgctgctgctgtgagccagggatcactgaacccattttaaaggtgaaaacaccgaggctccgtaactgccaactcctcaaagcccccacagtgaacaccccacgttgggatgtttcctggcctggcctttccccacactcagtgttgccctgagctccaaacgaggtgagattggggcaggagggcaggggtggcaaggctgctaccccgatggaggcggccagttggtgggatgcccgaacagggaccagcatggtgcagggcgccccgtgggtgggcaggatgggtcgctgaaggctcgtgaagcccggcaggggtccctgaagagtctagtggcatcgggggagagtttcttgtgcagagagggcgagtatgctttgggccggctggcctggggctgagaccaggggtggataggaaggcagagcccgtccagcctccaggccagcgttgcttcacaaggacaatgcccccagggtgttagcatccaaatatagcttgccggctgtcatgcttaatcctgagactcggacacatgtcacacccatgtccccgtgaggtgggaaccctggggcctggacaggcctgagtgtggtctcagccccatcacacacagctgggcagctagacctgggtgtccccacaggggtgccaggacacctcccaggggttgtagtgagccctcagcacccggcccacaatgggcacagctcagcgatctcccagcattccctgatcctcggaccctgggacgcaatgcaacccctgctcaggcccagatgcagccagcataggacagtctgtgactttgcctgggacacccactgcattttaaaactgcacttcatttggcagccccaggagccagggcgctgcccaggcctgttctcagaggaggtattatgcccgtccgcccgcccgctgtggctgctctgtggggagcctgacttggcagctcccaggctgtgtctggtgccagacctggctgcacatggagccagggatggatttagaaacctctcgcttctcccagcatgggcagaggcgcccagattcctccccggcctggggccaccatagcaggagaaggggagggaggcagaggaagccaggcccagggagggccaagcagcccccaggcagacccctggaccgttccccagtctgcactgccgcctcagggacctccccatcacctcagcaagcgcccttttctgtaaggagggggtaagaacacctgccctcgggtgatgtgagaagcacactcacgcggggaaacaggtcttagtattttcttagactttgttttgttttgttttaaggcagggtctcactctgccgcctagattggaatgcagttgcatgatcttagctcactgcagacttgacttcctggactcaagcaaccctcttgactcagcctcccaagtagccaggactataggcacacaccaccactcctggctaacttttaaactttgtgtagagatgggggagtctctctgtgttgcccagactggtctggaactcctgggctcaagcgatcctcctgttttggcctctcaaagtgctggggttgcaggcgtgagccactgcacccagcctcttagacttttggacagcagaggggccaggcctttaaatgtcctgggggtgtgatgtgctgtccgtggggatggtggggtcacctgccccagcctcagtgggtccctcttttacatgcctgcagctcaccggatgctcccgtgtggcactcagctatcatgaggtgtgcatccgtccaggtggaccccagagccccgcatgcaaccacgggccccgcctgggcctcagcctccatcccaggaatgggagaaccagcttcacttcaggccaggaaagagggagactgaaagagcagatgacatgggacaggacagagcctgaggcccagacaggccatgagcgaggggaggtgagaataaggccacaggtggtcccgtgtctgccttccctgctcaacgtgcagagagggctggccattttctccggcttcatcagcatgctctacagtcactgcgagtgttgcaggaggaattgtggcctcctccacagcagcgagaacactgagccccgtttcatctgtcttcctcctgtttccttgaaccctcccaagattctttctttggtgcgttattcatgttgttccttttcctgcaagagagaggcctttgtcctccttgttcagcaagcacctagtcagtggtaaagtgcaatatttagctggtaacaaaggtgtggaatggaattggcttccatgatttggcgaagtatttgcaagaagcctatggtgaggcttcttgtttacagatccacgtgtcttagtggaaacctcagaaacacacgctctcgtggatgctgtcattcttctttttttgtttgttttggttttttgggggggggttttgttttttgtttgtttgtttgttttttgagatggggtctcgctctttctcccaggctggagtgcagtggtgcaacctcagctcactgcaacctccacctcccgagttcaagccattctcctgcctcagcctcctgagtagatgggaccacaggcgtgcaccaccacgcccagctaatttttgtatttttagtagagactgggtttcaccatgttggccaggctggtctcaaactcctgacctcaggtgatccaccctcctcagcctcccacagtgctgggattgcaggcgggaaccactgtgcctggccagatgctgtaattctttggaaagggatggagttggcatttccccttatgctgttgggaaaatggctttgctaagatgtcagaagtccctgttaatacaacttaaatagataaaccatagtcagagcctggggaaaattcctgtttaacatattcatttgcatgcagtgatgacacttatttcaaagcattcctgtctcagcaatgcagtaggtcaaatgtgtaggcatccctgggctggcacaggtacataggacttctaatgcttggccttttccctagtttgattgtactctctgaccagcctgatttaggaagggtttgatagtacaatatccgtctttccctcacgcgtgctgccagtcccagggggatgggagcagccactcacccgtaggagttccaggtgtgcacagctggctcagagcctgctggcccagcacacatttcccaggccagcacagtgtgctgaagtgcttttcatcaaacagttaacaagacttccttatacatttccccagtgtcaagaaaaacaaaaggtgcccagttctctgctgcctccagcagtgctgggcagaagtgagacaggaagccaggctcccgagctcacacacgcagacgtaggtgggaagctacactgcgtgggctttcacatccccagggcccgggctgaggcctcttaaagacaagctggccctgtgcttgctccacacctgacgcacgccaggccaggccacagcgtggctctctgtcaacagaggaagtggcgcagtaagtggccagcccctccctgctttggaaaggtcccgctattcacagaatcctgggtgtgagccctgacaccaaaggcagaaaccacaagggagaagccagccctggctgcctaaatgcgaaataagcctgttgctggctgccacgaaaatgccactgtgttccagtcctaaatggggtgcatgctattggtttgagacagtgatttttttttttttctttgagactgggtcacactctgtcacccatgctggagtgcagtggcatgatctccgctcgctgcaacctccgcctcccgggttcaagcaattctcctgcctcagcctcctgagtagctgggactacaggcacacgctgccacacccagctaattttttgtattttagtagagatggggtttcaccgtgttgcccaggctggtcgcgaactcctgacctcaggtgacccgcccgcctcggcctcccaaagtgctgagattacaggcgtgagccactgcacctggccgagagagagatttttatcacatgaagaaaatagcttctttctgtgttttcaaggttgtggcttttttaaaatcagaaaagaatattgagttttctcaaatgccttctcaatgcgtattaaaatgacggtacatttttttcccatggtgtattaaagtgtgattttgtagtaacaggtttaaagcattcctgaaattagccctcctttaaataaaatatgctatgtggctagatgaagtttgttagcattgggtaggggacttgagtgtctatttataggtggaagcgaagggcatctgttccgtccgtgtgcgcatgcgttgagacgcatgtcatgccatctcaagaggcttgggatcagggtttgttaacttttttaaatgaactgggaagctgcacatctttttctttcactttaagaatttgcagtggctcacgcctcccacacctgtaatcccagcactttgggaggccgaggtgggaggatcgcttgagcccaggagtttgagaccagcctgagcaacatagtgagaacctgtctcaattaaaaagaaaaaaaaagaatttgaaagaactgcctgggatctagtgccttttgaaacagcaattctttaataacatttgccatttttcttcttggaattcctcctttttaagtcgatatttgatagtttataatttaaccaaaaagtatcccaattcactgaggattttccaatttttaacaaaccttttttacgtattaatctcttatacttcttctttttcttttctgttttttgttttttgtttatttgtttgtttgtttaggacagtgtctggctctgtcgcccaggctggagtgcagtggcacgatctcgactcactgcaacctctgcctcctgggttcacggcattctcgtgcctcagccactcaagttaactgggactacaggtgtgtgccaccatgcctggctaattttgatattttcagcagagatggggtttcgccatgctgccccggctggtcttgaactcctgagctcaagtgatctgcccacctcggcctcccaaagtggtggtattacaggcgtgagccaccgcacctggcctatattagcttctaataattattgatggacaaattatgtgccatttggagagatttattttgttctttttaaaaaatatcttgctttggatacttattttgtttattttcatttatttttgtttaataaaataatgtataactattaatttttctcagaattcacttttgccccattccattcatttgtacatatagtattgccgatcttgttctcttaatattttgtaattgaatttttaaattctcctgtgacttcgaaattatataaatgatctttcatttctaggaattccatttttttaaatttatcctttttttaaaactaatttttagttttcagtattgtagcctgagaatattgacttatgatttatactctggggatttgatgagtctctttttgccgcctaacacagacccaggggcctttgaaaagccggctgagtctctgtagaatagaacctttatcagacagtcactgcatcggtttattaacattatttttcataatcactttatgctactgtttatctacctagccttgggaggtgtgtttaagtctcccacgtgtcttgcgttcctggcagctgcgggctgtctgtacgctgtggcgcagtgccaactgtcctgggtggagcatccccatcagccccactgatggcccttctcaccggcctgggccaggtctgctgggaagcccacacccctgctcaccttctgtctgcgtctcctgggtacatccctctctcgctgtcttccttcaggctttgtttcactttgccttggaggtggccactgtgaccagagtaagtgggatttttgctcttaccctccctgccccggtggtgtctgcagtctggttgttgagaccaacagtgggtgaataatcacatgagttcatggacagccacaaagtaacacccatctatgaaggaaaaccccactttgctggggaagccaaatatgattgaagcatccagaaaaggcctctttgaggacgtgacatttaagcgaagggcgagcatagggtggccttgtgaagatgaggctaagagctttccagttaaaaggaacagcatgtgcaaaggtcctgaggcagaacactggccactgtggctagaatgtggccagcaggagggaggggacccagttgagtgacccacacagaagcttctgaatctgggacaggtgtaatggtgagcactgaaggcgtgaagcaggggtgggaaggtgtggacggtgggcttgggcagcggccagggtgtgggatgtggcctggagagcccgtggtagctaagcccagcatgcagagtggagggcggtggaggggtttgatggctgcccctgactaaactgggggaggcagaagaaggggtagatagatgccaagcccccacatactcactcactacagaaaagtggaagctggtatgtaagttgtaataacccatccaccaggacgagtcacttctgccccatcctgggcacagtgatggggcctcaggaggggagggcacccttgagggaaaggggagccatgataactcaggggataggcatggcatgggggccctgagtcacatgtgttcacagccagaagtgaacagcccaggcttcaggtggaggagggagaatggggaactctcaggtgcagcccaaggccaagagagaaggagcacttcgcgggggatgcctctcctccgggggctggtaagggcccggggtcttcagtgagtgaggatgccccactgccacccggagcaaggctggagtgaggatgaggtgggggcctggagcaagggcgaggtggaagagggaggggtaaggagggatcgggaggaggaggaggggctgggaggaggagggagggatcagggggtggaggaggggctgggaggaggagggagaggccaggaggagagagggatcaggaggaagaggaggggccagaaggacagggagatggaggagggaacaggaggaccaggaggacgcagaggtctccgcagagggggtggggggaacacagcgaggaggaaagtggggtcctgcccccagggcccaccccgcacccccactcacccttccacagagccccttcctgcctcagagttgggtcccgcggggcccccagttccacgcaggaggccactgagactggagaggcccaacgccccgtccccgctccctgtctgccctgcacgcctcccccatgagccgctgtcaccagagggtcccagccctgcctgcacatcagagccctctggtgggaagacccaggctgccccagacaccaggcacggtggctgcagatgcagtgacgccaacatctagtttcctgtgagccttcctgctaaaatgagctgttaaatataattataaaaagtatgtatgctcaaggtagaaaacccaaaaaagttgagagaaaagtccttcgtgttattaccattctggtggggatcactcctgtgacattctgctgtgtccccctcccatgtggaccattttaccccaatccaggctgtttatggcacctggtctaacctgctgctgcttttcaaaactttatttatttatttagcagagagactgggtctcactaggttgcccaggctggtcttgaactcctggcctcaagcgatcctcctgcctcagcctcccaaagtgctaggatcacaggcatgagagctgttcttctgcccagctttagaacataaatgtttttccacatcttaaaattttcttcctaaatataattttaacagctacataatggagccactcataaacaatttctgtgaccgctgtcctgttgtttgctgtttttcataattataaatctgcagtggacaccttcttacatcactgttatctatatttcacattattaatttaggataattcccagtaatgcaattacggggtcaagaggcatccgtgagtttgagattattgatacatattgccaaattgtgtttcagaaaaattgtaccagtttatcttccctgaggattgctatgagtgcctgcctcagtatcctacaccttcactagcattcagcattcttttctttttttttgagacagggtcttactctgttgcccaggctggagtgcagtggcaggaacatagctcactgcagcctcaatctcccacctccctgggctcatgtgatcctctgacctaagcctcccaactagctgggactacaggtgcatcccatcactggcaaatgtttgttgttgttgtttctttaagacagagtctcgctctgtcacccaggctggagtgcagtggtgcgatctccgctcgctgcaacctccacctcccaggtccacgccattctcctgccttagcctcccgagtagctgggactacaggcacccgccaccacgcccggctaattttttgtatttttggtagagttggggtttcactgtgttagccattttgtatttttttgtagagacaaggtctcactatgtttcccaggctgctctcaaactcctaggctcaagcaatcctccggcctaggcctcccccagcgttgggtttacacgtgtgagccaccacgcccagcctagcattctcctttttaagaggagtgccatctggatgtttggtctttcatttcacatgcttagtagtcatttgtatttctagaagaaatattgggccgggctcagtggctcacgcctgtaatcccagcactttgggagtctgaggcgggcggatcacgaggtcgggagatcaagaccatcctggctaacacggtgaaaccccgtctctactaaaaatacaaaaaaaaaaaatagccagggcgtggtggcgggcacctgtagtcccagctactcgggaggctgaggcaggagaatggcatgaacccaggaagtggggcttgcagtgagctgagatcatgccactggactccatcctgggcaacagagcaagactctgtctcaaaaatagaataaaaatcaaaataaataaataaatgaaagttagccaggtgtggtggtgcacgcctgtaatcccagctattctggagggtgaggcaagaggatcacctgagcccgggaggcagaggttgcagtgagccaagatcgtgccactgcactccagccccgagcaacagagcaaaacgctgtctaaaataataaataaattttaaaaagcgaatataaagccaaaagtgctttcccctcagattttctgacaatttagacacacattgcctggtcaccttttgcttaagtataaactcaaaaaggacaagaaatgtatacgtcatgagccagtcaagtgaggacctgtatctttatcttaataggagactaagacttgaacaagcgaatgaggtctccaggatcactctgggtaagaggtggagctgggatttgaacccaggtctatgggtgacagggcccaggctcagatatttcatattagggccagccgggggtagctgggggacaactgcaacccagggtgtccccagagtagatgactcacctgtgagcatcagtgatcacactttcttaccagcaagtaaccatgaacagtggtgtcgggccttgacttgggacccagatatgctggaaactcccaccataggattcaggaacattccaagcaaagtttgcttcgagccccagaatagaaggtcctagccaaaaaaggataattactcagtgacacgagaactgaaactttagggagttaaagccagggtgtatttttcatgactattttgggtccttcagtccgttctgtgttcttttgggcagaagaatgtctgtactctgaggggaattcttttatcacatcctcactgacggagctcacaacatttattgaaagtttcagctgtcacttctgtataaataaacaggatgaagtgggcagccgactgcacattagagatatttttagacgtgggtggcactgcaatccagaaggctgacatatcaaggagagagtgcctgatcccagaatagcccacccacacacggccctatctgcctcagcgtggcctcggcgtgggttctgtggtggcgtggcttcctgcatccgctccttcctgttctgtttggccagtgcagagatggcaatagctcctcctaaaaatgccacagctccgctcctcagaggacaggggtcagtgttcaggatcatgtgtcactggatctgcagaacaccaaaaactaaactgcctgcgggtttggtgggtctgagatatgggagaggatcatcattcaaagcaggcttcattggtcagatgccagtggctcacgcctgtaatcccagcactttgggaagccaagaagggtagatcacctgaggtcaggagttcgagaccagcctggccaacatagtgaaaccccatctctactaaaaatacaaaaattagccaggcatggtggaccatgtctgtagtcccagctacttaggaggctgaggcaggagaatcgcttgaacctgggaagcggaggttgcagtgagctgagattgtaccactgcactccagcctgggcaacagagcaagactttgtttcaaaaaaaaaaaaaaaaaaaaggcagcattctcactgtttagccctgtagttgagaaggctggacttggttttcagcaacaataacacgtctaacatttaccatggaccggccacataacgtgcactcattcgtttttcccccacgatgagactcaaaccgtcacgacttcatgtggctttttccacttctgttttcttcttgaaacatgagtccttgttcacctggagagaccacacaccccaatgcctacaggcacggcacactctctgctgcctctccctcctcatgcctcatctactaggcctcttggatgggctaagggaggccctgcacactcagggcagtgacctagagggcagccaggaaggaaaaacagtgaccgtacgataggggcgggggtagaggggtgctgggatgccggagaggcccctactttttctgtatagcctcttaaagcccccaggggtctcctcacatttaatttatggcctctgatccatttactcactttctagattaaatataaggaaaagtacccttctattgtcttcattttcactgtttttggagcccttcatctatttatgtggatctcaaactctttcttatcactgaagaactttctttgacatttcttgtagcacaggtctgctggcaatgaattctctcagctgcttttttctcaaaaggttcttatatcaacctcttttttttttttttttttttttttaaagacagtcttgctctgtcacccaggctggagtgcaatggcgtgatctcaactcactgcaacctccgcctcccaggttcaagtaattctcctgcctcagcctcccgagtagctgggattacaggcatctgccaccatgcccagctaatttttgtatttttagtagagatgaggtttcaccatgttagccaggctggtctcgaactcctgacctcaagtgatccgcctgccttggcctcccaaagtgctggaatcacaggtgtgagccaatgtgcccagcctcaacctcattttcaaaaggtatttttttctaggtatagaattccaggctgacaaatgtgtttcccctccccgcaacctctaatactttcaagatgttgcccattgtcttcccacatgacaagcctctgataagaaattaagaaatctgctgtaactcactgttcttctgtatgtcttttttcctctgacctcaagattttttcctttttctttggtgctcagcagttggagtttgatgtgtctatttggttgtttgctgttgtagctgctttgttttctgtcctgcttgaggttctccaagcttcttggatctgcgattttatgtctttcattatttttttaaaagcctgagccattatctcttcaaatatttcttctgctccattccctctcctctttctgggactctcacattatgagttgaggttgatgtcatttataggattgtcatgttacacagttcttggatgctctggttttccctcacttttttttctctttgtgttccagtttggttaatttctactgacatcttcaatttctctctttcctcagttttcgtgtctgctgatgggcccattgaaggaattctctctgatgccatatctttttatttctagcaactgtctttgactttgagttttcacttctctgcttaaattctccatctgttcatgcatattgtctgccatttccactagacccgttgtcatactagccattctaacataactgtctgatagttacaacatctaggtcgtctctgagtctaactccattcattgttttgcctcttgacaatgggttggttgttttttgttgcttctgaacaaaaaatatataatttttattgaatactgaacattcatgtatagaacagaggtgactacggtcaatagtatttacatatggaaatgggtaatcctcttctgtcagaccgttagtgtgggatttgagtcaatcttgttaggaattgagctgggtttgggatttgtcattgttatggttatcttcaatgtaccataggcctcaagtacctctagcaatgagctgtcattgccttgtgcccagggttgggactagggcactggaggagattcctcagtgtggtgccccaccctctgctttcagctttctcttgcctgcctgtgctgcagcatggatcttaccccactttctctcggcagtagacagctgctgcttgttattctaccaaggttatgttcaaggcttggggtgggttctctgtgtactggtccagcctcagtttagacaggcccttccctgtgcccttcaccccagcattcctacccctcttccctgtggcaaactctgtcggggtcttgggtgtgactgtcctgtcccttccccagtgagaagagacctctggtggtggtggtggtggtggtggtggtgtttttgagacagagtcttgctctgtcacccaggctagagtgcagtggcatgatctcggcatgatctcggctcactgcaacctccacctcctgggttcaagcgattctcttgcctcagactccctcgtagctgggattacaggtgcccgccactgtgcctggctaatttttgtatttttagtagagatagggtttcaccatcttggccaggctggtctcgaactcctgaccttgtgatccacccgcctcggcctcccaaagtgctgggattacaggcgttaagccaccacacccagccaaggcctctgttttctatggtgcaggatcgtaggccaggatggtttcctggtgcccttccaaggaaaaagagttccttcctatccttcccctagccatggtgtgtctttgtctgtgccctgggggtgacaggctgtgctgttcctccctcagcagcctaaggcatctgcttcccaggagagaagagtctgggatggtggaaagggctttgagcctgttcctaccctggctgcagccctggtggcacaacttccacagcaagcctggcatcacactggcatcatggatacgggggtgaaggggactcagcacctgccctagaggcactcaggctgcccccatggggcaagggctcattcaaggctctctggcttacggatgcccactgtggcctcaacccccagtgagtgcaacttggacccagacaaggaagtgtccaagctgtggccagatctggccaccgagggcgagggacagtggtgaggtgtgagacccgtgcagtcacaccctggccctctcacctggcagccctccagccttcccaaacctccatttccctgtctacaaaacaatgggtaacagcggtccccgagcatgagcgagctcacacacaggccttgccgagcctgtgcctgtcatgcaggggtacccagtggaccttcatgattgcagcagttatcatggaatggtgacaacagtgaatgccaccaagaccccttcaggccatcagtccccaagaacaggctctgagccccatgaaacgccagaggggcctttcttcctgagtctcagggctgttctgtgaagcaggaggtcacagggggttggagggaatgcagggctggaggcagaaggagccggcgtggtctgggctctacccacggccagtgatgtctcagagcctcagtttcctctgctgcaagaggcacttgacacccacgtcctgggttggaagatgacacagaaaagcaccgatggctgggtccacttgggttttgtccacttcatttcaaagggcatcctgtggcctacaaacccacatctatggagaaagttgttcagaaacagatggcgtttgctctccccagagagccctggggagcagagtcctgagagcacctaaggggcagggtgggaatgagctcacccgctgtggcttcgagggttaaaattcctggagcagaggggactccgcgatggcttctctccaagccaagcccaaggaacaccccaatggcacaccctctgcccgtgccgcccaggcccctggctcggcacggccacctccactcccttccttctagcctggtggcagccatacctgtgggtaaaggcacctgcagccgtggcaggatagggtcagaggccctgtggtgaagtccatatggggtcacacgtacccggtcacacacacagaataacacagtcacacgtgcacacacaggttcacacacacagaataacacagttacacccacacacagggacacacacagaataacagttacacccacacacagggacacacacagaataacacagtcacacacccacagacaataacaagttacgctcacacacagggacacacatacagagaataacacagtcacacacacacacaatcacacacagagaataacacagtcacacacacacacagagtaacacagtgttgcacagtcacacatagaatgtcacacactcagagaataacagtcacacacagagaataacagtcacacccacacacagtcacacacagaataacacaattacatatacatagtcacacacacagtaacacacagaataacagtcacacacacagaataacagttacacagtcacacagaataacacagtcacacagtcacacacagaataacagtcacacagaataacacagctatacacacacagtcacacacagggaataacagccactcacagataacagttacacagtcacatagtcacacacagagaataacagtaacacacagtcacacagaaaatagtcacacacacagtcacacacaaaataacagtcacacaatgtcacacacagtcacaaagagaataatagtcacacagtcacatgcagaataacacagttacagccacacacagagaataacagtcacacacagtcacacacacagaataacacagtcatccacacagagtcacacacagaataacagtcacacacacagagtcacacacagtgaataatagtcacatacacagtcacacaggaaaatagtcacacacacggtcacacagagaataacactgtcacacattgaataacagtcacacacagtcgcacacagaataacagttacacatagtcacacacagtcacacacaaagaataacagttacagtcacatacagaataacagtcacacacagacgcgacaccagcctgcgaccttgcccagggtggcagaaggagctggtggcagaggagctggtggcagaggttcgggccttatttggccacccagcctggcttgtcctcctggtgcagacagagctgcgaggggccccacggccacgccagggcttcctgcaccacgggccgccatgcaggtcgccttggagtccccttggagccatcgggcccctgccctcctggatccagggccactgcctcggcgtcggggcttctccgagccaagcttcagggctgcatgaggggccacggtgcagcagcccgggctggggtcccgcgttggatcccccgcctgcccagggtcttaccacctcctcttccatccgcaggagctacagggagctggccgactgcacctggcacatggcggagaagctgggctgcttctggcccaatgcagaggtggacaggttcttcctggcagtgcatggccgctacttcaggagctgccccatctcaggcagggccgtgcgggacccgcccggcagcatcctctaccccttcatcgtggtccccatcacggtgaccctgctggtgacggcactggtggtctggcagagcaagcgcactgagggcattgtgtaggcggggcccaggctgcccgcgggtgcacccaggctgcaggtgaggccaggcaggcctgggtaggggcagcttctggagccttgggacagagcaggcccacaatgccccccttcttccagccaagaagagctcacaggagtccagagtagccgaggctctggtattaacctggaagcccccctggctggaggccaccgccaccctaggaagggggcagggacgtgaccttgacttacctctggaaagggtcccagcctagactgcttaccccatagccacatttgtggatgagtggtttgtgattaaaagggatgttcttgaacttggaaagactcattatctctgggtacccatcactgggagaagggtggaaacccaggccctgcggactctctttcctctaacaggaggaatcaggggcctttgctcgggggtggcattggagccagtgctgagtgcactgaggtgctcctggggattctggggcccttgctgccccccggcgacacagtccagaccagggctggacacactgagctcacagaccaggaagggctgggaccctccccacagatacctggggccttgggtgcaggctctcttcttgtctgtccccgaggcatcaccgggcttggccctctgcccgtcacctccctgctctccatccatgcttctgcccacgcccctacctgcagcttccagaagcctctggctccccaaaggagcccctccacggtccctccggggtgtcccctgagttcagacccctcctctcgggtccctgcagcccccaggacctgtcccttctccagtgactgagaagagtgtccactcccccatcaccttcagcttgtcctctccctctgccccacaggacagccccatccaaacacggcagccggtgccgtggccttgtaggttcagctgtagcccaccacagccacgtggggccacccaccgcccaggctgggctgagcccaccagaccccaggcagcccatcacagcagcctcccccaacagagcccctgagcctcctcctgggtgttgcggtccccaccccacgcccacaaggtgcacccatcacgggcagtccccacctccccacccagccagtcccaagaggcatccccagcctaagagaccagaaggagccccgagtggcttctcggcttctccagcggaaccgtggctgtggtgtgggcccgttttcccaagaggagcaggcgtggctgcaccttacactgggtcaggagaggagcccagggtctactgacagtgggcggtggcctcagggactgatcctagtctctgtcttgttgggaaccgccgggactccactgtccgtgacccagtctcagccttgggccctcagtgagggtctggtcagtctgctacgccaggccccagcttcctccgcttctaggatgtcaccacctgtgagtggagaagccgagggtgctctggggccagtggctttgggccataaggaaataataagaatgacaacagcagtagcgtttgcgtgagccgggcactgcgctgtgaacttgtgctcataaaactcccagagaagccccttgagggagagcctgtcgttgtgcccatttcacagaggaggaaaagagagttcaagtcacttgcccgagttacttcaataatgtgtccaagaagattccttgagagactccaatacacaggacagatgaaggcgaagaggggccaggatgctgcctcccccttctctcctctgttcccccctcagctcctccccgacctgccccctgggccacactggggtccaggcctcacccctgtgttcacaagctggcctttcctgagaggccccagtgagggcgaggagacgggaggtgggagcttctcacacgatttcgacctgcgataccgacggcatctctcagacaacctgcagccgggccaacctgggttggggggctgtgctgggacctaagtcagggaccaccggaggaggtagcccttgagccgccctggagcccgggccatggctgggtcggccggctaggcaggcgtgggagcttgggatggagtcctcctgcaggggactggggaaaagagggattcactgaaaattaccaccaaaacagcgcccacggggatggcccacaggtccactccgggaacattatcagtgaggccaggctggggctgtcctcttaccagtaagcatttgtcaccttagttgacaatgctttttaagacactgtctagtccacaccactcactccgccatctccacttccagaaatctcacccctccctgggatccagggacccctgagccctcagccagctcttcctccatctgcctcctttcctaagggcccagttgtaacccacctgcactcatgacacaaagtggttatgagagctggaagaaaatgggacaattgtctcggctcatcccccacttctcccctagaaagccagggagtcctgaggaccctagtggctagcccacggtcacaccaccagtggcagagccccaggccctggcttcagcagccccgcggcccccgggcccccaggtggggatgcagagcccactgctgcacatgcagaatcctcccagaatccgttttagggctgtagcatcttcaaggacaaggccctgccatgtgctctgccagccgtgtgtgtgtgtgtgtgtgtgtgtgtgcgcgcgcgtgtgtgcgtgtgtgtgcgcatgcatgtgggtgcatgtgtgtgcatgcgtgcgtgcgcatgcgtgcgtgtgtgtgcacgtatgtgtgtgcatgtgtgtgcgtgtgtgtgtgtacaaacagtaaccttcaagtgcagctatcccttccaatgttctattgctttattcagtggtcacgacgtgggtttttcactggttccaggcctgctgtttgctgctggttgtggttgtggaggggtgtgttatactttgtggacatgaatctcctgccacacatctttctaggtggccactcacagctgtgctaccacttgcctcagattaataagatttgttttgattaaggacagtaacctttcccaggacaccgggaccgtggctgcttttcacatcacagcaccgacagaccctcatgaccactgccccattatagggaagcagaccaagggaaactagacactgaaattcagaggctggttttatgtaggagaaggtgttcccagagcactctaatcaaaaaaggtctgatccaaaagatgtcacccaatttcataaacttcagagtgttggctgttctggaaggatggtatgcctattctacaacttggaaaagtatgtctactgtcatcagaaataaatgtgacaggccgggcatggtggctcacgcctgtaatcccagcactttgggaggccaaggtgggcaggcagatcacttgaggtcaggagttcgagaccagcctggccaacatggtgaaaccccgtctctactaaaattacaaaaaattagccaggcgtggtggtgcacacctgtaatcccagctactcaggaggctgaagcaggagaatcacttgaacccaggaggcggaggttgcagtgagctgaaatggcgccactgcactccaggctgagcaggagagtgagacgaagaggaggggaggggaggggaggggccgcagaaaagaccacgctgagaccaggtcttccttactgtcccgcctccacacactcccaactcacagggacaataatggcatcttcctcaagtgggtattatgttaatgaggtaaaatgggttagtctgagttttccgagaagtagatgtggagactgggtttcagatgcagggtggttattggggcaaactccagaagcattagggagccagtggggaagacccggggatctgccctaggctgccatgccgtctaaggttccacaaagccatgggggtgtccttgcaccaaagccagctgtcagagccttcctgggggaggaggtctgcctgaatcccttcccaccccagcctcaagcagcggggcagccctcgtgaagcgtggcctcgcaggaagccacgaggcatttcagagccagcagctggggccctcggtcggctctgctcccttggttgaaccaaagaatgtggccttatctggaaataaggactttgcaggtgtaattagttaaattcaaataagattgtacttgattaaagtgggccctgcattcagtatgcaggtgtccttagagaagaggggatacaccaggacagagagagaaggccacagagattggagccatgcagcgaagaaacgggggggccgaggtatcactccagaagctgcgagacacagaggctccccgcagagccttcagaggacacagcctctgcagcccctcctgaaatcacggctcagtaggcgttatcattagaatgctttagacagtactaacagtgcgcaatgtcattactttaaaattatccaagctaagggaagagacgagggtgatggagaatttctcagtatttagactggacttcagaatgtgtgtttgcgaaggtttagggggagcaagagagctttcggttttccttcttcatcgtcaggtcacgatgggcagcgggtgaggtctacgggcaaggccagctgtggctgggatgggcaaagctctgcccttaccaggatgccctgtccgctcaggttcctggtcaagtatttgcacatcacaaggctgggaaccaagaactgaacgccggcacgtagggtggtaaaggagaggtgggccgggcatggaagcaccgtcccttctccagccttctctgatgggcccaggacgggaggcagtgttgacacagggagggtctggggtctctactaagctgactgggaaaccagtggcaggggtgtgtgtgtgtgtgtgtgtgtgtgtgtttgatttttggttttgggggggtattttgttctttttttttaattaattttttttttttttgagaaagactcttactctgtcgcccaggctggagtgcagtggcatgatctcgactcactgcaacctccacctaccaggttcaagcaatctcctgcctcagcctccggagtagctggaattacaggcatgtgccaccacgcccagctaatttttgtatttttagtagagacggagtttcgccatgttggccaggctggtctcaaactcttgagctcaggtgatctgcccgccttggcctcccaaagtgctggcattacaggtgtgagccaccgcactcggcctccaaagccaattttaattaaaagaaatgagattgagtggctttattgtgtcctgagctggagaaacactctcttatccagagcttgtcataaaaatccatgtcataaaatgtcacagaaatccataggaaaaaaatgaattggaaatcaaaaaagctttaaaaagcaagggaaaaatatggaatttagcatgggaaatggaattgcccaagtacgtcacttaatgtttgtcttaatgagctcccagaaataaaattgctctggggacagggtttcttgtaaaccaagaagcagctctggattggaaaaatcttcaaagaaaggacatccctgttggatttgctactaaggaggccacagacagcctgggagcggaggggcagaggcagcaccagaatgcacaatgagcctgagcctgggaacaggtcactcctgccggagagaaagccctgaggcctctggagatgcaatctgcctcttgtttgtcagaaatgaaaactaggctgggcacggtggctcacgcctgtaatcccagcactttgggaggctgggagtcagggcggggggatcatttgaggtcaggagttccagaccagcctgaccaacttggtgaaacccccagtctctactaaaaatccaaaaaaattagccaagcatggtggcacgagcctgtaatcctaaccacgctggaggctgaggcaggagaatcacttgaatctgggaggcgaaggttgctttgagctgagatcacaccactgcactccagcctgggagacagagagactccatcagatagatagatcgatagatcaatagatagataggtagatagatagatagatagatagatagatagatagatagatagatagatagataatggtaccatctttctggaggccaagttggaaatatgtaccaaaagtcttaaaatgcttattcccggtaatttcccttctaagaatatatcctaaggacataattaaagatgtgcaaaaggacaggagggaaagatcttcactggagttatttataagagcaaagggtggaaacaccctcagtgcccaacactggaggactgtcaatcagattaaaactcagatgacagggaaaaactgttcaatccaatcaaatccagatgacagggaaaaaactgttcaatccaatcaaatccagatgacagggaaaaactgttcaatccaatcaaatccagatgacaaggaaaataggttctttttttttttttccagaaacagagtctcactctgtcacccaggccttggagtgcagtggcacaatcttggttcactcactgccacctccacctcctgggttcaaacgattcttctgccacagtctccccagtagctgggattacaggtgtgcaccaccatgcctggctatatttttgtatttttagtagagacagggtttccccatgttggccaggctggtctcgaactcctgaccacaagtgatccacccaccttggcctcccaaagtgctgggattacaggcgtgagccatccaccatgcctggctgggaaaaacaagttcttaaattaagtacatgggaattttttttcatagtgtagagttaattggaaaaggcagattatgaaaaaggagagtgaactgatctcaattttggtgtgtgtgtgaacacattccccaggccatatccaagtagggggagagcacataatacaactagcagaaacgataacaacacaacaggctatggtctggatctaggtgccacatcccaattactgggctgtcactccctggcattagatcagccttggcaggttctgagtcttttttttttttttttttttttttttagacggagtctcgctctgtctcccaggctggagtgcagtggtgcgatctccgctcgctgcaacctccacctcccaggttcaagcaattctcctacctcagcctcccaagtagctgggatcacaggcgcccactaccatacctggctaatttttacatttttagtagagacggggtttcaccatgttggccaggctggtcttgaactcctgacaagtggtccacccacctcgccctcccacagtgctgagattacagacatgagccacgatgcccagcaggttctgatcttgactggacccctttttagctgagtgactttgagcaaacttttcatctttctgataattttgtgtgcatggaaaagatgacttagcattggtcacatgccctattccaaggatggtgtttgagctccaaagagcaggccacctgccagaggacccgtattttttggggacagggatgagaatgggcaagaagagagcagatgtaggctgggagccttgagaacgggagaggaaagaggtttcaagacatttttctctagattgtgaacataattgcactttggttccccctagaacaaatttaagaaggacctaaattgcttttcaaggctattttaggaagtgaacttggatctgactttgttttttttcttcctgggcctgtgcggaggtggaccatgggtgcccatctttatttgggttacaaaaatgtgaagggggtgcagaggaacagcgggaagagagcagccctccaaagcatccctctctgccccaccccagccacaatccttgggcctggggacagtgctcatgcccccacgtgaatcgcttccccacagacactctgacaggaggccggggaagtttgcttcctgttttctgggggcagggcgggaggcagacaggggtgactggaggtgcatgtccatgacaggtggcagctgctttccatccccagtgcatcctgccatgagagcacctacatcccagccctgcccctgccacctaagatctcttcttacaagaagcagtgccacctttaaaatgtttcaaatggtcaggccgggtgcaatggctcccacttgtaatcccagtactttgggaggctgaggagagcagattgcttgagctcaggagttcgagaccaggctgggcaacacgacgaaaccccatctctaccaaaaatacaaaaacttaaccaggtatggtggcgcacacctgtggtcccagctactctggaggctgaggtgggaggatcacttaagcctggaggtgggaggctgcagcaagccaaaatcatgccaccgcactccagtgtgggtgacggagcaagaccccatctcaaaaaaaaagtttcagatggtcataggtgtgaaagtatataatgtaaataaaatgttttaaaaaacaatatttttaaaagttgtagcatagaagtgatggcaccaagctgccttagttgaaaccaaatcctggctgtgccgattaaaaatggtgaggcaggctgggcacagtggctcacgcctgtcatcccagcactttgggaggctgaggctgaggctggaggatcacttgagcccaggagtttgagaccagcctaggcaacatagtgagacctcatctctacaaaaaaatttaaaaaattagctgggtgtggtggcatgtgcctgtagtcccagctactcaggaggctgtgggggaggatcgcttgggctggggaggcagtaagccatgatcacaccactgcactccagcctgggtgacagaataagaccccatgtcaaaaaaaaaaaaaaagaaaggaaggaagaaaggcgaggcaagctcctcaaccctctgggcttcagtgtcatcgcctgcagagtgctggccatggacacttcagggactcacagtgaagacagcccttggccatgtggcaggcacatggcaaacgctgctaaccggggccatagtgattcactttcacagcagggctgggagctgtggctgcacgtgcacgtgaacacatgtgggtaaatgctcccgtctctcagtgttcccagcccttctgcacagaaggtcgggtgagtcaaaaggagaataatcggtgatcataatgataggaaacgatcgagtttggggattgtctcctcctcctcgggctcggctgaggataaagcagtgcagtcggagtctgcccaagctgctgctataacaggctggggacttaaacaacagaagtgcgtttctcgcagctgtggaggctggaagcctgagatcaaggggtcggcagggttggttccttctgatgcctctcttcttggcttgtcatttcctccctgcctcatatggtcgtctttctgtgcctgcatcctaatcttttttttttcttttgagacagggtctcgcccagtcacctaggctggagtgcagtggcgcaatctccgctcgctgcagcccccacctcccgggttcaagcaattctcccacctcagcctcccaagtagctgggattacaggtgtgtgccaccacgcttgactaatttttgtatttttaatagagatggggtttcaccatgttggccaggctggtcttgaacccttgacctcaggtgatccacccatattggcctcccaaagtgctgggattacaggcatgagccactgcacctggccctaatcttctcttcttataagggcacagtcacattgggttagggcccacccagtgacctcatttaaccttagtcacctctgtaaagaccctgggtccaaacccagtcacattctgaggtactgctggttaggacttcaagatgtgaagtcacattctgaggcaaggacacaactcagccaggacaagagccacttccccaaccataaaagtgtcacccagggcagtgggcttttctacctgacccaacacagccaatttaagctggaatggaattaaagtgttgtaattcacgtgaaaagtcatggaaaacggcactgcagtaaggcattggctacggaaacatcacaagattgaataaagacctgctttgcatcaacgcacatcatggcacgttctcattgtgggaaaatgtggtttaatgagggagacacggggaggggcagaagacctcagggagattccaaagaggattcccaagcaggtgcattcacgggcattggtgaaaggcagcaggggcttgtcatcccgcttctgaaaaatgggcaactct

SEQ ID NO: 275 - DNA, 899 bp, Homo sapiens
gcggccgccgcctcccaccgctcccgcgcccgctcccgcccccggcgcgtctcctccgggcccgcgccgcggcgggctcagtcctcagcggggcgcgtggcgagcggactcgactcggcaccgctgtgcaccatggcccgggccctgtgccgcctcccgcggcgcggcctctggctgctcctggcccatcacctcttcatgaccactgcctgccaggaggctaactacggtgccctcctccgggagctctgcctcacccagttccaggtagacatggaggccgtcggggagacgctgtggtgtgactggggcaggaccatcaggagctacagggagctggccgactgcacctggcacatggcggagaagctgggctgcttctggcccaatgcagaggtggacaggttcttcctggcagtgcatggccgctacttcaggagctgccccatctcaggcagggccgtgcgggacccgcccggcagcatcctctaccccttcatcgtggtccccatcacggtgaccctgctggtgacggcactggtggtctggcagagcaagcgcactgagggcattgtgtaggcggggcccaggctgcccgcgggtgcacccaggctgcaggtgaggccaggcaggcctgggtaggggcagcttctggagccttgggacagagcaggcccacaatgccccccttcttccagccaagaagagctcacaggagtccagagtagccgaggctctggtattaacctggaagcccccctggctggaggccaccgccaccctaggaagggggcagggacgtgaccttgacttacctctggaaagggtcccagcctagactgcttaccccatagccacatttgtggatgagtggtttgtgattaaaagggatgttcttg

SEQ ID NO: 276 - protein, 148 aa, Homo sapiens
MARALCRLPRRGLWLLLAHHLFMTTACQEANYGALLRELCLTQFQVDMEAVGETLWCDWGRTIRSYRELADCTWHMAEKLGCFWPNAEVDRFFLAVHGRYFRSCPISGRAVRDPPGSILYPFIVVPITVTLLVTALVVWQSKRTEGIV

SEQ ID NO: 277 - DNA, 45677 bp, Mus musculus
  misc_feature (1)...(45677): n = A,T,C or G
tggttggtttcacttcctgtgcagcttcccctggccaccagggggagctgcataccccacactggtgtgtcatccgttctgcctctctgactgtagggactagccagccaagcctatgtgattcccaccccagtgcaggactcagatgggtgttcaggggacagaagtggatggctgtcccacttggaagaggtactgtaggagttggccaggccagaaagaaataacagcagaaactattccagggatagagatgtatccaaaggtgaactttcaaggttccgtctgtgagtccacagtgggcagggcaagaaagacaggagggtctacatttctgcttcttctaaatctggtcacaaagcctgaaggtttagccttgggcagaaaagccaggagaaggggctgggtccctagccgagtgacaggtcaggatatcagagacctcgggctgcagttatgttgccatcctctgttgacatgggatcctgggaagacacagaggcaaggacccttgggaatcagtctgagcttccttgtctcctccaaagaccacccccaagcccaggagggcagggcggttagaggggctgctggtccttcctgccttccctggctgagggtgtgggtagcaagccttgcctcctcatcctcttgcccagtgatagaaggcatgtggtcagagacttgggagctgtccttccgcaaaccttcccagacacgggctgcttctgggtctgtagtactcccgttgggagttttgagagaaacagccaaacaatatgtgatttcccagaatctatcagtatgaagacatcaagggcatgggctgggcacctgcctgaacctggggtgtgtggggcttgagagtcaagggcagtactgggttcactcctaatactgccgcacacatgactcctgaggccagtgatgtgcagtgatcgatcacacgtgggaccccatctaagcataagtataactttattgtgccctagctgggtgtcacggccccgctcccattccggccattggctgtcaactttagcctccttggatatctgctatcaacccttcccgtgggttgggatgtctctcgctactgatggtggcagcagtgggtggagcacggggcttcagaagctgcgccttcacctcagctgaggtagaagaggcacattaaggtattggcaaagaagaggaaactgcaggcacccgcatcgatgatggatgaggccccactctttaagggggtttttttggtggaggtgctgtttttgttagtaccagaagcggccgtagtggcttgtcccaaggatcctgtttgtatctgcaagagaagcgctgctcagtaggatttgaaccttctgttgagggctcctgcccctttgttccctttcttcaactctaggcttccataaaactgccatcagccctgttgagatgtttggcttcccacctcatcacaggcaagggaaaggcagcccccatgtttgtcattcttccacctcgaaacttcccaccacttttcaggctgccagatcctccagcaaagagggaaacagaaacccgaatgtgggcttcccctcccagagcctcggtttcctcatctcctggtgatcagagtccaccatggtccagagtatcacacgtgacgggcctgagtaaggcccctggcagagggtggggtggggatggcaggtgacaagctgtccttgatgcttgatcgggcagtaactgaagttgcccttgatggtcatcaaactagttttggtggccatcaaactgccttgatgcatggtctagatgttcttgatcaagaacttgatggctccattccctgtgttaatcaggcctctctgcgtacatagtgccacaaaggatgcctcccagggtggcagttgatctgcagagtatatgggagacttctgtctctgtattcctgcacacccacgattcactatggcaggggcaggggaccctcggtcacctatggcagtctattagacctctctccagccctctcaaaagggccacttctgcggctctcctcatcagggcttcctctcctgatccagaattacccagaaccctctgagtagcttcacacatcagacaccttctgagatttccctctctgaggccagtctgatagcgcctgtgaggagtagaaacccagccatataggccctcctagatcccctggtttccagttggcgaccatctatctctgtccctgtggtagaaggcaagggtccccaccaccaccaccgagaacctgcattccttccccagaacctggaccaaaccattaagctaagacctggtggtagctgcagtgactctaggaggagctgtccttacctgaatcacaaccagaagaatgatagtgaggaagaggaggaagctcttcatcctgaaatcttcctgggctctggagcagctttgagagatgagttcaggacagtctgcaggccactttgaacctggctgctttttctgcagaagagaaagggaggaggcgggaggaaggagggcctaggggcggggaaaggagcttccttctttcaaacctgggggtggatgaaactagccttgaggttcctgtagatgagttgtcagttctcaaaagaagcgcaggcagggcatacagagcaacatggagacaccgggcaggatggatggatggtttccaggcttggagccctgtgtcctgggaaggaatcttgttttcatgatttgacaactcagacctcaggcctgaggctgaatttacaagtctttaacatccccctcaaaaaaaaaaaaaaaaaaagtatgctgcagtgataagccttatttttttatctttgtattttgagacatggtctatgtcactctggatgggtttacattcaagctgctcctgcctcaacctctgaattctggaattgcagccctacatcacactgctgactaatcacttactttaaaaagagccaacaaggggtaggagaggtggctcagagattaagagccctggttgctcttccagaggacccaggttcaattcccagcacccacatggcagctcacaactgtaactccagttccagggagtccaacactctcacacagacacccatgcaggcaaaatatcaatgcatatacaattaaaaaaatcattaaaataaaaagcatgccagctcttaggagacagaagcaggtgggtctctatgagtctgaggctagcctgggctacatagtgagttccaagttccaagattgaactacatagttaagattccggctcaggccaggtgtggtggcgcacgcctttaatcccagcaattgtgaggcagaggcgggcagatttctgagttcgaggccaacctcgtctacagagtcagttccaggacagtcagggctacacagagaaccctgtctcaaaaataaataaataaataaataaataaataaaataaatattctggctcaaaacaaaaataagccaaaacaaccaaaaagccctgtatattgataatgcctaactctagcaactgttatataaatggcaattgtgttttgttttaaagattgagtccctgtaatcccagaactcagggtagagcccaggagacgatcaagggcagttatatctaaatggtgactttgaggccagcctgggctacctgggactctgtctgaaaacacacaggcaagcaaatgatcagacaagagaagggagctaagagagtggagtggatgtagaagtcgtgggaaatggtggatggatcctaccattggttctatggaggctcagggccattgagatccaggaaccggtagcaagatttgattagttttgggtctggccccatttcctctgctcctctgctctttattttaagtgaatcatttttgggaaaaaaaatccttaaagaagtgtgtgtgtgtgtgtgtgtgtgtgtgtgtgtgtgtgtatgtatgtatgtgtgtgtgtgtatgtatgtgtgtgtgtgtatgtatgtgtgtgtgtgtgtgtgtgtgtgtgtgtgtgtgcatatgagtgtttcacctgtgtacaccatgcatatgcctggctcctgtgaaggccagagaggatatcagatgcgctaagaactggagtcacagctgttcataggtgatggtaatcgaacccggctcctttgcaaaagcagcaagcgctcttaaaccgctgagccatctctccagtccttcctgaagtctcttaagacttgatgttttggaatttgggtgaagaagtgtcatcctactcagagaggcctgagagggggctcttgggaagacaaacaggtaaacacagcccagcatccaggaattagaaggcagctattgatctctgctgtgggcagagcgatgggagagtccccaaatctgtttggacagtgccctgccctaacttagacaaaacaaatctgtggttttgatactgggcagtaattatctccacttggctgattgaaaaaaagtgacttggtccaagttcatgacttatcgagtcatttgaacttgagtccaggtccctctgatgtcacagccacttccgggactgctcttgaatgagccaaaccagtctgtgctgttgttcctcacacaagttaggcaagtagtctccagcccttgattaaatcttgactccctctccttcttcattggctctgcagcccagctcctgcctcacccattcccctggcttagtctatgtggtgtcttatttacatgccagatggtaaaggggacttccctggcttctcttatatggttcgggacttttgtcacaaacctgagagggcctcaggggctttgagctcccaagataaagctgagaaagagaagtgagagtctgacctagcgggagaagggggaggattgagggtggaggaagtgacatcaccacctcccatcacccaccttcttggctgttttgcccttagaccctacagtctcagctactatgcctgggagagaaacctgggagccagggaagccacaggagacaggaggcccatgctgaagcccaagataaccctgctgaaaactggacaagtgtcctccttctcttgagaattggagctacatagagttgtgaatcaccagaaatccagaaatgggtgttgggatccgaactcagatcctctggaggagcagcaagcgcttttttttttttaacatttatttattactatatgtaagtacactgtagctgtcttcaaacacaccagaggagcttcagatctcattacagatggctgtgagccaccatgtgggttctgggatttgaactcaggacctcctgaagagcagttggcgctcttaaccactgagccatctctccagccctacagcaaggactcttaaccactgagccatccctctagtctggatgtaaccttttttttaaataaagtatcagcgtggggcacaaacatgccactgtttgtgtggaaactggaggacaactttcaggagttggttcattccttcatcagtgtggatcccaaagactgaactgggtaatcagctttcctgcaggctcttctcccactccggcatctcacgaaccccttaagcttagtgtattaatgtattttccagcactgggtaggtaccatgagctccaccactgccctactcttcaggtaagaaagattaggttgcaaacccctcaaagtttctttttcggatcctgaggtgtgaggtgtgcggtgggggatgagtgggatgggacacaaggatgctgggaatatctataaggacctggccatgaagagatgtctgctgtctgcccatacccaagaagagaagtagagcttccagcctttgcctcttttggcctttgagcagttacattctgttttgacagcatctgtgtagacagaagccgggttgccaaactgagaggaaaagccccatttgacagatggggaaaccgagggcaaggcagaggcaatactagaactacagactagacttctcaatgactgtgctccactggacactttaacgtctgacttcctagccttgacaaagcaggagtctgtccacacaccccatgcctctcctcacaaattgagaccaaatttccttagcttgatggtcagcccccctcccccaccagccttcttccttattgccagacctcatttggtaacatcctctactgcccagtgcgtaccacttcctagctggccctcccccacacttgcctggctgcctccggctctctgacacctctgcccttccccggagaaactttccacttcctctgtgaaactccctccgagatggctgtgatcttcacacttcaagtgcttctttggccgctgtgaagatgactgtttcctgagctggtgtgtagccctgtagaatgcttccctaaaaggccaaaggcttggttttccagcccggccacacgtaattccaggtgtggtggtgcagccctgtaatcccagcattggagaggattagagggtcaaggtcatcatgcttggctacatagtgaggctgagaccagactgagctacatgagaccttgtctcaaacaaaacaaagcaataaaagactgtaccttttttgtgtgtgtgtgatctgacctaggacttgtcacctctccaacccagtagagcgttgaacatgggaccaactggtgtcaggtgctacatccactccagtagtgacaagcatgacaggccccaaaaacctgagagctgtcccgaggggaaagttcacggaaacttagtctcctggaacggtggtgtcctgtataacgaatgctccaatgtccttgctttactggtaaacggatctgagtgctttcccttaatattgaggaaccagagtagatacttagaactatagatagctgagttatacccatacaccggaatttaaaatggcttagggggaagttggactatacaaaagactagactaggaactatggcaagggcacaaagctcttgcccctggcttctaagattaagtggaccttaggtggagctgttttttgttttgttttttaaagatttatttattgttatatgtaagtacactgtagctgtctcagacacaccaggagagggtgtcagatctcattacggatggttgtgagccaccatgtgattgctgggatttgaactcagaacctctggaagagcagtcagtgctcttacccgctgagccatctctccagcccaagaggtatgatttaatagcaccatagagcactcaagctatatctttgttgttactgctgtttttgagacagcctacctgacagtgtagctcaggctggcctcaagcttctattaaggtaaatcacccatccatccatccatccatccatccatccatccatccatccaccagctcacccatccatctgtccatccatccattcatccatctaccctcctatccatccatccatccatccatccatccatccatccaaccatccatccatccttttgttcatttactcttcaaatttacttatacttaccagcttgggcaagataaaggaagaggggaccctccccttgaggacttcataggcctgtactagggcagggtgtctataggtcacaaaactggatgggaaggtgaccatggcatcgggctgtaaagtagaatgtaaccctgcttaagagaagggagaaggcccagagctggtgtcgctagggtttgaaggagaagcaatggaaggtgttccagaagaagcccaacactcgggaggagcttgctgttcctggagcatgaggagggtggagggcgggactttgactatagaggcttcaagtatcctaagctgggggtgatgggcattcatccagaggtgggggctgtaagggtggcaaaggcggaagaggaggagtacagagagcacagttgtctcctctcctcagggactctgtgggcttgaaagactccctctctctgcttccttcctcccagagctgctagctctcaataaactccctagccccaaaggagccatgtctgctaagcatctttcagttaatgagctaaaagtcaagtggattctgtccacccaagaacagaattctgctcaagccctggatggggtaaagaggcagccagaggagctacatcccagaagtgaagaaggagtcctgggtggtgtggaagttatgtagacccatctccaggggctcctagcattcaaggctggagaccccagaaagatttccagggtctctaagatggtacattgagtgacaagggctgagaaagtaaccctgaggagagtttagcggtggttctcaaccttcctaaggctgtgaccctttaatctggttcctcttgtcgtagtgagctccaaccgtaaatttattccattgctacttcataactgtatttttgctactatctaatatgcaggatatcaggtatggggccccaaactgggtcacaagccacaggttgagacctctggattagagtcttcatgtttttcttcttcctttttttttttttccagacagggtttctctgtgcagccctggctgccctggaactcactctgtagaccaggctggcctcgaactcagaaatccgcctgtctctgcctcccaagtgctgggattataggcatgtgccaccatgcccggctctatgtttttctttttctttttgtttttttttttttttaagacagggtttctctgtgtagccctggctgtcctggaactcactttgtagaccaggctggcttcaaactcaaaaatccgcttgcctctgcctcccaagtgctgggattataggcatgtgccaccatgcccggctctatgtttttctttttctttgtgtttttttttaagacagggtttctctgtgtatccctggctggcctggaactcactctgtagaccaggctggcctcaaactcagaaatctgcctgcctctgcctcccaagtgctgggattaaaggcatgtgccaccacacctgacctggttttgtttttctaaacagggtttctttctgtagccttggctgtcctggggctcactctgtagaccaggctggcttcgaattcagagatccttctgcctctgtctcctgctgggattagagacaagtgccaccaccacctggcaagaaatattttgaaaacatctatagaggtgtttgataagtactttgcattaccctcctaatcgccaatcccagcaaccttgtcaggtaggccgtattttcattttacaagcgaagaaaaggagatgtgaatgtgctcaaagttaccctgtctgtactggtgaggacccagtgcagtcctaactaaagtatctctagtactttggtgctattaggataattttagttttcagttaatatctatttggtcacttatttcgtgtgtgcatctgggcagtgctcctgcagaagtcggaagacagatccaggagccgttttctcctgccatgtgtgacctgatcgaacttggtcttcagcttggtagtaagaccaagacttagtacccgttgagccatctagctatgaggctgagggaggggaaattactcgtcatactggaagtgaagggtcacccaattattctacttagaaactagaattagaactttcctgcagtgcatcatctagtccataaattagaggggggaaatgagatttaaatatttattaagtcacctgcatcatttccattcatctttgcatgatcaggtgggaaaacaaaggaaacatgatttcttcaagatcaaatagcacaatattgacaacgtcgggttcaacatcttcaggtctagaggcttctagggaccaatctcttgaactcaagacccggcctcaagaacgccctctgacctcttagagcggtgcattctgggatttgaagtctcacgtgcaaccctatgcccgtcttcactgccctctggttcgttagagagcttctcggaattagccaatgagaagtgctcgggtcctggtcgcctgggaaaccccgagacaacaagatggcggcgccgcgggacggctcgctggccccgtggtgagtgccatctccgggcctttctgccccgctaagtcttcccgcaggccgcggccctcgtcctgactccgagggtcggcgacgtgcatgacttggctcaggagggaagtggggaccatactcaccgtgtccgcgcgtggaggcgggacaggcggcggaatcctggggcgggctttgggcgcactaaccttcttagtgccaacgtgcccagcaaaggattaggaggatgtcgcgcagctatcaggctgtcgcctggtgtgtcgagtgataactgcctagggcagcactcagtttggtccttcagatgaagaaacaaaggacacgtttgtaaccctcaccggaggcgacaaccgtatctttacagacttaatgggttgtgacataggcctgcactctatgtaggggccgaggagagaggactggagtacgaagcctatctggctacattgcgagtcccaggccaaccagggtaaatcagcgaaactttaccttaaattaaaaaaagtaaaataaaacaaagccaggagtggtggctcacacctttaatcccagcaaagtttgaggccagcctggtttaacagagtgagactcttgtctcaaaaacaaaaaacaaataactaaacaaaatagaagctgggcctggtggtctgcagacgtgtaaagctactcaggaggctgaaacaggcggagcatgttcaaagtcagcctggactttagagccagttcaaggccagtgggggcaaagacctttatatatattatatatttattattatcatttcataatatatgtgtctgcatgtgtgtatgtgtaccacatgcatgtctggtgtcaaaggaggccagaggaaggcatcaccgtccctggaactggagttacaagaggttctgttctgagctgcgatgcagttactgggaaccaaaccgaggttcttcaagagcagcaattgctcttaacctctgagccattttcaagcttaagactttatttcaagccgggcatggtcgcgcacgcctttaatcccagcacttgggaggcagaggcaggcggatttctgagttccaggccagcctggtctacagagtgagttccagggcagccagggctatacagagaaaccctgtcttgccggttgaggccagcctgggctacacattttgggctggtgagatggctcagtgggtaagagcacccgactgctcttccgaaggtcaggagttcaaatcccagcaaccacatggtggcttacaaccatccatacgagatctgactccctcttctggagtatctgaagacagctacagtgtacttacatataataaataaataaatctttaaaaaaaaaaaaagaaaagaaaaactaaaaataaatttaaggggctggagagatggctcagtggttaagagcaccgactgctcttccagagatcctgagttcatttcccagcaaccacatggtggctcacaactatctgtaatgggatccgatgccctcttctggtgtgtctgaagacagtgacactgtactctcatatataaaataaataaatcttcaaagtcaataaacaaatttaaagggaccgagtgtcttgctcagcggtagatcctctcagcccccagtgccaaaacagcaacaagaaaatatctctggcccaggggagcgagaaggcacagtggtgcccaggagaaatccccagactgaaaacactagctaggtcttatccacagggcccagggctcacaggacgggcagtgtaaaagctcccgaagaattgtcctgtgtcacaggagaaaagaacccacagcagagacagggcggcatttgacctgaagggtttgggagctgatagaatggagagaggctagagagaggaaaacggtgcccttgggtgatgggtcccatgaagaagggaagatggaggaggtgagtctctggggcagtgatttttctgataacagaattgatacagcccgcacatcgctctgcactttgtaaattctagtcattttttataaagatttgtttatttattttatgtatgtgagtatactgtagctgtacagattagatggttgtgagccttcatgtgattgttgggatttaaatttttaggacctctgctcactccggtcaactctgctcgctcagtgcctgcttgctctggcccaaagatttatttattattattatacataagtacactgtagctgtctttagacacaccagaagagggcgtcagatatcattacaaatggttgtgagtcaccatgtggttgctgggaattgaactcaggaccttcggaagagcagtcagtgtgcttacccgctgagccatctctccagccccagtcctagtcatttttatgcttcatttataggaaatgttcagaatgggcagatgtatcagtagccacctggggttggtgggagaaatggggtgggaactggaaggcaagataataaggtgtgccggttttttgtttattttttaagtagatctcctctggtagccctgactggcatggtacttgctctgcagcccatgctaaccttgaatccagccttgcccttaccagatcacaggtgtgtaccgtctcacttggctttgcagagtcttttggtgaattgaatctgtgatgtccacattcagaggcaggaggatccctgtgactttgagaccagctagggttatacagtgaaatcctgtctcaaaataacaaagggcttaagggagataggttagttggtaaaacaagcttaaggagctgactttgagctatagagtgtgttcactaaaaaaacaaaacaaaacaaaataaagaagtgtgaaactgcagggcgtggtggcacacgcctttaatcccagcacttgggaggcagaggcaggcggatttctgagttcgaggccaacctggtctacaaagtgagttccaggacagccagggctacacagagaaaccctgtctcgaaaaacaaaaatcaaccaaacaaaaaaagaagtgtgaaacttggcaagctgacagcagggccaggcttctgccgccacggccatgtctgagcaccagcattccatcctcagcatccacaggatggaaagagaaaaccaatttcttcagagttatcctctgattgccacacgcatttaatggtgggcatgggcccatctacacaaatgaataaacaaatgctcaaaacaatataaaaacacatggctcgggccaccccatgctggggaaatgcaggcacttgggtccctggggcttgctgcttgccagcttagattgtttcacaagttccagtctagtgacaaaccctgcatgtaattttaaaaataaatagaagtgtggagagcgcctgggggcaggactcctgatggccctcagagcactgctcctgtttgtgagtcccatggacacacaaataaagagtggtggcagttgaaggacggtgacactgggagactgaggcaggaggatcacgagttagtggctgacctggattagctagtaagaccttgtctcaacaacaatcaaacaaaaccccaaagcattaaaaaagaactcttgccagatgttggcaatggcgcaagcctttaatcccagcacttaggaggcaggcagatctctgagttcaaggcaggcagatctctggtctatagagggagttccaggacagccagggttacacagagaaactctatatctaaacaaacaaacaaatggaaaaacaaacagaaaaacttttaattttatactttgaaatgctgaagtttatgaagtctgactaggtaaagctaagtaagaagaaaggtagttggctagtatctgattccacagaggtaagtaactttatcaaagaaaattccagagctgagcaggaatggtgggtcatttctctactcctggcactcaggaagcagaagcaggtgagacctctgacttctagaccgaccagggctacatactgcgaccttgtcttaattaataaataaataaataaggaaaggaagaaagaaaattccagatgaaagcactggttggccagcagtcccagccagtgaggggggggggggacgactgtgacttgggctgtagcaggaggcccgtggggagggaaagggctgcttggtgatgatggtggttaaaccctatctgtccccgttatcagatggcgccagcctgtgcctcactctctgttgtggttgtgttgatggtgactgtaggaggaagcttggtgacgggcaccacagggcctctcagaaccactgtcctgtgactgataacttccaaataaaaagctaaattatgtcctaagaacaaatagaagggactttgaggtgttagcttagccagaggaagagtatatggctgaggagagaccagactgccgactgaccaggatccctgtgtgcaagtcttggctcagctgtcttcctggcagggagagtcaggtgggtagggataagttgagaggcagacagggccagatcacgtatgggagttttatttttcctctcctcctcctcctcttcctcttcctcctcctcccccttttcttcctccttttcctcttcctcctcctcctccttcctcctcttcctcttcctcctccttctcttcttcttcctcttagcatctcacgatgtagctctggctggcctggtacaaacaaatcgccctccccaggtcctggaattaaagtgtgcaccaccatgcccagtttttgttttttgttttcattatctttcagggaagaaaggagcccctggggaggtttgttcagggttgtggcttgtctttgttgcttgtaagcatccgtgaagggagccactaagggagctgccatatttaactgcataaatcacgagggagcccagacccacagagcaatgccgggatggggaggatgctggatgatggggtgagaggcctctggtcccttctgaggaaagggcggggcatgaggaagaaggtgaaggaggctgtctccaggcagaatgcagtgtcagctcagggtccccctttgctttctattgaggtgacaaagaccctgccataaggaacctggggaggagagaatttatttcgctgactgtgacttcccaggtcacagtccaacatggagggaagtcaggtagggactgaaatagagactttttattcaactcaggacccctctgcccaggagtggctccgcccacagagcctgggccctccctgtcagtcatcaatcaaggataggccacagccttggctgcagcctcatttgatggggttttctcagttgaggggctccctcttctcagatgactctagcttgtgtcacattgacaaaaactaaccatcacatcgggcgaggagagtgtggcatgacctgctttggatttagcctgaaaaagactcatttcagaccctcccccaatggagatccccctctttggctctaagcttgttagattttagtcctgttaggtagggaacagagtggtggctctgaggtacagctggctgtacacatgtcctttcttcatcagaagaagtgtatgagcatttttgtgcgtgtcagtcccatctgtgtgccaataaggatgacccatacagccacaatccagctttcaggtgctccctctgagcttggcagatgctttaggactttgtgccctgccaagtcatctgcctggtaggggctgagaccatgcacagtttacgtgggaggaaataaagtgccacataactgtacacagcagagcttgtgtccaaggtacatgacttctctctgtgggctgccattctgcctcagagatggcggaggtggtacctggcttccggaagccacgaggagacagacaccttggctttctgcctggcagctcagtgctgagttagtagtggcacaagccttttgaggagtctgtgcccacactccaagtgtggagaagctgcaggcgctgcaccgcaacaggcaaggacttccatgttcagaacagagaagcagcaactgggaggagtcaccatgccaggaacctcacctcatgcctgcttctccccggaacagtgcttctcttcaggaaaagctgcagctccctcctgtgacctgaagccctgggtctctgtccctgaggcctgatttccctctttcccctcaggagtccctgacagtgaacctcaagactagagctatgagctcacctctggcctctcttagcaagacgcggaaggtgcccctagagtcggagtctgtgaatcctgggtaaggagccagctggtccttgacccctgacctgtctcctccttgatcctttcctcaccagaggaaaatgacccctagcgtcttggggaaagcagagagtagctagtggccttctgtgtctgccctccttctctttaaaccttcaggaaactggtttgtgctggccaaagatgggtgggacctttctgtaaggccctgtgagagtggctgagagcttgcccttcactgtttacccaccagctctgcagacgtgaatgtcctgccagcctgggccaggctctgtgctgggctcttttaaatgccgttgccttatatcttgaggcaacccttgtgcaaagccttttctccctcctgttcccttattgcttttctgagctcacttagagtctggctaaggaaggccaaggtgatccagagcagctaagcagcaatcccaggggtccacggtacttcagagaggagccagggtcagcttatgggctttggaatcttgtggtcttcccatctaagatggccctgcggtgtccccctattttcctctgttgggaggagttaggcgttggacagcgtgtctcttggctcaccctggctaaggttagatgggggtgggagtcttcaggagatggaggcttagcttctatctctttagctttgcatggggcctgggactttcccttggtggcattccaagggggttaacttatatttgttccttcttcctgcctgggttcccaggagacgagggataagagtctacggaaatggtgagtgtgtgccctgttcccatgtcccctcccctctcaccagcctacatctttttacagctaggcatgtagggaaggagcacgctgaggtcttgtgagactgggcatctggcctgcctcctgtattcatgctccctacctgttgctcaggggcctgggccacccacttgctctgatccctcagcagagagatccacaccatcataaaactctgcccccaaaaagatggttatgggtacctcagagctatgggaaggccagagatgtggacctcagcctctgccttgtagtcttctctcctggagccctggcctcatcactggcctgattgtgcaccttgtggggcagtgtataagctgtttcatcttggccaggacccaggccagagtgttctctgggttgtggtcccagagcagtgacccgggcattcctgtctgcagaagatgaggtggacatgtggaatgatggccaagactcagaagagaagatctctctgccttcctgctatggaggcatcggtgcccctgtgagtaggcaaggtgagagtggagggctaaaggggcgtggctctcccttgctctgggggaggctctgagaacagtggctcctactcatctcacctgctgtgtttagatgctgctcccactgccccagtgcttgtaccccacacccatccaggacaggagttgacctaaagccacaggttaggaatctggccaagccccaagccaggctgtggctggaaaccctccaatttccagcaagcgtgacgtcaacaggtctgtgattgaggctcagagacagtgaaggccctgaagggcgagctcagcctctggctatctgcttcctcatctgaacgctccaaaaagggctgaattccttaggaggccatttcacctgactctgtatcttcaaagggctgtatggagttgcctacagtaggatggggacagagggagagtgggcagacaggcactgggaaggattagaagttgtgacgaggctagaactttccatcagaagtgacatcttaagcttccctgtcctctagaggaagagcaatgggctggcatgctataaggatttggtgagttgctgcttggtggggttcctagctgtcacacaggggactcagagcagaggcccattagccaaggcagtgggaggcaactgccaggtaatcttggaccaaactcccttccatttgacactggcaggacttgcccagcccaaatcctacagtggcttagtcacaaagccaggatctccgtcacctagccaggcacagtggtggtcctgcagccacctccttcccttttagggactgtacatcctctcactgctgctccctgccacatctagctggtgtgtccccactaaggtctccagtaggacctgtctctcctgcttctctcctgtctctgctcagcagcccctctcctgctcctactgccttcctttctgagcagctccgtgctggctagactattgatggcgtcccttcctcccagggtctctcttttactgtcctcagtacctccttttcttcgccagtattcactgtggacattccaggctgccaccaggccacacactggcaggtcctgaatgcttccacttctgtggcttactatgctttgtctctaagtccctgacagccctcactgagtgagcatgcccactagggatggtaattcagggacttgaagatgacatcaaggtcgagttaaggtttcttcatctttctcctgagccatcctgggcttcctgtgtggtctcctgtggctgcagttcctgctttccatgttaggggagtgtctggtgacaaagagggcttgtgttctttatctcactcttatcattttttttccagagactggggtttgggacagtcagggttgcctcaaatttactttgggctgtggatggccttgaactctctctgggataaaaggggcacatctctatccaaggcactcaagctctattgtgaaagtttttactgtacagaaaagctgaagtaggaggannnnnnnnnnnnnnnnnnnntgtgtatgcatcaaaagaaaaactcacttttccttccatcgtgtgtgtcccagggaatccaacttaagtcaccaggtttgatggtaaggagggggcagggtaggtaaacgcccttggtataaatgcaagaggccctgagttcaagtccccaggacctgtataaaaggctctcatggctgtgtacgcctatagtctcaccattagctgtcagagataagtggattgtgggagtttcctggccggctagcctaccccaaacagcagtcttcaggtgcagtgtttgcctagcatacgtatggtcctagattcggtccccccaccccacaaaagggtggagagtgataaagggaggcatccaatgttctctttttcctctgcttgtgtgtgcatgggagtatgtaaccctgtacatgtgtatgtgcatatgcgtgcatacgcgcacatacgcatgtgcgcgcgacttaaatacaacctatatgttcaccactgataaacatacctggaacaagttgctgcacccccacccccacttccccaagcaggcccgctgtaactgactgcatggcccgctgtaactgactgcatggcccgctgtaagcaccgcatgtgctgctctgtagagcttccagcgctcctgccaccaagcggtagctgctgttggaattgctggttctgttcttgtggctttctccccctctggcccttctcatctcagcctcagctccaggactggcacaagaaactttgtccccttgtcaggaccccatgactcggagctgatggcctccatgaccaggaagctgcaggagctggagcagcagttgcaggcccagaacgacgagatgctgtccaaggtcggccctgggtcagggcggaccgttcctcctgttgaactggctgttggcatggcaagccgggacctaggaatgatnnnnnnnnnnnnnnnnnnnncttcctccccttctgcctctacagagatgctctctcatacaggggcttctcacagaggtcctgacagtcgtatctaactcctttggtaccctgcatgtcctaatcacgaggcacagacagtgttattgctgcacctctgagcatgaataatccagaaaccctcctaacacctatctcttctatattacaggctcctcaagagttccaaatagctcttagaatgacttgtccctggttggggacctgaaaggcagggaggcctcatgtgtcattgcagagtctatgcctgtttagattgtacccagtttttaaaaacaatgacattaactttccttttggggggtagccctgctgtcctagaactcactatgtagactaggctagctcccaactcacagagatcctgccttcgtctcctgagtgctgggattaaagatgtgggccaccatgcccatctgagaaagtctcgacctctcgagttgcagagcccagatgtgttgagtgatttactttgtgtgtgtttgttcctgtgtgtacacacaacagtgagtgtgtatgcatcaaagaaaactcacttttccttccatcgtgtgtgtcccagggaatccaacttaagtcaccaggtttgatggtaaggagggggcagggtaggtaaacgcccttggtataaatgcaagaggccctgagttcaagtccccaggacctgtataaaaggctctcatggctgtgtacgcctatagtctcaccattagctgtcagagataagtggattgtgggagtttcctggccggctagcctaccccaaacagcagtcttcaggtgcagtgtttgcctagcatacgtatggtcctagattcggtccccccaccccccaaaagggtggagagtgataaagggaggcatccaatgttctctttttcctctgcttgtgtgtgcatgggagtatgtaaccctgtacatgtgtatgtgcgacttaaatacaacctatatgttcaccactgataaacatacctggaacaagttgctgcaccgccacccccacttccccaagcaggcccgctgtaactgactgcatggcccgctgtaactgactacatggcccgctgtaactgactgcatggcccgctgtaactgactgcatggcccgctgtaactgactgcatggccccgctgtaactgactgcatggcccgctgtaagcaccgcatgtgctgctctgtagagcttccagcgctcctgccaccaagcggtagctgctgttggaattgctggttctgttcttgtggctttctccccctctggcccttctcatctcagcctcagctctaggactggcacaagaaactttgtccccttgtcaggaccccatgactcggagctgatggcctccatgaccaggaagctgcaggagctggagcagcagttgcaggcccagaacgacgagatgctgtccaaggtcggccctgggtcagggcggaccgttcctcctgttgaactggctgttggcatggcaagccgggacctaggaatgatcttggtccccagaagctgagcagaaggcagaggccactagaatgcgggctgctgagcagagctggacactgagcccaggacatgggctgtgtctttctcacctagtgtgactgttagagagatgggttatctgaggctcaggagcagaggctgtaccaaaggttgggagggacaggctcacactcacacctggtccccacctactcaccctgagtctcactgcttcaggagcagaagatcctggacctggaggatttggtacagaccctccagcagcaccagagtaagaagcccttggtcaggtgctcggttgggtccatgggtcttgggtgctggacagagacttatgggtatcaaggctccaacagcaccaggcagactgctgatggggtctggacagctgggaccagagagacaaactacccagtgcctctgcacagacggcattgtccacagcatggcagagccacactccaagggatgaagggatgggtggctcttgagagtcagttcaggcaactctctccccccacaccagtgttagaagagaggtctagggtctagatagactcaggggctgttctcagagggtccccagaagaccttaggggcagcgcacctgcagcttccagttgtgacagtagaacccctcacccacgtcttcccccagacaatgcagccctgcagaggcaggaggagctggagacacaatgcattcagctgcagcggcagattggtgagatggaggtaagactggtggaatggacagccagactgccctccctagtctagagctgcctaggatttgcagcagcgcctgcccctcaggattctccaggcccctgcctgtttccctgctctgggctgactcagagtttagagccagggattagggggaggggctgtatctggcaccatgaggcatgactccctgtggggctgaatagaaccctgagcacacgcccactcttccttaatatactgccttattctccacttgctctatcccaagtcctcgctgtgggtttgtggctgggccctgctctcctatctggaacctctctatgctccagccacgccacatcatcttcctctggttctctgactaagctcattcctccttagaccccagcctgtgctggtttctgcagggcccggcccgcctcctcctggagaagaacttggactcatttccttgaggccttcctgacctgaccagggcaggctcttcaccctctgctctccctgggcctcatctctcttcctctctgggactgtaacctccacgaggggcacatggctcacgctggacttagtgccaggtggtctcctgcctcaggccatgacttctttacccaatcacttggtcacctcagtcacttttcttccactcagaattgtgggcacgctgtaagacttgagctggaaggcactgggcacgtggcggggccactcctgcctccttactgccagtgtccagtcctctgctggcccctttcaagtcctttctaaaatgtctctcttcaagcagaagtgtttccaaagctccagcccactgcaggcctgttcacatctggggctgtgaggtacagctgcagctgggccccacctgcctgccaggattgggacagtagcgtggggtgaggctcagccaagcacacccctggcttaagcaaggacctttcacgtgtttattgagtccttaattgttttgttttgttttcagagacagggtttctctgtgtagccctggctgttctgtaactcctctgtagaccaggctggcctcgaactcagagatcagcctgcctctgcttcccaaacactgggatcagaggtgtgtgccattaccgcgtgtctgattcatcaatcgaacaaacctacagtatctatcctggtagacactgccattaggcgtgtgtcatctgtacagaaagtcatggtccccacatgcatgaggccgacagtccacagaagcagggagtcacatgttagaggagatagaagaagataggagagtgcaggaaatcattagttaggggacctctgaagcagagctggagctgggtcaggtggcagacttggggtagcatctaggcaatgaggtagaaggctccacctgccaccttcccctggccggaagtcaggagaaggggagggggaaagagaggccaggccaaataggcctcactgtgtgctcggtctggagggagtccttatgtatgtggaagcggagaagagccataacagggagagcgtggttggagctgtgtgtgtgtatgtgtgtatctctttgtgtgtgtatctgtgtatgtgtgtatctgtgtgtgtatccgtgtgtgtatatatagctgtgtgtgtgtatctgtgtgtgtgtgtgtgtgtgtgtgtgtaggtgcagacagaagggcttcagggtctcacaacagcaggcagttggcaaccacaccacaagcagggcagtgatctgtggagcagaggggcagagaagaaagtggtattggaaatatagactactctaaccaggtgtggtggcacacacctttaatcctagcacacaggagacagaggcaagcaaactctgtgagttcgaggtcagcctggtctacaaagcaagttctaggacagctatgcaaaccctgtcttgaaaaaagcaaaaaagcaagcatgtagatgacttcctgggctgggaaaggctcagtcattaaagaggacctttgtcctgtccctaaaagccacttaaaaaaccagaaaaaccagaatggtttcatggatggatcacctcggagctggggaagcagagttgagtagatctcaggcttcttgggtagtcttggcacccagtggacaccaagatggatggacggggctcgaagaggaacgacacccagcctgtcctctgaccccacataaaagtgcctgtgtgaatgcgcacctgcacatacctgggatcgcagccacatgaacacatgcacgcacagtctagtgtggcaggaagaagagggaggcccgctcttgtagagcaggtgtgtctgcctcttcatgcttaggtcagacccacaaagtcctcggagttctagagtaatgtcctggcttaggtactggcatgaagggtcttactgagtgagacagggctgccatgtctcctcctagagaaggagctgaacctgctgttctggaggtcaagagctttggggtcacaggcaggaagtgctcagggcctccagcacattctttgtccaggccaccctgggttgactgggggaggggggaggagggtttggccaggtgatggtttccatggaaaccaggcaggtggtgcagtatcacctctccctcttctgccccatagcggtttctcagcgactatggcctgcagtgggtgggcgagcccatggaccaggagaactcagaggaaaagacagtctctgaaaatgatgagcgagactggatgaaggccaagaagttttggaagccaggtagagcatctgccctggcccccacctaccagcttcctgagggcctgccagtcttccagaggcccattgtttgaagccctgccatcccaaccatggggtgaggtggggttgtgagttacctatgtcatcagggaaagagaagccaaggtttccctccctggccttactttagtctctgcttgctcatctgccaagggttagagagtcccagggttactagacatttgatgctcacccctcctcccagacagggtttctctgtgtagccctggctgtcctggaactcactatgtagattaggctggcctcgaactcagaaatctgccttctgactgctggcattaaaggtgtgcaccactgcctgaggcccctggctttgaacaaacaacaaaacaaaacaaaacaaaacctggcatggtggtacaaaccttcaatcccagcacttggaaggctgggtcaggaagattgagagttcaaggccagcctggactacataaagagcttgtgtctggttggggagatgggaaaggagggaagagtaaaagtgatcaggtttccaggcctcaaccacctccctgttcggctgcagctctgtgagccagggggtgggatctgccccggcagactccagttctcatggtttgtcgtcatccttcattttgatttgttttgcttgttttttccagaccgggtttctctctgtagccctggctgtcctggaactcattctgtagaccaggctagcctcaaactcacagagatctacctgcttctgcctccttttatcactgttaaccataggtatttagtggggacccagcccaccttgtccttagagctgtttctgagtcagagcctgttgtctttgggggtggagaagatccatctgtaggaactcagaccccctcatttctactccaccccttgttcaaggttgctttgtggcttgagcaagccacttccctttcctgactctcaagttcatcaacaaaatggggcaggctctctctctcttcagggtggggccctttgcatgtctggtttctgcttcccgggcttttcgggaacaagaatggtggcagcaccgcccccaaggacagtctagaggacgacagcagtgttagcctcaggaggctcttcctgcatagaaacccagattccagggctgagcctgtggctcggttggtgtgtacttgaagtgcagaaagccctgggtttattccccattggtagagtgtgtacttgtagtgcagaaagccctgggtttattccccagcacccgttaggacgggcatggtgaaccacacatgcaatctcgacacccaggaggtaaggatagaaaaatcacaagttccaagctggtcctgagctatggaacagtgtggaggataccctgggctacaagagatcccacgtcaaaaaacaaacgtggggatgggatgaagccatgacttggggttaggagtgtttattgctcttccagaggtcctgccttcagtcctagcacccgcactgggtggctcacaaccacctgtgactgctgcagtgccagggctccaaaccctcttaaaccctggtacaatcatcatactaccttgctaccttgtacttgggcctgggctccatctctctgcccctaaattgagacaggacttcactgtgtagctctggctgtcctggaactctgtcatggaacttgccgtatagacccggctagccttgaactcagagagagatcctcctgcctctgcctccgagtgccaggactaaaggcgtgcaccatgcccgtctcttactactttcaaaaaatcttgagtgacaaacagccttggcataggctaaaggtattccagcttatggcagactaagatagagtagctgatgacagctgaacagagggcgttgagagctcactgggaggtggccccagtcattgagtagaagatgaggtaggcgctgctgtggaggacaagaggagacaggagcgatttggaggtgaggtccttggcctttttgacagatgcagaggagaggaggaggagtcagagctggccctggagcactctgtgagaaggtgctgggagcatgtgtggccccaggctgtgggaggtaacctgaggccctgctggacaagatctagagtagcccagggcctggcgctctgaccacctttctccagagactaaggccacagcagggggctggctctgtgtgctgagaatgcatgggggaaggggggttcttgctttgcccctggagcccaccacaggaggtggggctctgcttcaagcggccctcacatccggagagcagcctgccttctggcagaagtttcttctgtttcctctaggagggggtcagaccacatggctgatctctgaacgcatcttctacatgtcccaagtacttcctccaccaaccctctccagacagcatcctgtgttgtgttttgttggtgcggccgctccaggcctagctctgaagccgtggtgaaggccgccgagccttccacgtcagggttcctgggccaccgagccttctacacttctcttgcttttgccttctggtgtgggacagacctttagttcttcctgccaggggaggaaatgtcctccttttctaggagcttttcctcctcggagctccctcttgtctcagggactagcctgactgtccctgggtcctctgctacctgctttggcttcttgctggtttgtgtctgggcatccatccttcacttcctacagctgccagtgggcaggtgagcggggcagccatggctgggggaagagggttgaaatggactagatccagaacttttgccttaggaaggagtcagtttctccatgaagggggccagcagaggggagcctggaattggggtgatgtgcagctggaaccccccagcctctcaccaggatacaagtatcacattggctgctgtgtcatgtgctctggcctcagcacagagcaggttttggacctgggtgaagagaacattcgaggcttggtgcttgtctctttcctgtctttcctcaaattcccacccttcctccacatcgcccgcctgtctcttactagatccctacccccaccctagcctccggcccaagcccctaccctggtgcttctcacattcctaggtcaagaggccatattggcagccctgcttgatttgccctggcctagtcctgggtaggcgagcttcccccccaaactcacttttatcctgacattgcccctccagcagatccccacagacactggggctgctgccgtagctgtgccagtgtctcatgggaagagcagtgctggaacaaggggtttaaaggctcaggctacatgttctagggggcagccagcaggctctgaactcactgtctcgtcccctggtgacacccaggagcatgcagtacagtgcttggcacaaggaaggctatggcacctggggaactgggacaatcagtcccccagaacagccccaagctggactgcagaggtcagggtgagagctgcaggcatcaggacaaacctgtccaggttgagggtgtgctcggaaactacccagaggctcagagcacatgcgagcagagaagtggctggggtaggcctggctcgcagagttgtggtaacaatggctgttttctgatgcaagaggctgagaggtggaccaactccatccagccccaaattagcaagttatccttccaacaagcctgcagggggcgccgctcatcctgtgcctgctgtgggctgtgcagaacacacagggcctctgtgtatctaccattgctgtttggcaccctgacttctctagggatgagcccgaggggaggggactctgggagggcgctggcaggactttctgagcctaacagaaccacactgctcctccaggggtggacagttgggtcagcacatgcttctgggggtacccctgccccccaagccaggctagggttcagtgctctaactggtgtttaaaaagtgcccagagtagttggaaggcaaatgatcatacccaaaatgacgagaatgtgtgaccagggccaggagcaaaagaaccaggcaggagtgcatggggtagcctgaggccaagtaagttgggacagacaacagcagccaccctctgagcttcggggctgctcttgtccaccttttacataagaggaagttacgactcggaagcttagaagcttgtcccagcctacagagcacacaagcagcagccctggctgtgtggccttgcagggccaagaaagagtcaaggagagaggtcaggccagcacttgggagggggaggaaggaaagtcaagagttcaaggttcatcctcacagtgtgggctacctgtcttaaaacaaaaactcctaaagtgacacgaagtctcagaggtcttccctcacactgtgacccttcctagaaaggggtcctaagtagctgtttcccaagtgccaccactgggcagctgctacctacatagagctgagtgagtcacgtaggtcctgtagggctcacatgacctggagcatggtacttcacaaggcctccaagggccattaagtcaggtccactgacatgatcttgaggccaggtcagggttctttttttttttttttttttctgagacagggtttctctgtatagccttggctgttctggacctcgctctgtagaccaggctggcctctgcctcccaagtgctgggatcaaaggcgtgcgccaccacgcccagctcaggtcagggttcttaacctgctcatgccacaaaagggacatgtctctccgttagcttgagccaacacaaggctggcttcttggcctatactgacttgtgtggaagctcctgctacaggctacagttttctccaaatgaaggtttcttttgaaccttggctgtttggcgagtgctctctgacttatctctgccctgggctggccatagcaggctcaacctgccctacttcctgaatgtttctccatggagctgtgctgcctccgcaggtgcccagtctctcccgcctgtccattgacccagtggcagcccagcccactctacctactctgtcctctcctggccagggctagatgtccttttcgaggcagaaagcagaccagttcccacttcactaaatgtcctgtctctctgctgtcttcctccacatctcttttctatctaaatgctctgccacatgggtccatagcccctgtcctccaggccagtattctgaggcaaacttttgccatcagtatttcttagtaccatcccagggactccatctgtccccttgcctcattacccaccctgtggctctccctaagccttggagcgctgaggttgcctgttttagatagcaggcttagacctcactctccttagttgtgggaagaggtacggggccagttcctgaagtcattgtaaagaaaactcatgtcagtatcattgtggggcaggaggtgcaatacagcggactgttggtggtcacacaacagggaagcccagtggcaggaggagcaggcatagcctttcagagagtagccagtgccggggagaagggagggctgagggagggcctacagctcagcagctgcagagacagcaggaaacagcccctccacctgtacttccacttgggggcgagcagttagatccccagtgccctgacctacatcctgccacaaaatagctctcagcaagctcacagtcatgtctgctgaatgcttgtcctcttttgttgttgttgttttaagatttatttattttatgtatgtgagtacagatggttgcgagccttcatgtggttgttgggaattgaattttaggacctctgctcactccagtcaaccctgcttcctccggttggccccacttgctcagtctctgcttgctctggctcaaagatttacttattattatacataattataaattactatacataagtacactgtagtactacagtagtcttcagctaccccagaagagggcatcaggtcccattacagatggttgtgagccaccatgtggttgctgggatttcaactcaggacctccgggagagcagtcagtgctcttaatcgctgagccacctctccagccctggggcatttaacagaagctggccagcaacccctctgcctgccatccttttatggcacctttctgagtgtcctggtttctccctctccgcccctagaactgtgcagggccacatgtgcagcagtttccagaggagtccagaaccttggcagatgctcaagagtctgtaaccatctggtcagcagctgcccccacaccctaagagccatctgtccccacccttcccctccctccctgatgatgcgtctgggttctactttctccagcctgccaggtggcctggggtgtgtcacctttcctttttctaatgctgtttcctcatgaatcaagtagagattaaacagcccctgcctcccagccttggggttggcctgaggaacatttgtacaaggtagagctgatgaacttggacagttcaggctgttccaagttagccctcacgcagccacttccttggcgccttagagccacccagaacattgtggtaaggccagccaggaagaagtgcaggagctgggatttgaaccgtgaaagctttgatccagagctgggagctttgccagcccagtgcccaacactctctggcctcagttcccatctctgaaaatatgaaggaatatgaataacccttacaatgtaggatcggtcataagcagaagaaatgggatgatggatagtaagcccctgacccaaagcaagtgtcccgctaggtgtggtgacacacatgtaatactagcacttgggaggtggaggtagcatcaggagttcaaggtaaataaaaagtttaaagtaagctgggcgtggtggcgcacgcctttaatcccggcactcgggaggcagaggcaggtggatttctgagttcgaggccagcctggtctacaaaatgagttccaggatagccagggctacacagagaaaccctgtctggaaacaaaacaaaaaacaaaacaaaacaaaaaaaaaaaaaaaccccaaaaaaacaaagttcaaagtaagtatccaatagctgccattgttagctagtgtggtgaaacctctgctcaatgtgggagggcccagagctgccagggcacacagcagccacagaggctcatgggcatctatcccttttgccaggggattcttttgtgccccccgaggtggactttgacaaactgatggccagtctacaggatctgagtgagctggtggagggagaggcccaggtgactccggtgcctggtggggctcggttccgtaccctagagcccatcccgctgaaggtctaccggaatggcattatgatgtttgatgggcccttccggcccttctacgatccctccacgcaggtaggatggagctctgggtccatacctactcacactcacgcctgcttagacatggtggggtgccactgcgagagcgtgccctccacagaaaacacaggtcccacccctccaatctcagagctcccagtatttccagaatatgatgtttatggcttgccaactaaacaggtagcaggcttggcatggcatggcatgacatagatggctgcagaggcctcacctgttcactcccctgcagcgctgcctccgggacatactggatggcttctttccctcagagctgcagaggctgtatcctgatggagtcccctttaaggtaagcagcagttctcaacccaccctttccctgtgcagtgttggagagagtggggttaatagtttcctcagggaaatagccttcctaagagggagccatccacgcaagggacccacccatccaggatgccctgcaggagggggagctgggaccgcagtgaggaggccacgaggctcccccaagctgagcagctgacagtgccctctgctggcatcttgaaggtactacattgccaatgggaccaccattctgcccacccttcccagcattcagggcatcttaacagcgcaactgccaagggatctgtaatgcgcagtgggcctagtttcccctacaagcttctgaagccacgtggttcgggtagaaggcagggcatgagttgcaaacgccgagaagaggcagagttggctgggctgcagggacaggagatgagcccatctgtcgccagggctgagtgggatgaaggttgtcctcgtggggagcaggaagcagcaggctccagaggcgggttatctccacagcgagggtgtgtgctgtcatgatgcacaagatagcgtgagtcatgactgggggtttttgaggtggctgtgaagaaagccttgagactatgccttgaccgagcagctgtggtgacctgcagggatggagtgggaactgcagaccagaccggagcagcagctctgccctctcctgacattcagacccccagtggagtggggagggggtcttcagtactatgccttcagctagtatgagtaagaagggtgcttgcataaatagggcctgagtgtgaactggggtgctcttagatcatcccttgggttcttgagacctctgagcaagcaggaatgggggtgaggtttcagggctgaagagttgggctccccacttctgtggccctttttccctgtcaggtaagtgacctgcgaaatcagatctacccagaggatggtctgggccaattcccaggtgagggtcgtgtggtgggccggcagaaaatgcgcaaggtcacagacagggtggaggagacttcaggtaagcgggaccccaaggttggctggggggctgtgcagagcaagctccaggtggcctctcccagcacttacagttcctcctgggccaaggctcccaatgccctccctgcaggctccaggatgactgctgaacaattcctgaacaggcttcccaagtgtataatccgacaaggcgaggtgattgacatccggggccccatcagggacaccttgcaggtgaggccagccctaattacccagcagccttctgcaggggacttttatcatcagccctggctcagcctacagtctcttgccagaggcaaggagaccctcagaactaaatcatgtctctgtggagctggtgaggactctgtagcccgccacccacaggacaacttggttggtggctacaactgagggggtgagcctgtggacctaaggcccaggtcccgcgtgttctggaagagcttggcccaggtgcgcctggctaatgtcccgcaagcctttcagatgcagttgtcttctgtcttcactcccattttcccttcccaagtctccccaccaaaaagtgggtgtcaagccgcatgcctcctgacatccgtctcctttgccctttgctgccttgtccagtttggccaccccttgaggtcctccctgcagcgcactgcccatacctaggctccagtatctcacagatgccctttctgggccggccttcctgcttcatttcttcccgtaccagccatgtgccccaacagctttctctgttggcattgtctggggattcttggagaaaaccaaggtcactgtcctggcattgaagacccattttgtgacactaccctctctatctgacttttccttcctgtccgcctgatttgcttccttgcttcaagagctgtcaacggctggcagtttcccaactagacccctcctttcatattcctgtgggtcagggtgatcataccgtagggaatgtcctcaattctgttccctttcagatgaccgcaggctaggttagggccccaagcctggccaccatctgggcgggcttgtttcccacgctggacttggagaatgacaatgtcaccgtccagagcctcctttccttttcttttcttcttgggcctcagctgacacagaacacctcagctctttagctcactggtcccatctatccctgctcagagatgagccagtcctccctgagggcggagggaatgatttaggtgagacctaggctccagccactctccgtggctgccttccagaactgctgcccaatgcctgcccggatccaggagatcatagtggagacacctgccttggcttctgagcggcagaggtgagggcgaggcagagagatgggagcagggcggagaggaaaggaccagggagctggggagcgctgaaggcctctggatctgcaggagccaggagtcacctgacatgccaatgcctctgctctccatgcttcgcatcaagtccgagaacggagagcaggccttcctgctgatgatgtggcctgaggataccattggcgacgtgcggaaactcttagcacaggccaggtgggtatagggcaggactagggctgcagggagttcctggctccacggcctggcctgatgtactctgctggccatccagggacatggattcagctgcctttgagatcttgagcaccttcccgcccacggtctaccaggacgatacagtgactctgcaggccgcaggcctggttcccaatgcaacgctgctgttgcggacccgcagagccctgctgtcgaaccccatctcccgcccaggctcactgccctgaataaagtgccgcccctgacataagctccacaaggctctccagagaggggttaggcctgtaactgtagggagggggtggtagagatgctcaggcctataactggagccccagccggcatagccactgactctttgtcccctgggttcctgttctccaagttgtactaagtgaatccagtggagggagtggccagtcctagctgggctgacattctctgtctcagctgggtcaggggagccttaatgggggcgaggcctctgaagacaaccagatgcatgtagatccacaagctcacatggatactttctccagagtgtgcacaaaaccagtgccacaactacccccatggacccaatctaatactgctgcagctgtacacgcccccatcacccccctacactgaatcagtcagctccaacacgggaggcagcccgggggcagccaccctcaggcaggcaggcaggcagacagcagaacctacatgggaaacagggtgactcagccatcatggtcatgtgctgccagccagccatgtgttccacacacatacacacatgcacacgcacacgcagcggcagccctgggacagtccaaacaccaccagaactatctgcctctgccaggcagggacccggacaccacaagcagtcagcaccagaggaatggacatttaattgtctctagggcactcctaggatggggatgcggggcctttggcagagctctggctgatggaagcaacagaaatgctcatcagacagggccaggcagagaggatgccccaaggtgtggctggggacagccatcgtcagggcttaagacaatcttttgagactagttggtgaataaggaatgttgcctctggaggaagaggaggcggctgcggaaagggtctgggtctgggtttgcagattaggacgacaaggagttggttacaaggcctggtgaagagctagctggataggatcggtggccatcctgactcaggccagcttcaggaactcctgcagtgtgtcctgctccacggcctccacgaagagttcatagtcctgaggaagggaggcagtcacctgagtcgaggtgcagggcaccccagttgtttgcccaggtctgaccctggctgcagtcctccaacacctcccagaacccaaaccccataccccacagtagtggttcccgttgacaatctgaggtggggtagctttggggttgccagccaaggttcgcatctcatctcgaagggcgttgtcctgggagatgtccactagctggtattggatcctcttcccatctaggatgcgggtcacctcactctgctgggacttgatctaggggcggaggattgacagggttggcaggcaagctgaaggatttgtgggaggaattccttcgggtgtgagcaacagcttctatcctgcccactctgaggggaggttctggccactaagggatgggaagggtccaaggatagacaggtaaactactagagtttcagaaagaagacgggcaagttctgtgcatgacagggaagctagactcggcgaggggcaggccctctctacaagacacatctcctcctccacagccgcacagtggagaggaagcgggattaaagcggtcgggggttggtgcaagagaatggatggccctatactgggggaatgagcgtgggcagctcacgctggggatgccgaggggcccttggtgccgggggttcaggctgggcccagcccttggaccagacctgggaggccataccccgcacctcactgcttccatcgtgggggcggctcccgggcgctggtcggagcacagagacggcccaccctctccgggcgccggcccaggcacacacttacttctcgggagccggtgaccgacgtgctgtagacgcgcaggccactcatgctgcaggcgggggacacagaccaactgagggacggtgggagcggcagctgcacggctaggaactacgctgccgccgccgcgcttgggagcggtttccttcctgctccgcccgcgagtcactgctctccggaccaatgagctgcgcaggcgggtaaggcggggcctgcatgaccccgccctgctccgtggcctggagccgggaggacccctgtcctctgcagctacttggctcccccacttccccctcagccccatgctggggaccggctaaaaggcagaaaaagctgggaaggcaggcggaccggttcagctaaaagctttccccagtctacccgggttgtgtacattcagtggccaaagcagtgccacccaggtctcccggtctcttaatagcacagctcagtatggaactttggaaggcgggtcagttcgcaagcttagacagcaagggccggggggaagctgtggtggggcgctggagggcggggagggccagtgcagccaggacattttctctaaagcacctctccactcaaacaggctcagacaagaaaggggtggtggctgtaagcgagggggtgggggagcggctcacacccttcaggagccagggggaggaagtaggctgcgggacagcgagcgtgctagtgtgcggagtcaaaggctggtgccccgacttaacctggcttgcactggcccttggcacagctatttttggggtgatcccaacttaactctacctttacattgcaaatgacaccccacatctttgaactttaagaattcagctaatgagatggaagagagtccagcacccattccaaatgtggatcaagctctgtcaggttcactataggccccaagagtagacctggggctacataaataatggcgcaggaacaacacaattctgctgcctgctgaggcaaactgcctgtctgcttctggggaagtcatttcctcaaagccacagaaaccctgaagctgctgacctctgagaggtgtgcaactttgtagtgacaactggcggcggttgctctctgcaacacaggagtgtgggcagagactaatctgtcgccacccagagcagaagtgggaagactgagcctccacactggatctgcctaaactcacttcaaaagagtcacaggcaggctggcaggggacgctgggaggcactgggaaaccggagtgtttgttaaatgttttattctgtaatcaaaataggcaatacaaaccagtcgacttaacaaagattcatataaataactttataaactttacgaagaaaaatacccgtgagcatggaggctgggctcccgataacagggtggaaaccaaccaggaagctctgttttaaggaggcagcagcccggaggctgaggggatggtcagctgggtgtgattactctgaaaggtaagccactccataagaaaacataaacttgttaaaacactggcaaagcggcccctcaggccctggaggtccacggtgctgttaacagccccaaggcttagcagaagtcctgtctgcacccccacaactactttactcctcatacatacagggcccttggatccaaactagaggaggttgagggctggccaaataaccagatacaactgagacaatccctaaattgggaggcaagaaaaaccagaaagctaaggctcaaaggccttagagaaacacaaaacaccagaaaacactcaacacttttttaccttaggtgctccgaactgtcaaggttagagcaggaaaagggaaccctcctaaccccaaatgagaggcacagttcagaggacagcgacagcgcccagccttaggaaggactgagcagccacagccaccctgtgctcttacgggggaaactcatgtccaacccgggaaccacgaggcaaccacagaggcgtctgtactcctagacgacatagcggacccaagcacatgcccacatgcccaaggttctagggacagacaatgggtagctaagaagagtttcctgtaaaagatggcccagcaggcaggccgaggagccctgccatggtccccaagtcagtgatcatagtaggggctctgctgaggggtggataaccttgaggcctctgtgggaacaacagccctgaggaaacaggtacctgagaaaacccagaaagccagctgagttctcagaagactgatacaaggggcctgagaattcttaaaaggttgctactcctactttaccctttaggcctctcttaaaagagcatcagtaggaccaaggtatggataggaatgaacatggatccgtcctggaggatggaggggaggccagcagcctgtttgcttctcatgccaggttagagctgggaacagcttgtgaggactttatcagttgaaatctgcaaaaaggttaattagtaactcagtctttaagagtgaattaagataacaagcaaaacataacccaataaggcaaagccagagaacagcaaaacaggcaggcttctcacaaccctgggcccagatacaggctctcccctctgggtgcagcagcggaaggcagaactctcagggaaggaaccttctggcgaggcagcagcagcctaagtcctccctggcactcctcactgtgtggcacagttttctcccatgtcctgggcatatctgtctgacaggctggtccttaagtcctcaatgtcatggcgcagctgttgaacctcttctagtttcctcctgatcacatctggcttttgtagatctagctgcgttcctgggtgctgggtggctgaggaggagagagtttcaagagtgtcagaaaacgaggtgattgaaacattcacgaagaacgggcagaatacagcagttcagcaagcgcatcaccttagggcacagccttcccatcactctgaggtctgagccagggctttgcacatagtaaagtctctactacaagctacaaccccacactcaggagaccctggtttcaacctctccctgccactctgacaaagtggccaccagccagcctgataacaggctgtcagaggaataaagggggcaagggagacagtaagactgctagtggccactgggtgtgtcgatggcaaagataagagacctggagataaacagctgaaaggcatcttgctttttttttttttaaggatgtgatacctttacagaaccaaccgggataatttgttgcctaaggctggcttcctgtttgccatctgtaagccccctctagggaggcctgtctgtgaagcacttactttgacaactcccccaaagcagtgaccaggcctatgcacctggttcagttactgtaagaacagccacactggggggctggtgagatggctcagtggttaagagcaccgactgctcttccaaaggtccggagttcaaatcccagcaaccacatggtggctcacaaccatccgtaacgaaatctgatgccctcttctggagtgtctgaagacagctacagtgtacttacataaataaatgaatctttaaaaaaaaaaaaaaaaaaaaaaaaaagcccagccacacgagaagatggagaccttctgatgactcacagtgaatgcctaggagtagtgagaggttaggattgtggccctgggccctctgggtcacaatgctgcagacagcttgcagatcttgaaggcaactggccagttcctggtgcagctcacaggccagctgggctgagtctggtgaagatgaggaccctggctgggcctggcgcaagtgctcttgcagcgtcagattcttctcaatcaggtcctggttttgcactgaaagctaagcaaacaaatgataaactgattaagactccaagagagccctaggaagtgtgtatgtgagtatacatggctgtgaatacgcgtggaagagaaatggagccccagacaatgtctctctccgttgtacccacaaaggcttggtgccatgttctccaacccctttccctctacgaatgctagctcctcccgtgtgtaggctgagcccaggcccttagggatccagcactgaagaggaaactattcctcagcaggatctgagtcactggcctccaggtttcggtccaggaaccagagaagatgttcccacccccaggaactctatctgaagccagtccccgggcagctctgtgagccaggccattagagatggcttaacgtgaacagtgaaatctgaggagacactggtttcaatctctccctgccaccccgacaaaagtggccaccagccagcctgataacaggctgtcagaggaataaagggggcaagggagacagtaagactgctagtggccactgggtgtgtcgatggcaaagataagagacctagagatacagagctaaaagccatcttgcctccacccctttttttgagacccagtcaaacagcccagtttggcctcaaacttcctacatcactgaggatgtccttgaacttttgatcctcctgtctccaccttttccgagttcaggggttacaagtatataccactaccccctgtttatagctcaaggcttcatgtatgcaaggcaagcattctaccaactgagctataccccaacccttccttcatttgtttgttacagggtagccctggctggcccagaacacactatataaaccagactggctttttaaaagagacagggtttctctgtgtagccctagctgtcctggatcactttgtagatcaggctggcctcaaactcagaaatcctcctgcctctgcctcccatgtactgagattaaaggcatgcgccaccaccacccagctcagactggctttgaccttgtgtcctcttgccctcctccagggaggtgaagttctagcattctacattgcaagctctcactgtagtagccaggctttcctagacggagcagctacttctataaggctgtcttcgccttctctcatcctgagagcttaacacacccacacccacacccatacctctactctctgcccttcacgcacactgggccttacagacaaccctattcactccatgagtaccaccaaatcctcatttattttgggggtgtatgtgtgagacatgctggccttgcgttcagtctcagtctcccaactgctgggattacatgccctagtcatcagtttttttacctctccccccacccccaatctcacaaacctgtggatgcaggaagatggggggggggagaaaaggaggggatcctacctctgaaaagcatccctaggtgattatggccactctcagacaagcctagggcttttaacataaaaggaaaacacaacgctactacccattcctttgctaaaagcttacctccccttccacactcttgggcaaagggagaaatcaccttcgaggaggctctgagggcctagccaatgctcacctccttcacggctgtgcgcatctgctgcagggccgtctccctccgctgggcctcctctctcagtgcctggttgattccctcttcttgtgccagttcttgcttttggctctaaagaccacatggcaagatgttgtagagaacaagcaagagcaacaagtctgacttgtatgctgtcacctctcatctaggctgcacacccacactgcatctaccatacagctgctctaagggctgagagccactacattccatttccagcccgcttctcaatcttcttaatactgcgcccctctaatatagatcctcgtgttgtggggaccccaaccacaaaattattttcatttttacttcataactgtaattttgatagttatgaatcatatcaacctcttttttccaagagtcttaggcaacccccgtgaaagggtccatcaatctcaaagaggtcacattcacagtttgagcacactgattaaaacccttccactcaataagccacagacaactaaaatcctggcctttaaatgcttaccggtgtgactacttcccgacgagaactgaaatggagacctacacaggcacaggcgtaaaggggtgggtgggtgtgcgtgcgcgggcacagcctgcagctttcctcctgcatttcaacagtttgatgtgaaaccctttcattttctgcatatacatgtgtgtgttgcatgtatgttttgcccaagttcactctgtatggaggccagaggttgatgagtcttttcatgatccctcttcaccttgtgtactgaggaaaggccttcatttgagcccagtgctaagcagtcagctagtctagctaactagtttgctccacagatcctgcatctggctctgactcccagcactggattacaagtgggttgccaccctcccagcatgtacatgggtgctgggtctggattctggtcctgacacacaggaaagtgctttccccactaatccacatgactatgtaaaaccttttacagttcaaaaaacctaagtctatttcattcaagatttctcagagaatgaattaatgaacactcctactgtggccaaatataggcaccaggagttatccttggctggagggcccctgtgttgcatggctctttgctgttccttaagtcctattcctgtcactcattgattccttctaggtgttctcccatctgtctccttatacctcttctctgtcaccatgtctcatgccacattccccacacctcactacactttctgctgcctcctcataggaggtcaagtttctcgccgagcctgaactgtaaacctcaccatcccacactacaattaaggttctagcgagattcacatcacccactagagattaaaagttaacatggcgaggggctgaagagatggctcacagttaaaagcacttgctgttcttacagacaacctgggtctgattcccagcacacatgtgtcagaagccatctagaagagggtgagacatgcaagtgagtttgctggagatggcccactgtttctcatggcttgtgatgagtgagctctgagatgcaagattaccacagacttcatcccaagattgcttcttgctgctgatctgcctttcctgccactatcacctaatgattcctgagcatcagtctaccccactgggtatattttctacacatcagcatgaagatgtattctcttgtagtaaggctgtacagacaaactgatgatttcacaacttctggtaatgattttatggaactctcaaattaatacaagtagtctcaagtctcctataaaattaagctacaaacagagctctgtaaacctacacgtgtcatgggctaattgcactaggataagaaagcaggcttggaacaagttttgatcaaggaaaaccattcattctaagtctggcccaaggatgaagccacaggtgtgatacagcaaggccctgggaaactgttgctgtgaatttgcttatggaaggaagccctgctttgaactgactatctatatccttctgtaactccccctttgtgtaacgcttcatctgtgaggtaattttataaagaattttttgtctaagaaggtataaggaggtcagagagaagacataatgtatggcatttggggctcagccccatgcaccaaatgtgtgtgtgtctgtctatacatacatgtgtaggtataatgtgtatatatttaagtgtgcatgaattcttgtggaattgttgagacaggtggtcaggcccagtcaaagtgtgtgtgtgtggtttgtgtctatgtgtatgcttatattctctccttcttcctcttcttttctatattgctcacaaagagttaacaaactccaaacctctcccctggccagggagggaggggcccttgagactggcagaaactagcttttttctaattcccctgctgttataagttggagtcaaattaccagaagccagaggcttttggccttagaacagcagagcaaaaggaagagaagaattaccaaatgtaagtagctttggcctacacaggagcaaagggtaaggacagaagaatgaccaaaagtgagtagcttctggcccagagcagcaaagagttaaagaactgtcaaagataaagcagctttggcctcaatccctgacacctctgctgccttcctggggaagctgggtgccaggataagccctcagcacacatggtgattcacaa

SEQ ID NO: 278 - DNA, 1559 bp, Mus musculus
ccccgagacaacaagatggcggcgccgcgggacggctcgctggccccgtggagtccctgacagtgaacctcaagactagagctatgagctcacctctggcctctcttagcaagacgcggaaggtgcccctagagtcggagtctgtgaatcctgggagacgagggataagagtctacggaaatgaagatgaggtggacatgtggaatgatggccaagactcagaagagaagatctctctgccttcctgctatggaggcatcggtgcccctgtgagtaggcaaggaccccatgactcggagctgatggcctccatgaccaggaagctgcaggagctggagcagcagttgcaggcccagaacgacgagatgctgtccaaggagcagaagatcctggacctggaggatttggtacagaccctccagcagcaccagaacaatgcagccctgcagaggcaggaggagctggagacacaatgcattcagctgcagcggcagattggtgagatggagcggtttctcagcgactatggcctgcagtgggtgggcgagcccatggaccaggagaactcagaggaaaagacagtctctgaaaatgatgagcgagactggatgaaggccaagaagttttggaagccaggggattcttttgtgccccccgaggtggactttgacaaactgatggccagtctacaggatctgagtgagctggtggagggagaggcccaggtgactccggtgcctggtggggctcggttccgtaccctagagcccatcccgctgaaggtctaccggaatggcattatgatgtttgatgggcccttccggcccttctacgatccctccacgcagcgctgcctccgggacatactggatggcttctttccctcagagctgcagaggctgtatcctgatggagtcccctttaaggtaagtgacctgcgaaatcagatctacccagaggatggtctgggccaattcccaggtgagggtcgtgtggtgggccggcagaaaatgcgcaaggtcacagacagggtggaggagacttcaggctccaggatgactgctgaacaattcctgaacaggcttcccaagtgtataatccgacaaggcgaggtgattgacatccggggccccatcagggacaccttgcagaactgctgcccaatgcctgcccggatccaggagatcatagtggagacacctgccttggcttctgagcggcagaggagccaggagtcacctgacatgccaatgcctctgctctccatgcttcgcatcaagtccgagaacggagagcaggccttcctgctgatgatgtggcctgaggataccattggcgacgtgcggaaactcttagcacaggccagggacatggattcagctgcctttgagatcttgagcaccttcccgcccacggtctaccaggacgatacagtgactctgcaggccgcaggcctggttcccaatgcaacgctgctgttgcggacccgcagagccctgctgtcgaaccccatctcccgcccaggctcactgccctgaataaagtgccgcccctgacat

SEQ ID NO: 279 - protein, 511 aa, Mus musculus
PRQQDGGAAGRLAGPVESLTVNLKTRAMSSPLASLSKTRKVPLESESVNPGRRGIRVYGNEDEVDMWNDGQDSEEKISLPSCYGGIGAPVSRQGPHDSELMASMTRKLQELEQQLQAQNDEMLSKEQKILDLEDLVQTLQQHQNNAALQRQEELETQCIQLQRQIGEMERFLSDYGLQWVGEPMDQENSEEKTVSENDERDWMKAKKFWKPGDSFVPPEVDFDKLMASLQDLSELVEGEAQVTPVPGGARFRTLEPIPLKVYRNGIMMFDGPFRPFYDPSTQRCLRDILDGFFPSELQRLYPDGVPFKVSDLRNQIYPEDGLGQFPGEGRVVGRQKMRKVTDRVEETSGSRMTAEQFLNRLPKCIIRQGEVIDIRGPIRDTLQNCCPMPARIQEIIVETPALASERQRSQESPDMPMPLLSMLRIKSENGEQAFLLMMWPEDTIGDVRKLLAQARDMDSAAFEILSTFPPTVYQDDTVTLQAAGLVPNATLLLRTRRALLSNPISRPGSLP

SEQ ID NO: 280 - DNA, 44749 bp, Homo sapiens
  misc_feature (1)...(44749): n = A,T,C or G
gccttggcctcccgcatagctgggactacaggtgtgtgccaccacgcctggctaattttttgtatttttttttttttttagcggagactgggtttcaccatgttggctaggctagtctcgaatgcctgatctcaagtgatccgcctgcctcggcctcccaaagtgctgggattacaggcatgagccaccgcgcccagccaagacctagaattttgtgattttggtagagaaagtagcaagcagatgggttgtttgtattagctgaggatgaatgggaggggagcgagggaagggacaagtgggtgactaagctacagtggaaggggactggggtgagagagtggctgtgagggcccagggaggggtggggggatgagaggaatcccacagctgcctggatagtgctccatgctttatgcattccctcacttgataccctctgtggtgccctgcagcaggtgttatgtttatccccatttgactggtgaaaaaactgaggcttagatgttaagtgacttgctaaggtcgtaaatggtggagccagtctcatttgaccttgaatccaggtctgtctgaagccacagccatgtatgtaacctctggggctgccctagaattcatccattaagtcttgattccctgccactccctccccctcccctacacaaactccccccaggccccaggagttggtcaccacaaccccagctctggcccactctcccttcacactctcccttccttagtctactttaggcctcatttacatgctaggtagtaaagggaaaactcccctcacttctcttctattgttttgggccttgtgttgcaagcccaggggagatctggctgaggctgagtccaaagaaaaaaacagaggctgggcataggggctacgcctgtaatcctagcagtttgggaggctgaggcgggcagataacttgagcacaggagtttgagaccacccgggcaacataggaaggccccatctctcaaaaaaaaaaaaaaaaaaaaaaaaaattagccgggcatagtggcacaaacctatagtctcagctacttgggggctgacgcaggaggattgcttgcacctgggaggcccaggctgcaatgagccatgattgtggcactgcactccagccagggtgacagagcaagaccctgtctcaaaaaaaaaaaaaaaaaagccaggcaaacagtggctcacgcctgtaatcccagcattttgggaggccgaggtgggtggatcacctgaggtcaggagttctagaccagcctggccaacatggtgaaaccctgtctctactgaaaatacagaaattagccaggtgtgctggcacatgcctgtaatcccagctactcgggaggctgaggcaggagaatcacttgaacccgggagaaggaggttgcagtgagccgagatcgtgccattgcactccagcctgagcgacaagagaaaaactccatttcaaaaaaagagaagagaagaaaagaagaactgagagtcaaagctgatgagagaaagccaggaagtggagagggaggggcagggagggagagaagagggaggagtccccagccatccatcaccctctttccccatccctgccctttcacccagaggtctctcctcacccttgactcaagttctcagctgtctttggtgtgcctgtgggggtgagtgattctggggttcatgagagtcagggaggtgtcctgtgccagaagggcaccagcccagaagacaggatacccgtgttgaagtctgagattactctgctgaaaatgagctccatcacactgtgcaatcttctcccctcttacaaagaggcagccagacaggacgagcctggggccagccgtgttatagtttcccatgctggagatgcatgcgaggatactaaatgccagactcttatttgtaaacattttcttgcaaacctcagaagcttcattttcacctcctgacaccctgaggagtatcttctacagtccatgtatttcctctgcaaggaaagcccttctccaattattttacctggcaaactctttttttttcccctcgagtcaggttcttgccgttgtcacccaggctggagtacaagtggtgcaatcatagctcactgtaacctcgaactcctgggctcaagcaatcctcccgcctcatcctcctaagtacctgggactacaggtgcatgccaccatgcccagctaatttttggggtggtggagggtggagttttgctatgttgcccagactgcaaactcttctttattcttcaagatttagcttagaagccccttccccagggaaactttccactttccctaggaaactcaaagttcctaaatgttcgaagggccctttctgttgacctctgttctaaagattgtgtctaccaagaatatggtctgtcccttgtgggttgggactagattttgtcacttctcttactcagcgaagcacagaacatggcacagtgtaggtgtcagggactgccggaagaatgagtgcgtgtattcatctagatctattcccacctccgagcctagtagtcctgcatttattcatccagtaaatatttactatggggcaacagtaaagtcagtactgaaaagttaccaatgcagaaaagaaataagggactgagagaagcaagccctttatatggagctgctttcctcctaaaagtatgccacttgcagaggggacagctgagaaactgagctgagctttctcatcttcacatacttacaaatgtatgggagaaaaactatagttctagattctctaagaaaggggagccctgacaaactccccccacctaggctttgggttggaccacggggagtgagagtaaacaggaaacaacagcccaaccctcaaagaaattgaagacaacatgaccaaaaagcagaaacagataatagaaagttatacaaaagatccagataatggaataatcaatcaaattttcaaataactatgcttacttaaagacattttcctcttctgccctctgagcagcaggacaagattgagaactagaaattatagtaaagaaccggccgggcgcggtggctaacacctgtaatcccagaactttgagaggccgaggcgagtcgatcacaaggtcaggagatcgagaccatcctggctaacaaagtgaaaccccatctctactaaaaatacaaaaacttagccaggcatggtggcgggcacctgtagtcccagctactcgggaggctgaggtaggagaatggcatgaacctggaaggcagagcttgtggtgagccgagatcgtgccactgcactccagcctgggcgatggagcaagactaagtctcaaaaaaaaaaaaaaagaaaaaaaattatagtaaagaaccaaatggaaattctagaactgagaaatatggtaataaaaattaggaactcagtggataggtttaacatcagattgggcacaactgaagagaaaattagtgaagtgaagtaaagatcgtaagaaagtattattagagcagaatgtgtttattgggtgcctgctgtgtaccaggtactgaactaggcactgggaatacaacagtgacataaagacatggtccctgctattatggagctgatatttgagtgggggaagactaataaaaaacaatggtaatttcagatgttcacaaatggcatcaggaaatcaagggggtaatgtgagaagaagaagaagtgaaatgtggggaggatatattctaggtcagtggtcaggaaagaccactcagaggaaatgtgtgtgctgagacctgcagaacaagagaagaccaggcatgcaaagcaccttagatcacaattccatcccagttccacagtgtcttttgatgactgtccctggggcctagcacagtctcacataggccaggttctccaaatgtccttggtcaatgatagaatggaatacagcagggagggaggaaggagaagagagttatagcacacgtcacagtgtgatctgccttgaatttttcatcctcactgagacggggctgggattcagtagcatcatacagcataccaaggtgaatcttcatccacccattcattcacctatccacgcacccacctatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgacagaaagagattttgtctcaaaaaaaaagaaatgctataatggcagcagggcttttagacagtggattttagagtgtggttctgcttgcaggggagtggggatgaaccagcagatgatttcatgggggaggggacatttgaacttgttgaaggatcgagtgggaattttcccaaatggaaaaggcaagagaggatgttctcattggaaggagaggccagaacgtaggggagaacatgacggtttctggaacgtgagaaaggcggaacccaaaataggagggctctaaatatcaggctaagctgtagatgatgagggcttcgtctaaggtggtggtgatgtgggtggagaagggagaaggtggaagagatagctagatttgtattctgctaaagagacttggaggaactcctttattatttaccttttacttcctgagctggtagaactcaataaactctttaacctcagaggggtcataactgtaaggctctttcaggaaatgacctaaaagcaaagcagactctgtccactctcaagaatagacttgtggctgggtgcggtgggtcatgcctgtaatcccaacactctgggaggccgaggcgggcggatcacgaggtcaggagtttcagaccagcctgaccaacatggtgaaactctgtctctactaaaaatacaaaaattagctgggcatggtggcacgtgcctgtaatcttagctactcgggaggctgaggcagaagagtcacttgaacccgggaggcagagtctgcagtgagccaagatcgcgccactgcactccaaccttggcaacgagtgtgagactccatctcaaaaaaagaatagagacttccaccgggcatggtggctcatgcctgtaatcccagcactttgggaggctgaggcgggtggatcacgaggtcaggagttcaagaccagcctggccaacatggtgaaaccctgtctttactaaaaaatacaaaaacattagctgggcatggtggtgggcacctgtaatcgcagctactcgggaggctgaggcagagaatcgcttgaacctgggagctggagtttgcagtgagctgagatcacgtcactgcactccagcctggaaaacagagtgagattctgtctcaaaaaaaaaaaaaaaaagaatagagacttccagaaccatctagccccagagctggggtctacttcctcaccctgcaggtgggaaacaggtccagaaagagccttgttcaagacctccctcctcccaggccagggcctttgcaccatcatcagactgaatatccaccactggatgcgatcaagatgaggctgggcgaccccatctcagaagtccagagggaatccttccagcttggaagtggtcggatgggtctccaaggccctcacaacactcaagtcttgtgagcctggagacctcagagatttccagaccttctaagatgtgggaagagaaatataggttaaaaaaaaaaaatcagatgagcttagactcttggtttcttttataattttgtttttgaaaaaacaccttttttttttttttttttaagacagagtctggcactgtcgccccaggctggagtgcagtggcgcaatcttggctcactgcaacctcagcctcccaggttcaagcaattctcctgccttagcctcccaagtagctgggattacaggcgaccgccaccatgccctgctaatttttgtatttctttcttttctttctttcttttttttttttttgagatggagtcttgctcttgttgcccaggctggagtgcagtgatgcgaccttggctcactgtaacctccgactgctgggttcaagtgattctcctgctttagcctccaaagtagctgggattataggcgcatgccaccacacctggctgatttttgtatttttagtagagatggggtttcaccatgttggccaggctggtctcaaactcctgaccttaggtgatccacccacctcagcctcccaaagtgctgggattacaggcatgagccactgctcctggcctagtttttgtattttttagtagagacagggtttcgtcatgttggccaggctggtctcgaactcctgacctcaggtgattcacccacctcggcctcccaaaatgttgggattacaggtgtgaaccactgtgcccagccaaaaactcctcctttttgggccgggcacagtggcaagagggtatagtctctgctacttggtaggctgagaggccgagacaggaggatcccttgagctcaggagttcaaatccaacctgggcaacatagacagagtctgtctctaaaaataaataaatgagcaaagaaagaaaagaagaacaccttttcaggagcaataatgcaacaacattataggaatttttaaaatagtgtatatatttttttcagctgttgtccccactcatgctggggccggtgcctcattatggaaaatttaatttgtacaataatcctaggaggtagattctattagtatctctactttacatttgtagacactgagactctgacaagtgaagtatcttgagcaggaacagccagctattaaacgacagagcccagcctcatagagttgttaagttatgctggtccacagtacaatgtatccccaacaaatgatggctcttattattttccaagtttctccagtgaaattgtatatttttataataaggctctgactttcccaataaatgttatttttttaaaaaaaatcaaaccagaagggcacggtggctcacgcctgtaatcccagcactttgggaggctgaggcgggtagatcatgaggtcaggagatagagaccatcctggccagcatggtgaaaccccatctctactaaaaatacaaaaattagctgggggtggtggcacttgcctgtaatcccagctactcagaggctgaggcaggagaattgctcgaaccagagagttggagattgcagtgagctgagatcacaccactgcactccagcctggcgacagagtgagactctgtctcaaaaaaaaaaaaaaaaaaaatcaattgactcgggacagggtgcagtggctcacgcctgtaatcccagcactttgggaggctgaggtgggcggatcacaaggtcaggagacggagaccacactggccaacatcgtgaaaccccgtctctactaaaaatacaaaaaaattagctgggcatggtggcgtgtgcctgtagtcccagctactcgggaggctgaggctggagaatcgcttgaatctgggaggtggaggttgtggcgagccacgatcgtgccactgcactccagcctggtgacagagcaagactcaaaaaaaaaaaaaaaaaaaaaaatcaaacgactggcctgccaggttagagggctcccattttcctcccaggaaatagatgtttactgagtgtctgcctgctgcggaatctacagccaggccctgggtgggaagaagggatggggtaaatcctggtgcctgggtaaatgccactcacgatctggttcttgctgaggcaggaatcagagggcagaccacagcagggctcatgagaccagagctcctgcttcccacgcttgcttatctccatgagcaaggtgacagtatgaagttgctactcaccctgaccatgggtccaacctcaaaaaacacttggccccgacatgatctcagtctttctcatcttcatatacctaaaacctcagaaaactttctgggagcagctcagcaacaagagagctcttcctatgtccactctccagtcacactttccgcccagactcctcccttggcagtaggtctgtaccaccttcttccttggcttatctatgcctgccttgtttaccagagtgaaagtttctaggaagagcatggactcttgaggctgaccgttctgggtttgaatccacttctgcttcctgcctttataatcttatgcaagccgctgtactaccctgagcttgttttctcatctgtttttttcttttttcttttcttttcttttcttttttttttttttgacagagtttcactcttgttgcccaggctggagtgcaatggtgcgatctcagctcaccgcaacctccgcctcccaggttcaagcgattctcctgcctcagccttcctgagtagctgggattacaggcatgcgccatcatgcccggctgattttgtatttttagtagagacggggtttctccatgttggtcaggctggtctcgaactcccgacttcagatgatccgcctgcctcagcctcccaaaatgctgggattacaggcgtgaaccaccacgcccggccctcatctgtaaatttcatgttaccatctggtacttggcactcagtagtagtagctctctttagcttccaatttgcatataaagaatgctgtccactttgggaggcagagatgggcggatggcttgagctcaggagtttgagaccaggctgggcaacatggcaagaccctgtctctacaagaaaatacaaaaactagctgggcgttgttgtgcacacctgtagtcccagctacactggtggctgtgatgggaggatagcttgagcctgggaggcggatgttgcagtgagcagagcctacccttccctgaatgtggtaggctagaaagtcaaacggaaaattaaaaaaaaaaaaaaaaaagcaacagaaaaacactcttgggttgtgcagagaaagggcttttgaacctgggcacaaagaagtgagtgcctgagatcagaaatcataaactcccagaccatcacagctgaaagggtggagagatgatgatgatgattaacagcaggaaacgtttttgaaaaagtgctctctacaggtgtttctgtttcggctttcccctttaaaatcgtgtactttgcattaccttatttaatcctcacggcaacccagtgggggtaggtattatcactgttttacagatataaaaactaaggtgtataaagtgcccaagaacacacagtaaggagccaggactcctaattccaaagttcgtggtcttaactgcctttagctgttttggtgactgagtctaatccaacacaattttacagatgaggctctgggaggggaaattgtcttacccaactcttaacacaagggaactagaatttgggccgcccttccgggcgccaatctggtcaaggatttgtcacagaaactcagatttaggaaacatttattaagtacttgcatcattgcaatccatcctcaaagcagcctccgtgaagtattacagtacttcgtgttacaatactgatcatatggggaaataagctaagagggataattcctcccaagatcaatttagcaaaatagcggcactgtcgggatcacacattcaggtcctgaatgtgaggctgccagcagttccattaacctaatcccaggctccttcctcccgcacctgagggtaggaacgaaaccaccccaccaaccccccccccccccgccccggacctggagccctctcagagcggtgcattctgggattcgcccgcgaagaataccgactctgtgggccaatagaatccgagcacaggcgactgtatccaccttcgctgtctgcaggttgctcaggcctccctcaaactagccaatgagaagtgcacgggtcctggtcgcctaggaaaccgcgtgacaacaagatggcggcgctgcgggacggctagcggccctgcgtggtgagtctggcttaagacctttctgcccctggagtccccacgcaggctggagcccgagccccgagggcctgcgagctccgcggctcccacaggagaggttcaagaccctgcttaccatgactacgcgtggaggcggaaggaggcgacacggcctccagggctgggttagatcgtgatagacgtcgctccctgagcgcgtcctgggggcattagggagtcctggcagcgggccggaccgtgtccccgccagatctctgggctctggggatgacggagaggccgaggaggtgtgaagaagaatattgtgagtcaagcacagcactgagtttggttccaaagatgtagaggcatggtgcagagatttgctctcagagccaggtctgaagtgggtgacaactctgccttaaggaccttttggcctgaggggtagtcacagtcctgcccttggaagccccaaagtgaaggagttaggcgactgtcctcagggctccctaatctgaaggagaaagagatatgcccctgccctcaggagtccccccaaacggacagggaaatgcagcctttgccctcaggggcccttgtaatctgggagaagattaacctggagacaatgtgtcggactggactggagtgacactggaagtagggaagtcagttgggagccatgtgacagcccccagaatgggcagtgagagtcccactaggacggccgacggtggccatggaaaggggcagctatatgtgagagagtttagcctgcagggtttgatgtaagaggcaagatggcgtaagagggaaggaaggagagaaaaaatgtggttgggtgatggggtcccattaagaagggggaagtgggaggaagtgagtttgacgaaaatgttggatttggtttaggagttttgtttttttttccctatgacagctttattgagatataattcacgtattacatacttcactcctttaaagtgtaaatttcaatttttagtatattttagtatatattccatttatatgaaatgtgcagtgtgggcaagtctatagaacagaaaagtagatttgtggttgcctaaggctgccttggaaaaggggtgggggctggagggtaaattgggggtgactgccaaagggtacagggtttgtttaggctgacgaaagtgttctaaaattgtgatggtagtacagctctgtgaatatactaaaaagaaaattacactgtaagaaggtgaaatatgtgaattatatctcaaagctgttttatgaaaaaggttgcatactgtataattccatttgtgtaacttttttgaagtaagaaaattatagagatgggccaggtggggtggctcacgccggtaatcctagcactttgggaggctgaggcaggagaattgcttgaacctgggaggcggaggttgcagtgagccgagattgcgccattgcactccagcctgggcgacagagcgagactccatctcaaaaaacaaaacaaaaaaagtattgaggggagctgggtgaaggatacaaaggatctttctgtactattttcctaatttgcctgtgaatactataataattttcaaataaaaagctaaaatataagtaaaaacaaannnnnnnnnnnnnnnnnnnntgcaggtaggaagtggggagaccgttctgggagtggggggattgaggttgaggcaggggggatacacatgcatttgaggcattgctagaagttgaggtggctcaagtgtgggaggcggcaagatgggagatgaggtcaggagacataagcagggaccaggtcacctatatcaaggaattatgaatttttttttgagatggagtcttgctctgtcacccaggctggagtgcaatggcgcaatctctgctcactgcaacctccgcctcctgggttcaagcaattcttctgcctcggcctcccaagtagctgggattacaggtgcctgccaccaagcccggctaatttttgtatttttagtagagatggggttttgccacgttggtcaggctggtcttgaactcctgaccttaggtgatccaccctcctcggcctcccaaagtgttgggattataggtgtaagccaccgtgcctggccagaattttgaatttttttctgtgggtgagaagtgctgggattataggcatgagccaccgctcccggcctgctttatgttttaagatctctctggtagcacatgggaactaatgaagggagccttggccatacaacccgtgaggctgcccagacagggcaggggctggggcagggtggggacagatttgggaggctggatggtgggggtgaagaaactctgggcctgatccttgaggagggctccttccaaggaaggggcagggcatgattctcaaactctgcagtgaaggcattggaggctgcctccaggcagcatagattcccttgctgactgacttcagaagtagggttgaggccagaaccagacatcttcaaagtggaacttcttggatttgtcctaaaaaatttggtccaggctgggtgcagtggctcatgcctgtaatcccagcactttgggaggtcgaggggggcggatcacctgaggtcatttactgaatagagtagtagccttcgattatgtccttcaggtgcactcctttttccagaaggaagaggaaaggaaaggaaactaacatttacgagtgcttcctatgtggcagcaacagcaaaaacaacagcagccccaactcacatttttcagtgcttcctttgagcttggcgctgggctagaccttctctgttatctctgaatctgctcagaaccctgcctgtgccagtactattacgacccccattttatactaaaagaaactgagggtgggttactccagtgagtggcaaaacctggcatcttaaccttggtgtcacatggactgtgtctttttttttttttttttttttttgagatggagtttcgctcttgttgcccaggttggttggagtgcaatggtgcagtctcatctcattgcatcctccccacctcctgggttcaagcgattctcgtgcctcagactcccaagtagctgggactacaggagcacgccaccacgcccagctaatttttgtgtttttagtagagacagggtttcaccatgtcggacagctgatctcgaaccactgacctcaggcgatccacccaccttggcctgtgtcttgattgaatcctgcctgtgggttggcctctctggctctgagatgttgggagtggcacctggtttctggtgggagggaaggagatacttgggctttgtgtcacccagctggctgatggacggacagcctcctgggtagtagcattttcaggctctaagtttgggaaagttccaggcttctgactcatttctgcatcccatcccaccctcacagtactttcccaagcaccaccaggccaaaggtctctcagttcagagcagaaagccgtatacccagaggagcaggcagataacagaaacttccagaaacctctgtggagacagtggaagaggcaaaaggtactgctgcctagacagcgcttcccattaggaagtagtagccagggaagtggaaacttcaggctacccgctgggcttggagccctgagtctgtccccaggggctgacttcctgcattcctctagggagttcctgacagctggattctagaagtagaactatgagctcacctttggcctcccttagcaagacccgaaaagtgcccctgccctcggagcctatgaatcctgggtaaggagccagcctcaggggtctttctgtccccgcctctgtatcctcttctatccttccatggccagaggacagtgactcctagtgtcttggggaatacaaagaagggccacatagccttccctgaccactgtctttttctttataccttcttctggggcacccaactttggatctgagcataaactgggttgtgcttttagtaaggtatgggccctgtaggagtggcttggcatcccatctgttcattcactgttcattgattaattctgcaaacacagatggtctacggacctatcctgggccaggccctgtgtggggttcagtaaagggaatcttttacatctgtctagcactttcatgttttcaaaacattttttacctctcttccttcttgctctctggaataccactttgagtcttttttttttttttttttttttttttaaagaccaagtctcgctctgtcgcccaggctgtggattgcagtggcacgatcttggctcactgcaacctgtgcctcctgagttcaagcgattctcctgcctcagcctcagtagctgggactacaggcgcatgctataacacctggctaattttttgtatttttagtagagacgggtttcactgtgttacccaggatggtctcgatctcctgacctcgtgatctgcccacctcggcctcccaaagtgctggaattaccagccaccgcgcctggccccactttgagtcattctaaggcctagaagattcagagaggttaagcaacaggcctcacagcctttgcagagcagagctggggctgagctcatgggctttgcaagccttgtagtcttcccacctaagactctgctcttcaccccttccccatccttctccactgggtgaagtcagacacctcgaagcctgtcccttgtctcaccccaggctggggctgggatttggggctggaagtcctcaggagttagaggccctgcttccatctctttgagctttggctgaagtccggtgcccagagccttatccctggtatcattccaggggccctaacttatatttcttccttcttcctgcctgggttcccaggaggcgaggaatccgcatctatggagatggtaagtgtgccccgccctcgtgccctcttcgcctctcatgtgcttgcacctcctacagttggaccgatggagagaaatcacacgagaaaggcccttgtcagctggagcagcggcctccaccgtgttctgtgcagctcccatgctgtcctccctgagggctgggcttccctcctggaagctctcagattaggaggccccatacccttggcacagatgttgccactcacatttgaaccccttgacccactgtgggactggccagtgtgtgcctagaaaccaagtgagggccaagagattacccagcccaggggtttggatcccagccccccttccccctccagcctcctccagtgtgacagcctttctcccgggaggcctgtccatacattgccaccctgactcttgtagctcaggcctttggatccctgccccccaactctccaccatggcattggcattggccatgccagtccccctgggagcaggactggaagaactccaaaacagccccattctggttggatccttgctccccagccttgtgaattctctctcctcaaactccctggggcacagtgcataggccgcgtcacactggcgagggcccagggcctgagtttcctctgggtctccgccccagagcggtgacctaggcatccctgtctgcagaagatgaggtggacatgttgagtgatgggtgtggctcggaagaaaagatctcagtcccttcctgctatggcggcataggtgcccctgtgagtcggcaaggtgagagcagaggcctgaagggtctgggtcctggctgcaggagggggccccagagacggggcaaggcctagggaggcatggcccttcctctcgcctgtttggtctgaggcagctgcttccactcctggctgatcgtggcagggacctggcttggcataaagccacacaagccccacccttagctcaggaggccgaggcccagccccagccccagccccaggccaggctgtggctatagttaccaggtgtgatatcagtgggctcaggattcagggtcagagagggatgaagagtctgagggtagagctcagcttcctgcttctgcagggctctggcaaggcccaaagtcgcctagacagtctgcttagcttggcagagggctgtggcaatgctgagctcatggaggcacctaaagtgggatggggctaatcagggtggcttcccagagtggtgatttagcaggtctgagaaaaggggagacatgggcaggcagggatgagccctgcagagtgctgggcgggatctggggatgctggggataaggttagaactttccactagctcactagctgtggtatcttgagcaagcaacttcgcatctctctgtctctgaggcctcctctgtgaagtgggcatgggaacagcgagggcagcgtgttgggaggattcgatgagatgctcctcggtggaaggcccctggccagcgcctgtcacgcgaggtgctcagtgtggtggctgcccatcaggaggccagccatagggaagggcctgatgattctccctcaggccccttccattttaccggaagagggaattgaggtggaaaaagagacaggaagagcctggcctaaggttctgcggccatttcaccacaaagccaagatctcctataccctggctggggtcaactttcttttttattttattttttttgagacagggttttgctctgtcatccaggctggagtgcagtggtgcgatcatggctcactgcaacctcagcctcccaggcacaatcagtcctcctgcctcagcctcccaaagtgctgggattacaggcatgagccaccatacccagccaggtcactttcagtagtaaccatggcaaccaggttctctctttgaaagagctccaggtgtcctctccctgctttcccctgtcatcccctcctctcccactcccagccaatatctgtccctaccaaggtaacagatgaggacttgcctatcttattttacttctctgccagcagtgtcctatactgtccactgctccttccttctcaggacctccaccaagctcttaggcaccaagctgctgccctcccattaccctctgcttctaggctctgtctcttagctgtcatcaccacctccttttttctctcaggttttttttttgtttttttttttttttggagactgccttgctctgttgcccagcctggagtgcagcggtgcaaatcactacttactgcagcctcgacctgtcaggctcaagcagtcctcccacttcagcctctcaagtagctgggactacagacacacaccaccatgcctggctaatttttgtatttttagtagagacagggtttctctatgttgctcaggctggtctcgaactcctggtctcaagtgatctgcccgcctcggcctcccaaagtgctgggattacaggtgcgagccactgcacccaggccctcagcttttcaatgtgatgttcctctggcctggattctcctctgtgtccactgtgccccagtgagctcacctgcactccatgtgtagacagttcccaaatgtttgtcaattaagatgcatttaactataagtcaaagaaaacccttcctcagccaacaagaacattaaggaagttttgttatcccacatgcaaagaaatcctaaagaggcagctccaggggtgttaattcagtgactccaagacatcatcaggggctcaggtttctccatctttccactgaacctgccttgacatgtcagcctcatgtggttgtaggatgatggccgcggttcctgcttcatacatagaaaggacactgtctaggggaagaaaaggaaaaggcctgcttcttcctgtaggtttctcttcttttccattttcatacttttttttttttttttttttttctgagacagagtccctcactctgttacccaggctggagtgcagtggtgcgatcttggctcactgcaacctccgcctcctgggttcaagcgattctcgagtagctgggattacaggcacctgccaccacgcccggctgatttttgtatttttagtagaggcagggtttcaccatgttggccaggctggttttggactcctggcctcaagtgatccacctgccttggcctcccaaagtgctgggattacaggcatgagccaccgcatgcccggccctggctactgttttctacagcaccccgcattctggctttgtctggcagtttgcccgtggggtatttgcctcactcctctatctgctgttttgcgtaccaactggacactagatttggaggtttgattagatcgagggtgaaattcttggcaatgcttcagggtgatgtcacccatatgttacaccacttccttgtatatgttggacaaattacttgatccctttgtgtctcagtttcctaaaacagttcatttacctcctgggtgtgtttcaaggattacagggggttgatctacatgaagtgtttagaacagttcctatgatgccagtgggagctgctctcagtaccttcatttccattcctgggacccctatcctcctccctcccccccacaactcagcctcggctctaggtctgggctctaaagactttgtgtgcttggcagtccctgcatcccatgactcggagctgatggccttcatgacgaggaagttgtgggacctggagcagcaggtgaaggcccagactgatgagatactgtccaaggtggggctccaggtgggagagggccaggggccggtctgagaggtggagggactgggctggggaggccaggagttggactagggtgggtgattctagaaccgtctaccacactgacctgcccagtttgaggaccaggtgtggcctgggcctgatctaggtcctgtgacctgagccgagaggctagggggtcttcccctcagctgagcaggacccagtagaccctggactgggtggcacagtggactgctgagcagagcgcggcaccctcagatgtgggggtcctcaggtgtgggccgcacctctccctacctcagaggaactgcgagggttatctgaggtccgggagaagtggctgtgccaaagggtggcaggggcttgctgctccccagcatccaacataggcaaagctctggagcttcctgtctgggcagggctctgggaaccacaggccctgtgctcaccctgtgtcttatgctacaggatcagaagatagcggccctagaggacctggtgcagaccctccggccacacccaggtagggggctcttggagggctgacctgcgcccccagtcaggcacctcccctgggcccagggctcctggaagcttcacaatggcttctggcatcaagagcatcaagctgactacttggtggggtctggacagctgagcccacagaggggctgcagcatatccaggacagtgctggagtcactccatgccctcctacatgggaccgagtcccatctgaagtgtggaggagaggaggctctgaggggagtggcagcctcctagggcccatcaaggcaccgccacggggtcagaggagaggccagagaggtggggggccaagaggcagttcttgggggatccccagaacagcttctccagatgaccctcagggcagaggtgacctggcagtgtcttgctggggcagctgaagcctgtccctgtctttccctgaagccgaggcaaccctgcagcggcaggaggaactggagacgatgtgtgtgcagctgcagcggcaggtcagggagatggaggtgagagagctgggccccgggggatgcgggcagccagcagtccccagctcttcacggcatgttcctcaggagctgggtccgagcccacctctctgggcctctcctcgtcacatcccacccaggggaccctgccctgnnnnnnnnnnnnnnnnnnnntcccacccagggaccctgccctgcatttccctacccaggactggcccagactttaaagagccagggaggtgtctggggctggggcacacccctgcttttgggccctctgaacatgcctctcccctgcttagcagacctcatggctcccactgaactgaattctacagtcctcgctgtggcccctgcgggctggcccctgcatgcctcttcatcttagcttgaaccactctcccctccagccatgaggcccttcctctgggtctttgacctcatggagctgcttcccacctcagggccttgggccgtgctgttgctgttccctctgctgaaatgtttccccacctcccccaggtcagttccactgtcctcagtcatatcccccgggcctcctaggcaggttttccatcctgagctttctcagtgcctcatctctcttcccttgtgggactctgaactccacgacggagggagcagtttcctcctgtatgtcactgtgcacccaggacctagcactgaattggttaagcaatttgctgcctctggctgtgacttctgctcactggggactcagtgaccccagtcacctttctttcccccactcacagacccattcaaacagcaagggaactagagggacaccaggcacagagaagggtcccaggcacgcatgggccctgccagaagttcttcctgggattcagcctctctccctctccacgcagaattggtttccaaagtcccaatctaatttaaaaccttggcagcaaacctccaattgcagctgagagcccttcccactccaagctgttcatacctggggttgtccccgagcagtggccacaggcggtgagggctgcaccagagcctcggggcaggggcatgactgcccttgcatgcgtctccgccacacagttatcacttcattcatttaacagcctcatctggaggatctgcttggggcaggcctggggcagagcatgaccaagacagacatagtcccccgcctgcatgaggctgccagtctgtggggaggggaacaaacgagtacacaggtacacaagtacagagagtgctgtgacttgatgaaatgggtgacaccacagaggcaagttgggggaccacctgcggggtgacattgggcatgatgtctggtgagtgaggaggggaatggggtgagaggatccaggccttagacagggaaggtgccacttcccgccacataacttggcttgcggtcggtggctgtgtggaggaaggagaagaacgggaaaagagaagaggtcgtgggggccttatcacattggagccgcccgtggttctggctggatcctgtcccgaaaaaatgggaagccattggaaggcttctgtttgagaggtggcatgacaaaaagaccaccctgctttgtggggttgggtggtgtgggtgaggagaggacgggggaagcaggcgccgcccctggattgtccaggagaaagatgacggtggcttgaactagggtggtggcagcagatggagcccagtggatgggttccaggctgcattggagggggcaccacaggccttgtgggtcatcctggaggaatgggccacagaggattctcaggtggagggggtgccatttctggagacaggaaaacctggcacgggggaggtttgacagggggacaagagccacagccattagacatccaagtgtggacggttggaaatgtgagtctggagctcgggtgaaatctgcataaatacaaacttgggttctgtcgtatatatttgggagagcgtgtggatggagctgggcccccatgagttggtgttggataggaaggggaaacggtgaaggaaattggaaaggaacagcccaggagatgggaggaaaactagcagatggtgaaagatagacagaaatgtgcccatgcgcttggcagcgggtaggttggtggttgcagcaccttgagcagtttcagagaggtatggcgatggagccaggttagagtggcttgagaaaagaagtcggggtgtggacatgtagacagtccagaagtttcctgtggcagaggggacatgcggccaagccctagggaggctggcacatggttcacatccctcagccctgcctccttctcacacttgggccaggccacgtgatttctgcagccaaggaggctgaccttaccgagccctcgcatgggctgggcgctgacctgagtgatcttactgagccctcctcacaagcttatgtggcaggaactgtcactccattttattagaggagtcgtctgaggctctagggactgaggcggctttccaaggtcacagccaggaaatggcaagatccccctactcatccctttgtctggtcagctctgggggccccattgcctgcagactgaggctgggctttgggctgacactgcctttccctgggaaggggctgagctgacggtgcccctgcatctcccccttctttcccacagcggttcctcagtgactatggcctgcagtgggtgggcgagcccatggaccaggaggactcagagagcaagacagtctcagagcatggcgagagggactggatgacagccaagaagttctggaagccaggtagagcagggcgtctgccccaggccctcttcaaaaggaattctccaacagtttgctgttggccggcagctccccagaggcctatctcattcgtgcccgggtccctgacccaagacgccctgagagcccacaacttgcccctgagacaatgtgggagcagccttggcctccatcactgaccacttaacctgctggcccacttctccgcggtcctacctctgctctctcttgctcatctgtcagagacccagagatacaagaggtagcaaggccttatttgcctcaggtcacatagtctacaaaacgccaccaatctggaagatgttgccgttttaaaaaaaagcaatccttctgttctagaagctgctgccaaattcccaggtttggcctccctctccaggtttgcttatggcccttggaatccacctggttctgtgggcccctaccatgtcttttttttttttttttttttttttttttgagacggagtcttgctctgtcacccaggctggagtgcagtggcacgatttggctcattgcaacctctgcctcccaggttcaagcaattctcctgcctcagcctcctgagtagctaggattacaagtgtgtgccaacacacccagctaatttttgtatttttagtaaagacggggttttaccatgttggccaggctggtcttgaactcctgacctcgtgatctgcccgccttggcctcccaaagtgctgggattacaggtgtgagccaccacgcctggcctaccatgtcttatttttaacttctaatatctagagggattcctcccacagtcccctcctatagacccacagatttgggtccataaaactggccatttctgaaaaccaggcccattctcttcaaagaatggagattgtcacccaaaagatgcttctccaggctctagagtcaggcacacctgggccctcaactcgactctacctcctatcccaagtgtgacttgggcagatgacctctattcacttcatcaacaaaacaggagtgttcttccctgggagttacaaggagcaaatgagttaaacgcagagcgcctagctctggccttgcagccattgttgtttccaaagtctgagggcaggggtcccacgggaataggagcacagcttccaaggggcccatttggaagatgacgacaccttcttggtttcctgctaggtaaaaacccagattccaaacatgagaatcctgcctcctgtttaggcctgggctctggctggatccccccagatctcagggtctaacgccctcactgcttgttctcaaaacatcacttcccatttttgtgccatttgcagctttctttttttttttgagatggagtacttgctcttgttgcccaggctagagtgcaatggcacaatctcggctcactgcaacctctgcctcctgggttcaagcgattctcctgcctcagcctcctgagtagctgggattacaggcgcccaccaccatgcccggctgatttttgtatttttagtagagacagcgtttcgccatgttggtcaggctggtctcaaactcctaacctcgtgatcttcccgcctcggcatcccaaagtgctgggattacaggtgtgagccaccgcgcccagccatttgcagctttcaaagcattttcttttttcttttctttatttttctttttattttttgaggcagggtctcacttttgcctgggctgagtgcagtggcacagtcatggctcactgcagcctcaacctcctgggctgaagtgatcctcccacctcagctgtctgagtagctgggactgcaggcacgtgccaccacacccagctgattttctttattttttgtagagacgaggtctcactacgttgccaaggctggtcttgaactcctggatgccagtgatcctgctgcctcagcctcccaaagtgctgggattacagttgtgagccactgtgccctgccagcatcttcatagccttgacaggggccaggagttactccatttcacagatgggtaaagggaggcacttaaggagtctgtggactcattattgagggaagaggggcaagacttaaggctgacagcccactgtaaggcagttggtcactgaggcagaagatgagatgatgcccagcttgagggtggggatggtgagaagggatgggcagagagatttaagtagaatccgtggccttggtgtctttacatgagggagaggactggaggagtcagggataacccgagggagcacagctgcgggaaagatgctgagtacacttgggacacagcaaagctgggggctgtgcagtccctatgatgctaggaaggggagcgtgtccctgctgcccagggcactgtaggcccaggcatgccaactccaaagctctaactgaacccagggtgggtgtcgtggggagagttctcaagggacccctggcatgagtgagaggtgaggccctattgggtggctgcaggtgctctgagaatgtctatcctggatctaggccagaggcccacaagtgccgcaccctgggccctgctgtggcgggctgggctcaggcttcaggtaggcctgccatcttgttgcagggcagccttcctcctggccaggggggacctccttgctccttgccaggtggctggtttctggacctggctctgtggattcctactctgccctgtttggttgtttgtgctctgagtgcctcaagtcaaagtaacttgtgaaaaaccctgccctccatcttggaggccctggccatatatgtggtccctccgtgcgttctcttccttcttttgttctttgattttttcagcatgggcggggggccttgattcggctctttctgccagatgaatgacgtttttcgtcgctagcagcttctgttcctgggacgtctctccggcgtccccgttcctctctccccaggtgccaccctgctccgcccaggggcctcaggctcacagcctggcccccgctggcctgcctgacactcggctgattgctctgctctccctctgttggagaggctcccacaggcgctggggtggaggcctgtggagggtgagccagggccgtctgtgccgagccagtggggtgatcaaactttctggagcctgggactcctagggaggagggccggtggggccatgaaggggcttggcctcaggctggatcgctcactctccccctctctctgccagcgtcacagagcatgctgtgccaggtgcttcagggtctgtggagacatgaaagggacagtcctgctctggtcacacgccactggggccaggtgttgggcctcggggctgagagctctggtcagctctgaagttctcccttcccccccaccctctgcatctctgagctcctcactcctcactacttccctgttcccctgagaatcctcaccctctcatccccctctgaaatccccacttcccctacccaagtcagtccctgcctccctccatggctccacctctccctgccagcaccccacacgcctccctccttcctctcaagccccacactcctgagtctgggttggagaccccctgactccgcagcctgcgtgacttgcccctgggcttgcccttcaatcccagagccacctggcttgacccctccccacctgcacttctgcctccagcctttgctcctgctctgtccccacagagcgccttgcccgcttccctcccctctgaagctcagggcaaatccaacctccgccagcaaactctgactgccctgtgtgggctgtgctgctctgtggggagggctctgcttgagggaaggggctaaaagctctggctgaggcagggttcaggtcgggtcagaccccagatcagcagatcgctgaccccctctgagttcatttcctcctcagtcgtgctgacgggctcctagggccactgaatggatgtggtaataaactgtgacagccactgtcacctagctgttgtcatgcatgtcccagtgcttggcacatgggcaagggtgtgtgtagctgcatgtgattggctgtgatgcccgtgtgcccaggcttggatgatcagagcacattggaacagtcatctgcacatgatgaggtggggacagggtggtgcgtagctcaatggcaggggccagagagagctgcaggtgggacccggcaggcctgagttcagatcctgccagtccacaggctggttgagtgttctggcggggaccagacctgcagggcctcctttcctgcactggctcctctgaagagcagagtgactgcagtaaagtccccagagcggggcctggcttgcaggtgtgtggtaatagtggttccacttcctgttgcagccgtctttgcctgagggtcaagggcaggcacatggagggcggcaccgcgtgagctgccggggtgccctgggcacttgtgcagtgaggggctgccacctctccactgagcatggtagggtctggccctcttctgggctccacagcccccacagtgatacttacacatgccattgtcgccatttgccgccccgtcttcttcacttgagtctgagcctgaggatggcaggaccctgggcgtgggcatcgccatgatgggcagggcctagcagagcacgggtgctcagacatttctggaaagcaggatccaaccctgcttttagtggcccagccactctgggccaggcccagggctcaatgctcctgagctcaaggggtgcccagcatggctggaaggcaaacaagcaagcagaaagcagcggcctgtgacgagggccaagggagtaggtgcaagggctccaggcatgcagcctcaaggcaggttgggggtggctcctagcaaggcttcttggaggaggtaggggtgagtgggcacagcttgagcccagcgatgagtaggcggtgctagggacaacaacagccaccatctgccaaacgcttcctccaagcctcacagcagccctgtgaagtgtggaaacttttatcgtcctcattgtacagaagaggaagctgaggcccatagaggcccagggttacagagctcggaagtgccctccagtgcccaccagagcgcaaggcaaggggcatgttgagggttggctgggtgctaagtaagggtcttgggagttgggacaaagagcttggacttgagctcccttctcattttaatacactcgtgggctctcaaagttggatgaggcctcagaggtgatctcccagcattgccactctccctggaaaagggaccccagtaagcagcctctcaagaaccaatattgagaggcagcctatgtgatcactgagcactgaggctgagtcacttgggccctgcaagctgcatgatctggggcgtgacagctcataaggcccaatttccttatctgtaaaacagaaatggtgatgcctgcctcctggcgcttggcacagggctgtcatttacagacaggttcaccagctggatcttgcaggcagtacagggttcttaccatctccccattgcacagaaaggacggctgtggctcaaagaggaagtgcctttccatttgagttctgctgctagctcagggcagacctaggacttgccctctgaccttactcctgctgtgtgactccccagctgcacctctctccatccacgggtcaggcctcagttgaaccctggtggggtggtgggggctcactggcttcacaaggccctgctgtggtagctcttcccacctcattctctcagtgctggtttgcccagagctgtggttccttcttcctggcccctggtctcatctccactctatcatatccagcatctgcctgggccacctgcttttacttctttaagccagggccgttttcttggcaagcttctctcttccccttcgtcgtttcttggcatcctccctggtctcaccccatcccatgtcaaccacccatgttcatcagcctgaaaaacccccggccctgggaggcggcaggagcattgaattaggagttggtgtatttggtgctcttcctggctctgtctggtctgatcaggccatgtcatctgacctttctgggcctcactttccccatctataaagaagacggagccctggtaacacagcgagaccccatctctacaatttttttttaaattaattagcagggtgtggtgatgcctgcctgtggtccaagctacttgggaggctgaggtgggaggataagttgaacccgggaggtcacggttgcagtgtcatgactgtgccgctatactccagcttgggtgacagagggagaccctttctcggaaaaaaaaaaaaagggttgaggcaggcattgtatgagatgatctattctgctattgtttttaggtttgcctatttgttcttaaggtagttgttaaaagaaaagtgtcttggtatcattctgttaggcgagtttttcctgggaatctcagggactatgtggggagcccccggaggggctgggggcaggtatagccccttcaatggtaggaaatataggggagaggagaaggccagctggggcctaccatttcacctgctgcaaaagcaacaggaaacacatctgcacctccctggtacagccactgcaccactgagaggaaaggaattaggtccccagagccctgacccacatcctgccgcagcctgcttgtcctgttgaaaaacagcctctctgaggccccaaaagttattggtgtgttgtagggcacacccaaacagatgacttacttgggggccaggtcccatcaaagatgacagaacaggcccctggtctgtacccagccagcatctacctgccctccacctttctgctctgttgtctgtcacggctgtccccaccgctccgtattctcccctgaagccagaacacagctgtatgcgccacacgtgtttcagaagaggccagagctttgtcagcttctcaaaggggtctgtgacccagaaatagttgcacaacctaaggtctgtcccatatctgttctggccagcagctgtccctacatcctccctgagagccatctgtccctcttctgacctccctctcctgatggtgcagatgggtgggggaaacagacttgagagtcagccccggctcccttcccagttcctcctctcaccaagtggcttgggacgagtcatttttcatctctgtgggcctgtttcctcatgtgtaaaatggaactaaataacccctgcctcagcctggcgtggtggctcacacctgtaatcccagcactttgggatgccaaggcgggcggatcacctgaggtcaggagttcgagaccagcctgaccaatatgatgaaaccccatctctactaaaaatacaaaaattagccgggtgtggtggctcatgcctgtaatcccagctactcaggaggctgagataggagaatcgcttgaacccaggaggcaaggttgcggtgatccaagattgtaccattgcactccagcctggacaacaagagtgaaactccatctcaaataaataaaaataattacccctgccttaagcctcagggttggcgtaaggaccatgtgtgcaaggtggagttgggcacagtagcaaacatggacagggtgcgtgttccaagctggctcttaacatggttacttcttggagccttacagccatcctaggaggcagatactactgtcatccattctagaagagaatgctgcagcacaagcattaaatgacctaaggtcacacagatagaagggaggaactgggatttgaacccagaaggcctcgatccagagctgggagctctgccctgtacttttcagctgccaacccagtgcctgacacagatctgggatcagatcctgcttctgctgcttactactgtgtttctcacaagccatgtaactttctctaaccctcagtttcctcatctgaaaaaatggaggtgattatagcctttatagataggcttgataagaagtgggaatggaatatggatagtaaacccctagcacaaaataagtgctcaataaaagacagctgctgttattatctagcgttgtccttttccccaggcagtcagttaaggagacattaagaccactgcccagcttgggagggagccacagaggctagggctgctagggacatgacagccaaaaggcggctcacaggtgtctgtcctctttgccaggggactcattggcgccccctgaggtggactttgacaggctgctggccagcctgcaggatcttagtgagctggtggtagagggtgacacccaagtgacaccagtgcccggcggggcacggctgcgtaccctcgagcccatcccgctgaagctctaccggaatggcatcatgatgttcgacgggcccttccagcccttctacgatccctccacacaggtaggagcggtgttggggggggtggtgctctagtgcccctgctgcccactgttagttggggatgatgaagccagctcaccccaggcccagcctgccctccacggggcacccaggcccacacacgacttgcagaggcccctctcccaaggcctgggactctgaatgtttccagagtgcggcactgggtgaccctggatctagggcctgccatccagaccagtggcagggcagggtgggcccaaggcccaggccaccccctcacttttcctctccccttgcagcgctgcctccgagacatattggatggcttctttccctcagagctccagcgactgtaccccaatggggtcccctttaaggtgataagctgctcctcaaaccacacctttggggattttgaagggagtggggatacacagcctccccagacacctcccattctgaggggaagccgctgcactccctgggggaccccagtctgatgccctccaggaggataagtctgaagccgggctgggaagggagcggagaggcccgaaacagagcagcaggcagcgccctctgctggcaccctggagacagcctcggctgcggggcccctgccttctagtcctccccagctttcaggacaccttgacaacctggggtccctgcagaagtggcccggctgtcccccaagtctcctgaagctatctgggtagggtgggaggcagtgctgtgagccacaaatgcaaagcagaggggacagatgttgggactcaaagacatgaggtagagctggccccatgggtaggtgccaccaccagagcccatgaggcttcgtgttctagaaggtggtgggttagtgccgcactgagggcgtgtccgggagggagcatgtgtcaccagggctcaggaaacagcatgagtcatgacgcgggggtgtttaaggcattcgtgccacagcggggacctcggagctatgccttgataaggcaagtgaggttacatgtacgatgatgcggtttgtgctgcagactggaaaaaagcaggggctttgtcctctcctgaccccctcacactctgccttcacggtaggctcctgagaggggggtctccaaggagggtgtcagtactgcagcttcagctggcgtggatggggtgcttacaggagcagcagggctgagggagatgacagcagtacgaaccgtggctctcctgaggcctgggtttcctcatatgtaaaatgggggttgcattagaccatacccttggcctgtgtttaggcaaatagggatgaaagtggggccaagggctgaagagctgggtccgctgccgtcgttgcccttctttcttgccaggtgagtgacttgcgcaatcaggtctacctgggaggatggactggaccccttcccaggcgagggcnnnnnnnnnnnnnnnnnnnnnnnnnnnnnnnnnnnnnnnnnnnnnnnnnnnnnnnnnnnnnnnnnnttttccctactgaaggttccaccaccactcatagtccttcctgggccccggttcccaactctgcctgtaggctccaggatgactgctgagaaatttctgaacaggctccccaagtttgtgatccggcaaggcgaggtgattgacatccggggccccatcagggacaccttgcaggtgaggccaatgctaactcccccagccctcctgggggaactttagcaccagccctggtccagcctgccagaacagtgtcttgtcagaaggctcaagcttgaggcacctgatgagtccctcagagctgttgctccactgtctcctggaaactgtgaggctggtgagggcacgggctgggccccggaaagcaggtgggttagctgtaagagggctaaagtcagagtccaggccaggggtgagcccaaggcccaggccaccccatcaaggtctaggccaaaatatccaactcagtactgggtactcccttcgtggttgcctcagactctccttggccctcatcattctgtctcctcgctccctattctgcttctcctcctaggtgtccacctgtgaaaggcaccaaaccttagtttctcaggcctcctctgcctccctcacccacacattgctaagtcctgtctggtctgtccacccccagaacttctcccagatgcatcccttctccacattcccaccacccaccaccctagtctagggttcagagtgtctctcccagacagctgcctcccactgccactcctgcccctgctgaccatcctccaggctgccttccctgttgaaatgttccagtggttcttgagataaagccaggttccttatgctggcactcaaggcccgtcctatattgccaggcccctcctcacaccaaccttttccttccagtccaattgagccccagcttcagccacacataatgctggcagttgcccaaatgtgtcgccacctctaggaagctttccctgaacccaggatctttgttgatgctgtctggaatatccctgcatccattccatttctaaggactcccattcatccttcagtcacagctcagttgtcattttccgagggaagccttccctgaccccaggctggggtgggcttccagcctgatcatcgtctgtgtggggttctgtctccattagactgaaacggggggttacctggggggaaccatggggctgcctcccagaaccttcttccccttccattgcctctcctctggccttggtttatacagaacaccccctcccgctttgctcactggtctcatctgtccctggtcaaggaagtgtccctctaaggtttgtggggatgactcaaatggggcctagggctctgtccaccctccactgataccttccagaactgctgcccattgcctgcccggatccaggagattgtggtggagacgcccaccttggccgctgagcgagagaggtgagggcgggatgaggaggtgagggcctgggggcgttgggtcaccgagtgctgatggcctctgggctgtgcaggagccaggagtcacccaacacaccggcacccccgctctccatgctgcgcatcaagtctgagaatggggaacaggccttcctactgatgatgcagcctgacaacaccattggggacgtgcgagctctgctagcgcaggccaggtgggtgcagggcagggccagggccacagaggggctctggtcccactgcccagcctgatctgctctgcctggtccccagggtcatggatgcctctgcctttgagatcttcagcacattcccgcccaccctctaccaggacgatacactcacgctgcaggctgcaggccttgtgcccaaagcagcactgctgctgcgggcacgccgagccccgaagtccagcctgaaattcagtcctggtccctcgtcccggtcccggccccagtcccggtcccggtcccggccccagtccctgtcccggacccagtcccagcccccaataaagcacccgccccctcaacccgctgctccgccaggctcttgggtgggccatctcgccaggcacgtaggaaaggcctgggaccagctgggccagggagggggcggtgccgacccgccccttggtaactcgagccccggctggtgggcctggctgctgggtctttgtcttctaggttcctctttctcccaagaagggctaagtggatcctgtgaagggagggatgcagtggggggaaggagctggccccagctgggtttacattctcagctgggacagcagagcctcactgtgtatgtgtgcagccagcagatacctgtgcacaggcacagacccaccaactcgtggggacacttcaacaccgcacaaagccattttgccactagacccatgcccccaaattagcagaactgcagctgggtacccacctcccatgatacactcattcttagccattgtgctccaacacaggcgcatgggatggccacactcactgacaggcatggagatgtgcactacacaccaaggcacaagcatgatatggacacatgcatgtgaactggagggtggcccacccagacatctccagaaaccactggtccatacaggtatttgtgtgtcagacatatccaaacacatgcactaacaaacacagaggtgacagtcacaagagaacagctcagccacccttcccacagagcagtctcagcacagtcacaactaccaaccttgcccagggcagggacccaggaggcccaggccacaaccaaccagacacagtgccaatggaacaggacatcatttaattgcctctagggtcctcctgggagagggactgcggggcctttggcagagctctggctgatggaaccaacagaggtgcccatcagccagtgccaggcaggatggcggccccaatgcttggctgggggcagccagcatttggggctgttgcttaagacaatttctgagactaatgggtaaggaatgttgcctttagatggaggagaggggactacatttagagaggagggaggagaagtggcctgcattgggggagggactctaaggttaggttaggaatgacagggagttggtcaaaaggtccttcatggccaggtgaaggctggggggagtgtggtgatggagtccagcaggggaactctggacaggcttgactcaagccagcttcaggaactcctgcagcgtgttttgttccacagcctccacgaagagctcatagtcctggagaaggggaggcgaggggtggtcacctgaatgcagggggcccaagtgctttgtggcagatatgaccctggctagagtcctcttccaacactccccccacccccccgtcccccagcccataccccacagtactggtccccgttgacaatctggggtggggtggccttggggttgcctgccaaggctcgcatctcatccctcagggcgttgtcctgggagatgtccactagctggtattggatgcgcttcccatccaggattcgggtcacctcgctctgctgggacttgatctggggacagagggtgggtaggggttagtggataggctggaggatttatgggggaaatgctgggcagggtgagagaggctgtgaccaggagcttttgtccccccattcccctccacactaggggagggttctagcctctaggagttgggaggatgagtcaggcttgaggtggtgcaggatgaagagagggattatcagccacgggggagggggtcagagtgaagggaagtgggatcaggctcagggtggggaggggaggggagggcaggctgcggtcgtggtcagggtcagcccggtagtgggagtgcagagaatgggtgtggggttgatgggggatgggcacgggaagttcatgccgcggctgcaaaggacccaggatgcccgatgaagacattcaggatggggcctcgggaccgggtccgggagaccgtgcccagcacctcgccgacgcactccccccaccccgcccccgtcctgggggtgggtcccgggcgctagggtccaaagcaccgggatacagccctgcgctttcccccagcgccagtccgggcgcgcacttacttcgcgggagccggtgaccgacgtgctgtagacgcgcaggccgctcatgctgggggtagacagacgggccggcgggcagagggcggcggtagcggcagctgcactgccgggagacgacgccgccgccgtgctcgggagcggtttccttcctgctccgcccgccaagtcatcgcgctcgggaccaatgggcggcgcgggcaggcggggtgggacctgcgcgacaccgccccgcacgccagaggccccttcccttccccctcggttaccaggcgcgcaacggacccgtcccacgcagggcgccccttctgcggctgccctgatcgtccttttcggcccttccctgatctggagctcagtgtgagactggggaggggcctgggtggcaggacaggcccgggagagggtctggcagaagcctccctctccagccgcacacaggtttggtgcatccaactccccagccacgagagccgctctctccaggaggaggtgctctaatagcacagggaagcttggggctttggaaggtttgagctgctttcagacccaaagttctctaagaaccttgctccaagggatccctcgctccaccacccaacacgcaccactaaccctaggggataggaagcataggacagcaggaagagcccatgcttagagattttcccccaagttcctctccactcaggtgggaaggtttagacaaggaagggtgatagcaggacgcagaggccacaccctcaaggaaccagatggagaccaaggctgacagctggaaagcgtggcggtagaggatgatgtcaggactcgagagcctaggctcaagctgacccttaagatccaccccaggtcttggggtggtccaagctcaaccccagctccatgctgcagatggcattcccaaactgctactactcccagcaagaattcagcggttgagggggcagactccagcaacgagcccaactttggagacctagctgtctggcactcaacatcatgcttctcagatgtccccctggtccagggctcaggcaggttaacagcccagaaagacaacccttgctctggtaaagccacttcctcacagcaacccagaggctgccaacttcctgagaggactgctgaaactttccagtgacaaacttctgttatgactcagggaaggtttgcccaagagaaagtgagtgggaagagatctggttctatagaacgacagaggagcagaggtggcagagatagggacatgaggctggctggacctgccaaaggttcctccacgctgctgcctgggggacctggctgaacacccaggtgtttggctctaacaagccaaagtgaggggtagaatagcgtggtggtggtgatggaagggtatggaaaactgaggagtctgttaagatactttattttataatcaaaatacgcaatacaaacaaatggacataacaaagattcatataaataactggttataaactttatgaggaaaaatacccgtcagcatggtggctgggctcccaatgcacagggtggagaccaaccaggcggctctgcctttaagcagcaggagcccagaggctgaagggctggctgggtggggctgctctgaatggaagggataagtcactccataaataaaacacaaacttgtaaaaacacttaagaaagannnnnnnnnnnnnnnnnnnnccaacagcccaaacttagcaaaaatcttgtagtggctgactggcccacacgtggcccctgcctggcctggctccagatctagaggaggcacggctggcccaacaaccagatactaacaagtgtgagatgctccctaaaccaggaggcaagaaaaaccagagggcaaaggtccctcactaaagccccagagaaacaacccaggaaacactaaaagctgtactttaaagctgacttgtactgggtactctgaactttcaaggaggccagagcaggaaagggaaaggaataacccccaccacccccaacacaagagaggcacaaattagagggctgggcacaggctgtagccctgggtgagggggtaagcagcttgacagttgctctgtggtctctgggatataattctgcccaaggctagaaccacagagaagagtttgcactcttaagtccaggaaggggactacctggaaggcctgagaacaaaggagaaagtttagcacactaaacacatggccaggaccctagggacacaaggcagctggagagtgggatctcttgttaaatggcatggtaggcagattagagtcctggctataatccctagggccccaatcctagtagttacgtgctaaccaacacattaccctgaggcttctgggagaacaagagccctgaggaagaagcagtaagaccaggcatgagaaaacccagaaagccagctcagttcccaagaaggctggcacatggggcctgagaattcttaaatggccattgtcactggtacttgctcagcctttccaggcccctctgatgagctctctaatcagcaggaccaaggtgtgaagtgggaatgaacatggatccatcccattggatggagaagaaaggtggacagcctgttcgtctctcatgtcagcctagggctgggaacagtttgtgaggacttatctgttgtacctgccaaaagttaattagtaactcaccgtcgagagtgaattaacaggacaaacgtaatccaacatgccagtgtgggtaggacacagttccctaatcagcccttggcccccagatgcaggctctcccctcccctctgagacctctctgggaatagcagacaagagaatgtcagggcagaaacctgctggactaggctctcagcagcccagctcctccctgggggaatcccccagaattcctcactgtgtgacacagttttctcccatgtcctgggcatatctgtctgacatggtggtccttaagtcctcaatgtcacgacgcagctgttgaacctcttctagtttcctcttgatcacatctggcttctgcaaatctagctgagtctctgggtgctgtgctgctggggagaagagcatttcaagagaatgttagttatgagacattttcatgtggagggtgcagtatggataggcagtatcttgaacccacagtcttgggacatgcactttaaaaaaagcatctggggacagtgggttaatttgctgctgaaggtccacttttagtttgtcctgcatgcaagtaccccatagcttgtttccaaaaacagatttgtgaacacctactttgtgaaacaaataaatgtccagagggcagtggccaggactatgtactctgtctacatattaccacaagaatatgggaaagcaggatgggggagagaagagaaagaaggaccctccttcctgggccccagactggtctgaggactcacagtgaatgcccaggagcagggagagattggggtcatggccctgggccctctgggtcacaatgctacagacagcctgcagatcttgaaggcaactggccaactcctggtgcagctcaagtgccagctgggccgtgtctggtgaaggtggagaccctggttgggcctggcgcaggtgttcctggagtgtcagattcttctcaatcaagtcctggttttgcactgaaagctgagcagacagatgggtaagcacattaactcaggcccagggagaggaagagtatctgtgcatgagtgtgtgggtgtggaagggatgggtgagtcataggcagtgtccctccttccccaaccctacccctgccaacaggcttttagcacttctcccactatcagtatcaggcctggttcttcctgtgggtaggttgggcccacagggctctagcactggagaggaagccaaccctcaactggttctgaatcatcagcatccaagtttctgttcaagaaccagagaagatgctcccgcccctaggaactctatctcaagccagtccctcagccaactctgttagccaggctattagagaaggcttaatgtgaaccgtgaaatctgaggagacactggtttcaatctctccctgccaccctgacaaaagtggccaccagccagcctgatcacagtgtgtcagaggaataaacagagtaagaaagacaatatgacagctagtagccactaggtggggggctggagaagctggaacctggaggatccagccctggaacaagtcctgccttttcaaactctcacctcagtggagtcagactttattacaaaaaccatctattcatgtatgtctgtctgtttccctctcttcctgacagcttaatccactttccttcccttcctaccttgattgtatttttatagagtctgaatagagtccgtccttcagtcccaggccctccacccacactgggccatgtgacaatcctaactcaaggaagttccttcctaggcactaggccagtcagtgaacttggttgccccctgctgacagctctgtttagtgcatgaaggccaccaaatcctcagtcttcttgaactctccactccccaaccccagaaacctgtggcttcaagacaaaggaagagagaatgactttccccatcaaaaagcattcctgggcccagcgcagtggctcacgactgtaatcccagcactttgggaggccaaagtgggcggatcacaaggtcaggagatgaagaccattctggccaacatggtgaaaccccacctcaactaaaatacaaaaaattagccgggcgtggtggcgcgtgcctgtagtcccagctacacaggaggctgaggcaggggaatcgcttgaacctgggaggcggaggttgcagtgagccgagattgcgccactgcactctagcctggcgacagagcaagactctgtcttaaaaaaaaaaaaaaaaccttcctaggtaataattatggacatgctaaaacaggcttagggtctgtaatataaagaatgatgcaatgcacctttcctctgcccccagagctcagtagggacctttccctttcaaacactggggctcttattggggtagagatggggagggcaaacaaagaaatcgggtttgtggaggcaaaaccaagaggtctgactaatgttgctcacctccttcacggctgtgcgcagctgctgcagggctgaatcccttcgctgggcctcctctctcagggcctggcttgttccttcttcttgagccacttcctgctctaggctctgaatcacacagcaagatgttgagggaacacagtaggggtaacaagtctggttcagacaatatcaccgttggcttggactatatagtgacgactcaccctacctacaccctcataagaaatcattttagaacagtcctgatttgtgacctcccatttaaaccctcctatagcccttgaccacataccaaatagaggtcagcttcttagcagggcattcaaggccactgtagctcctacctacttttctagtcatatctctttccaccctccacatggccagcctctacaccgtcacgatgaatgactggccctcatccctgaaggctgcagtgtcaatgcttctgctcacttctcttttcctttcttcaagctgctcttctgctgttacctccaggaaacctccaaggcacacctgagctgtcttcaatctgcaaatcagatctaattaatcctaatcctaccttgctatcatatccatcatggcttacgagtacatctgcttaatattctagttggctatgcacatgatccttcgctccactcaaacataactttcttgagggcagggaatgtgctattcagctgagttcactatttaccgagcacttactgtgaccagcattgagaagaacaccaaacagttcctgtcttttaggagtcaacagtcaagtgctcttgacaatactgtctactaaatgctgttcagagacatggaaaggggtagaagagcatactcacaggtacctaatctagtgagttgtgtgtaagtgtgtctgtgtttgtgtgtgtaggagcggtcaggggaagggagatatttaagcttttaaacttctgcctctcattctcttcattcaatttttcctcaaattttgaaactgatttgaatgaagtgtgaaaatttttttatatttctcatttggtattaataaaaaaaaaactgctaaggaaaacacctcatgatcatgaaatagccaaagtgactatgatgaatccatctaattccaacaaattcacatatatatatatattttatttatttatttatttatttatttatttatttagagatggggtttcactctgtcgcccagactggctggagtgcagtggcgtgatctcggctcactgcaacctccacctcccaggttcaagcaattctcctgcctcagcctcccaagtagctgggactacaggtgcatgacaccacgcccagctaatctttttgtattcttagtagagacagggtttcaccttgttagccaggatggtctcaatctcctgaccttgtgatctgcccacctcggcctcccaaagtgctgggattacaggcgtgagccaccgtgtccggcctcacctgatattttaatttgcctaagtagtcttatcataggtaaatgtgccatttaaaatgtcaggcttttccaaactttgcagaaccccaagggttctaggaaacctattttgagatccattaaaaactctactaaaaacctgggattttaaatgggtatgtattaaaatgcttgccaggcttgactacctccttacaggacttgaaagaggtgaaccagatagacgtagcccaatccacataatggcaaaggcaagactgcagcctccacttattccctcaaaacgagtgcatttcgggtgttttggtgtgaaaacttttagagtccaaagagacgctgagtgaacctgctttacccagaatttcttggagaacccagttaaagacactcccactctggcccaaaatagaaacctggagtcatatttgattcttccctattcttcaacccctacatcttgtcagtcactgattccgcttgatgttacctcctaaagtcacttaaatctgtcccctcacatctcctcgctgctatgctgccttatgccaggttccctcatcacctctcacgagaatttctccaacagtccccctggacctttcttctctccaggatgccaatcttccacacttgagcctgagttgcaaacctgaccacatcacatcccaattacatgctgtaataggctgggcatgatggctcacgcctgtaatcccagcactttgggaggccgaggcgggcagatcacctgaggtcaggagttcgagaccagtctggccaacgtggtgaaaccccgtctctacaaaaaatacaaaaattagccgggcgtgatggcgggcacccgtaataccagctactcgggaggctgaggcaggagaattgcttgaacctgggaggcagaggttacagtgagccgagattgcgccattgcactccagcctgggcgacaagagcgagactctgtctccaaaaaaaaaaaaaaaaaaaaaaaaaaatgctgtaatagatgcccaccacctacataaagaataaaagctaacttagttgatagataaggcccttccatagcctggaatgcccaggtctccatttaccatcttaaagtggatacgtcagcagtatcaaactgcttgcagcaccacattcaaactatgctgtttcatgtctccatgttcccactcatgctgttcctcctatctggaatccaacacatcctatccagctcctcttgtttgcctggctaactcctcatccttgtaggttcaggatctccagaaacctctcttttacctcccttcctcccactgactctcctgcactcccccaggatactgtggggactgctctcacagt

SEQ ID NO: 281 - DNA, 1802 bp, Homo sapiens
ctcaaagcagcctccgtgaagtattacagtacttcgtgttacaatactgatcatatggggaaataagctaagagggataattcctcccaagatcaatttagcaaaatagcggcactgtcgggatcacacattcaggtcctgaatgtgaggctgccagcagttccattaacctaatcccaggctccttcctcccgcacctgagggttgctcaggcctccctcaaactagccaatgagaagtgcacgggtcctggtcgcctaggaaaccgcgtgacaacaagatggcggcgctgcgggacggctagcggccctgcgtgcaagacccgaaaagtgcccctgccctcggagcctatgaatcctgggaggcgaggaatccgcatctatggagatgaagatgaggtggacatgttgagtgatgggtgtggctcggaagaaaagatctcagtcccttcctgctatggcggcataggtgcccctgtgagtcggcaaggtctgggctctaaagactttgtgtgcttggcagtccctgcatcccatgactcggagctgatggccttcatgacgaggaagttgtgggacctggagcagcaggtgaaggcccagactgatgagatactgtccaaggatcagaagatagcggccctagaggacctggtgcagaccctccggccacacccagccgaggcaaccctgcagcggcaggaggaactggagacgatgtgtgtgcagctgcagcggcaggtcagggagatggagcggttcctcagtgactatggcctgcagtgggtgggcgagcccatggaccaggaggactcagagagcaagacagtctcagagcatggcgagagggactggatgacagccaagaagttctggaagccaggggactcattggcgccccctgaggtggactttgacaggctgctggccagcctgcaggatcttagtgagctggtggtagagggtgacacccaagtgacaccagtgcccggcggggcacggctgcgtaccctcgagcccatcccgctgaagctctaccggaatggcatcatgatgttcgacgggcccttccagcccttctacgatccctccacacagcgctgcctccgagacatattggatggcttctttccctcagagctccagcgactgtaccccaatggggtcccctttaaggtgataagctgctcctcaaaccacacctttggggattttgaagggagctccaggatgactgctgagaaatttctgaacaggctccccaagtttgtgatccggcaaggcgaggtgattgacatccggggccccatcagggacaccttgcagaactgctgcccattgcctgcccggatccaggagattgtggtggagacgcccaccttggccgctgagcgagagaggagccaggagtcacccaacacaccggcacccccgctctccatgctgcgcatcaagtctgagaatggggaacaggccttcctactgatgatgcagcctgacaacaccattggggacgtgcgagctctgctagcgcaggccagggtcatggatgcctctgcctttgagatcttcagcacattcccgcccaccctctaccaggacgatacactcacgctgcaggctgcaggccttgtgcccaaagcagcactgctgctgcgggcacgccgagccccgaagtccagcctgaaattcagtcctggtccctcgtcccggtcccggccccagtcccggtcccggtcccggccccagtccctgtcccggacccagtcccagcccccaataaagcacccgccccctcaaccc

SEQ ID NO: 282 - protein, 567 aa, Homo sapiens [sequence omitted]

SEQ ID NO: 283 - DNA, 33500 bp, Mus musculus
  misc_feature (1)...(33500): n = A,T,C or G
ttccaaactccatctgtacttatgctaactcccaccaactcaatacaaagggacagagtagcactaccatttgaaggcagggtcaggagtcaaggagacctgccctgagaagaaaggagagtgaagaggccagtgcaaggtcatgaccatatttaatctgctgctccctccccccaggaggcagggaactcatgggatatctgcaagggtgaagggcttcattacattcctcaatgactgactgaccatgcaggaaggcagtgaccacttggttatgttttcaagttaaaagctaagcttcctggtttgtttttttttcccattgtaataggaaagactaaaaacctctaaatgtaatctggctttaaagaattgaatttagaaaactctcatggctgctggtctttctgacctaattggccaatgatgtagaacactcccaaatcactgccctgctccttttcctccacatacaaaaacatactctcacagaccatttactgcagccagtgaccctgccaacagcctgtgatacagggctgagacctcagaaggtcagggcctcaggatcaaagaggatgtcacagctctgtgactgagagccatgtacacgtacttgctctaagctgccatggtaacaagtgttttaaagggatacttcaaccttctgtgtttaaagtcctgacaacttgcttaagctaccttctttcctgaacacattcgtaaagcttgaccatcaggaacatatttttcatgccagaagtacacaccttgtttataaatcaacaagacaaaactggtgcctactgtctttgcccagggaatttcctgctagaagaattcctcccctcccacagatagttttgtttaacttgctcttttacttgatcttaaatcttaaccatggctgcagcttctgagaaatcactaactttcctatgttaggttcatacttctaaaagaacaaaatgcccaaaagagagaagagatccacttagggtttctgacacccttatacagatatacatacaggcaaaataccagtgagcataaaataaaaataaattagatttaatttttttccttcaataatcttaccttactgaaactttataaatttttcaggttttttttttttgacacagattagaacacaaatcaattgcacattgaatggctcaacataatttctttaagaattgactctaggggctggagagaaagctcagtggttaagaggtcctgagttgagttcccagcaaccacatggtggctcacaaccaaccataaaggaatctgatgccctcttctggtgtgtctaaagacatcaacattgtactcaaatacataaaataaataaatttttattttttttggtttttcgagacagggtttctctgtgtagccctggctgtcttggaactcactctgtagaccaggctgacctcgaactcagaaatccgcctgcctctgcctcccgagtgctgggattaaaggcgtgcgctaccactgcccggcaataaatcttaaaaaaaaaaaaaatagaatctaaggcctcacatgctaagcaggtgaacatccaccccagttccaagttttatttatttatttatttatttatttatttatttatttattttcgagacagggtttctctgtgtagccctggctatcctggaactcactctgtagaccaggctggcctcgaactcagaaatccgcctgcctctgcctcccaagtgctgggattaaaggcgtgcgccaccactgcctggcttccaagtattatttttaatacagagtcttacacagttgcccaggctagataggacagatttctgtagtctaggctgagcttgaacacacttgtaaccagactcctcccctccccccttcttcttcttccttcttcttcttcttcttcttctttttttcttggcttttattttgaacatggtataccatatagctctgggtggctgggaactctcgatgtagactaggctaacccaaacttacagagatctcttctagaactcttctgtttctgctttctgagtgctggaattcaaggaatgcaaaaaaaaagaaaaaaaggaagaaaagaaaagcttttttgttgtaaaaccagacaggagtgatgatttatgcttgtattcccagtgcttgggagatagatacaggaggatcaagagttcaaagccattctttgcttcatagcaagtttgaggctccataagttacaagaaatgctgccctaaaaccaaatagacaaaatatagaaatccccctttcaaacccacttccctagaaacaaacaacatagacacctgctaccctctagcctgggcctacccccagttttacccaagaggtcttcagagtcagctttgagttccccctgaaggctcttccagctgctctctctccctttccaagtagggaagtagacctttaacttgtgcatgctgagcaaatgctgtacctcaaagctacatcccattccaccccaattcacactttcttattcataagtaggagtaagttcttaatactgaaaagtatagtaactatataagccagcaagctgctcctttttaaatgtactgtactatatataattctatatgccctactgttatttgactagcagcctagtaggttttacccagtggccacagtgtgagtgctaccttgtattgtggttaggcatcaggaactttttagctttattgtaattttatatggccactatcataaatgtgctctagaacattggtatgagccttgtgactatctagttaagtggattactgtttgtgttttgtgatttggtaatgcatataaagtcttaattgaatagaatatgaaatttagaaagactgctcagtaattgaagcctcacacctatccttcagggtaagcagtgtgcagatgtgtgctgaagtgttaattgtgtggtcttaagataattgtagtttgctttcattggattcctggatgccgtgtgagttgaaggtacattcccacttgcatcctaccgagtctgaccatccacccctggccccagcccccacttccactacacctcctgtactacctgctttaaccaaatggatgattagatttagcccttgtctctgggctcttttgaacccttttccatccttagtgaccagtttaggcattgatagttaaagactggaccttgttatggaaatgagctcctaaggcatccttgtggaatttttttttttaatgtctaaattgcatgattctgaggaatgctttgatttttctggagacaaggccttgctatgtatccttagctgaccttgaacttgctgtgatcctgtcgcctgtatctctgccttcctcctgctggatgctcggtttgaataatgtttcctggttagttttgcagtgctgtggactaagcccagggccttgcacatactaagcaagcactcttccagtgagctgtgcctctagctcagctcttgcataaacgtccctgtgtggtgtgtgtgtgtgtgcgcaggagtatgtgtatgcaggggcaggcagagcagaggccaagtcctccacggtgttgaacttacagggtttatactgcctgggagccagaactaggttctctatgagaacagcacactctgaacctctgagccatcccttcattcccaacttcaaagtccataacttacttaaaaaaaaagattaatttatttgtgtatatgagtgatctatttgcatgtatgcctgtatgacagaagagggtattttacagaagtgggcatcagattccactatagatggtagtgagtcaccatctataatgtgctgggaattgaactcaggacctatgtaagaatggccagtgtgctcttaacctctgagccctctctccagctccatcatgttatttaaaaatgtggcatgtgtaagtgcttcatgttcaacccaggcccttgtcccatggtaagcatgtccgctagcccagagttggtttggttttgtttttgagacagggtttctctgtgtagccctggctgtcttgtaacttgctgtgtaggccaagatggcttgaactcacagagaactgagcacctctgccttcacactgctggcatcaaaggtgtgctatgcctgtcgccctgagcttgtttatgctatcattttcctttctctttttgttgaggaggtggggcgtactggagattgaacccagaacctctaaccattagttatagtcccagtcctttgcattttatttatttattaatactcctgaatttgggtcttattaagttgcctgggcaggccttgaccttgtattccacctacctcagcctcttgagtagctaggattataggcctggctctaaaataaacaacccaaaactacttttggagatgggatctcactataaagttgagacttcaattcttttcaatttcctggccttagcctcctaaatattgggattgcagggaggagttaaaatgaatcttgtttaaaaaaaaactgcataagttgggcataattgtacatgccatggaggcaggagaaccaggagttcaaggccagtacccactagagggtttgaggtcaatttgggcacaatatcctgtctccgaaataacaaaataggagagaaattcatgccataaaatccatgccataaaattcatcatgtgaacagtttttaagtgtgacttaatagtgaataatatttaaccactgcatgtggagtgtaatggagtgtggaattgctcagtgagcctcccacacagggtattcaaagtcagcttggattacagaccagggtctagtagagaaaagctgtttagttctggactttcaactgtattcttcccccttctctagcacatgttttcacctgtgtgtgtgtgtgtgtgtgtgtgtgtgtgtgtgtgtgtgtgtgtgtgtgtgtgtgtgtgtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatttacaagaagttttttaaatgagagaagcttttaaagtagctttcccttgttgatagacaggataggtgcgcttacttctccagaggtggcaactttcttctcccacagatttttacccttaagtctgtttatgtggccctggctgcttttgactgactgggcctggttgttcctccccatggcttgaaatcatctcttaccaatatcatgccaggtctccatggcagagaaaccctggtgcttccagagtgaagaacagttcttaggtgagacttgaaattctcaccagcagctttctttatctgtgttacagagtacaaaagaccttttaaagactggaagcagaaagtccgcttgtctttttcatatttgggagtccaaataaatttcacagcattgggtttcgttgtgtttagataccctgtttgccctttagattgaactgctttaaactggttaactttacagaggttttgtgttaatattgaactcacagtattgaattataacttttgtgtatgtggactaaaaaagcctttttgttaggtgtaccctaaagtgattgttttaattaaaatttctttttaattttcccaagaccatttaaaacagagacataggacttcattattttaattgtgttttaagaggaaaatctcattttccttaaatgttttaattacaagagtgaacagtagatgtctgacagtgtcagtaaggctttaaggtagcagagctggtgagtgttcccctccattctagcagtgtgtgaagtaagtagagtgtggttaacaaggagttgaatctcacaacttttcctttattcttagagagtgaaaacttatagctgctctttaaagagtttttaggttaagataggtaaaagttttattcctggagttttggttattgtggactgaatatatcatatgtgcatttaatttttgaactcactgagtgaagcactaactgagtcccccaggagcacaggcacacattacatgtggggaggcaccagagtggtccagagctgcctttgtcccagggcccaggtctgtgggaataagactctctccttctcaggaactcaagctttctgaacataatagggtcataagggcttggtgccacactggcacctacttgtccctcccagcaggtgacatgcttcagttatgtctaagtagggctctgtataggtgataggaaaggttagaaggcccctttcctgctgcattcattctgcctcagctgactggagtccttgccagacacagcatagtgattttgagtccccatgtatcaaatggctgatgtataatttctacttccaaggcaacttttgatattttgggttaccttttaggtacttatgaaatgtcactttgcttctgcccatttgagacttccatttttagattaaaggcatctatctgatagattactgcagacttcccaagagcttggtggaagtcttgtcttcaaatactcttctaccttcaggcgaagatgtggctgttagatgcttactgtatgcttggctcagcagtgaggtgggggagtctcccagctctcagggaagtcctgagcagcctgagaggctgctcctacactgctgtcagagaaagaaggctcagtcttttccaggttctgtaggcaccaacacttttttgtagtccaatctggccatgtgagtagtggaatttaggtgtgtaccacccatccaaacctctaacacatttaattagttaaacattttggggtgcaaagtctccctgttgtaaccctcctggccttgaatttgctaggttgcccaagctgggtggctacaatctgttaggagaaagggcacagtgctcctgacgaggcacacacagttaacacttcatatacatgtacaccttctgtgacaccaggactcatggccgatcctctgaatggaccgcacttgccctcactcactgctgtcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgacagcagtgagtgagggcaggtgcgatccattcagagatccgccatgagtcctggtgtcacagaaggtgtacatgtatatgaagtgttaactgtgtgtgcctcgtcaggagcactgtgccctttctcctaacagattgtagccacccagctttatacagcagtgattgaatttgtactgttctttgggttttgatccctgccagaaggtcactctggtgaccaagagtgagcatttgagacttgtacaaaaattttccagagctagtcagatggcttaatgggtaaaggcacttggtgccaatcctgatgaattatgaatcctaagatccatgtgataaaaggagaccccaaaagttatcctttgacttcagtatgcctgctgtgacatgcaccctctccccagtaaagaaatcataaaaattaaaatttgtcccagagggacagcttaatataggcatgtagatataatttacaaggcttctagcataagcaggcatgattcttgcttatagaaagccagcatcagaaagatattcgggctgcttttagccaagtagcagaaactgtcttttctccccagagcatggaaaaccagcacatagtagttggagttgtgccctggacattgcctgactgctaaatgcagagctgttagtcatgcctgtgaaacagacaccccatgtgacatgtgaccacagatagtaggactaagctcatgcttttagtggggtagggtttgtcttataactagtgctgtttccaaataagctaagatttaaaattgagagtcaggctggggaagtaaaagatctactggacctagtagattagatggaaaagtaaatgaactatattagaaaaaaaaagtagtaaaaatgaaaaggcccacaccctcctgtgcatccattaggtgaacgcctagtactgaaatgtaccccttccgtgcttccaggagttgagcacaggctttccacatgctcgacaggaacttcactgctgaaccacactcagcccagcagctgggcaggctagggagggagagtggggaacagacaagtagtggaataaatagggcagagtctccagataccgatgggagtttgggttttagttaccatttcaaaatttccccaacactcatgggaacagaattcaaatccaaaagttataaaactggtctccaactccctatagagtccaggatacttgtatttctggtcctcctggcttcacttcccagggctaggattccaggcctgtgtcaccatgttttgcaattaagtaattaatgcccatactacccccccttgtgtgtgtgcgtgtgcgtgcgcgtgtgcgtgtgtacagtaggacaactgtgggaaccagttctttcttctctctcctgccatatgggttctagcgattgaactcaggttattaggcttggtggtgtgaatctttactcagcggcatctcgctggcccttgctttgttctttgagacagagtcttgctgtagagccctggctaatctgctggtcgttctccttccttttccttctgcctcctgagtgctaggatttacaggcccaagtgtgtgccaccacaccctgcttaagatttatttcatatcacatgattcagtagaaaacacgctaatgtcatacatacctgagtatgcagatttgtcaacgttatcattcttccatatttttatgattgatctaagaaaatttggagagtctagagagatggcttagtgatttaaagcatttatttgtagctcttgcaaatgacctgggttcaattcctgtcactcatatggcagcttaaaattatccataagtacggctccaggggatctgaaacgttttctgacctttgaggacacaggcatacacgtggtgcacatacatgcaggcaaaccattcatacatagaaaataactcagctgggtgtgctggcgtactccttagatctcagcactctggaggcagaaacaggtgagtgctaggctggcctggtttacagaatgggttctagggcaaccagggctacatagggagaccctgtctcaaaaacctaaaataaaataaaattaataaagataaaaggaaaaaagaaagaaagaaaaggagaagttgagtgtggtgttttaggcgtgtgtttgtagctttactgggctgggaatgtggctcagaaaggtctctagcattcctctaggggcgggctgcttagaggcagaatgtcagctaatgtcattcatttagagttccctctcacaacaaaacaaacagttggacttaattccacctatttgtattttacagaatttttttgttcatttagtaatgtgagtgatttaatacgctatagtttcaatatgtattatccctttaagttacttttcgatgatatattcacttattttatatgcactggttttgcttatatgcatgtctgtgtgagggggtcagattccctggaactggagttacagacagttgtgagccaccatgtgggtgctgagaattgaacctgggtcctctggaagagcagcaagtgctcttaaccactaagccatctcttcagccttccctttaaattactaatgaggtattttacgttttgtttttatataaaatttcaaacttcagtgttattttacacttactagaccaatcagtttccatcagtttccatcgctaagtagctgctgaaggacacaggagtaagaggctctagttagggcagaatgtcttggcagaacactggggaagtgtacagtctcaaagccgccaacatggtttgaatgtttgaatctgttcttctcttgtaggctctgggtgctctaggatggaacagctgtgcagagggtgaggatccaaccctgggaccacatcatttgctttcttccttagcaactggtggcttgaacaaacactagcctgggtgaggatgtctgtggacaactggctactgcaccccctctggggacagacctttctcctcctcctgtctgtggctgtggctcaggcccactggcccagtgaaccctcagaggctgtgagggactggaagaaccagcttgaggcgtccatgcactcagttctctccgacttccaggaggctgttcccaccgtggttggcattccagacggtacggctgttgtcgggcgctcatttcgagtgagcattccaacggatttaattgcctccagtggggagatcatcaaggtgagactgcatgcaagcacagctgaggaaggaagaggccccctcttccacttagttctgatactcgatgccttttcctcttttgttgtatcttactgatttatctattgagactgggctggctcgagcactcacatgtatgtatgaataccacatgtgtgcctgccacctgcagagatcagaagctgtcagactcactgagccgtgactcccacctgagccattcctcctttaaggcccaggctgggaaagctcccagcaacagctttttctttcttttttaaattgtgtgtgccactgaagtcagaagaggatgtgcattccttggaactggggttacacatggttgtgagctctcatttgggtgctgagaaccaagccctctagaagagcacccagtgctcttcaccactgagccgtctccagccacagcccagcagcacttccactttcggctctcagttgaaactttcacaaagtctggtgtggcctttctgacatacaaacccagccttctaggttgaacagccgcagattccatgccagtcttacctggaagaggtgaatctgttgctcctttccttttagtgtgggtgagcttttccctctggactccattctctgtaaatcatagtctgtttgcagggtggccttacttcggaagaccctagctcatagagcaggtgaattctatagatcaatatcagtttcgatctctctgtctctgttgttgtttgtttttgagacagggtctcaccatgtagctctggctgtcctggaagttgctttgtagaccaggctggccttgaactcgagagattcccttgcttctgcctcctgatggctgggattaaagacgtgcaccgccagcaccagcccatagaactcttctactccagcaggcagatgctaatctattagttaaagactggtagctcgaaggatatgttgcttgcctgattttatatgaccctttgagtgtcctgactctgcattggttgcctttgttccggtggttattggaatgttttacatgggttaattttgaccagaagtatcttgaattgatacagtgacttagatatttgtagtatctggcagagacatataatgaatgggcttaccaggagcataaagagcttttactgggaaaacaggatttatctgaacatatttatctgtggagaacaaacagtttagtagctgatgagcctttgggagagcagatgaagtactggggtgtagttcagcagcagagggcttgcccagcacactggactaagattccattctgtagccaccctgctcctcagaaccagggctgtgtggactgagggtttggaaaggtaatgcatgacctgattctgggagcttcgctttgcttttctcgcctgtgaaaataagcttaaagaggatttacttacttatcttgagacagagtcttcgctggcttctgaactatgatcttcctacctcttctgctgtgtggtgggattacaggtgtgtgccgccgacctgaatgaaaagtcagtggtaaagcagcaaccgaagggctggagagagagaaggctcaggagttaaacacttgttcagaggacctgggttaaattcttagcacatacctggtggctcacaaccactcataacttcaggtttcaaatacttcctctgccctttgagggcacaaaggatgcatgtgggacacagacatatatgccagcaaaacaatcatacacatgaaataaagtaaatacatctaaaaccaaaattttaaaaaagttacatacacttgcaaagtatgtgagagacaaaggaaaagtttttgtggcttccaccattttctatgcttattaagaggtggatgtactacatatacagatattttagactgacccaagatttgtaggtgtttgtgtgtgtgtgtgagtgagtgccagctgtgtatgattctgcaggatgcaaaagagggcactggatctgtaacagctggagacacaagtggccctgaaccactcagcatgggtgctgggcactgaactttgggccttgtaagaattgtagccttttttccttttcttttctccctttttttccttttttgaattgtaaaataattacaatgtttctccctcttttgtcttccctccaaaccctctcatatacccctctttagacttttggaaattcgtggcttcttttttcactcattcatatatatgtgtgtgtgtatatatatactcatatatatattcatatatatatatatttgtaaataccacctgctcggtctgtataatgttacttgtatgagtgttttcagggctgaccatttggtactgggtaaccaatcatcatgctcgccctggggaagggcacctctcctgctctcagcgttctcaggtacccacagttgtctgtgtagggttgagacctcctggcctttctccatccacttttgggatgtccatgggttttatccttgttacagctcacatttgggcagttatattggtaagacctatgggtgttttattttgttttgtttttgaaataggctttcactatgtagcactggctggagtggatcttactatgtagacagactatccttgaattcacagagatctacctctggctcccaagtgctgggaagaagaaagtattcttagctgataaaccatttctccagcctttactgtttaattacatttatttgggtgtgggtgtggtgaggggagtgtgtcttggatcttgtgtggaaattagaggagttggttctctcctttgatgtgggtcctgggatcagctcatgtcttagtgtcaagtctaacaactccaaacactgagccatcttctggtcctggttgtatttttaacgttttcttaatttgctgcagcttgagttctatcccatgattttttttttaattttttttttttattatttgtttattgtattttgggtgcactgtaactgtcttcagagacaccagaagagggcaccaaatcccacttcagatggttgtgagccaccatgtggttgctgggaattgaactcaggacctctggaagaacaatcagtgctcttaacactgagccatctctccagcccttatcccatgatttttaatacttactatgactgtacctgtcagtggctgtccagtgttatgtttctttcctgtctttgaaatggtgtctcactgtgttcacagagatctgcttgccagtgtcttcccattaaagtggtgtggcaccgtacctgacataaggagcattttaggtcaaatatgtcagcacatgtttataatcctagtcctggagacgtggaggcaggaagattaggagttcaaggccatcctaggctggcatagtcagtttgagaccaggttgaacacatgagactctgtctgaaacaagcaaacaagcaacaacagaaagagtactttagatgttatcaccaggatttctgtttaggatagtctccaagtcagagctgacaccttcgtgcctgtcaccctctgtccaagccgttccttgttccttctcaggaagctctttatctatgttcttgactcactcagtctttttcatactaaagtaagagacattttgtcattttgaatctacccagtatcctgttactgatcggcatttagatctaggccctgaactctgtccccagctctcctttctctccccattgctctttgtctcttaccctctcttcgtccgcccctttctgttctggttactcctctctcagggctatgtcagcctgttggctctattctcctttccttctgccctttttcttagtattgtcatctctcagattcagtttgaacatcctttgagctattagagtcctgttctccatctagtgaaagcagccttcccacaaaccctgttaccttcttaaatgcctgtcctggtctcccgccatagtgcttgcctataaacccagtattctaggaggctgagatggttgaaggccagcctaggttacagagtaagactttgtctataaaacagaaacaaacaaaccctcagtaataaatacatgcttgaaattcttgctttatgttactttgtatgttgtctcctgttacccagtagaccttcaaatgattctaagcaggcagagtgaataaagattcctttccacctcaaacttggtttgaattctcaaaacctctgtacattggtgttgggtctgggtcgtagtctgtcatggagagtctccggctgcaggtcctcctatgtgcccagcctgtaccttggagagccagcagcaacgggtaattggggaagagttggtgtcaggtaggagggagcaagcctaaaattttaacatgcaggaggatttctttcagtttgagctcagtttcagctgcagagtgaggccctgtctggaaaaataaaacaaaaaaggcaagaaacacttcatatcacctgaaagagtgatatatatattgataagatgtccctgcagagccctctcagagctctcactttggcacagcctgtggacgtggctttttttcacccctgctttgttcagcctctttgctttcagacaatgtggacttttcctcagcccaagctgtcggctggctgggagcagcccttgctgggactctgctcagccgctggcatgggctgcctaattgtttccctgagaacaatggctactctctgtagtcaggaagaggggttcatgaaaggggctttttttgggggggggatgcttgagagctttgtggcactgcagcctgcgtgagatgaactacagtttcttcctgcctcgagtgggtgttccctggttctgaatggaccccttgtgagcatggcacaccgggaagtgtgggttgccaaaggaaagcgtccttgggagtgggctgtcagaatggtatttgtccagactcatcaacttaaatacttattgaaaatagaggcttccctgttttatttttttattttattactggcaagagctgagaaataaaatgataaagtaaaaatagatgccaagacttagggagaaggattgactgtgagaactctttgagtggctataactgtgtttagctgctcttttggggagatttttcttctgaatatatatgttcatgcttgaatgtgactggcatgtgtgcagtcacctgcagaggccagaagaagacatcagattttccgaaactggagttataaggcagttgtactcttaaccactgagccatctctccagtcccaaagattaatttttaggggaggatagttaacatcagataaagtacttcacagctcagatcagaagggtactggctggcctggaatgtggtcccgtggtccaggcctttgagagaggaaccaagtatagttctgacattgatatatctggatgtgggatgagtgattctcccttgcagttctggctgttttacttggcatgatgtctggccttctagcctcaagctagacctgtgttctctctctgaatgtagctctgctttgtgactgccacacttaccatttgcagaaggccacaggatagaaaacaaagggttatgactgcttcatttgggagtgcttcagagggtttcctgtggctcctgcagccaaccttctacgtaaccttgcaggttggcctagccaggggagagagctgaaggttaagggccagtgacaaggtctgaggaaaggttttaggcactttacctgaacaggtggtataggttttaatagggaccatggaaagagggaccctagcatatctgtaagtggatacaggaataggcccagggcttgatgagtacagaggtacttgttggaagatgctatcatagagatgcaaaggacccaccagaaggtttgtaatatgagggaattgattttgcaggccactgtcagcagtacaagtgcttgtttatggagtctcatttccctgcacttcctgcgtagatgtatcttgcaggcctgaatggcagcacttacagttttttggttcataagctcattaaaattaattcagtcatagttttgtccttttggctatatttactgccttgttgaaactgtgaatgaaatcttttttgatgaagaataagtaatggaaactcctactcaattgctctttctccatgccttgaagggtactggtttagagtagagcctttggttgtatttcctggcatataatgcatatgggtacttctctgctacagccccctgccaatctggccacaaacttttccatcttccgagttctgtgtaagaaggcctaagtacagaatacggaatcagtgccttagagctgaaatcactagtcatctaaccttttaggctaaaggggattgggttggttgttgttgacagggtttctctgtgtatccctggatgtccttaaaattcatttcgtagaccaggctgaccttgtttctagtgctgccattgaaggcatgtaccaccatacttagctggggatcagaattttaaatctggcatttaaagtctctgatagaagatgtcttgtgtacaaacctgaggtttgaactggagtctcctccaaacattactggcttttgatgggaaggagacctaggcagccactgggatgcccagaggcatgacattaaccccttgccataggacnnnnnnnnnnnnnnnnnnnnnnnnnnnnnnnnnnnnnnnnnnnnnnnnnnnnnnnnnnntctctgtctctctctgtctgtctgtctgtctgtctgtctgtctctctgtctgtctgtctgtctctctctctctctctctctctctccatggttttaaggcgtttattgtagaagggtagggagaggagaagagtagagaagtaaaagtggggagggggagcaagagggcaagagagtaagagagcgcgtgacctttcttgaatcaggggcaggagtttgtatttcacaaaggtgagaggagctgaacatgtcagccaatagaaattccttgtgtatgtcactgagggagaggactcgaacactgagttcatccctgagacagacacctgtggtcgacattgttctagaataattttagttgccctactctgaggaccgtagttgttggggtttgagaagtgggattcatttagacagacattacaactaattattttataagaaatgtgtaccttattaatctttatgcattaagtgatgattgtaaaacaagtcattcggggtatggaccttccttctccccagacgtatgtgcgcttgcgtttgtgtgcggcaaggtactaagctgggcctatgacttgagcagtgtgtgtctgccaagagtaatagaggggactggaaagagtgtttcaggctggaataaagtaagctgacaaggagggtgtattactcgtagaaaagtccacaagaatctttgatttttaatttacatgtttttactggtcgtgtttgtttgtttgtttgcttttacctctgtgtgtgtgtgtgtgtgtgtgtgtgtgtgtgtgtgtataaattatatgtaagtacactgtagttgtcttcagacaccccagaagagggcatcagatctaataacgggtggttgtgattcactgtgtggttgctgggatttgaactcagtatctttggaagagcagtcagtgcttttaaccgctgagccatctttccagcccgctggttttattttttaagatttacttttttatatatgtatcagtgtgtttgcctgcatgagtctatgtgctcatgtgtacagttgctagaggaggccagaggaggttaggagctccagaagctgcagctacagctacccagtgtgggtgctaggaaccaatcccagtcctcttaactgctgagccatctctctagctttgcttggttgtttttagagacagggtctcaacctgtaccccagactggccttcaactcatctctccttagatctgcctcttgagttctgggattacccgtgagcatgatgcccagtcaaagtccgtatgtccttaaggaccgtgacatcctagtgtgtgttagtgtgtcccagtgctgtgtggcatgtgacaggatgtcatgtgatagggcactactgctttccttaggaggtgatgagttggatttcccagcaggaattgtaaatcattcctctagcttatcacacacctcaggttagagcttggtttattatggtgatcattttaggccaggccatgatggtaacatttataactcacacttttgtctcttctaggtgtctgcagcagggaaggaggccttaccgtcttggctacactgggacccacacagtcatattttggaaggccttcctcttgacactgataaaggtgtgcattacatctcagtgagtgctgcacgcctgggagccaatggaagccacgtcccccagacttccagtgtgttctctatcgaggtctaccctgaagaccacaatgagccacagtctgtacgggcagcctcatcagaccctggtgaggtagtgccatctgcctgtgctgctgatgagccagtgactgtccttacagtgattctggatgctgacctcaccaagatgaccccaaagcaaaggatcgatctgttgaacagaatgcagagcttctcagaagtagaacttcacaacatgaagttggtgcctgtagtgaataatagactatttgacatgtcggccttcatggctggcccaggaaatgcaaagaaagtggtagagaatggggctctcctgtcctggaaactaggctgctccttgaaccagaatagcgtccctgacatccgtggtgtagaaacccctgctagggagggtgctatgtctgcccaacttggttatcctgtggtgggttggcacattgccaataagaagcccactctccccaaacgactccggaggcagatccacgccacacctacacctgttactgccattggacccccaaccacggccattcaggagccaccatcgcggatagtgcctacgcctacatctccagccattgcacctccaacagagaccatggctcctcctgtcagggatcctgttccagggaagcccacggtcaccattcggacgcgaggtgccattattcagaccccaactctgggccctatccagcctactcgggtgtcagaagctggtaccacggttcctggccagattcgcccaacactgacaattcctggctatgtagagcccacagccgttattactcctccaacaactaccacaaagaagccacgagtgtccacgccaaagccagcaacgccttcaactgattcgtcaactaccacaactcggaggccaaccaaaaaaccacggacaccccgaccagtgccccgagtcaccaccaaagcacccatcaccaggttggagacagcttccccacccactcgaatccgtactaccaccagtggagtgccccgtgggggagaacctaaccagcggccagagctcaagaatcacattgacagggtagatgcctgggtgggaacctattttgaggtaaagattccatcagacaccttctatgacaatgaggataccactaccgacaagctcaagctgaccctgaagcttcgagagcagcagttagtaggtgagaaatcgtgggttcagtttaacagcaacagccagctcatgtatggcctgcctgacagcagccatgtgggaaaacatgagtattttatgcatgccacagacaaagggggcctctccgctgtggatgccttcgagatccatgttcacaagcgcccacaaggggacaaggctcctgcacggttcaaggccaggcttgcaggggatccagcaccggtggtgaatgacattcacaagaaaattgctttggtaaagaagctagcttttgcttttggggatcgaaactgcagctccatcacccttcagaacatcactcggggctctatcgtggtggaatggaccaacaacactctgcccctggagccctgccccaaggagcagatcatagggctgagccgcaggattgctgatgaaaatgggaagcctcgtcctgccttctccaatgctctggagcctgactttaaggctctgagtattgctgtgacgggctctggcagttgtcggcacctccagtttatccctgtggcaccaccctctcctggaagctcagctgcaccagccacagaggttccagacagggaccccgagaagagcagtgaggacgatgtttacctgcacaccgttatcccagccgtggtggtcgcggccatcctgctcattgctggaatcattgctatgatctgctatcgcaagaagaggaagggcaagctgacccttgaggaccaggccacctttattaagaagggggtgcctatcatctttgcggatgagctggatgactctaagcccccgccctcttccagcatgccgctcatcttgcaggaagagaaggctcccctcccacctcctgagtaccccaaccagagtatgcccgagaccactcctctgaaccaggacactgtgggagagtacacacccctgcgggatgaggatcctaacgcacctccctatcagccacccccacccttcacggctcccatggagggcaagggctcccgtcccaagaacatgaccccataccgatcaccccctccgtatgttcccccttaacccacaagcgcctgggtggaggcaggggtagggcaggggcctggagacaacttggtgttgtctgtagagaccggtggcccacaggccattgcccactggtccccaacacctgacctagcacacactgacaacagggcctggacaagcccgccctctctggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacatggaaaacagtagctaaagattacattcaaaggactttcagaaattaaggttaagtttttacatttaatctgctgtttacctaaacttgtacgtataatttttgggtgggtatgggaaattgctttgctaaaaataagatcccagggtgtttcaaacttagagaagaccaagggacagtattttttatcaaaggaatcctattttttcacactatgtcaacttggttgctctgatatcccagagcctgactgagggcctcctggtcctggctcgggtgccagggccctggtgctgggttcgctctcccgctgttgccaggggctggaagctggaggggcctcttgggccatggacatcctgacctctaccccatgcacgctagtggcctaccaccaagggggtcttcatttctgtgggaaagggactccaaaaggcattggtggctatggcctccaacctaggtgctccaaggtgggccagctgctcgtaggggcacctgggaaggtcgaaggactccacctcatcaacctttcttttcccttctctgtggtttggtttggtttggttctgttctttcccttccctcttaaaaggaatatcacggtctttgaaacactcagtgggggacattttggtgaagatgcaatatttttatgtcatgtgatgctctttcctcacttgaccttggccactttgtcccaacagtccacagccctaccccatataccctgcccctcttctctggcgctccagtcctgggccgtgggcctgtggctggggaggagtgccagcaatagttcatagtaaaagtctgtgggctctcaaagctaattttttactaaagtttttatacagcctcaaattgttttattaaaaaaaaaaagattaaaaaatggtgatgcttagcagcagtttgtataagctcctagtgtcaactccatgggactgatggctttgctcatttggaccctcccctccttcttttcctaatgggttaaattctggattacatagaggcttcctttgccttttttagcagaacatcgtccatctgtctgcatctctgtcccatgactcaggggcacccactctgctttgattctcctcctttggaagaaaccattttgagcatgccttttcttgatgtctgagttatttcgggtaccttttagggaggaatgccttttgcaataatgtatcccttccctgatggagggtgggtgggtggacccaggctccctttgcacacggagcagtaccttctaagccatatcgactgttgagcagagggtgtgctgtctcaggaaggaaaggccagtagttcagaagggttgcttccaaatggtggttcttctgctttctccacaaggcctacccttcctgctcagcccccaggagggttctttgtagtgagcactccccatgcgggagtctgccgatgagtgcttcatggatggctggtgactgggccttgtgctcccaagctctggtccgagctggagtttccctgatgtcccagagtcaagagcagggatctgatccgatgaaattatttctggtgacctcatcaaaaataaataaataaataaacaaataaacaaatcccagtattccaggtgagggctttgggaagccctccagataactcttgttgctcttagcaaccccaccattgggcattgccatgtagagaggaggcaggcccaaagtggcctgttgtcatagcaactggaggcagtggggcagtgaacagaataacaacagcaacaatgcctttgcaggcagccccctccctgagccggcgatggccatcagactctgagacagagagccaatctcacattcaagtgttcaccaaccactgacgtgtttttatttccttctatatgattttaagatgtgttttctgcattctgtatagaaacatatcaaactaaataaaagcagtgtctttattacaatgtcattgcctctgactgtctatttacctgggatcttctggttcctgggcgtgaatggtgggagaggatcaatcatggtagagaagggcagctcagggaacctctgcagaagctgccatttctgtgccgccgggacctctgccaatacgcaagctgcttctagtgctccttctgcctttagtcaagactaactttagtcctcagtttcctcatttgccaaggtagggtataactgggagtctagtggatggggtggagcgtgatgggagatgtgcctcagaagaggcagcctctctgaaggctggggtggagctatgctgatggaaactctactgtggcttttatcgtcttttgtccaaaaatacctatgggcttgggattggctggtaaccttagcgagcggtttctaaccagggtgctttgtgcttgagcttccagattctgggtggccagccctaaggtggtgcctgtcaggatgtagacgggcctaggtagaatgagcgtactccatatctaggaaaggacaggtgttctcctgggacaatgctcatacaggaagtagagatgcagcagttgttgccagagggccagtggttacagaaaaaaacggtgcctcttctggtttgtctctgcttctaccagctcaccatgagtctttgcaccccacttttcctgatggtccaaaagtgtttgcagttaggatataaatgtgtagcaccttgaaaatgccaaggcaaaaccagcctaggcacaagggcagacatggtggggcacaccaataactcaagttcttgggaagtggagcgaagaggatcaggagttcaaggacagagtaagctacttagtaagtttcacctgggactcatgagaccttgtccaaagataccacatcaggaaagactcctgacaagtgttcaaaggcacatgcctcacggagccttctaagcattgcagcaggaaccccgtagatgaccccacaattgctctcagttaagctgaccctcagaaagctcagcttaagatgaaactgaggatgatcgagaagctacaggctgcacggggctccagctgcttcctgtcttctttgcaggaggtgagttgctgttgagcctggtagatggcctgctccccagccctcaggccaagttcctatgatcttgtcttggtggaagtgagtctgcctatgaacagaaggtgataggagggcagggggcaggcagaagggtactaagaggaacctgtttttctacttgatttgacgcagggctacttcctgggatccctccagcaaggctctccagtctgttattgaggttaggacagtgctgtctccaaggggctccaagatacccagtgaactggggcatggagttgagataatggattatagtcaagagtcggccctcaagagaggtagagagaaaagcagaggatctgaattcttagcaatcttgtgtagacacttccgtgagagccaagctctctggatcaatcatgggcgagacaaggctgttggctagaggacctagtgtgtttatgaacggtgactcgcctggcttctagactattgctaagatgtagcttctagcttctttttctatgctcctgccaaacgagccgctaggaggagctcttccctggtttctttacaatacgcaaggtctattctcaaataccggtccttcaaagctaaattttagtttcagtattgctgtcttaaaaatccatatcagaggccgggcggtggtggcacacgcctttaatcccagcactcgagaggcagaggcaggtggatttctgagttcgaggccagcctggtctatggagtcagttccaggacagccaggactacagagagaaaccctgtctcaaaaaaacaaaaaacaaaaaacaaaaaaaaaaaaaacaaaacccaaaaaaccaaaaccaaaacaaaacaaatccctatcagtctagcacagtagcacacgcctgtaatcctggcgtgtgtgaagcagaggcattagaggagttgaagacagtcttggctacataaaaaaatctgagatcagtcttggctacatgagactgtcttaaaacaaaaagcctgcagtggcacacactgtaatccagcattcaggagccagaggtttatgaacctctctgagtttgaggccagctttgtctgcatggtgagttccactccagccaagactacttagcaagatcttgtctcaaaaaaggggagatggcgccaggcatggtggtgcacacctttaatcctaacacttgggaggcagaggcaggcggatttctgagttcaaggccagcctggtctacaaagtgagttccaggacagccagggctatacagagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagttggcccatttttccaactagcgtaaggcaagttccattcctaggtgtgaccccaacactattattttgtttgtattgtagaagatcaaggtgtttttttttccaatttttattaggtattttcttcatttacatttcaaatgctatcctgaaagtcccccatactccccccacccacccacccactcccacttcttggccctggtgttcccctgtactggggcatataaagtttgcaagaccaaggagcctctcttcccaataaagaccaacattttaaataaacctcctaatgagggatggatttaccacttctttatgaggactctagaagatgcagaggagacagtagtttaaaggaggggtgcccatctgctgggaattccagtggtaggagcaacagttgacacctactttgctgaagatgactcgaatttcatctgagaccacgtctcttgggggttctgtgaagcccagatctctaggcaggttcaggaccagagcaaggattaggtctcaatttgatagtggctccacaagcacgccaaggaagccccagctgactagccccaaaggagaacaatgtctcccgactaccaggagatagcgctataggactaagaggccagcagtgggcggggcttgaagaggtgggttgtgggtgggaacaagaatgccgcaggcatcagaaagtcgggctgtgtgctggaatgacttagggagggaggggctaaattgcgccagcatagctgggaagggaggggccacccggatgtgggcaggactgaagcagagaggcgggcggagcggtcctctagtggcgctcaggcttcactaccctgctgggttctgagaatgtgtctggtaatccgaggctgtcattcacataatacattctctctcctaaaaggaagcctgcaggggaatgggtgacgttgaggccctggctttgcgctggcttctgctctggggtttgaattctgcctgcaaagtttgaattctggtgtattatatagtccttaggattctaactactcgtcctagcaagatggcttagtgtaagggcggttgcctgaatttgatctcgtgatccatatgttggaaagagaactcttgaaagttggtttctgattcagattactaaacaaataaacgtgggttggggagaccctcatcctttgccagcacaaagttctctcttactttaagacctgtgctccatggagtctaatttccacaatttgggtttgttggatttgtagtctctccttcttcgatcctgagagcatccgaggcaggggatagcctgatagggtacttcgggatttgggagcgtctagactagcagttaggcacatctggttgttggagtcgttttagtctgtactcctgggcaaagaacatgacccgagaaacgaatggggatggagaattggtggctcattctcttgtggacctggggcctgagtgccctgaaacgccagagaatgcctttcctcagactgtccagctcccggcacacactgggagagcaggtgatcgctagctggccaagaacgctgttgttctctgtctacagggtagcttagtctcaggatatagggacagataagtttggagcctaccacaatggggcaagctgaggataagtcagccttcctacacagtgacttgaacttagtgctccaggatcatgccccacttcccttagatactaagggaacctacggttaacagtctaaggttgagagcacacttgggggttgatcctttggggtcaaatggccttttcacagaggttgcctaagacattagaaatcacagatatttacattacactttacaacagtggcaaaattacagtaatgaagtagcagcgaaaataattttatggttggggggttaccacaacatgaggaactgtatcaaagggtctcagctatggggaggttgagaaccactgtaagtcttagaacgtcttctaaagaaggtcttgggaaagagaggtggagcaaagagctggtccagttagtgtcagaggtgggtggacctctgagggagtctctgagaggaaactagctttgtttcagatgcattcatcctcagggagcccagggttgagatgggcaggaactggccatggggattctgatgtggatgtagacctgctggatgcaggagctcatgtcctgtagcatgtgtatgtgtgtgtgtgagggtgtatatgtacatgagggtgtgtatgtgtgtgagtgtgtgtatgtaaggatatgtgtgtgtgtgtgagggtgtgtatgtgtgtgaatgtgtgtaatgtgagggtgtatatgtgtgtgagtgtgtgtatgtaagggtgtgtatgtgtgtgaatgtgagtgtgtgtatgtgtgtgagtgtgtgtatgtgtgtgaatgtgagtgtgtgtatgtgtgtgagtgtgtgtatgtgagggtgtgtgtgtgtgtgtatgtgagagagagtgtgtgtgtgtgttgggatgagatgagaatacttgattttcctgtgtctagtgtatgcttagagtgaggacagtggtgcagctcagtttgtagtgtttgcccaacaagcataaagcctgggttccatccctagcaccataaaaaccagatgtgccttggaagaccaacaatcccagcaccgcagaggtgaatacaggaaaagttcaaggtttccctcctctacagtggtacatgtattcaatcctagaatttaggaggcaaagacaggtgactttgcctgtgactttgaggccagcctggtctacatagcaagtttcaggacacccagggctacatactgagaccttgtttcaaaacaaacaaacaaacaaacaattaagactaaagggaatgtagtgcaaatgagagcttgaagaagtgctgactgtgagtccctgggccctgcctctatgataattattccccacaaccctgctgtgggtcctgaggctgcacactcctggaactccagcctccttagagagattcaggctcaggaagggctaggattcttagagcagccttgggaatggtcaggggtgagcctgtatggaattagcattaataaagatggggaagacaattcaattgctcacggcctttctgcttacagcagatggagcccgtcctttgcccagagttacttggaattctttttttgttacttggaattcctagtctgcactgtcagctttttgccttcccggaaagctggtgctcacaccaggcctcccagctggaggggttagcaatacagaaacagtaacggtaacccagatgttgctgcctaactgacacctgctcccacccagcccagatcctggggcagccagggcagtgtctcctcagacaacctcaatgtccaagggtagtgtcagccttcactgtctggtgataccatgcttaaactcactactacaggtcaggacactgagggccaggaagcaagtgcattgggttcggggtctggtttgagcagcagactggcaaaggttagacttggatatcacaagctgaagacataatagtttcaacagtcttgactctgttgtatctctagaacctaactcaaaacatcagtcaagtttaactgactgaaaccacccatcttggcagacactagggcatctttgccatgaaggtcttataatctttcgtcttgccccggggtttggttttgctctcagggacttcaatcctttgcctcattctccccttccattctgggaggacagaagctttcctgacagttctggggagcttcctaagaagtcaggaaaggggctggtgagatggctcagtgggtaagagcacccgactgctcttccgaaggttcagagttcaaatcccagcaaccacatggtggctcacaaccatctgtaacaagatctgacgccctcttctggtgtgtctgaagacagctacagtgtacttacatataataataaataaatcttaaaaaagaaaagtcagtaaagatgacagggcaacccaaccaccctgattgggacgcagatgtcactcagtgaaagaaatggctttatcttacagtaggaggtcccatgtagcaaagggttagtcccagtaatgtccttgggtttgtattaggaaagaataggggagatgaaccgggagggaccctcttgatggacttccctgaatacaggcagaacagtatggtagagaggctgtctctttcccctacaatgagacacgtctgaccctctgttgtcttactggtaaccagaggatgccgtgaggatgtgacttctcactggggcctgctctcccccacccggggaacgaaggtgggtgaagggcagttcatagagattctgggggagagaactcaagctggagcttcaggctgggagtttcctgtagtttatcagtaacaatttgtatgtctgtctttctcttacaaacacagctcctgaaggacggctcccgtgggcctctctggcctagcactgaggagtagaagaacaggcattggaaaagaatgaacgtggtgtacgtcatggagacaggcggatccagcccggagacccgcagggggcggggcgcagaggggccagcagagcagcatgttttgactgagccgcttacaacttgcagaaaccacggtttcattattttttttcttgtcacaacaagccttcgaacgtgtgtaactctactagcgatggggcttaattagctgtcttgggagcgatatgcaggggcggtggggttacgctagtggcaaatatttctgatgatttgttttttgttttttgtttttttttttttcaaactgcctctttataatgccagtaaagatttacgcgctgcagccggaaaggttctacacgggcagagcatccggggaactctatactttccaggtttggtctttttcctcttgtttcaggaaccgtggccagctgaagactatagtatgaaactgagtttgtttaggccagcagggggtgaggggagtagggaccgtggacttgggcaggacaggataaggtctctttgcagactcctgcctacctggtgagtgcctgattccctgtctatgggtgatgccagcctggagggcaatcttctctagacttccctctctccctttcagttctatttctgtctctcctacccaggggagtattgggggctggagttgcatctcactaggaagtatgacaaacagtggggatggaggcagaaagggggttaaagtcctggcgataaccctgagttctcccagtctctctgaaacagcccaaagtgtctatggcatcccaacatccaaaaatgtcttcagccattctttctttttgtatgcatgtttttttctttttccatttttttttaaagatttatttatttattatatgtaagtacactgtagctgtcttcagacgcaccagaagagggcatcagatctctgttacaggtggttgtgagccaccatgtggttgctgggatttgaactccggacctttggaagagcaatcgggtgctcttacccttgagccatctcaccagccctctttttccattttaaattatttttttatatatatttcttacatgtatgagggcttgaatatgtctagacatcacattcatgcaatgccagaggatgccagaagagggcgtcagatcccctaggcttggagttaatcctttttaattttatttatctttttatttattattagatattttctttatatacatttcaaatgctatcccgaaagttcccttatacctccctccgccctgctcccctacccacccactcccacttcttggccctgctcccctactcacccactcccacttcttggccctggtgttcccctctactggggcatataaagtttgcaataccaagaggcctctcttcccagtgatggctgattaggccatcttctgctacatatgcagctagagacatgagctctgggggtactggttagttcatattggttgttccacctatagggttgcagaccccttcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacatgcccaggtttttacacgctggagatccacgctcaagattctcatgcctgtgtgaccatgccaccttctcagccctgtctccttttcttgcctgcaaagtgtcttctttaccctggtatactttttcttttcttttttaatgtgctgggtgaccacaggcctgtgcacctgatcatatgtgcctgatgcctgcaggggccagaagacagtgtcagatctcctggaaatgaaattatgggtaaatttgaactatcatgtgggtgctggaaattaaacttggatcactccggaacagtggatctcaatctttttcatgctgagtccccttaataccgttcctcatgctgtggtgacccctaaccataaaatcatgtcactgctacttcataagtgtaattttgctaccgttatgaatctcaatgtaaatatttttggagatgacggtttcccagcggggtgccgacccacaggttgagaaatgctgctctggaagaacagccggtgctcgtactgctgaaccat

SEQ ID NO: 284 - DNA, 4465 bp, Mus musculus
ggctctgggtgctctaggatggaacagctgtgcagagggtgaggatccaaccctgggaccacatcatttgctttcttccttagcaactggtggcttgaacaaacactagcctgggtgaggatgtctgtggacaactggctactgcaccccctctggggacagacctttctcctcctcctgtctgtggctgtggctcaggcccactggcccagtgaaccctcagaggctgtgagggactggaagaaccagcttgaggcgtccatgcactcagttctctccgacttccaggaggctgttcccaccgtggttggcattccagacggtacggctgttgtcgggcgctcatttcgagtgagcattccaacggatttaattgcctccagtggggagatcatcaaggtgtctgcagcagggaaggaggccttaccgtcttggctacactgggacccacacagtcatattttggaaggccttcctcttgacactgataaaggtgtgcattacatctcagtgagtgctgcacgcctgggagccaatggaagccacgtcccccagacttccagtgtgttctctatcgaggtctaccctgaagaccacaatgagccacagtctgtacgggcagcctcatcagaccctggtgaggtagtgccatctgcctgtgctgctgatgagccagtgactgtccttacagtgattctggatgctgacctcaccaagatgaccccaaagcaaaggatcgatctgttgaacagaatgcagagcttctcagaagtagaacttcacaacatgaagttggtgcctgtagtgaataatagactatttgacatgtcggccttcatggctggcccaggaaatgcaaagaaagtggtagagaatggggctctcctgtcctggaaactaggctgctccttgaaccagaatagcgtccctgacatccgtggtgtagaaacccctgctagggagggtgctatgtctgcccaacttggttatcctgtggtgggttggcacattgccaataagaagcccactctccccaaacgactccggaggcagatccacgccacacctacacctgttactgccattggacccccaaccacggccattcaggagccaccatcgcggatagtgcctacgcctacatctccagccattgcacctccaacagagaccatggctcctcctgtcagggatcctgttccagggaagcccacggtcaccattcggacgcgaggtgccattattcagaccccaactctgggccctatccagcctactcgggtgtcagaagctggtaccacggttcctggccagattcgcccaacactgacaattcctggctatgtagagcccacagccgttattactcctccaacaactaccacaaagaagccacgagtgtccacgccaaagccagcaacgccttcaactgattcgtcaactaccacaactcggaggccaaccaaaaaaccacggacaccccgaccagtgccccgagtcaccaccaaagcacccatcaccaggttggagacagcttccccacccactcgaatccgtactaccaccagtggagtgccccgtgggggagaacctaaccagcggccagagctcaagaatcacattgacagggtagatgcctgggtgggaacctattttgaggtaaagattccatcagacaccttctatgacaatgaggataccactaccgacaagctcaagctgaccctgaagcttcgagagcagcagttagtaggtgagaaatcgtgggttcagtttaacagcaacagccagctcatgtatggcctgcctgacagcagccatgtgggaaaacatgagtattttatgcatgccacagacaaagggggcctctccgctgtggatgccttcgagatccatgttcacaagcgcccacaaggggacaaggctcctgcacggttcaaggccaggcttgcaggggatccagcaccggtggtgaatgacattcacaagaaaattgctttggtaaagaagctagcttttgcttttggggatcgaaactgcagctccatcacccttcagaacatcactcggggctctatcgtggtggaatggaccaacaacactctgcccctggagccctgccccaaggagcagatcatagggctgagccgcaggattgctgatgaaaatgggaagcctcgtcctgccttctccaatgctctggagcctgactttaaggctctgagtattgctgtgacgggctctggcagttgtcggcacctccagtttatccctgtggcaccaccctctcctggaagctcagctgcaccagccacagaggttccagacagggaccccgagaagagcagtgaggacgatgtttacctgcacaccgttatcccagccgtggtggtcgcggccatcctgctcattgctggaatcattgctatgatctgctatcgcaagaagaggaagggcaagctgacccttgaggaccaggccacctttattaagaagggggtgcctatcatctttgcggatgagctggatgactctaagcccccgccctcttccagcatgccgctcatcttgcaggaagagaaggctcccctcccacctcctgagtaccccaaccagagtatgcccgagaccactcctctgaaccaggacactgtgggagagtacacacccctgcgggatgaggatcctaacgcacctccctatcagccacccccacccttcacggctcccatggagggcaagggctcccgtcccaagaacatgaccccataccgatcaccccctccggccctggtgctgggttcgctctcccgctgttgccaggggctggaagctggaggggcctcttgggccatggacatcctgacctctaccccatgcacgctagtggcctaccaccaagggggtcttcatttctgtgggaaagggactccaaaaggcattggtggctatggcctccaacctaggtgctccaaggtgggccagctgctcgtaggggcacctgggaaggtcgaaggactccacctcatcaacctttcttttcccttctctgtggtttggtttggtttggttctgttctttcccttccctcttaaaaggaatatcacggtctttgaaacactcagtgggggacattttggtgaagatgcaatatttttatgtcatgtgatgctctttcctcacttgaccttggccactttgtcccaacagtccacagccctaccccatataccctgcccctcttctctggcgctccagtcctgggccgtgggcctgtggctggggaggagtgccagcaatagttcatagtaaaagtctgtgggctctcaaagctaattttttactaaagtttttatacagcctcaaattgttttattaaaaaaaaaaagattaaaaaatggtgatgcttagcagcagtttgtataagctcctagtgtcaactccatgggactgatggctttgctcatttggaccctcccctccttcttttcctaatgggttaaattctggattacatagaggcttcctttgccttttttagcagaacatcgtccatctgtctgcatctctgtcccatgactcaggggcacccactctgctttgattctcctcctttggaagaaaccattttgagcatgccttttcttgatgtctgagttatttcgggtaccttttagggaggaatgccttttgcaataatgtatcccttccctgatggagggtgggtgggtggacccaggctccctttgcacacggagcagtaccttctaagccatatcgactgttgagcagagggtgtgctgtctcaggaaggaaaggccagtagttcagaagggttgcttccaaatggtggttcttctgctttctccacaaggcctacccttcctgctcagcccccaggagggttctttgtagtgagcactccccatgcgggagtctgccgatgagtgcttcatggatggctggtgactgggccttgtgctcccaagctctggtccgagctggagtttccctgatgtcccagagtcaagagcagggatctgatccgatgaaattatttctggtgacctcatcaaaaataaataaataaataaacaaataaacaaatcccagtattccaggtgagggctttgggaagccctccagataactcttgttgctcttagcaaccccaccattgggcattgccatgtagagaggaggcaggcccaaagtggcctgttgtcatagcaactggaggcagtggggcagtgaacagaataacaacagcaacaatgcctttgcaggcagccccctccctgagccggcgatggccatcagactctgagacagagagccaatctcacattcaagtgttcaccaaccactgacgtgtttttatttccttctatatgattttaagatgtgttttctgcattctgtatagaaacatatcaaactaaataaaagcagtgtctttattaca

SEQ ID NO: 285 - protein, 1088 aa, Mus musculus
GSNPGTTSFAFFLSNWWLEQTLAWVRMSVDNWLLHPLWGQTFLLLLSVAVAQAHWPSEPSEAVRDWKNQLEASMHSVLSDFQEAVPTVVGIPDGTAVVGRSFRVSIPTDLIASSGEIIKVSAAGKEALPSWLHWDPHSHILEGLPLDTDKGVHYISVSAARLGANGSHVPQTSSVFSIEVYPEDHNEPQSVRAASSDPGEVVPSACAADEPVTVLTVILDADLTKMTPKQRIDLLNRMQSFSEVELHNMKLVPVVNNRLFDMSAFMAGPGNAKKVVENGALLSWKLGCSLNQNSVPDIRGVETPAREGAMSAQLGYPVVGWHIANKKPTLPKRLRRQIHATPTPVTAIGPPTTAIQEPPSRIVPTPTSPAIAPPTETMAPPVRDPVPGKPTVTIRTRGAIIQTPTLGPIQPTRVSEAGTTVPGQIRPTLTIPGYVEPTAVITPPTTTTKKPRVSTPKPATPSTDSSTTTTRRPTKKPRTPRPVPRVTTKAPITRLETASPPTRIRTTTSGVPRGGEPNQRPELKNHIDRVDAWVGTYFEVKIPSDTFYDNEDTTTDKLKLTLKLREQQLVGEKSWVQFNSNSQLMYGLPDSSHVGKHEYFMHATDKGGLSAVDAFEIHVHKRPQGDKAPARFKARLAGDPAPVVNDIHKKIALVKKLAFAFGDRNCSSITLQNITRGSIVVEWTNNTLPLEPCPKEQIIGLSRRIADENGKPRPAFSNALEPDFKALSIAVTGSGSCRHLQFIPVAPPSPGSSAAPATEVPDRDPEKSSEDDVYLHTVIPAVVVAAILLIAGIIAMICYRKKRKGKLTLEDQATFIKKGVPIIFADELDDSKPPPSSSMPLILQEEKAPLPPPEYPNQSMPETTPLNQDTVGEYTPLRDEDPNAPPYQPPPPFTAPMEGKGSRPKNMTPYRSPPPALVLGSLSRCCQGLEAGGASWAMDILTSTPCTLVAYHQGGLHFCGKGTPKGIGGYGLQPRCSKVGQLLVGAPGKVEGLHLINLSFPFSVVWFGLVLFFPFPLKRNITVFETLSGGHFGEDAIFLCHVMLFPHLTLATLSQQSTALPHIPCPSSLALQSWAVGLWLGRSASNSS

SEQ ID NO: 286 - DNA, 87331 bp, Homo sapiens
  misc_feature (1)...(87331): n = A,T,C or G
acaaacattagctgggcatggtagcgggtgcctatagtcccagctacttgggaaactgaggcgaagaactgcttgaacccaggaggcggatgcagtgagccgagatcatgccactgcactccagcctgggcaacagaacgagactccgtttcaaaaaagaaagatgtggaagtggagaggcatggggagaagtggagggtgaagaagcaggaagaggtgaggtaaagtggaggggataggaccaggaggctggtcagggggcacgtgagggatccttgtcctccagcagctggaagacaggaagaatgctgagcagagcaggatcataggtagatttgggtttggaagttagctctggctggtgccacagtggactggattagcagtgtgctgcacgcagagtctccagctgaggacagggccctgtagcccctccttctgcagaccattgttcttaggagggagaaggtattcagacgaccaaggcccaagaagacaaggggggtgcagggtagaggctggcacctcaggccgataggaggcagggggaccttggccctagaggagcctgggaacagcagcagctgttgctgctggcaaggcaagcgggtaggcagcccacgtctgtggtggccagtgggggagggtctccagaatttgaggccaaggacatctgcaagggtgggcagcaaagccatcaagacaggggagggggaggttgtggcaggtcagccagggacagtgtcccaccctcatccagctgtctgggaacagctgcaggaagagggagggaggaggcctggcagcagcaggtgaggaagctctctagttgcctaagcatgggaaaggagagctggtgcgggtgggagggaattgagggagggtacccaggaaacggggacggaagcatgtccatgccaaagggactgcctggttctcatgcatgcaaatgcagctggaattcttcagggaaagaatgtgtggggttgggggattgggagtagggagggaaccaagtgctctcctcttccttccagaggttcccccaaaggctatcctcctaggctgctcggccccacctcaggactccccccgactcctcattcctgggttgaattttctctttccccaccctcctctttccttattcactcctgtggcttgatcctattcctaggaagaaaagcaaacagaaggccagacacagtggctcacccctgtaatcccagcactttgggaggccaaggtacgcagatcacctgaggtcaggagattgagaccatcctgtccaacatggcaaaacccccgtctctactaaaaatacaaaaattagctgggtgtggtggtacacacctgtaatcccagatgctcgggaggctgaagcaggagaattgcttgaacccaggaggtggaggttgcagtgagccgagattgtgcctgcactcccgcctgggcgacagagtgagacaccctctaaaaaaaaccaaacaaacagaacctaggattcctaagggccctttggaaagctctggtccacaggagtcagagggggaaaggatacagagagaagtctttgcccaaggccccagtcagtcagaggcaggcaccagcgcacctgcttgtgcacacccagcccttggggccttgaccctgggtaagaccttgactgtgacagcaagtgggcctgggcatccctgagctctgcctcctgtgagctcagtggggcttactagaaacaagtctgttcccagtggttgtaggtgtcctgaggaggcctgagatttcccacttctctgccggccagggcctcagtgctgctgaccttgaacaaattgctgagagccccaggcagcagagtgagtataggggggttttgggcagaggaagaatagggggtcagctgagaccaggctttctccctgggatttccccaaggtaggaggagcagctgctgggccctggagcagccttcctcacacctacatgtcctcacctttatatcagctgctacattcttttaagtatcccagggcatggagatgatgaaatatttcttttaaccttttctagaaaaaccctccacacaccatgaatgggtttttgtatggcactggggacatgtgagtgcctctgcagagagccactaccatgctatagccagtcatgcccacccctgaaggcccacaacctgggcttcaagctggggtctctctctttcttaccttaaacgccagttctgagctcagcccctaatacttcccactccaggccttcctagtccctggggtcccctgccaggtccagcatagttaactcatctgatggacatagaccttttcctgagggtcacacatattcgtgggcgaccccagccagaaattctgtccagcttggttaagtgacagctgctgggagggacgtttgagggtcaccggcccagagcatcccagagatggatgggacagctggcctgggctttgtgcctaccaggtgaccctacacctgtcctgaaggcctccagcatgcttgtgtcaagcagtagctctgggggaggtaggtgggggtttgccctggaatccatcttaaggcaggaccttccccaactgctccctgctccccagctaccctctcctctccactctctcctttctcccacctctgccattggcccagtccatgggtttcctttccccaggcagttgacgctgggccctctctgatgggccatgctgggtctcccctgaagtccttacatactgagtataccaggagtatatccaggcccaagggagcccttcctccaccatgtcccttcccctttgacctttctctcctggggctggaaggaggggagtggcctctctgcattccagggaaggtggaggaaggacaagtgagaaattttctctctaaatgcttgttctgacttgacttccctgatgcctgttgcccctcctccacatgacccccatctctgcctccactctgcctgctctctcctccccaacccctcctctgtgctcccacctttctttccccacctacaggggaaagaagggctgcaagcctggagctcagctgctgtcccctcacccctcacccaactgcattccttcctggaggcctgagggcactgcctgccctggccctcccaccctccttctcctcctcctcctcctccttgctcccatctttcagctaccatgccccttgctcctgggatcctacctttctggcaaagcccagcctggttaaatatagtgctggtgcctgctctcccatctgttgctttctctcctttatcaccactccattcactgctcaggccttggggatttccaagatctttcaggcctgccctgcccactttctcctaagccttcactgtggcctttctctaggcttattccattcactctccagaaaaccccagggtttcctccgtgttcacctcctataggctctgccttcaaagagtggatttctcaaatgttctgcaccacacagtacaccctggttccccccttccctctcatcccctttgtaactacctgattattacatttgtatttacttattttatttactgtcttatttgtctggaatttgggctccacaagggaagggcttgtcccttttatttcttcctgtgttcctagcatacaatagactcagtaaatatctgtggattcaacaaggcatggatggatgtttcaccctggccgtgactcagtcacataatctggtcttctgtcatttttagtgagcagacagggccacagcccacatatgaggtcacttgatgatgaggtgaccaaggggcttagagagggcaagcagctttgcaaagtcatacagtgaactcggctctgagtctcagcaggggcttattctttttttttttttttgagacggagtctcactctgtcgccaggctggagtgcagtggcatgatctcggctcactgcaagctctgccttccgggttcacgccattctcctgcctcagcctcctgagtagctgggactacaggcgcccgccaccacgcccggctaatgttttgtattttcagtagagacggggtttcaccgtgttccgtgttagccaggatggtctcgatctcctgacctcgtgatccaccctcctctgcctcccaaagtgctgggattacaggcgtgagccaccgtgcctagccagcaggggcttattctttattcttttttttttttttgagatggagtttcgctcttgttgcccagtgcccaggctagagtgcagtggcgtggtctcggctcactgcaacctctgcctcctgggttcaagcgattctcctgcctcagctgcccaagtagctgggactacagggataggccaccacgcccggctaattttgtatttttagtagagacagggtttctccatgttggtcaggctggtctcgaactcctgacctcaggtgatccgcccgcctcggcctcccaaagtgctgggattacaggcatgagccaccacacctggccaaaaaacacctttccccgtgggtggacatacatgtccaatgccccctcccttagctacattcagctccctgctggctctgggataagatagtcccccaagactgactttgcatggctattcccaaaacactgtgtctgtggccttgagcgctggactaaacactagattaggtttagtctagccaggcagtcagtggaagcaagcaaaggtagggggtctgtttgttcattctcttcagttactgaccagctagcccctaaacccaaagtcgtgggggacaccacccatattcgtccagtttagcagaattgttctcttctccatcacatgtcagtccaaatctggctcaggggtcaatcaggggcttttctagggcagaaacacctctttcagagctggctagatcttatttgggcctgtccttctcattggcctgggcacccctcagtggccctttagtcagagacattgatgggccaccaagcaaacactgactctgaccctgctgtcatggctgatgagtatgcccctgaaacactggaaagtgttggatccaggtgaaaatatagcttttgcctctaggctgagtgctgacagagacaggaagggcctctgagagccctatctctagtgtagggaatcctcgacatttctgggatgaatgagagcagtcctccggccatcttgaggtgaactaataaaggaataaaaggtgaatgttagctaatcagtcacgttctccagtgtgtacatgtaaagaataagcccctgctgaggccaggtgcagtggctcatgcctgtaatccccgcactttgggaggccaaggtgggcggatcacttgaggtcaggagttcaagaccagcctggctaacatggtgaaactccgtctctagtaaaaatacaaaaattagaagccgggcgtggtggtttacgcctgtaatcccagcactttgggaggccaagatgggctgatcacaaggtcaggagatggagaccatcctggctaacacggtgaaatcccgtctctactaaaaatacaaaaaaacaaaaaaaattagctgggcatagtggcgggtgcctgtagtcccagctactcaggaggctgaggcaggagaatggcgtgaacctgggaggcagaggttgcagtgagccgagatcgcgccactgccctccagcctgggtgactgagcaagactccgcctcaaaaaaaaaaaaacattagccgggcgtggtggcgggcgcctgtaatcccagctactcagggggctgaggcaggagaatcgcttgggcccgggaggcggaggttacagtgaacagagatggagccactgaactccagcctgggccacagagtgagatttcgtctcaaataaataaataaataaataaataaataaataaataaataaataaataaatattggcccggcgcggtggctcacgcctgtaatcccagcactttgagaggcagaggagggtggatcacgaggtcaggagatcgagaccatcctggctaacacggtgaaaccctgtctccactaaaaatacaaaaaattagctgggcgtggtggtgggcgcctgtaatctcagctactcgggaggatgaagcaggataatggcgtgaacccgggaggcggagcttgcggtgagccgagatcgcaccactgcactccagcctgggcgacagagcaagactcggtctcaaaaaaaaaaaaaaaagattaaataaataaataaataaattgccaggcatggtggcaggccctgcgcctgtattcccagctactcaggaggctgaggcaggagaatcacttgagcccaggaggcagaagttgcagtgagtcaagattgcgccactacattccagcctgggtgacagagggagaatgtttaaaaaaaataaataaataaaataaaaataaagaaggccagtcgcggtggctcacgcctataatcccagcactttgggaggccgaggcggatggatcacctgaggtcaggagtttgagaccagcctggctggctaacatggtgaaaccccgtctcaactaaaaatacaaaaattagctgggcgtgatggcaggcgcctgtaatcccagctactctgggggtggaggcaggagaatcgcttgaactcgggaggcgaaggttgcagtgagccgagattgcgccatcgcactccagcctggggaacaagagcgaaactttgtcacaaaaaaaaaaaaaaagaataggccgggtgcggtgactcacgcctgcaatcccagcactttgggaggctgaggcaggcggatcacctgaggttgggagttcgcaacaacagcgaaactccatctcaaaaaaagaaaggtgtcttttatttattcaaccaacagtcccccttgctatggggttcctgccccataggactctctgttcctagagggacaggtgtggaagctgtggcccagttgactggaggaatgctctttgccagccatgtatggaggggtctggtggaagtgctggagtggagggccctgcaaggggaggaactggcttctgggaaggctggtggtgacccacaaacacgcctactggcagtttatctcggatgaacttatcagtcctttctttctgccagagctgccaaacaatcagccttctgttaaatccagacaaaagggactcctcccttgccgtgacttggctggccctgcttgctagccctctgcctcaggcaggcctgtgggcctggcatttgggtcaggagcctccacccttgaccagcaccagcccctgcccctctctgtcaggcctggagaggaatcagcagcagaggcctccctcccctgggaagaatctgaggatgagcactggtccttgaccctcagcttctcagaaacacgccagggtaaaaagccctggaatcctaggaccatcagaaagtttggtccacgtaatgtcccttggatttgttctaactaaaatcaaggtcttagtttaagtcacatgagccccaagcaaacactaggacatttgccttgggctttgcacagggcatggacctttggagtagcaacttgcttccttccttccaaaaccaaaattgagcctctgctatctgccacttgctgttaggtggtggttgctatgtggggccaagcaagttggtctctagcatcaagggctcatacttcagtggaggagacaaaccttaatcagataatcttcctgaatcctcaggttgagggtctatgtggatgaaacactgggggctgaaggcccaagagagttggggactgacaggcccgaagatcctcattctttgcctcttgatcagtcctccccattccataccacatgggtcctttgagtagctgctcctgggagtaacccaggcctcatttttttttttctttctttctttctttttttttttttgagacggagtctcactgttgcccaggctggagcgaagtggtacaatcttagctcactgcaacctctgcctcctgggttcaagtgattctcctgcttcagcctcctgagtagctgggattacaggtgtgtaccaccacgcctggctaattttcatatttttagtagagaagggatttcaccatattggtcaggctggtctggaactcctgacctcgtgatccacccacctcagcctcccaaagtgttgggattacaggcatgagccaccgcgcccagcctttttattttttcttgagtcaggatcttactctgtcacctggctggagtgcagtggcatgactgcagctcactgcaacctccacctcccaggctcaagtgatccacctcagcctcctgagtatctgggaccacaggtgggtgccatatgccttgctaattttttaattttttgtagagatgggggtcttgctaacatgttgcgcagtctggtctcaaacttctcccatccaagtactaaccaggcccaaccctgcttagcttctgagatcagacgagcttgggtgcattcagggtggtatggccatggacagctcttgaacttctgagctcaaacgatccacctgccttagtttcccaaagtgctgggattacaggtatgagccactgagcctggcccagacctcatttttggttctgccctccaactggttgtgagcaccaaacctggcctggagtggcctaggctctgctggggtttggaaggtgagttactggggaccttgtgctgaactctagagtaggctgtgcagttcccactgagggtaaaggctttgactcttagaactaaagagagtaacaaggccttaactttacagcccctagccagtctaggggaccatgaagacagctatttctgtgtcatctttggtatggactccagtgggggctggttgggttctggtgggaggtggttaggcctcctaagtggcttgttcaggtctggtcagccaagcctcctgccgtttttttttttgaggggggacagagtttccctcttgttgcccaggctggagtgcagtggtgtgaactcggctcactgcaacctccgcctccctggttcaagcaattctcctgtctcagcctcccgagtagctaggattacaggcatatgccacaacgcccggctaattttttttgtatttttagtagagacggggtttcaccgtgttagccaggattgtctcgatcttctgacctcgtgatccacccgccttggcctcccgaagtgctgggattacaggcgtgagccaccacgcctggcctctttctttttttttgagacagggtctcattctgttgcccaggctggagtgcagtggtgtgatcatggctcactgcagttttaatctccaaagctcaagcacctggctaatttaaaaaatttttttgtagagatggtgtctcactatatagtccagactggtcttgaatcatgggctcaagagatccaccctccttggcctcccaaagtgctggaattacagacctgagatgtaaaactatatagtcagacactaaaatatgcagcagaacgtatggctgcaaagcagtgcacggtggtggggtaggtggtgcactctcagagccaaaggagtgaatgagagaatagaatatattttgcttagaaacccaaataaataattttctgcatggttagcccccccttttttttttttggagacagggtctccctctattgcataggctggagtgcagtggtgtgaacacccgctcactgcagtctcaacctcctggtctcaagcaatcctcccacctcagcctcccaggtagctgggagcacaggtcatgtgccaccccgcttggccaattttatttttaatttttattttttgagacagagtcttgttctgttgcccaggtggagttcagtggcatgatctcggctcactgcaacgtctgcctcctgggttcacgtgattctcctgtctccgcctcccgagtagctgggactacaggcgtctgccaccatgcccggctattttttgtatttttagtagagacggggtttcacgttgttggtcaggctggtctcaaactcctgacctcaggtgatccacccgccttggcctcccaaagtgctgggattacaggtgtgagccaccgcggctggtcaaaattttttttttttggtactttttttgtagaggcggggtttcgacacgttgcccaggctggtcttgaactcctgagctcaagctatccatccacctgcctcggcctcccatagtgctgggactacaggcgggagcacagcacctagccccttccttttcttgtctctgtgaatgaggtttggagccgagacactgaagtatagataattgcaaaaaggtatgtttttgggagatggggcattcctttcttatctctgcaacttgcatctcccagacgctcctgaggagggagggaaagccagggagccccagagctctccgggatccagggaggaaaccatggctggtggcagccagttctgtgttcagaatgtgcttgctgtcaagagtgcaggcctggaattccagcctggccacaggccaaggagggaatggacccatcctgcgcatggtgtggggatgagaagcagagcccaccacgggtctcattcccagacccatccggtaactgtcagtttcagtaactgtgaagtctggggcttttggggtggggggctgcaggttaagtcctggggagagctagagctaccttaggaccctccccttgaatgttccaggcagcaacccccctctcttatttcttcccccaccaaaagaatgcaggccactaggagtgagtgaccagcgcctgcgagttagagctattttgggcaggagagcaggcgtcggattccagtgttccaggcagggggaggggacgagggttaggcctgaggcgctttccgactccccagcctgctgtgggcgaggctctaggagatgagctagcttcccgctcctcctgtccctggcctcagtctcccatccgtgtaagggccgggcagcaaggctttcatcctttgcaattgagagaacgcttcctgattgttctcatggcttagaaataccccttgatttgcattcgaaggaaataaggagggctgaacgcagtcgacgggtggccagttgctgggccagttcgcagtcctgactgtcccttgattagtcttagaggcccaaaggcctgaagttgggcggggagcccctcccccacactactggttctgaaggctccgagtgaccgggaccgaccgccggggtgtgtcccgggacggacttccctggccgtgggggcgaggcttccataatggggcgtgacttttagggcgggggagtggctagccaatgagcagagaggtgcgggccggggcggggcttgcgcgcgggtgcggcgcgctgcggagcggccgacgcaggcagaagccggcggcgcgcggacagccagtcggcgccgcgcggagctggccgctggattggctgcaacactcgcgtgtcaggcggttgctaggctccggccgcgcgccccgcccttgcgctcagcgccctctcaccgcccggtacgtgctcgcgcgaaggctgcggcgcggcgctcgcgcctcttaggcttggcggtggcggcggcggcagcttcgcgccgaatccccggggagcggcggtggcggcgtcctggggccaggaggagcgaacacctgccgcggtcctcccgccggcgctgggtgagtgcaccgcccgccctatccgctgtgcctggctgcttgggcccccatccctgctgccggctgagccttccgcggaacacctgctgctgctcgctgttcggcccggggcggggacacggccgcggacgtccttgtgggtgaggaggcggtgccgcccgggcggagccgcccctttgctctgggtcccgcaggcaaaggctcggagcgttcggctgcaaggcccgggccgcgcgccgcggcgatgggccaggccttagctcggcccgcgctcccgggaacgtggagcctgcgccttggccgcggtcgtgagccgcctgcgggccgcctccctggcttccaataggggttgtggcccagttgggccggattccgactgtggggagtcgagccccgctagaggcagggaagggcaccgctgccgccactgctctgtcagagctgctcagagccttggtgggttccgtcatccttacttgagctcctttggaagcttgtttacttactaccttttcactttgtatttggcagacctggttcacctgcgagtgtatttggatagtgtctccacagaaaatgtcgtctcggcttggaatctttttgccataaattctaagttagtttcctacaaactcaactggtaacttaaaatgcatcctttaatctctataacttgaaaagttcttatttttgtaaatcgagttgcttcagaattagttttaatggtgacgatgaagttttgactggttgaggcaagagcctgggacagcaccttcatagcgcagagtctaacttaagattctagcctgctgcttccctaaataagcgagtagaagtgactcctggcatagaagccagactccgtgaagggaaggtggtgtttataggacataattccagataaagagctggatgtgctttcaggtgttttgcaaagtctggtgtagatggggtattgcagttttatcaggttctatgcttagttaagttcagagacattattttggaatgttcctgttctaaaaaagaattcaaccgtactacattttggaggcataaaaatccatagtttgagtatggagaagtttagttgaacttttgtgggttttttttgctgtgaactaaggaagaagagctcatggcctgtgtcctgtattttggagaaatcagatttcagtagggagttggatccatcatgtgaagaccctatgggatataaaagcttgtgctgacatgtgcttttgttaaaagaggcacagtgcaaatcctcactgttcttaaaaattgattttgcaaaatgcatttattcatttgaacaaatattttgattcactacctgccaaattctgtggtagatcctagggacccatgtaaaagagtctgcttctgcccttaaggaattcagtttagggggcagtggggaccggggaacccatgattaatagtgtctgcccgctaagcgtgctcacatagtagcctgaggagagagggaattcctgagctgtggttttcagggccagcaggaattagtgggggacatcaaggcctggacacagggaaccacatgtacatgagcacctaaaatagtgcttgggagtcctccagcttggcaggtgcgagctctgggcctgccttgtgctcaggagttccaactttgtatgcggggtgcaggagtctggggagccttttaatcagtagagtggtgtgacccagacctgtgtttagaaagatattgctggtggagtggcaggaagagggagggggtcaggacctctggcagttaagtcagctaacagaggagaggtggggagggagaaggagccatcagaaaagagagactgaaaaggtagtacagaggggatgtcctgccatgatgggggaggagctacattctggaatgcatgggccagaagaccaagcataaccaaggatttaaattccttgttgactacctggtatagtgacctacagagttgcttgtgtctggttagtgttgaggatggtgggatttggagggaccacttagggaccacttagactgccgtcgatgcataggaaaggaggcctggcatttgattattaaaaactttatcgccgggcacggtggctcccacctgtaatcccagcagtttgggaggccgaggcgggcggatcacgaggtcaggagatcgagatcatcctggctaacacggtgaaaccccctctctactaaaaatacaaaaaattagccgggcgtggtggtgggcacctgtagtcccagctactcaggaggctgaggcaggagaatggcgtgaacccgggaggcggagcttgcagtgagttgagatagagccactgcactccagcctgggccacagatcgagactccgtctcaaaaaaaaaacaaaaaaggaaatcccagcgctttgggaggccaaggcgggaggatcacttacctgaggtcaggagttcgaacccagcctagccaagatggcgaaaccccatctctactaaaaaaaatacaaaaattagctgggtgtggtagcacgtgcctgtagtcctagctacttgggaggctgagacatgagaatcgccttaaccccggaggcagaggttgcagtgagccaaaatcacaacactgcactctagcctgggccatagagcaagactttcaaaaaaaaaagaaaaaaagaaaaaaagaaataggccgagtgcagtggctcatgcctataatcctaggactttgggaggctgaggtgggtggactgcctgagctcaggagttcgagaccagcctgggtcacatggtgaaaccccatctctactaaaatacaaaaaattagccaggcgtggcagcatgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggtgaaaccccgtctctactaaaaatacaaaaaaaaaaaaaattagccgggcgtagtgttaggcgcctgtagtcccagctactctgggaggccgaggcaggagaatggcgtgaacctggaaggcagagcttgcagtgagctgagatagtgccattgcactccagcctgggcgacagagtgagactctgcctcaaaaaaaaaaaaaaaaaaagtgaattgtgatttacagttttgtagaagcacatttatcaatgtcaagtaaggcagatttgtactgatttttatttttaagtattgtgcacgttttctgtagtcccttttctgtgacttgcatggatttgtgatttttatagccatgtggagacctagtctcagtgttccctgcccttggggacatgaggagccacagattcattcttgctgaggcagtcatggcccttggataccctaagtataggggagtgtgccagttgtggggagctcaaggatgaatgaagcacttggaaggatatgtcgtattcagggaaacagtagccagtgcccagcttgattcccctgttttggcatttactcttcatttctatagatgttgtttttgtatatgaggtatgagaatctacaaacaagcacctcttatagagttctttctcctaatcggtacacagttttctgtatctataggttccacatctgtggattcctccaactatggattgaaaatatttgggaaaaaaggatggttgcgtccgtatgaaacatgaataaacttttatcatcgtcatcatttcctaaatgttagaacaactattttcataccatttacattgtattatgtgttataagtaatccagggatgtttaaagtatacaggaagatgtttaagggatccagggctgtgcaggacgtgccttgttaacaaaatgtttacaagcagtatacttggtaaaagtcatcgctattctctagtctcaataaactggggacacagtgcattgcggaaaaccacagggacctctgctcttgaaagcggggtattgtccaaggtttctccccatgtgatagtctgaaatatagcctcgtggaatgagaaagacctgaccttcccccagcccgacacctgtaaagggtctatgctgaggtggattagtaaaagaggaaagccgcttgcagttgagatagaggaaggccactgtctcctgcctgcccttgggaactgaatgtctccgtgtaaaacctgattgtacatttgttcaattctgagataggagaaaaactgccctatggggggaggcgagacatgtttgcagcaatgctgccttgttattctttactccactgagatgtttgggtggagagaaacataaatctggcttatgtgtacgtccatccagtcacagtaccttcccttaaacttaattatgacgtagattctattgcttacatgtttttgtccttattatgatgcaaatattacaccattttatataagggacttgagcacttgtggattttgatatcctggaaccaatccctcatggataccgagggaagagtttgtaaatgtattaaaacaaagtagtggaattggaatcaaattcttttgattttgtaggtatctgtgtttagccttttcactgtgctgtgaagatttcccccccaggcatcctaggggttgatgggagatttacttaagattcccaaggctgtctagggcagaagtgaaccagttctgccttggttgtcataaacacctctgttaattagctcagttgttctccagggatagattgattctctagctagcttttgccaagaaaaatgatccagtcaataatggaattccaaataagatttcctttttatttggctattaatcagaacctgggataacatccattttctgggccctgattttactatggaatatttccataaaacatgcatgtgattactgtaaatgtcctgtaaacactcctgcttgggctggtaggtcatctttttttttttttttttcttttgagacagttttagtcttgttgcccaggctggagtgcagtggcgtgatctcagctcactgcaacctctgcctcccagattcaagtgattctcctgccacagcctcccaagtagctggaatgatacaccatgcgccaccacacctggctaatttttgtatttttagtagagatggggattcttcatgttggtcaggctggtctcaaactgcgacctcagatgatctgcctgcctcggccttctaaagtgctgggattacaggcgtgagccaccatgcctggactgtaggtcacctctgtgtccagtctgccagaggtcagggatacgttgccgtctaggattttttatattggagaccagtctgatgagtagcccttgagcagggactggattctaagtcttggagaaaatgagtaagttctacctcttatgtgaggtatgattgaagaaattgtgttttctttgttttttgagaggcagggtcttgccctgttgcctacctggagtgtggtggcataatcatagctcacttcagtcttgacctcctagggtcaagcaatcctcccacctcagcctcctgagtagctgggactactagcacgtgccactgtgcccagctaatttttaaatttttttgtagcgatgtggtcttggctatgttgcccaggctggatcctcctgcctcagcctcccaaagtgttgggattacaggcgtgagccaccacacccggcccagaagtgtcttatatttttagacttttgagcagtgttggaacgattgaattgcctgagtggagaaatttggtaggaagagagtagaagagaggctctttattaaagacctaaaaatagaattcattaaagtcacaaatagataacagtaggattcctgtctaactctctcctgctttgggtttgtgctaccagctgttgcgtttgcttacctagaaaatagaataatattttgtcagaagggtcaacagtatggtcctaaaacattgtgtttgcaagtctgaggatgtgctttttccaattttaaaagtagttagaaagtgaccagattctttcatgtaggggagaaatcttagcaggagacgttggttcttctgcttgtagtgccagccctaacctgacaggtcctgtggggacccctgtctcttcagagccctgagcctttttcccttctagttggactttgctgactagagagggatatcctatgtaggccacctgattacctgatttaatcagatggtacctctgttattttggagaagagagtctccttttgattctaatagctgaagataaaaatggctccgtatgctttcttcctgtggagggctctgctgccctgagctgcctgtgccctttacatctgtgtgagggggtggaggaatgtcctggcctcctcacttccatcctgctatgggcttccaggaagaatggggtccattgtgggctgtacccaaaggcacagtcctctgcctcagtgtcaggcttactgtggtctctgtgcccagtttgctgtggtcactgggtgccaaggggttgggagctcaagaagccattgctgcttttttttttttttttgagacggagtcttgctcttgtcacccagcctggagtgcaatggcacgatctctgctcactgcaacctccgcctcccaggttcaagcaattctcctgcctcagcctcccgagtagctgggattacagatgcgcgccaccacattgggctaatttttgtatttttattgttattattttattttattttatttgagacggagtctcgctctgtcgcccaggctggagtgcagtagcttaatctcggctcactgcaagctccgcctcccgggttcatgccattctcctgcctcagcctccggagtagctgggactacaggcatctgccaccacgcctggctaatttttttgtatttttagtagagatggggtttcaccgtggtcttgatctcctgacctcgtgatctgcccgcctcaggctcccaaagtgctgggattacaggcgtgagccaccgcacccggccaaggacggagtgttgttctgtcgcccaggctggagtgcagtggtgcgatcttggctcactgcaaccttttggagacaaaaggcctttgttgtgtctggcctttatctttgttgtaatgaccctgaaaccgtggcctgagtctttgaggtggaagttgccctagaaatgtcatgtaatataccagaatttatcaagcctttctctagtactgggacacttaacatgtgcctgtggtacttttgtttgttttgctattatttcacatttaatttcatttttgtaaataaataattttgaagccaaattcagatttttcatctttatgtctacttaggttgcttagacctaatgtggtagatcaggttttgtttttgttttctttcttttttttttttttttttttttgagacaaggtctcactctgtcacccaagctagagtgcagtggcatgatcatggctcactgcagtctgaattcctgggcttaagcaatcctcctgcctcagccttctgcaaagctggaactacaggcatgtgccaccatgccagcctatttttttttccttttgtagatacatggtcttgttatgttgcccaggctagtctcaaactcctagcctcaggtgatcctctcatctcaaccttccaaagtggtgggattacaggtgtgaaccaccatgcccagcctgttttcttgttttgaatccaagctttctgagggttgtcctttaggaggagaatgtaaggaattccagagtcagggaggcatgggctgtgctctgggagaggcctggggaggcactgctctggaactgcctgtaggagtggtgtcagactgccagcagaagccagggtggtgaggggagggctgaatgttctgcaagagagatttataccactattttctttttcttttatttatttatttatttatttatttatttatttatttatttattttttgagacggagtcttgctctgtcgcccagactggagtgcagtggtactatctcggctcactgcaagctccgcctcccaggttcacgccattctcctgcctcagcctccctggtagctgggactataggcgcatgccaccacgcccggctaattttttgtatttttagtagagacagggtttcaccgtgttagccaggatggtctcgatctcctgaccttgtgatcctcccgcctcagtatcccgaagtgctgggattacaggcgtgagccaccgcgcccggccctttttcttttttttgagacagagtctcactctggagtgtagtggcatgatctcggctcactgcaagctccacctcgtgggttcaagtgattctcctaactcagcctcccaagtagctgggattacaggtgtgcatcaccacgcctggctaatttttatatttttagtagagacagggtttcaccctgttggccaggctggtctcgaactcctgacctcgggtgatctgcccacctcagcctcccaaagtgttgggattacaggcgtgagacactgcgctcagccggatatgaatattcttgacggtgtcttctgggtatatacctaagagtgaactgttagatatatagtatttgattttttttgtttgttttgttttgctttgtttttgagattcagtctcgctctgttgcccaggctggagtgcagtggtgtgatcttggctcactggatcctctgcctcccaggttgaagtgattttcctgtctcagcctaaccagtagctgggattacaggcgtgtgccatgcctggctaatttttgtatttttagtagtaatggggtttctctgtgttgcccagactgatctcgaactcctggattgctcaagcaatccacctgccttggcctcccaaagtgctgggattacaggtatgagccaccgtgcccggcctgatgttttaattattgagaattttgtattttttgtagagatggggttcttcctctttgcctaggcacacgactgtctatcccagatggctgcactggcctaggacagacggttcttcccccagtacgtcaagaccctggagggtgcaagctacagaacagctgggctcctgcattcctcccagaccctgtcttcagtaggacaacaggcaacaaacttaaatttggtaatatgaatttagaaaatgttaatgttttccagaacagtgaaactacaatataaaggttagacttgagaaccaaagttactctctagcttccctcttctgcccttcatgtgctcagcacttgtatctgtgttctcactacccctgagccctgagttcttctggggttggcccaggaggtgccttggttcagagagatacctgggaggaaaccacatggaatcaacaacagtactacatatttgttattatttggagtaattagccccatacattcttttttttttttttttttttgtttgagatgggatcttgctctgtcacccaggctggagtgcagtggcgtgatctcggctcactgcaacctccgcctcccgggttcaagcgattctcctgcctcggcctccccattagctgggactacaacaggctcccgccaccatacacggctaattttttgtgtttttcatagagacggggtttcaccatgttagccaggatggtctcgatctcctgacctcgtgatctgcccgcctcggcttcccaaagtgctgggaattcagacgtgagccaccacgcccggccagccccataaattcttgatagcaattttcctgaggtactcaagttttactagaaaaacatagcatcatgttttgattcattagttgtctagatgctcaccctcctgtattatcattctggctaactattaagtaccattactcccagattgaatttatgacacctgctgcccaccatgcccattaatcaaacaataagggcagggcaaactgctgtctcatgttgtttcaaactgccccacctccttcctcttccatcttatgttattaatgaaagagtttgacaatacttaaatgttagtgaaaataagagaaaagtcgtttgtatctttaggtgagggtgtaaattgaaggacattttgccaaatctaacaattccaatgtacatatcctttgacccagcaattccacatctaggattatatccttagatatgttctaagaagaatgcaaggatgagtgtgagaacaccctggagagcaagatatgcaagatacttagacatttagatgtgccacacacaataggtgtgaatgagaagaaggatctacccactggggctgaggtctctcagttctgctaaattagaaaaaggaacggttatttatttttttttttttgatagggattctcattctgtctcccatgctggagtgcagtggcgcggtcttggctcactgaaacctttgcttcccagggtcaagcgattcccctgcctcagcttcctgagtagctgggattacaggtgcgtgccactatgaccatctaattttttatatttttaatagagacggggtttcaccatgttggccaggctggccttgaactcctgaccttatgatctgcttgccaggtgtgagccactgtgcccggcaaaaaaggaacagttttgaagaatttgatttcatttgaactttaagaatgaaattaaaagagatgtgcttgtttatgtgtttagagatatacattcaatgtgtcatttgtggagagctactgaagaaactcagtctgctcacctgaggacctgggaaggagacctgcttttcatttgtgtcctagtgtggtgttggaatttattttacctccatgtgaattaccttttttttttttttgagacacagttttgctcttgttgcccaggctggagtgcaatggcgtgatcttggctcaccgcaacctctgcctcccggattcaagcgattctgcctcagcctcccgaatagctgggattacaggcatgtgccaccacgcctggctaattttgtattttcagtagaaaaggggtttctccatgttggtcgggctggtctcgaactcccgacctcaggtgatctgcccacctctgcctccagtagtgctgggattacaggtgtgagccaccgtgcctggcccttgaattacttttattgcattaagtcaaaggggaggaccagatagttgatgacatcattgtgagatagactgggaaccaatagtagggaatcggatactgggaaacactggatgcagcgtgcccacattttgcccttagctctggggacctcttaacttggtaatgatctgatttgggttttttttcctctaggagggaaggttcctgggaagggaagatagaatctatttttaatcttaagaaaacatagctcaatgtagtaattttgggccctagtgtgacattttcttccattataacccaagtcacttttaaaacaaaatcctttttttgtatattttgtgtttgtaatgtttctagaggaaaatgcttttaaagtatcctcacttcccttcgtaaacttgggagggcttgggacctggtggggtatgtgttttgaatcatgctgtctgggggattagtgcctggaatccagattcctactggacaaagcgctggggtttgaggtaagtggggtggggtagggggagggttatatagctgtcacagattacagagcttacctgctgactgcttcacaattgttggtacatacacctgctttggcatggacgtcctgagagggggcttggaccatgacccgtgttcctttctcttaccacttgtttttttccattttggctgggcgcggtggcttacgcctgtaatcccagcactttgggaggccgaggcagacggatcacgaggtcaggagatcgagactatcctggctaacacggtgaaaccccgtctctactaaaaatagaaaaaattactgaggtgtggtggcaggtacctgtagtcccagctacttgggcggctgaggcaggagaatgatgtggacccgggaggtggagcttgcagtgagccgagatcgcgccactgccctctagcctgggcgacagagtgagactctgtctcaaaaaaaaaaaagttttttttttttatataactttaaatttacagaaaaattgcaagaataattcaagaaactcccaaatactccatctagagtcaccatttgtttgcattttgctgtgtttgctctgtcattctcttttctatctatacctttttttctgaaccatctatgagtaattgacagaaatcatgcctctttattcctaatttttttattcttttattttttttttttgggacagggtcttgctctgtcacctaggttggagtgcagtgatgagatcttggcttattgccacctccgcctcccaagcttgagcgatcttcctgccttagcctcccgagtagctgagactgcaggtgcaggctaccatgctggcctaattttgtatttttttgtagagatggggtttcaccatgttgcccaggctggtctcaaactcatcagtgcaagctatctgcccttctcagcctcccaaagtgctgggattacagacatgagccacaacctggcctactcctaaattctttttttttttttttttttttttgagacggagtctcactctgttgtcttggttggagtgcagtggcacgatcttggctcactgcaacttctgcctcccaggttcaagcgattttcctgccacaatctccctgagtagctgggactacaggcgcgcactactacgcctggctaatttttgtactttagtagagacaggtttcgccatgttggccaggctggtctcgaactcctgacccaggtggtccgcctgcctcagccttccaaagtacaggcgtgagccaccacgcctggcatttttttctatttttaatagagatggggtcccactatgttgccggggctggtctcaaactcctgggtttaagtgatcctcctgcctcagcctcccgaaatgctgggattacaggtatgagccaccgctcccagccaagttgtttttttttttttttgagacagagtctcattctttcgcccaggttggaatgcagtggcgtgtttttggctcactgcagcctctgcctcctgggtcaagcagttctcctgcctcagcctcccaagtagcagggatcataggcacctgccactatgtcctgctattttttttttcttttttttgagacggagtcttgctatgttgcccaggctggagtgcagtggcgcgatcttgctcactgcaagctctgcctcccgggttcacgccattctcctgcctcagcctcccaagtagctgggactgcaggcgtccgccaacacgcctggctaattttttgtatttttagtagagatgtggtttcactgtgttagtcaggatggtctcgatctcctgacctcgtgatccgcccgcgtcggcctcccaaagtgctaggattacaggcgtgagccaccgcgcccggcctgtcctgctatttttgtatttttagtagagacggggtttcgccacattggccagtctggtctcaaactcctgacctcaagtgatcctcccgccttggcctcccagagtactgggattacaggcgtgagctgcctcgcctggccccaagtctattcttttttnnnnnnnnnnnnnnnnnnnnnnnnnnnnnnnnnnnnnnnnnnnnnnnnnnnnnnnnnnnnnnnnnnnnnnnnnnnctggagtgcagtggtgagatctcgggctccctgcgacctctgcctcccgggttcaagcaattcttctgcctcagcctcctgaataactgggattataggcatgggccaccaagcccagctaatttttgtatttttagtagagacagggtttcaccatgttggtcaggctgttctcgaactcctggccttgtgatcttcctgccttggcctcctaaagtgctgggattacaggcgtgagccaccgtaccccgcctggctccaagtctattcttaagaccacagaacttttgatttaagattcactggacagatacataacaatacataaaataaatgttttatttacaaaataagacctttaagtagttagctgccagttgaaataatgatttggactggatgtggtggtttatgcctgtaatcccagcattttaggaggctgaggtgggagaattgcttgagcctaggaatttgagaccagcctgggcaacgtggtaaggccccatctctacaaaagataaaaaattagccaagtgtggtggtgccatgtttgtaatcccagctatttgggaggctgaggtaggaggatcaattgagcctgggagggtgaggctgcagtgagccatcatcgtgtcattgcactccagcccaggtaacagagtgagaccctgcatctttaaaggaaaatttaaaaagagataaatgcaggagatcttccatcttatcaaaagggtgctgttataatttatatatttttaagtactggatggggaggtggagtagcagctccaaggtacttttcagtggtggccttaatctgctgatgcatggaaggtgtgttcttcttccagatagccctgggatctcctgaatttccaggttgggctactcaggcatggattgactcctacagttcaggcggatggagatcccaccaacccacagcttaattcttcagatgctttatcttcatttctcatgtatcttcagttggcttctaatgtgagcacataaatgccctgcagaatttctttcccatctttgtgcaaatcattatttttattccttttttttttttttttttttttttgagacgacagggtcttgctcagtcacccaggcgggagtgcagtggcatgatcatggctcactgcaacctcaacctcccaggctcaagcgatcctcccacctcagtagctgagtagctcagattataggcatgcgtcaccacactcagccaattttttcatattttgtagagacagagtctccctgtgttgcccaggctgatttcaaactcctgggctcgagcaatccatcaaccttagcctaccaaagtgctaggattacaggcatgaaccactgtgccttgcctgcttttcatttttaatccttgggttctaaaatgcaagaattaatttccaaataattagtatggaatggaatcccactttttcctgtgtgctgagagaatgatcaaagatcacagaaaagagatggagacagaagaagctgagagcaagggcatctttaaggatttcttcagtcttgttaatctgggtgtaaattctgtgtggctgacagcctctgaggatcccttgaagttttgaggaggaggaaagcgcttgagagtaatgggtttacttgattttactttgtatagaagagcctgaactggacatatctccaggtatgtgctgtggtctttaacaagcagcccaacatcctttgctggggaaggccagcaatgtgggagctagtggggcctagcccaggagccttgcgttcaccaggtcactgggaactggtgctttctgatgcacctctatgcaagcctgattctgaagtcagatgtggtgggcatccctgtccatagtgttggcctggcccaccatttcactggtcatagaatggctgtagctttgcagagcagggattgcgagaatggaagaatgtcttttggctcttctgctctagcttttggaagtacgtcagagaagtttgtgattttttagaatttgtagctgtggcaaggctgaagcaggtaaaagggccaattagaaccatctgtgggagggaaggaattctgttagcaggaaggaaaacctgagcaaagggagtgggtggtagttttgtcttgttcttttataaacacagtgtgttgatatggcagttcctggcatgggtgaaatatttttgatggttgagcattaagaatgtagccaaaaacaagaatgtggctaaaagcaagtcaccactttaaacactgaagattgaagcatttgcctagataaatattctgcagtgaatatgccagaattcccacatacctgtttggctcctgaggcattgtgcttagggtcccaggcctttattacagggctgctggcagggtcaagggctgggttgcctggagcttccctgacatttcgcctcactcctctgttttggagtctaattggccaattaggtcagaaaggccaccagccagcacactttttctaaatttaattcatcattgctagattagcatattaattttgagctatggcacttatttttaatctttcgtagtgtaatggaaaaaataccagaaagctcagcattgaacttcaaagtgtgaaatcaagtgatcattgcctttatgcttggtgaattattattattatttttttttttttggagacagagtcttgcactgtcatccaggctggagtgcagtggcgtgatcttggctcactgcaacctccgcctcacaggttcaaacgattctcctgcctcagcttcccgagtagctgggactacaggtgcctgccaccacgcccagctaatttttgtatttttagtagagacggggtttcaccatgttagccaggatggtctcgatctcttgaccttgtgatccacccgcctcagcctcccaaagtgctgggattacaggtgtgagccaccggcgcttggctgcttggggaattatttaggggatttagtggaatttcctttcctgtactctgtgggcatctgctgagtacctgcttggtgccaggcatctactgggagagaaagcagcagagtcaatgctgtcaagacccctgcagtggacctcttctcccccttttctctcaagggaaccattggcatccagccttgacccccagtagacactgatcatccagcccccacagggtagccccactgtacctttgtactgagttggtgaggggatgggatagccagggggagtttggggaagtcagaaggcaactttcagtttctattagagtaagcacttggaaaatgtctgtttataatgtattagtataaatacttggtttgttaccacttgtgtttcctgatttagtaatgtatataaatcttaattgaatatttttgtgtgaaacttggaaagactgcatctatagcaaataaagcctcacacctagcacagggtaggtagttggtaaacatgtgctgaagtgttaattgttgggctgtcttcagagaattgtagtttgctttaattgcattttttgatgcaacgcgggtgcaagggtgtggtaattcattcccacttggattctgctgaggctggccacccacctctcagacttattcccccaccacctctccacctcctactctagctgctgcagccaaatggacagttagggccgggcacagtggctcatggctgtaatcccagcactttgggaggctgaggcgagcggatcacaatgtcaggagttcgagaccagcctggccaatacggtgaaaccctgtctgtactacaaatacaaaaattagctgggcgtggtggcaggcacctgtaaccccagctactcaggaggctgaggcaggagaattgcttgaacccggaaggcagagtttgcagtgagccgagatcgtgccacttgcactccagcctgggcgacagagcgagactccgtctcaaaaaaacaaaaacaaaaacaaaaaaacagaaaaaaaaaaaccccaaatggatggtttggcctggtccttatctttggcctcagtttatccttttctgtcttcagtgtcttacctgggcactggtgattaaagtactggaccatgtcatcacggggatatgcccctaaaagcctcctaaagtattttcttctgaagtctaattggtgtaactaagtaatgttttctaaaatattgtggcaaaatatacataacataaagatggtgtatttatttatttattttgctttgtcacccaggctggagcacagtggtggagtcatggctcatggcagcctcaaccttcccaggctcaagcagtcctcccacctcaggccaagtagctgggactacaggtccatgcctacgtacttggccaattttttaaatttttaactttttttttttttttttttttgaggatggagtctcactctgtcgcccagcactggagtgcagtggcgcgatctcggctcaccacaacctccacctcccaggttcaagcaattctgctgccttagcctcctgagtagctgggattacaggcgtgtgccactgcgcctggctaatttttttttgtatttttagtagagacagggtttcaccatattggccaggctggtcttgaactcctgaccttgtgatccgcctgccttggcctcccagagtgctgggattacaggcatgagccactgtgcccggcctaaatttttttttctttttttttttggcacaatctcggctcactgcaacctctacctcccaagttcaagcagttctcctgtgtcagcctcctgagtagctgggactacaggcatgcaccacaacacccagctaatttttgtatttttagtagagatggggtttcaccatgttggccaggatggtctccatctcttgatctcgtgatccacccacctcggcctcccaaagtgttgggattataggtgtgagccactatgcctggcctaaatttttttttgtagagatgggggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaaaattaaaaaatgagccaggcatggtgctgtgaaccagtagtcccagttgtgggaggctgaggcagaaggatcacttgagcccaggagtttgaggttacagtgagctattactgtaccactgtactccaccctgggggatagattgagagactgtctctcaaaaaaaaaataaaaataaccccaaacccacctttttaaattgtgaaaaacacaatataaaacttaactatcttcaaagtcaagtatactgttcggtaataaataatgtttaacgcagtgtatggacttcagtggaatgtagaaggaattctttcagtgagccccattacgtaccatgttaaaatctactcagattaaaagccatggttcagtggagaatgactgttctgggttttgaaccttgcttttcttccctttccctagaacatgtctgcacctgggtggatttatacctaggttttaaacctttgcttctgtctttgttggaaaaaaccaaaccaccgccagcagaagccactgccctttgtttatctgtgataagtgagaatttgtaagaattttccaagtgagagaagtgttcaaagtagcttttatgtttgatagaatgtgtagtgcttgcctctcaggggtggtattttttctcccacgtatttttacctttaaatctcttgctgtatatgtgaccctggctccctttggttggtcctccagctccctgatggtcctggggctccctccatatcactggtggtatttccacattgcctgcagtttaggtaggaacctgtcccatgtcagggaaaccctatctgtcccctgaactgagcacttttaattttagggtgataccttgaatcttcaccagtcacttgacttcagacctttctcatctgacgccaaggagtcaaaaaggcctgtttttaactagaagcagagacatttgccatttttttttttaatatttggagctcaaataaacaatgacttcacaccactgttttccactgtgttgagtacatcctgttggccatgatattgagcagttttaaactggttaacctttcagaaactttatattaatgttggactgacagttaatatttaacttgtcaaagtgatttttgctagattgaacctgaagtggttaatatttctgctttttatgttttccaaaaccatttaaaataggaacatggtattttattattttaatctggtttcaaaatgaatatcccattttctttattattattattattaattaattttttttttttgagataggttcttgctgtgtcacccaggctggagtgcagtgttgtaatctcactgcaatctcaccatcctgggttcaagcagttcattcacctcagcctcccaagtagctgtgattacaggcatgcgccaccatgcctggctgaactttgtacttttttgtagaaacagggttttgccacgttgcccaggctggtcttgaagtcctcagctcaagcaatctgcccacctcggcctcccagagtactgggattctaggtgtgtgccactgcacctggccattccttaaatgttttaatgactgtggcaaatgatagcaatttaacagcttaactactatttttaggtagcgtagctatttgggagtaggggctcctaggagtggtgggatgggctacctctgccaaattttgtgtggttaataatgggttgagtctcccaacttttcttttattcttgggaagcaaaaactaatagagagctgttctttcagagtttttaggttaagatgtgtgaaagtttcagagccgggtacagtggcctgtgcctgtagtctcctatttgggaggccgaggcaggaggatcactggggagttcaaggctggtgagctataattgtttctgtgaatagccactgcacactagcctgggcaacatagtgagaccctgtcttaaaactaaaaacagaggtacttaaaaaaatatatatctgaaagtttcattcactgtgagtttttctatggatgaggaaacattaagtttatggcaaattgagttggtgccccatgtgcatttgttcttcacatctgttgagtggaaagcatttattaactgagttccctgtgtgcgtgggcactcatagctctggggaggcagcctgagtggaacagagccgcctgttccataaggctgtctggacagaatggggtcataagggcctggctcctcatgggcatctcccctttcctcccaccaagcaacatcctttggttgcatcttcctgggggatggtattggtggtggtgatgggaggggccagtgggatccttacctgctgaaccttacccttggatgcctggtgtccttgccagttactgtataatgtttttgatttcctagttatatccctgatgactgatctgataaactttaaatatacctgcctctagggtagctttaatatattttggctacaaaggtcactaccttttaggtattattgataacttgacattttacttcttcttctttttttttttttttgagacagaatcttgctctgtcgcccagtctggagtgcactggtgtgatcttggctcactgtagcctccgcttcccgggttcaagcaattttcctgtctcagccctcccgagtagctgggattataggtgtccgccaccatgcccgactaatttttgtatttttagtagagatggggtttcaccatgttggccgggctggtcttgaactcctgacctcgtgatctgcccgcctcagcctccaaagtgctggtattacaggcgtgagccactgcacctacctggcctgacattttacttctgcccatcacttgagagtcccacatatcacaactgggaggaagggagtgcctggtcattggcagatgcgagccacttactggccctaccccaactagctctggttcttctggctgagggtgtttatctgcagtgagtctcagggtctggggtctggggcagtgctgagagcttagactcagttgtgggtactgcactgggtgctggcacagaggaataaggttcccattcccactactcgaaaaagagcttctgtagctcctgtcagccagtggtgaatccagctaagacatgttcttgggctgccttgagcacttcctactctcttttagaggatataatgtgaatgagtgtgaggtgttaaattgggtagctgtgtcaggaagactaggtggctgtggccagaatcttgccagaatctttctgtggttcccaagcactcttttctcccacaagttctggccaccaagctgtatgtgaccacgactgagtatttacctctgtttggaccttggtctctgaaccacgaggaggaggatctctgtagcgtctctatctgaatgactgagtgtatgagtatgagactgtgtaaaaaaaacttccagagggacattctgatacaagtatatggatgcagcctatcagattcctagcacaggcagacatgacccttgcttataggaagccagcatcagaaagacaaaagggtgttttattaccaagttgcaaaaaatttttctccttagagcatggaaaaccaacacatagtagttggagttgtgccctgaacatcgcctgcctgctaaatgcagagcacttagtcatgcccatgaaacagacaccccatgtcgtcatgtgtccgcagatagcagacagcttaagttcctggtagggcagggtgtgtctcataactgactgtttttaaataagctgagaattttaaaattgagaatgagattggaatagtgaaagatcagctggatctaataagtgaagtaaagactaaagatgatgggaagaacctgaaaaaaaggtcctgtgtctccccattcattcattaggtgtatggtgtatgtctggcactggatgagtgctgggcacatattagtgattgcaacagatgtatccctgctctcccacaacttatagtcttgtgggggtgttggttgagctgagccatttactaaattagaattaaaatgcgtctgggcatggtggctcatacctgtaatcccagcactttgggaggccgaggtgggcagatcacccgaggtcaggagttcaagaccagcctggccaacatggcgaaactctgtctccactaaaaaatacaaaaattagccaagcgtggtggcaggtgcttgtagtcccagctacttgggaggctgaggcagggagaattgcttgaacccgggaggcagaggttgcagtgagccgagatcatgccactgtactccagcccgggtgacagagtgagactccctctccaaaaaaaaaaaaaaggattaaaatgcataagaaaggaaaaggccagtaaagaaaacactatgcaacagtaaagaaaactgtaggccaagcacagtggctcacgcctgttcccaacactttgggaggccaaggcaggaggattgcttgagcccatgagtttgaaaccagcctgggtaatatagtctgtatctcttcaacaaaatttacaaattagcctggtgtggtggcgcacacctgtagttccagctacttgagaggctgataggaggttttcttgagcccagaggttgaggctgcagtgagctgtgattacaccatttccagcctgggtgaccaaaaaaccaaaacaaaaactacacagaaaagagttgaagaaaaaccttcaacttggagcactttatagagatctgaggagaagaccctcaccagagtactgggactgctggttgttgagaaggagttcctggtggaggacccctcagacatcactggaagttaaatggttcttggaactgatgcccatagggctcctccatctatgtacatggtcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgggattacaggtgcctgccaccacacccggctaatttttgtatttgtatttgtttgtgtatatgtatgtatgtgttgtttttgagacagggtcttgctctgtcacccaggctagagtgcagtggtgcagtctccgctcactgcaacctctgcctaccaggttcaagggattctcctgcctcagcctcctaagtagctgcgacttcaggcgtgcaccaccacgcctggctaattttttgtatttgtagtagagacggggtttcaccatgttggccaggctggtcttgaactcctgacgtcaggtgatctgcctgccttggcctcccaaagtgctagggttacaggcgtgagccaccatgcctggcatgtatttttagtagagacaagatttcaccatgctggccaggctggtcttgaactcctgacttcaagtgaacctcctgtctcagcctcccaaagtgctgggattacaggcatgagccactgcacccgcccgccaggcctcaaagtatttttctaagcctcattgttacagttgccacatgaatgtatctctatatatacatgtatacattttttttctttgaatcattttgaagtgagttgcagagtgtttgacacttcatccctaagtacttcaaaatacaattcataagattgaggatgattccctatagagtcttactaccatcatatcacctaagaaaaataacagtaaatcccatttccagtttacatgcaaaattcctcaattacccctttgggagctggactcatgggtttttttaaaaagtaaatccagaatccagtcaagagatacacattgtctgggcaagattgcttacctttctaatcctgggagactgaggtgagaggatcacttgaggccaagagtttgaggccagcctgggcagcatagtgggacactgtctgtacaaaagatttttaaaaactagctgagtggagtggtgtgcacctgaagtcccagctatttacttgagcccaggagttcaaggttacattgagctatgaacatgacactgtactctatcctgggccacagagcaagaaccttctctgtccccactcccctacccctagaaagatacacacatcaagtctggttgctgtctctaaatcgagaacagtcatcttatgtttagggatgtcagcatttggagagaccaggccagttgtttggcagaagatcccacattctagatttgtgtgattttctttgcatagctcccatatttcctgtaaattggaagttaggtctaaagcagtgccacccaacagaaatataacatgagccacatatgtcacttaaattttcctggtagccacatgaagaaaagcagattaaattaatttcaatcatatattttacttaatattttattgtttttttttgaggtcgagtctcactctgtcacccaggctggagtgcagtggtgcaatctcggctcactgcaacctccacctcccgggttcaagtgattctcttgcctcagcttcctcagtagctgggattacaggcacccaccaccatgcccggctaattttcatatttttagtagagatgggattttaccatgttggccaggctggtttcaaactccttacctcaagtcatccacccaccctagtctcccaagatgccaggatcataggcgtgagccacggtgcccgtcttgtttaatacatttctttattatttattctttgttaatacttattgtttacttaatatattttattgaatgtatctgactgtattcaaaatattactaatacatatcatttcagtttgcaatcaatattttaaaagtattaatgaggcattttacattcattttttatgaagttttcaaaatccagtgtatattttatatttaatggatcagctacatttccagtgctaaggagttgcacgaaactgttggtttctgtataagagaccatgggggtaagaggcttgatccaactcggggtagatgtttttgacagtaactcctggaggatagtatgtgactgaaccactggaattgctcaagtctaaacctgcttttctttttttttcaggctctgtgtgctccgggatggagcaggtgtgcagagggtgagaacccagctctgggaccaagtcacttgcttccttacttagcaagactatcgacttgagcaaacttggacctgggatgaggatgtctgtgggcctctcgctgctgctgcccctctgggggaggacctttctcctcctgctctctgtggttatggctcagtcccactggcccagtgaaccctcagaggctgtcagggactgggaaaaccagcttgaggcatccatgcactcagtgctctcagacctccacgaggctgttcccacagtggttggcattcctgatggcacggctgtcgtcgggcgctcatttcgagtgaccattccaacagatttgattgcctccagtggagatatcatcaaggtgagactggatataaagcataaatgaggaagagttctcatcttccattttagttttggtggcttttccttttcaagtctaagcttcaccaattctgagctcagttcttccagtacccccttagaagagggacagccactgatgttcataagagaatccctatatactcagaatagcatcctaaactgtattcttgttcctattctgagggcatcaccatgtaatagcctttactctggaagttctactgaacactgatttagggatttgttggaaaggtctgtcacgtgtatagggaaaggttacctttaataaaacacagagttaaaccccaaaaaataggacttttatgctttgaacttactttttaaaataagatataaataaatataggagttctgctctgatttgctgatgtatgttggctaatgtaattgatcacttaagaaccaaaattagtacccaaacttcagccttgccccatatcctttggagaagccatccagagaacaatggaatctgaggcccgtgtagagaagagtgtcttggttgacccaggatagaaatcaggtgaaataggaagcttttgtgtgatgaagcaccatctctctgtctgagtttgtggaaccatggaatttcccctagatcttaaatgagtttgtttcatggacaggtgggtgggatgtacccctcaagttatgaacatcttctagagcagaagtcagcacacttcacccaagctggagtgcactggcatgatcatgtctcactgtagccttgacctcccaggctcaagtgatcctcccacctcagcctcccaagtagctgggactataagcacatatcagcacacctggctaatttttgtactttttgtagagatagggttttgtcatgttgctcaagctagtcttgaactcctgagctcaagccatcttcctgccttggcctcccaaagtgctgggattgcaggcatgcaccactgcaccaagctccaggcagtaaatattttaggctttgcaggccatatggtttctgtcagaactcctcgactctgcctgtgtagtgttaaagtagcctttacaatatataaatcaatgggcaataaaactttacggtggatactttttcttttttaattttttacacttatagtcccattctgacttgaaacagatttttgaatttcatatgtcaagaaagaaatattcttttacaatttttttttttgaggcagggtcttgctctgttgttcaggctggagtgcagtggtacagccatggctctctgcagccttaacctcccaggcttaagccttcttccctcttcagcctcccaagtagctgggactacaggtgtgcaccaccacacccagctaatttatttatttatttatttttgagacagagtttcgctcttgtcgcccaggctggagtgcaatggcacaatcttggctcactgcaacctccgcctcctgggttcaagtgattctcctgcctcagcctcctcagtagctaggattacaggcgcacgtcaccacgcccagctaatttttaaattttaatttattttaattaattaattaattttgagatgaagtctctctctgtcacccaagctggaatgcaatgacacaatctcagctcactgcaacctccatctcccagattcaagtgattctcctgcctcagcctcccaagtagctgggattacaggtgcgcaccaccatgcccggctaatttttgtatttttagtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatacatttagtgctctggctttctgttggtgtgtttaaaccaccaaaacagtggtttaactcaaccagcttgttttactcaacattttttggccaggaattcagagataaggaaccttatctctgtttcacatggtactaggtagagtggctcacctggggctggggaattcacttctaagttggctcattcatggctggcaagttgatgctgcctgttgacagggagcttagctggggctgttggtcagtgtccttgattcctcttcatgtagacctctccatgggctgcttaggtgtcctcaaagcacgatagatggattttaagattaggtatttcgagaaataggaaaggaagctgcccaatctcttaaggcccagaacttgcccaacaacacttccattttactccattggtcaaagcacatatagactctgatgggtgtttaccagcttgcccccgtgacccgtaagccccagccttctagattagaaatggccacaagttctatgccactctttccttgcagaggtgagtctgtgcccttttccctgaatctgggtggacctccccttcagcctgctcccttcttgtgttcgcctccttttccctgttggtcaccttctttttaagccgtggcttgttctcagagtgaccttgtggtctctggggcaaccgtatttctgaagatcttggcccatgtagcagctcacatgtagcagttcacagagctcttcctagtttgcagagtgtttgcataaagtttccttgtcatctttgtaatatcccagcaagctagatgctaatctgaccattagatacagagtggtggctctggaaggtacatttcttgctcagcttcagatttaatcctgaatatccataccctgcattggttgcctttgttccagtagccattggaatgttttacgtggattaatcttggccagaagtgccttgaactgatacagcaaactagatatttgttgtatttggcagagagatgtttaacaggcttatttaccaagggggtgaagagattttactgagaaaacaggattttatctgagcatatttatctgtggaaagcagaccatttagtagctgatgagcttgtagaaaaacagatgaagatgtgtgactcttcgttccagtcttaaccaccgggattatatgggttggggagtcagaaggtcagaaagcctgatcttgttcctagagctttggtttctgcatctgtaaagcaggatttagaaagtctttatattaaaggaatttttttcttattataataatgatgcataaatgtacattgtggaaaatatagaaagggaaaaaaaatctgtggtttctaccattcagagtgaagtcctctaccgttttctatgctcatcaagagatggtcatgccacatacacacacagacgtcttaacatattagacagacctaggatcatagtggatatattttttaaccttttttttttgagacagagtctcactttgttgcccaggctggagtgcagtggcacagtcccggctcactgcaacctccacctcccgggttcaaatgattctcctgcctccgtctcccgagtagctgggactacaggcatgcgctaccacacctggctaatttttgtgtttttttggggggatggagtttcgctcttgtcgcccaggatggagtacaatggcgtgatcttggcctactgcaacctccgcctcccgggttcaagcgattctcctgcctcagcctcctgagtagctgggactataggcttgaaccaccactcctggcatatgtgtgtgtgtgtgtgtgtgtgtgtgtgtgtacacatacatagacacacacacacatatatatatattttttgagatggaatcttgctctttcgtccaggctggaatgcagtggcgtgatctcagctcagtgcaacctccgcctcctgggttcaggctattcttctgcctcagcctcctgaatagctgggactacaggcatgcgccaccacacccggctagggtttcaccatattggccagactggtctcaaactcctgacctcgtgatccgcccaccttggcctcccaaagtgctggggttacaggggtgagccaccttgcccagcccacgttttgtatttttagtagagatggggtttcaccatgttggccaggctggtatcaaactcctgacctcaggtgatctgcctgcctcggcctcccaacgtgctgggattacaggaatgagccactgtcccgggcctattttttttttttttttaacatttttcattcactgtagcttgagtatttttttacctgtagtcattaaatgttatgtgggaatgtaacttttaatggctgcctaatattcttgtgttgttttttttttttttttgagacagggtcttgctctgttgcccaggctggagtgcagtggcactatcatggctcactgcagcctccacctcctagcttaagcaatcctctcacctcagccttccaagtaactgggactataggtgtgggccaccacacccaggtaatttttaaatttttttgtagagatgggtctcactttgttgcccaggccggtcttgaactcctaggctcaagtgatcctactgcctcagcctcccaaagtgctaggattacagacatgagcatcacgcccagcctgcccactattcttgagtgtgtgaggaacatttcagatattggtcctaaggatgcttgttgaggcgaccccagtcatcttgggcccactggtactgcccttcatccaagctactgcttgcttacttcttcctaggctccccctgcctttgttcttgacctctcaatttgttctccatattgagtcaagagatgtctttatctttctaaagcttaaatctattcaaaatccctttttactgagctgcaccaagaatcgaaccccatatgatctggcctgtgacctcctctcccacatctttttctttgtatactttgtcccagccacactggtccttttctgcccagtgaacacacctagcttagggtccaccccaagcttttgattctttcttcttttgtcatgggtacagccatatctttcaggctcaacttggacatcatctgttggagccctttccttccaccctggtaaaagcagctttcccacaaaactctgtgtcatcttcttcttagcagatttctgtatttgaaattcttgttttttgttagtcatgtttgccttccatcacatagtaggccctcaaatgtttgtaggctggcaaagggaatgaggactcatttagcacctgcaaacctgttttggattgtcaaagcctgccttgctgtatgcagggagaaatgctagcctgtgctggggcagcaagagactaagttcacctgctgccccacagtgtactatggtcttgccgtgttttgaggcctcaggccctgtgacacacacactttcaaatgacttcttgttgtattttcacattggaaagtggccccaccctgtccctctaacacttgactgtgtgtttattgatccattattagtacaaactcactgtttcctaatattcaatagtttattgctcatcttaattattgtggtgttcaaattgtcccagatttgaccattgggagcccctttaagttggttcctgtattcttgtgatatgcccctgtcaatcattaagtgcttccttactttctgggataagatgctccaggcctgtcttgtattcaccctccctcagccatttcttcaaggagcctgattcctttttgtggtgaatgttattgggggttcagatctgggtgctaggtgagttcattgccactgggatttccttgcttctttgagccgttcagcagatagtgtggctccatttttagatgacaaagtggtagctaagtgacttatctcggagcacatagcttgtagggacagagttagtttgtagggagcacccaagaggcttttttttttttttttttttattgagacggagtctcgctctgtcgcccaggctggagtgcagtggtgctatctcggctcactgcaacctccgtctcccaggttcatgccattctcctgcctcagcctcctgagtagctgggactacaggtgcctgctaccatgcccggctaattttttgtatttttagtagagacggggtttcactgtgttagccaggatggtctcgatctcctgaccttgtggtccgcccgcctcggcctcccaaagtgctgggattacaggagagagccaccgcacccagcccccaagaggcttcttgagcctgtagtatataaggtcttatcttcaggtaactgacctgtgtttattttgtgtgtcagcatgctttggaattataatttaatgctttgttctagtcagttttagaagacttccctcgtagttgtctgttaccgtgcctctgacctctgacactgcagggctgtggaagagagagacacactgggtatgccttgacatggatggtgtcacatgtgatgagacgggtttgtacaacctgccatgcatgtgggcatctttgagccagagcagaagctgacctatcattgggcccaaaactgattgctaagtaaatggctggtttacagttctggcttttggaatgaaggctgcaggaccacaggtttggaagatcagggccaaccttgatgaaagtgaaaggagagtctgagtgaaaggtgatgtctggctggtaagctatcattgttccctgtgtagggttctagatacttggcataggacctgtttcgaagtagatgcctaattaaaggcttgctatgtgataaagcattaacagaggtggagcaacaacggtaagacatgtgggacagtggtgggttgcagagctccatgtggggaatttgagaagttgttgggagcacatggagttgggctcctcagcagagaaaggccagtgcccacatgtggcagggttgtcaatttgagtgaaagtaaatggagagagaagtgggtccgtaaggggcttttcaaaggctttcttccccaagtatcagaggaagaagaagctggtgaagaactgaggtaggaggtactgagcctggcctgcttcctcctaagccccatgtgggatgtccagatgagggttggtctatttgggcagggctgagttgccaaatgaagactcaggtggaacgtgatctgcatggtctgtcccaagacctggtgagattagatggcatagttgtcatacttgctgattggttaggggatatgcatgggggttgacggtagaataatccagtgtttatagcacacttagatgctggtctgttgaagggctagaaaattaagttctcattctaagtgagctgtgttgactgcctgaaaagcctggcctgacctgtgtgggcttctggttactttatttcaggaggttgtgctgcctggtgtcagtctgttgatatacccaacaaagcgcctgaagcaaatgcttcgctacattttatattggtgtatactttacacgtcagtctgcagggtcaggagaataaagaagggacctgcctgcgcagagggtatagccccaagatcctggctcttctgctctgccccacacctgacactccttcatgttctgacagctcttgtccagtctcagcctggccagcacttgttgcttaaccaatgctgttctccagttctgccttgagaattgatattctgttattgaccccagcttaactcacacatggactgctttgaccagacgtgtgagaaggggctatgggctccctcaaggtcctcatggccagcatagcttttttgagagacctgtgccatggggcccctgtctcctctcttgtggccttaggaaaccctaaagcagatagtcttgatgtttgctcccttgaatcagactggatgcctgtatacaaagctcagcccagctcttgactgtccttggctctcacagctacttttggagctgagaggaccctttctccttatcagggtctgtggggatgggtcccacagaagccaacctggccttcactcagtggatcctggcctgtcctgggctggcaacagtatgagccacccttgtctcccttgggtttggtgctggatccctgcaggcacctctcctctgacttgagtgtgggactggctgagaaatgtgattatatgccaggagatgttctaacctctcctcgaaggtggtcagggagagacatctttacatttcatgaaatgcccaggctgcccctcagatgtctcattttggtagagcctgcaaggatggcttttcatccctgcttccctttagccttcttgcctgcagacaatgtggaccttccctcagcccaagatgttggcaggctgggagcagcccttcctgggactgtgctctcagctgctggcacgggcccccaattgttcccctgagaacaatgggcactctctttggctaggaaggggagttcatgaaaggagcatttctttggatgcttgagagctttgtggcagccccgcctgtgtgagatgagctgcagtttcttcctgccttgagtgggtgttccgcatttctgaatggaccccttgtgaacaaagcacaccgggaaatgcgggttggcgatggaaggcatccttgggggtgggctgtcagaatggcatttgcccagattcatcaactcaaatacttagtgaaaatataggcttctatgtttaaaaaaatcactgacaaagactgaaagagaacatgacaaagtaaaatagatgatgtcagggctccagattgaaggactgattctgaggattttattagtggctctaactatgttaagctgccctttacttttttggggaaaaagactaatttttgcttttagatgagaacagtgaacatgagataaaatgctttgtagctcagaccagaagggcattgactgggctgaacagtgtgttcagtattgatcctgtggcgttggtgtttgtggcaggggccaggttctgctttgaggtttgcatgtctaacagcaggaccaatgatgatcccttgtgggtgtgactctgctaaggccgcatgtacttaacttccctcatgattttttacctcaggtggggacaaaggcctggccctctgaccttaagctagaggctcttcctgttggtctgtgccatctccctgcagcacagccatgtgactgcccatgttcctcattagcagaaggccacagagcagatttatctcattgtcttagtccatggcacagacacaggataaccctgagtgtgagtcagcaccaaggctgatactccatcagagggtccatctcctgcttccctgagcagaggacacacagtcagcttgcaatgaggaggccttgactgcctcatgtgggagtgcctccagggtgttgtctatggtacccagccatagatggctgcaggttggcccagctctgcagcctgactagggatgagggagctgaaaggtcgggaattgatgaccaggtctgaaggaaagcagggactttgccaacgcaggcctctgcaggtccagcattgggatgtcacggggcagcagtctgtatcactttgaaatggatctgttgggggacacggggaagggcccagcccacaccttaagggctgacatgtccagaggtattgatggaaggtgccaccaccaaggcccaaagttccctccaaaagatttgtagtgagaaggaatgctcaccaaatcagtttctcgattatgttattcttaggatccctctttactggccatcatcagctgtgaaagtgctcgtacatctgtctagagtctttgcttgccatttctaagtcctgcaactcctgcatggataagacatcatcttgtgggccctgaatgatacagcttgtgttttcttggtttcataagccaattataattatttggccctagagagagcctaattcttcagttttgtttttcagctatgcataactgactcagactatgggtggaaacctgcttttatgagaactaagtaatagaagctcctccagccatttgctctttcttcaggtgtggaatggtactggcttggggtgagagactttgcttgagtttcatggtgtttttttttgttttgtttttttgtttgtttttgttgttgttgttttttgagacagagtctcgctctttgcccaggctggagtgcagtggcgcgatctcggctcactgcaagctccgcctcctgggttcacgccattttcctgcctcagcctcccaagtagctgggactacaggcacccgccaccacacctggctaattttttttgtatttttagtagagacggggtttcaccgtgttagccaggatggtctcgatctcctgacctcgtgatccacccgcctcagcctcccaaagtgctgggattacaggcgtgagccactgcgcccggccgtctttgtttttttgagacaggtcttgctctgtcacccaggccaaggtgcggtggcgcaatcatagctcactgcagccttgacttccccaggctcaagcaggcttcccacctcagcctcctgagtagctgggaccaccacgcccagctaatttttcttttttgtaaagacgacgttttgccgtgttgcccaggctgatggtgtttagtgcctacaggtgctgtatctttatcaaagtcagtgtttgatggtctattgtgtgcagagggcatcagtaaagcagctggagggagtgtcccagagactgaggagtgaccaaaatgttcaaatttggcagttccctggtcattggtcatggtgatttattgtgggcatcacagttttagacctttgtttttttttttgagatggagtctcgctctgtcgcccaggctggagtgcggtggcacgatcttggctcactgcaatctccacctcccgggttcaagcaattctcctgcttcagcctcctaagtagctgggattacaggtgcgcaccaacatgcccggctaattttctttttactttattttatttttttttgagacaaagtctcactcttgtcccccaggctggagtgcaatggtgtgatctcggctcactgcaacttccgcctcccgggttcaagcaattctcctgcctcagcctcccaagtagctgggattacaggtgcctgccaccacacccagctaatttttttgtatttttagtagagatggggtttcaccatgttggccaggctggtcttgaactcctgacctcaggtgatccgctcacctcagcctcccaaactgctgggattacaggcgtgagccactgcgcctggcttttttttgtatttttagtagagatgggctttcaccatgttggccaggctgctcttgaactcctgacctcgtgatccacccgcttcggctcccgaagtgctgcgattgcaggcttgagccaccacgcccgcccccctcccaccccttttttttttttttaagactgcatcatggtatgttgcccaggctgggctcaactcctggcctcaagtgatcctcccgcctcagcctcctgagtagctggggttataggtgtgagccaccatgcccagctcagtctttggaactttttgtggatctgcccaggttttgtggttttgattcttaatgttttgggatgcactttgtgggtcaggatttcagaagctggttataggcttttcaagatctttttttccttaatgctagacttactttctatctcagaagcacatcgtctctaagggttgccgaaaccagaaagttttctggcctttttggtggcctgtgagctacagcctgtgatctccttaaatcaggctttcttgggcagtttctgcctcctgcagatgtgcctagtaactgtctgaaggcttctttcaagacagcaactgtaaggtcagcaggccttgcctctcccagctccaaggcagtgttggtgtttggtgttggctggtagagagacctgaaatgctggaggagttccacggtgggaccagcttgtcaccccaaactcatgtgcctctgtgcctctgctgctaaggacctcagagccccaattcctgcctcttttctgcccttcctggcctggcagcccttagaggattagttgtgggtggctgtggtatagtaggcagaaatctttataccaggcaaaccaaggactctaaggatagtcaaaatcccatgtgtaaatgtgccaggatctagtgcacccattttattaattatagagacaaagtctcactatgttgcccaggctggtcttgaacttctggcctcaaacaatcctctcgccttggcctcctagagtgctgggattacaggtgtgagccactgtgcctggcctagtccacctgttttaggttgaagaggtgaaagcaggtctttgggttctcacctgcagcaggtcccccacttcccccatgccccttagtgttttcatctacttctggtagacaagtgttgacaggcaactctctgagcttccccagcctcagctttgtttctctatatgattttggctccctcattgcctgttgcctccccacttaccttagatgctttgagcttctgttttgtggtatgaacagggagacaggaccccactgtgcactgggtccaaggtcagttgggaaggagaactagggagaggagcctggacatgccctgggcccctttgtgcagtagcctcaaattacttactggttcttctcagagcccatgggagccataggaaccattattggcagagtccatcatgtgcctggcactataatcatatgaggttgggattgtttccctgattttacagatgacactggggccaaggttgggtcaagcgccagccagcctggagctgggattcgcagtgaaagatgggccttctcatggagtagaagaatgaggattgttatccccattgttatggggatgagtcctggcttgtcattgggctgcatctgtgagaaggaactttcatatcctgtttcacccttaggatctgagaagaagagaagtgatccagagcctataagttttgaaagctgaggaggtatccagagttcccgtggactgagggcctcctgctttgttagggtagagcaggtgctttatcccctagcacctccgggatgagctaagccctgagctgagtccctttgggagggtggggctcctagtggaatcctttggggactgtggacactgccaaaccttcaggcatgttcagactttccaggtaggggctttccccaaatggccttgaaaatgcagaagtgccagtgtgcctgtgacttggccaggttccttgtggaaattaggtttgttttgcttcctgtagcccttctattaaaatgaatcatggctgggcacggtggctcacacctgtaatcccaacactttggcaggctgaggcaggaggatcactgaagcctaggagttcaagaccaatctggacaacataggaagacccatctctacaaaaaagtaaatattggccaggcctggttgtacacacctggctcaagtagtcccagctattcaagaggctgaggtgggatgatcacttcagcccaggagtttgaggttgcagtgagctgtgattgcaccactgcactccagtctggtgacagtgagtgagaccctggctcaaaaaaatgtatatttaagggctgggcatggtggcccacacctgtaatcccaggattttgggaggctgaggcaggaggattgcttgagcccagaagtttaaagccagtctgggcaatataatgagaccctgtctctacacacccacacacacaaaatacccgggcacgtgcctatgtcccagctacttgggaggctgaggtgggaggattgcttgagcctgggaggttgaggctgcaatgtgccatgatcacactactgaattccagcctaggcaacagagtgagacccttatatatacatatacatatatgtatataaagaatcattgccactcaaagtgctgcttgggcctgatgtcaccagtaccactcaaagtgctgcttgggcctgatgtcaccagtaccactcaaagtgctgcttgggcctgatgtcaccagtaccaagactggagatgcaggggttttagaacattcaggttagtactttttcttcctgagtagtacccatgatcgtggagtgactgcctgcttcagggctgtagatctagacacctgtcctgcagccaggtagtggccgggacttcaggaccctggggagccaaaatttgcagaggggaaagcaggtgactaggttggagagacttggctcttatattagtctgttcttgtggtgctataaagaaatacctgagactggtaatttatagagaaaagagttttaattggctcatggttctgcaggctatacagggaatatagtggcttctgcttctggggatgcctcaggaagcttccaatcatagtggaaagcaaagggagagctggcgcttcacacggctggccggaacaggaggaaggctgggggaggtgctacacacttttttttttttttttgagacggaatctcgctctgtcgcccaggctggagtgccgtggcgtgatctcggctcactgcaggctccgccccccgggttcactgccattctcctgcctcagcctcccgagtagctgggactacaggcgcccgccacctcgccccgctaattttttttatttttagtagagacggggtttcaccatgttagccaggatggtcttgatctcctgacctcgtgatccgcctgcctcagcctcccaaagtgctgggattacaggcgtgagccaccgcgctcggcctttttttttttgagatggagtttcactcatctgcccaggctggagtgaagtggtgcaatctcggctcacttcaacctccgccctctgggttcaagcgactctcctgcctcagcctctcgagtagctgggattataggcgcctgccagcatgcccagctaattttcgtatttttagtagagacagggtttcaccatgttgaccaggctggtcttgaactcctgaactcaagtgatccacccacctcagcctcccaaagtactaggattataggcgtgagcctctgctcccggcctacacacttttaaacaaccagatcttgtgagaactctgtcatgagaacagcactaggggggtggtactaaacgatccatgagaaatcacccccatgatccagtcccctcccccagaccccacctccaacactagggataataatttgacatgagatttgggcagtgacacagatgtgaaccatataagctctgtttttctgacatgacttgccccaaagacatgggtaaactttacatggctgcaaagccatgggtagacaatagtaaaagaatttggtcacgtgcagtggctcacaactgtaatcccagcactttgggaggctgaggcagccagatcactggaggccaggagtttgagaccagcctgggcaacatggcgaaatcccatctctaaaaaaagaaaaagaaaaaaaaaattagccgggcatagtggcagtcacctgtggtcccagctactcaggaggctgaagctggagaaacatttgaacccaggaagcagaggttacagtgaactgagatcgtgccactgcactccagcccaggtgacagagtgagactctgtctcaaaaaataaataaataaataaaattaaataaattgtgaaagaatttgttctcagtagtcaaaataaagctcatttctcatctcccatctcccaatttgaaattgagcattataacttgctttggtgaaacctgacgttttctttagtgtttattgtttgttacataatattaacatgtttttaagttacttggcatagttaaaataagtgtatggctttcaaggatggcttcgctgtgggagccttcctatagaatggcctgagtttgttctgtaggaactgcctgatagcagaactttggctgttggggtcagcagaataggaagtgagccaggctgggaagccttgagaaggcagggcccttctctattttctgttaaaaagtgcccttgtggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngccaggcgtggtggcgggcgcctgtagtcccagctacttgggaggctgaggcaggagaatggcgtgatcccgggaggcggagcttgcagtgagccgagatcacgcccctgcactccagcctgggtgatagagtgagacgctgtctaaaaaaaaaaagtgcccttgtatagttgaagacagacttggagaggcaacaggttgctgacttatcaacactgatggagcgcctagccactcaggaatgtcccatggttctagccagccatttggctcccttcttctagtccctctcaaccttgttcagtctcctctgcagttggcttctccttagttggctttacccagacctctattccaggccttccctgtcacctttcttcatcctccctctgccatgtgagctcgtgtcctactggtggccattgggatggagtagagttaggaaataaccctcaggtgaccaaaaaccggggtccacaccctaattcacctactctccacctctcaggacccctacttctatcccactcctgtaaaacatctcatgggccttacttatttgcttcatggtggttttttgtttgtttgtttttgcaaaacaagagcattcaacctttattttatgtgtttatatacggatgtggcagttttatttaatataaatgaactgaaaaatgtaaagcttagatttttcagccaaaacatttgaaatagtgtgatttttttttttttttttttttttttttgggacagagtctcactctgtcattcaggctggagtgcagtggtgtggtctccgctcactgcagcctctgtctcctgggttcaagccattcttgtgcatcagcctcccgactagctgggactacaggtgtgcaccaccatgcctggctaatttttgtgtttttagtagagacgggattttgccatgttggccaggctggtctcaaactcctgacttcaagtgatccacccgcctcaacctcccaaagtgctgggattacaggcatgagccaccacgcccagccaataagtgtgatttttatggttaaaaaatatttttaaagaaaaatatatttagcatttttcatgaatttgaagacacccatgtttacagatgttttaacatttctgatgtttgatggtgagtgacagggtgggagattcttaattagatgatggcacatcttagagttgatgcaatgtggtatcacaaaagaaacactatttgctaacccttaatgagtggctcagagagcaattaggaaatgataaccctgataataataacgccttttttttttttttttctgagatggagtctcactctgtcacccaggctgggttgcagtggcgtgatctcagttcactgcaacctccgcttcccaggttcaagcaattcttatgccttagcctcctgagtagctgggactacaggtgcctgccaccacatccgactaatttttgtacttttagtagagatggggtttcgccgtgttggccaggctggtctcgaactcctgacctcaggtgatctgcccaccttggcctcccaaagtgctgggattacaggggtgagccaccatgcctggcccaataataataattcctaacaatgtcagtaatctcatggttaaaaaaaattttttttttgaaatagagatgggggtctcactgtgttggccagggtggtctctaatgcctgctggcctcaagcaatcctcccgccttggcctcccaaagtactgggattataggtatgagctaccatgcccagctttctcatacatttttgctgggtgtaggaaacctgtttaaattagtttaaaggggggaaattatctagtttctgataaggctgctgcctggacacctgggtacaagcctggggtctcctttccaaatcactcaagtactttgttttttggcaggaggaagcccagggaaccagaggcactggggaatccagcagtcagtggctttagctttcctgccacagggagggggaagcattttagggtccccctattgataagcagtggtcatgaagggcagtcctaagctgagtctggcagtgtgatgtactgtgttttggccaatttgtctctggtacttgttataggacaatggagatgagagtgccttcaggccaaccagagaatggggggtgtcacttttcttgcattggggcaggagtaggtgtttcccaaaagtgaaaggagccacagatggggctggggcaagagctaagtcatattttcctcttgtcagctgttggtggaggtttctatggtggcatttccttgggtgctctgagtatgaccagttatatctctgtggaaagggacttccacaacaaaagaagtctgggagatgctgttgagttggaataaggtgatgagctccttaggcctgcttctgtgcctggtctctccaagggcagaagaggtctctgtgtatttcctgtacttgattgactgtagaacctctctcttttagagagaccagagctccttgggattcctttagtaagcactattctagaatagttgattctagtctctgctccctgggtaccacagtttgtcttgagatttgagaagcagggtaaatgaaaacattagatacaactaactctctttgctacacaaatgtgccccactacacttgaatgtaacgtgatgttgtaatgtgagtccttcagagcgttgagccttcccttgtacccagacctgtgtgcatctccactttggggcaggaatggtcctccaggccaggcatgtgacctgagcaaagatgtggtgtctgcagagggccggggagaagtctgaggcaagggtggaaaggaatgctgagggctggaatgtgacttgattcttcaggtagaatgggcaagtaggtggcagggcgtgtcactgttataaaatccacaacagtcgtgagctccatggcatcagttcttgggaatgagacatgtgcttgagtgccagcactgctgtctccccactgtgtggccttgggtgagatatttgcctcccaagttagcccatctcatagccctagtcttgtgacaggtaaataaactcagttgtgtctctctaggggagaggaatcagcttccccagcaggcattctgaattataccttaaacctgtcacacaattcaggttaactgttgtgatcatattcaggttatgcagtgacaatagtatttttaatttatgcttgtgtctcttctaggtatcagcggcagggaaggaggctttgccatcttggctgcactgggactcacagagccacaccctggagggcctcccccttgacactgataagggtgtgcattacatttcagtgagcgctacacggctgggggccaacgggagccacatcccccagacctccagtgtgttctccatcgaggtctaccctgaagaccacagtgagctgcagtcggtgaggacagcctccccagaccctggtgaggtggtatcatctgcctgtgctgcggatgaacctgtgactgttttgacggtgattttggatgccgacctcaccaagatgaccccaaagcaaaggattgacctcctgcacaggatgcggagcttctcagaagtagagcttcacaacatgaaattagtgccggtggtgaataacagactatttgacatgtcggccttcatggctggcccgggaaatgcaaaaaaggtggtggagaatggggcccttctctcctggaagctgggctgctccctgaaccagaacagtgtgcctgacattcatggtgtagaggcccctgccagggagggcgcaatgtctgctcagcttggctaccctgtggtgggttggcacatcgccaataagaagccccctcttcccaaacgcgtccggaggcagatccatgctacacccacacctgtcactgccattgggcccccaaccacggctatccaggagcccccatccaggatcgtgccaacccccacatctccagccattgctcctccaacagagaccatggctcctccagtcagggatcctgttcctgggaaacccacggtcaccatccggactcgaggcgccattattcaaaccccaaccctaggccccatccagcctactcgggtgtcagaagctggcaccacagttcctggccagattcgcccaacgatgaccattcctggctatgtggagcctactgcagttgctacccctcccacaaccaccaccaagaagccacgagtatccacaccaaaaccagcaacgccttcaactgactccaccaccaccacgactcgcaggccaaccaagaaaccacggacaccccggccagtgccccgggtcaccaccaaagtttccatcaccagattggaaactgcctcaccgcctactcgtattcgcaccaccaccagtggagtgccccgtggcggagaacccaaccagcgcccagagctcaagaaccatattgacagggtagatgcctgggttggcacctactttgaggtgaagatcccgtcagacactttctatgaccatgaggacaccaccactgacaagctgaagctgaccctgaaactgcgggagcagcagctggtgggcgagaagtcctgggtacagttcaacagcaacagccagctcatgtatggccttcccgacagcagccacgtgggcaaacacgagtatttcatgcatgccacagacaaggggggcctgtcggctgtggatgccttcgagatccacgtccacaggcgcccccaaggggatagggctcctgcaaggttcaaggccaagtttgtgggtgacccggcactggtgttgaatgacatccacaagaagattgccttggtaaagaaactggccttcgcctttggagaccgaaactgtagcaccatcaccctgcagaatatcacccggggctccatcgtggtggaatggaccaacaacacactgcccttggagccctgccccaaggagcagatcgctgggctgagccgccggatcgctgaggatgatggaaaacctcggcctgccttctccaacgccctagagcctgactttaaggccacaagcatcactgtgacgggctctggcagttgtcggcacctacagtttatccctgtggtaccacccaggagagtgccctcagaggcgccgcccacagaagtgcctgacagggaccctgagaagagcagtgaggatgatgtctacctgcacacagtcattccggccgtggtggtcgcagccatcctgctcattgctggcatcattgccatgatctgctaccgcaagaagcggaagggcaagcttacccttgaggaccaggccaccttcatcaagaagggggtgcctatcatctttgcagacgaactggacgactccaagcccccaccctcctccagcatgccactcattctgcaggaggagaaggctcccctaccccctcctgagtaccccaaccagagtgtgcccgagaccactcctctgaaccaggacaccatgggagagtacacgcccctgcgggatgaggatcccaatgcgcctccctaccagcccccaccgcccttcacagcacccatggagggcaagggctcccgtcccaagaacatgaccccataccggtcacctcctccctatgtcccaccttaacccgcaagcgcctgggtggaggcagggtagggcaggggcctggagacgacatggtgttgtctgtggagaccggtggcctgcagaccattgcccaccgggagccgacacctgacctagcacacactgacacaggggcctggacaagcccgccctctctggtcctcccaaaccccaaagcagctggagagactttggggacttttttatttttattttttgcctaacagcttttggtttgttcatagagaattcttcgcttcatttttgatggctggctctgaaagcaccatgtggagtggaggtggagggagcgaggaaccatgaatgaactcgcaggcagtgccgggcggccccctggctctctgcgttttgcctttaacactaactgtactgttttttctattcacgtgtgtctagctgcaggatgtaacatggaaaacagtaactaaagattaaattcaaaggactttcagaagttaaggttaagtttttacgtttaatctgctgtttacctaaacttgtatgtataatttttgggtgggtatggggaattgctttgctaaaaataagctcccagggtgtttcaaacttagagaagaccaagggacagtattttttatcaaaggaatactattttttcacactacgtcaacttggttgctctgataccccagagcctgattgggggcctcccggccctggctcacgccaagtccctggtgctgggtttgctctcccgctgttgccaggggctggaagctggaggggtctcttgggccatggacatccccacttccagcccatgtacactagtggcccacgaccaaggggtcttcatttccatgaaaaagggactccaagaggcagtggtggctgtggcccccaactttggtgctccagggtgggccagctgcttgtgggggcacctgggaggtcaaaggtctccaccacatcaacctattttgttttaccctttttctgtgcattgtttttttttttcctcctaaaaggaatatcacggttttttgaaacactcagtgggggacattttggtgaagatgcaatatttttatgtcatgtgatgctctttcctcacttgaccttggccgctttgtcctaacagtccacagtcctgccccgacccaccccatcccttttctctggcactccagtcccaggccttgggcctgaactactggaaaaggtctggcggctggggaggagtgccagcaatagttcataataaaaatctgttagctctcaaagctaattttttactaaagtttttatacagcctcaaattgttttattaaaaaaaagatttaaaatggtgatgcttacagcagtttgtacgagctcttaagtgttgattccatggaactgacggctttgcttgttttgattcttttccccctacttttcctaatggtttaaattctggaattacactggggttcttttgccttttttagcagaacatccgtccgtccatctgcatctctgtcccgtgactcaggggcgcccactctgcttcgattctcctcctgtggaagaaaccattttgagcatgacttttcttgatgtctgaagcgttattttgggtactttttagggaggaatgcctttcgcaataatgtatccattccctgattgagggtgggtgggtggacccaggctccctttgcacacagagcagctacttctaagccatatcgactgttttgcagaggatttgtgtgtgctgcctcaggaggggagggctggtaggagggggggagaggtctctgtcctactgctctccagagggcatttccccttgcgccttctcccacagggcccagcccctctcccctgccccagtccccagggggtactctggagtgagcagtgcccctgtgggggagcctgtaaatgcgggctcagtggaccactggtgactgggctcatgcctccaagtcagagtttccctggtgccccagagacaggagcacaagtgggatctgacctggtgagattatttctgatgacctcatcaaaaaataaacaattcccaatgttccaggtgagggctttgaaaggccttccaaacagctccgtcgcccctagcaactccaccattgggcactgccatgcagagacgtggctggcccagaatggcctgttgccatagcaactggaggcgatggggcagtgaacagaataacaacagcaacaatgcctttgcaggcagcctgctcccctgagcgctgggctggtgatggccgttggactctgtgagatggagagccaatctcacattcaagtgttcaccaaccactgatgtgtttttatttccttctatatgattttaagatgtgttttctgcattctgtaaagaaacatatcaaactaaataaaagcagtgtctttattacaacgccgttgcatctgggcatctgtttccctggcatctggagaggttcctggacatgaggggttgggggctcatgtgacggggaagaggagactcagccaggtccacttggggttggcccagtggcctccatgtaagccttaccatttctgtgctgggagggctgggtgtgcactccagaaactctgccaacatgtaatgcccccttcacccctcttctgcctgtgaatcagctaagacaagtctcctacatcctcagttcctcctctgtaaggggtgggggatagcagagaaaccagtgagactggctgggaaggaggatggtgggaaagtgtcacgggttttctgccccagagtgtgtcagcccctgtacctcctgggtagggttccttcaggccaggtctctgtgaagatggggacctagggatacctctggctgcagctctaccccacctcctgcctgcattatcttgtgggcttgggactggctagtctcccaggtagtctcaaggcaggtttgtgttggccttggggtgggaacaatggtttctggccaggctgctctgccttggttggcctgtaggttctgggggttggggggtgaccttcagtccctggcttgggatggacagtccagctgggtaggctgatcatgactcagtgcccaggaaggggcagatgggttgtcctaggacactgctcggagtgtgggcggcaggagatgcagcagctgtgtttcaaggggcaaaggggcagaatcgagtgattggtcacagaacaactggtgcctcttctgggctcaactctgccatccctggctccttaccatgacccctgctcctctgctcaaagacccacagaggctggtccgatattgcagataagagctgattcccagggtgggggggttgttgaaggtccaacaactacttggagttaggacctgaatgtgcaccatgctaagtgccaggaaaggctgtccccagcacacacttcactccctaggcctagcagcaggggcccaggaaatgaccccgtcgttattctcttgacctcaggaacttttgcttaacatctaacctgaagccactgggtaatgagtggactcactgttctgaattcaagtaagggaatacttggtcttggcagagaacattaaggccagaaggacctctggcctcagctctgccctgcctcttttgggggatggggtagtatccgctgtttagcccagcagacccttgacccctggcactcctgccagatccctgttccttgatttggatgaggactgctcaggtcttttaagctggggttagagggtcgtagacaggagagtaggaaagaaggaacatcagacctacaggaatctgccttcccacattcctctgacttggaatgactctggcctggcttggagacagtgctggtctctagaaaatgctagaggaatctgcattttctcttgtcataaaggcactgccttaggcctagatctttgagctagtcttgggataagggctgttagctggaaaatcttgtggtgtgtctaggccagcctggcctctagaatactaccaccagtttgggaccgggcgcggtggctcacgcctgtaatcccaagcactttgggaggccgaggcaggcggatcacgaggtccggagatgagaccatcctggccaacatggtgaaaccgtctctactaaaaaatataaaaaagttagctgagcgtggtggtgggcgcttgtagtcccagctactcgggaggctgaggcaagagaatggcatgaatcacggaggtggagcttgcagtgagctgagattgcaccactgcagtgcactccagcctgggcaacagagcgaaacgctgagactctgtctaaaaaaaaaaagaaaaaaagaaaagaataccaccagtcttgggggggctggaggctccacactacttacctcattgtagcccacagcctcgcctcccccttgttgcccacaggttgaacaagctcctaggagaggccctttcctagctcccctaaagcaaagaaggcccaattcaagcatcagtctttcaagagtgagcttcatttctctatttcttttcttttcttttttttttttagagactgagtcttgctctgtcgcccaggctggagtgcagtggcacaatctcagctcactgcaacctccgcctcctgggttctagcaattctcctgcctcagcctcctgagtagctgggactacaggtgcatgctgccacgcctggctaattttttgtattttagtagagtatggggtttcaccatgtgacccaggctggtctcaaactcctgagctcaggcagtccacccacctcagcctcccaaagtcctaggattataggcatgagccactgcactcggcctatttctttttttctttttttcttttttttttgaaagtcttgctctatggcccaggctagagtgcagtgttgtgattttggctcactgcaacctctgcctcccgggttaaggcgattctcatgtctcagcctcccaagtagctaggactacaggcacgtgctaccacacccagctaatttttgtattttttttagtagagatggggtttcgccatcttggctaggctggtttcgaactcctgacctcaagtaagtgatcctcccgccttggcctcccaaagcgctgggatttcctttttttttttttttttgagacggagtctcgctctgtcacccaggctggagtgcagtggtgccatcttggctcactgcaacctccgcctcccaggttcaagcgattcacctgcctcagcctcccaagtagctgggactacaggtgtgtgccaccacgcctggctcattttttgattattattattattattattattattattattattttgagatggagtcttgctctgtcacccagactggtgcagtggcccaatctcagctcactgcaagctccacctcctgggttcatgccattctcctgtctcagcctcccgagtagctgggactacaggtgcccgccaccacgcccggctaatttttttgtatttttagtagagacggggtttcaccgttttagccaggatggtctcgatctcctgaccttgtgatccgcctgccttggcctcccaaagtgctgggattacaggcgtgagccaccgcgcctggcctgggatttcaatatcttaaaaatccaaatccattggtgactctttccctgttttgctcaccttcctcacaactaccttgaggcaaagtcactgaggcccagagagggcaagggagttattggtctgggtcttgtggctagtgtgaggcgtgttcagttctaaatatgacccaaacactttaggttttattattattattattattattattattactactactactattattattttgagacagcgtcttgctctgtcggccaggctggagtgcagtggcaccatctcggctcactgcaacctccacttcccggattcaagcgatcctcctgcctcaacctctggagtagctgggattacaggcatccgccaccacggccggctaatttttgtatttttagtagagacaaggtttcaccatgttggccaggctggtgttgaactcctgacctcaggtgatccactcacctcggcctcccaaagtgctgggattacaggcgtgagctaccgtgcccggccaggtttaattctgatgatgaaattctgttcctgttgtagagcagcaaagaattatttgaagcacctatggagaaatgctgggtaccatttccctgtggggaccctagaagatctagaggaggttcggcaagaggttcaaagtgggggctnnnnnnnnnnnnnnnnnnnnnnnnnnnnnnnnnnnatggcagcatgaagaccgggttgctggggccctggttagccccactaccccctagttttggtggcgattatcctagagtctcagttcgggtcagacgaattgttctgtccatgtccctgtgaaggctccgtgtggcgagacgcagggccttgggcaggttcgggctggggatagggagagctcccaaccttggtagtggctccagatgccccccaggtgagcccagcagagtggactgccaggagcagctctgggccgaagagggagacagtgtccgcggcctcccaggaggtggcgccagaggattaagtcgccagcggtgggcggggctgaagagtcgggctgtgggcggggctaataacgccgccagctcccggaaagcgctagcctccggaggccggccgtgggtcgagctgaggccgctcgggagcggacgaaaatctccggcagcgcggggccgagcggggctgtgggcagggctaaggccgtggggccggcgggcgggcggggcgaagcccgcgagtagcccaaccgcggggagccagtccgagcgcggccgctagctggtggtgtaactagacttgtcttctctccaccactgccgcacagtccctgagggcatcggggcgagtgtagctgcaactggggagcctgtgattcgccagtgcccttctccctaggcaagggaagcgggcaggcaataagaggggcgagtctggggcccaggcttccgctaccgagaccccagtcagcaaacctttaattcagaggtggggaaccaataaggagccctcctgtgcgtactccctcgccttagcgtttgcctgcctccaggccccgtgccccgcggagccagcgcgggacctgcacacggtatagatagagctcagcgcttgcagggcctctctgtctctccttcctccagccagagagctcctgagggcaccgcctaaagggggtagcctgatagggtactgtgagatctgggagggtactggatggagatgaggtgcctccacttgtgtgattgggtccccctgcttggcactagaagcagacgtgggatgaggctgctggcgacttactctttccctgagtgggggtaccctgaaaccccaggaaacacctttcccaaagcagtcttcacagctctaggcatgcattggaacagcagggacatccagttgggagctggccagggccagggctgagggtgctgttgtcttctgtccgcatggtgtcgcatccttaggctatagagggcaaaaccaagtttggagcctgccaaaatggtccagagctcacgccagaccagctccctttctagggaattggagccagtagtctaggatcacttcccacttccgttgcaaaaggtcttgagagaggccgggcctagcggctcacgcctgtaatcccagcactttgggaggccaaggcgggtggatcacctgaggttaggagttcaagaccagcctggccaacatggtgaaaccccgtctctactaaaaatgcaaaaactagccaggtgtggtggtgcacacctgtagtcccagctactcgagaggctggggcagaagaaccgcttgaacccgggaggtggaggttgcagtgagccgagatctcgccactgcattctagcctgggcgaaactctgtcatacaaaaacaaaaacaaaaacaacaaaatcaacgttcagttgggacttactgacattataaaacctaaacagttaattttcttctgcaccgtggcctggccacagtacaaactggataatgtcagttactgagttactggccggaaagtggcactttcaagccccaacttcaatgcaatcgttttttttttttcttttttttttttttgaggcggagtctcgctctgtcatccaggctggagtgcagtggtacaatctcagctcactgcaacctctgccttccagggtcaagagattcttttgcctcagtctccctagtagctgggattacaggtgtgtaccaccacacccagctagttttttgtatttttagtagagatggggtttcgccatgttggccaggctggtctcaaactcctgacctcaggtgatctgcccgccttggcctcccaaagtgttgagattacaggcgtgagccacaatgcccagcccaaacaatctttttttttttttgagatggagtatcgctctgtcaccaggctggagtgcactccacaatctcggctcactgcaacctctgcctcccaggttcaagcgattctcctgcctcagcctcccgagtagctggggctacaggcacgtgccaccacgcccagctaatttttgtatttttagtagagaaggggattcaccgtgttggccaggatggtcttgatctcttgacttcatgatctgcccacttcggcctcccaaagtgctgggattacaggcatgagccaccgcgctcggcccagcccgagcaatcttaacaatttcttacaacaaaatggcaactggtccgaggtcccttatatccaaggatttcatgtatttacactcaaaactttccctctatcagtcttgctcccctcatcaagttttattgctaaacgaaaactcccagtccccttttcacccctccccttcagcccctgaaaggaatttcaaccctgctgaggaatgtccaccatatctccagccccaggctccccaagagccgccagcaccattgccatctctctcattcccctatccacctgtcactcattcaaaaaacaatcagggctgggtgcggtggctcatgcctataatccctgcactttgggaggccaaggcgggcagatcacctgaggtcaggagttcaagaccagcctgaccaacatggagaaaccccgtctctactaaaaatacaaaattagctgggcgtggtggcacatgcctgtaatccaagcaacttgggaggttgaggcaggagaatctcttgaacccaggaggcggaggttgcggtgagccgagattgcaccattgcactccagcctgagcaacaagagtgaaactccatctcaaaaaaaaaaaaaaaaaaaaaaaaatcagaccccggccacccttcccctttgcaaagtagctggggcagaaggcatagtcagggttcatgttcccttttcaatctcagacatgtcggaggttgagaggctccttggctccttttccactggcccatcccacttccagaaggaatttctttatattactcagtcacataaccttacttggcatgacatttatgttatcctgtcagccactctcaccctagatgagaaagagcatatttggctagctgctcaagcccatgccgacacacttcatcagcaggatacagtccataatcctgttgtggccattgctgttcccctagccgaccccgaatggacttaacaacagggggaccctggcacccaatgccgtaaccatatggtcacttgtctcgtggctggcatggaaaaatgtgcccatgccgataaggtagtaaattatgaaaaaattagagaaataacccaaggcccaaatgaaaatccagctcttttcctatcaaggttattagagactatgctcaaatacacaaaactagaccctgaatcacaagagggtcaaacctatcttcacttacattgcatttcacaatcagcaccagatatcaggaaacagctgcaaaaactagaggagggaccccaaaccccacaaagggaccttttaaatctgtccttcaaggtcttcaacaacagggaggaagaacataaagtgccaaaggagaaacaggctaagattaaataccagatgctggccattgccctccagagaggttccaaggagaaatcaccttctcagggccccggcacctgtttttgacgtggcaatccgggacactgggcaaaggcttgcccaaacccatggcctccaacaaagccttgccctatatgtggcaaatggggacactggaaaatggactgctctcaacaagaatgcccttcccattcaacagcatcctccagtcagtccccaaacccaccacagggacacctctcctctttgttgacactagcagctgaagactgacggtgcccgggattgcttgtacccatgccatgtgagtctccagaacccggggtaattgggatggcatctggtaagccagtctccttcttattggatactggggcaagtttctcagttcttccagagtattatggacccctaaattgttcctctatttctgttgttggggttgatggccaccctaccgctcactctcaaacacctccattatactgcaccttattcaatactgcctttactcactcatttgtagtaattccacagtgtcctacactccttattagaagagatataatcaacaaatttggggccacattacaattgaatgccttaccgtaggtgcctgcatacttgctcctttgccagccagaaaacaatgaagcccaaacccagtcctcaacaatttcaatccaaggagttaacccaatggtatgggacacttctcagcccactgttgccatataccaccagctgtttctaataaaacttaaggacccttcccaaattgtttcacaaccccaatatcccctcagtcaggctggacttaagggaataaaacccatcatcaccagattactaaaagctggcattttaacaaccaccaattccccccactgcagcaaaattaaagggcatagctccctggatacatttctcaaaacttaaaagggctcctcctcttaatcccaacctgtctcaattttcttgttttcttacaggacccaccaaactcaagatcacttgactccccacaattctttaaccaccaactctttcagtaattttatttgctgccttgtagaagacctttcctggtatccaggctccccccaccccccataatttatttctcctccttttatgagatatggctgcaggaaacttttgcagactgcactccatctcaaatgtcctttttttcttttgttctttgtctccttctagtaccactcttccccttacttaaaccataccttgcagctgtcttacaacttactaaaacaggccaacttaggctccacagaactctgttgggtctgcatgccccctttgttcccaatataccattatctccctggacctttagaagcctggaccaattccttggcaaccctcaccattactaaaactaccttaggatctgcattctgggaaccaagtactgatcctgccacagccatagccaaaaaggtgcatcaggccgttctcaaacaactaaaaactttatcccctatccaaagcctcatggttacaggacctataggaaccaccactccactcactactcaggcccctatatgtttcacctgctccttaaacagagttccagaagggtctttaaaatgctcggactgtaacctgcctctttctctctctcacacaacagattgtagttattcctctacaacaggagcaagtgacccattctcatcagtgacccaactcatcagccaaagccacgccctcttaccccttaagattttctctccctatatgtagtaatgcttatgaatgtaaccaagagtcagattttttttgtttttgacacggagtcttgctctgctgcccagacttgagtgcagtggtgagatctcggctcactgcaacctccgcctcccaggttcaagcaattctcctgcctcagactcccaagtaactgggatttcaggcacccactaccactcctggctaatttttgtatttttagtagagatggggtttcaccatgttggctaggctggttttgaactcctgacctcaagtgattcacccacctcggtctcccaaagtgctgggattacaggcgtgagccactgcacccagcctcaagggtcagatttttgcagtgggtgagggccagctaatacattgcctttattcaatatctatggtagacatgaaaaatccaaatgccaacttcttcccctcccgggtccaacccaattctttcttgattcatctgaacacagactattctcagaaatacctttggtaactcattacccccttctcca
